United States Patent 11,981,905 (POLYNUCLEOTIDE SEQUENCES AND PROTEINS ENCODED THEREBY USEFUL FOR MODIFYING PLANT CHARACTERISTICS) - sequence listing, part 2

SEQ ID NO: 2764 - protein, 608 aa, Panicum virgatum
  misc_feature: Ceres CLONE 1786284
  misc_feature (1)..(283): Pfam Name: CTP_synth_N Pfam Description: CTP synthase N-terminus
  misc_feature (1)..(238): Pfam Name: GATase Pfam Description: Glutamine amidotransferase class-I
  misc_feature (1)..(561): SWISSPROT Homolog: EC 6.3.4.2 CTP synthase 1
  misc_feature (1)..(561): SWISSPROT Homolog: EC 6.3.4.2 CTP synthase 2
MKYVLVTGGVVSGLGKGVTASSIGVVLKACGLRITSIKIDPYLNTDAGTMSPFEHGEVFVLDDGGEVDLDLGNYERFLDIKLTRDNNITTGKIYQSVIDKERKGEYLGKTVQVVPHITNAIQEWIERVAMIPVDGKEGPADVCVIELGGTIGDIESMPFIEALGQFSYRVGPGNICLVHVSLVPVLNVVGEQKTKPTQHSVRGLRGLGLTPNILACRSTKELEDNVKEKLSQFCHVPAANIVTLYDVSNIWCIPLLLRDQKAHEAILKVLNLDRVESIAREPKLDEWVARATIFDALQDTVRIAMVGKYTGLSDSYLSVLKALLHASVDCRRKLVVDWVASTDLEDSTAIEAPDAYKAAWDLLKGADGILVPGGFGDRGVQGKILAAKYAREKNVPYLGICLGMQIAVVEFARHVMNLTDANSTEFDPDTKTPCVIFMPEGSKTHMGATMRLGSRRTFFKVADCKSAKLYGNVTYVDERHRHRYEVNPDMVPEFENAGLQFVGKDDTGRRMEIIEIPNHRYFVGAQFHPEFKSRPSKPSPLFVGLVAAASGQLDRVLQDCCNGHVVPAKHILSNGSYPSIVHQNGHPKKLANGLSNGTYYANGNGVHA

SEQ ID NO: 2765 - DNA, 2252 bp, Panicum virgatum
  misc_feature: Ceres CLONE 1786299
  misc_feature: Encodes the peptide sequence at SEQ ID NO. 2766
attcgcagccatggtgtgcctcatccctgactcctgaggccattggtgagaaagagtcgcctcgggaggacgcacctggacacgcctctgagagctccgacctccgacctccgacctccgagtccgagtccgagagatccccagctcaactctgacccgccatatcggacgaatccgttccaaccccctcaatccccccatttccaagaaggctcccctcttcgatctccctactaaagccccccgccatgtcctcctcctgcgtctcccaccaccaccaggccgtccgcccccgccacggcggccgcctcccgcgcccagcggccgcgtcctcgttcgcgccgccggcgctgcccctccgccgccgggcgacgcgcgccgccgcgacgagcgccgaggctgccccgggcgtcgctccggcggaggaggcggggcggctgcggggggcggcggtgctggccgagatggcggaggaggccgccgtctggtgcgccgtgcacgggctcgtcgtcggggaccgcgccgacccgagatcaggaactgtacctggtgtcggcctggttcatgccccattctcgctgcttccagcgcgtttcccggcatccttttggaagcaagcgtgcgagctggctcctatcttcaatgagctcgtcgatcgtgtgagcttggatggagaattcttgcaagctgcattgtctagaacgaagcaggtagatgaattcaccgctaggctgctaggaattcatgagaagatgatggcaataaataagaaagaggatatccgcttaggattgcaccgatctgactatatgctggattctgaaaccaattcactgcttcaaatagagctcaacactatttcatcatcctttcctggccttggttcccttgtcagtgaacttcacaggaccttactaaatcactatggaaaagttttaggcctagattataaaaggataccacggaattgggccgctactcaatttgctgaagcattgggcaaagcatgggctgagtataacaatgatagtgctgttgttttgatggttgttcaacctgaagaaagaaatatgtatgaccaatactggcttgtcaatcatttgaaggaatcatatggtgtgacgactataaggaaaacattggctcaagttgaagctgaagggcaggtgcttacggatggaacacttgcgatagatggtcgtaccgttgctgttgtatatttcagagctgggtatgcaccaactgattacccttcagaagcggagtggagagcgagacttttgatggaacagtcatctgctataaagtgtccttcaatatcataccatttagtaggaatgaaaaagatccagcaggaattagcaaaacctaatgtccttgaaaggttccttgacaacaaggacattgccaaactacgtaaaagtttcgcaggattgtggagcttggataatgaagagattgtgaaatcagcaatagagaaacctgacctttttgtcttgaagcctcagcgagaaggcggagggaacaacatatatggtcatgatttgcgagacatgctgatcaagctccaaaaggaacaaggggagtcacttgcagcatacatactgatgcagaggatttttccgaaagcttctcttactcccctagttaggggcggtgattgcttcgaggaccttacaatctctgagctagggatatatggagcctacctgcggaacaaagataaggtgatcttaaataatcagagcggttacttaatgcgcaccaaagtttcttcatcaaatgaaggtggtgttgctgcaggatatgctgttttagacagtattctcctcactgatgagtgagacaggaaaggctgagttacaagtgacaactgacctgaaccagtgacagtacccacagtcaaaagatcgcagtgtcattgggcacaaattgatcttggctgcaattggagaaaaactgtgaatatagcgtacataataccagacagcagatgctacaccttggatggagaagatggtattggtatttgcttgaagaaaccctagacgagaaaacggaacgggatcatgaagaagcttatgttgtcatagtttcatgaatttgtatagcaccatatagagccgcatccgagcctgatgtttcatttgagtggttccattctgtattttggcgacctttattcctgaccatgaggataattgtattgagtaagaattgaataaagctttttttaagagaaaaaaaaaaaa

SEQ ID NO: 2766 - protein, 531 aa, Panicum virgatum
  misc_feature: Ceres CLONE 1786299
  misc_feature (10)..(470): Pfam Name: GSH_synth_ATP Pfam Description: Eukaryotic glutathione synthase, ATP binding domain
  misc_feature (22)..(528): SWISSPROT Homolog: EC 6.3.2.3 Glutathione synthetase, chloroplast precursor
  misc_feature (72)..(528): SWISSPROT Homolog: EC 6.3.2.3 Glutathione synthetase, chloroplast precursor
MSSSCVSHHHQAVRPRHGGRLPRPAAASSFAPPALPLRRRATRAAATSAEAAPGVAPAEEAGRLRGAAVLAEMAEEAAVWCAVHGLVVGDRADPRSGTVPGVGLVHAPFSLLPARFPASFWKQACELAPIFNELVDRVSLDGEFLQAALSRTKQVDEFTARLLGIHEKMMAINKKEDIRLGLHRSDYMLDSETNSLLQIELNTISSSFPGLGSLVSELHRTLLNHYGKVLGLDYKRIPRNWAATQFAEALGKAWAEYNNDSAVVLMVVQPEERNMYDQYWLVNHLKESYGVTTIRKTLAQVEAEGQVLTDGTLAIDGRTVAVVYFRAGYAPTDYPSEAEWRARLLMEQSSAIKCPSISYHLVGMKKIQQELAKPNVLERFLDNKDIAKLRKSFAGLWSLDNEEIVKSAIEKPDLFVLKPQREGGGNNIYGHDLRDMLIKLQKEQGESLAAYILMQRIFPKASLTPLVRGGDCFEDLTISELGIYGAYLRNKDKVILNNQSGYLMRTKVSSSNEGGVAAGYAVLDSILLTDE

SEQ ID NO: 2767 - DNA, 1891 bp, Panicum virgatum
  misc_feature: Ceres CLONE 1786317
  misc_feature: Encodes the peptide sequence at SEQ ID NO. 2768
cttccccgtttcggctcccaaaatccccctcctccgtcgccgcctcccgtccggtcgtctccccgcctcgttggacgttgggtggctcgccggcgcctgcattggggataatctcgccgcctctgtccgagtgcaggatctttgcgtttaatgggctggacgcagtacatgcatgtttgcagtgacaagaagacattgaaacgctggtttttcatagacaagagggttggttaagtgctcagttctgtggaaaattctgcattctggtgcactgactttgtgtagcttctaactgctcttacaacaagacttgaagggggagggagagtcgtgtcttgttgatggatttgaagacaggcctcaactcacctgttattgcagatcatctccctacattagccttgcctgctcctgtcatgactttcacaacacctactagcttcccctctccggggctttgcttgaatactacaaagaagacacctctgcctggtaagatcgaagaagttcgtgccactggatggctcgaccttatgatggctgcatcacctacccgcagaaggcagatcaaggatgtcgtcaatgacactcaagctgatgatctcgatttgcaatatcataactggatggttgactatccatctgctttgacctcatttgaggcaattactgatcttgctgggagtaaaagattggtattgtttcttgactacgatggaacgctttcaccaattgtggacaatcctgaaaatgcattaatgtctgatgagatgcgagctgctgtgaagcatgtggcatcacttttcccaactgcaatcatcagtggaaggtctcgggataaggtttttgactttgtcaagcttaatgaactacactatgctggaagtcacggaatggacataatgggccctattaggaagactgctgactccaatggcgtggaatgcattcactccactgatttgaagggtaaggaggtcaaccttttccaacctgcaagtgagtttttacccatgatcagtgaggtgtataaaaagcttggtgagagtgtcaaggacattaatggtgccaggatggaagacaacaagttctgtgtctctgtgcattaccgtaatgtggcagaagatgactataaaaaggttttccagcgtgtaactgctgttttggaagattacccttgcctaaggctaacccatggaaggaaggtttttgaggtccgtcctgtgattgattggaacaaaggtaaagctgtggagtttttactcgaatctcttgggctcaatgagagtgaagatgttctccctatctatgttggagatgacagaactgatgaagatgcattcaaggttctgaaggcaagcaaccgtggctttggaatactggtgtcatctatacccaaggagagcgatgccttctactctttgagggatccagctgaggtgatggaattcctgagaaagctggcacaatggaaggagcaatccatctgagagttgaaaaacattggtttggttggtctggtccaagagtataaatagttacaatgctaaccaaataagtcggctatttggaggagtcaggccaaaatgtttttgatttggcattttataagaggctattgcatttttctgtcccactttgttctcgtgtcagggtttctcaagcaaattcaattctttcattatttaggttcctttagtatatacggagatatttttaaaagaattttggttcctactagtgtttcgctgcctcgcagttttactgtaggtaattatctattccatgttgtattcgtgaagatgtaaagaactggttctttgtttaaacagcggttagctgtcaatgtgctataaatgtcgaagttgcgagcaaaaaaaaaaaaaaaaaa

SEQ ID NO: 2768 - protein, 382 aa, Panicum virgatum
  misc_feature: Ceres CLONE 1786317
  misc_feature (1)..(246): Pfam Name: Trehalose_PPase Pfam Description: Trehalose-phosphatase
MDLKTGLNSPVIADHLPTLALPAPVMTFTTPTSFPSPGLCLNTTKKTPLPGKIEEVRATGWLDLMMAASPTRRRQIKDVVNDTQADDLDLQYHNWMVDYPSALTSFEAITDLAGSKRLVLFLDYDGTLSPIVDNPENALMSDEMRAAVKHVASLFPTAIISGRSRDKVFDFVKLNELHYAGSHGMDIMGPIRKTADSNGVECIHSTDLKGKEVNLFQPASEFLPMISEVYKKLGESVKDINGARMEDNKFCVSVHYRNVAEDDYKKVFQRVTAVLEDYPCLRLTHGRKVFEVRPVIDWNKGKAVEFLLESLGLNESEDVLPIYVGDDRTDEDAFKVLKASNRGFGILVSSIPKESDAFYSLRDPAEVMEFLRKLAQWKEQSI

SEQ ID NO: 2769 - DNA, 1921 bp, Panicum virgatum
  misc_feature: Ceres CLONE 1786326
  misc_feature: Encodes the peptide sequence at SEQ ID NO. 2770
gtctatacaagctcccttcccgatcgattctcatcgatcttgcatctctcttcgccgcaaatttaaagctttctttgtttggacttgtggaagcaataaatcttgaagcttccttagcctgattgcattggtctctcctgctccagtcgattggttgctgggagttcagagctgttgagatcttcgcaggctccgatcagcgcgccgggatggcgaatctagccgcggtgcgcccgtggctctgcttgctggcggcaatggcggcggcgtcgtggtccggcgtcgcgacggtggacgcgctggggatgaactggggcacgcaggcgacgcaccccctgtcgcccaaggtcgtggtgcagatgctcaaggacaacggcatcaagaaggtgaagctgttcgacgccgaccagagcacgctcagcgcgctcgccggcagcggcatcgaggtcatggtcgccattcccaatgtcctgcttgacaggatcaccgactacgacaccgccaaggagtgggtacggcacaacgtctcgcgctacaacttcgacggcggcgtcaccatcaagtacgtggccgtgggcaacgagccgttcctggcggcgtacaacggcacgttcgacaaggtgaccttcccggcgctgcagaacatccagaacgcgctggacgaggccgggctgggcgacaccatcaaggccaccgtccctctcaacgccgacgtgtacatgtccccggcggacaacccggtgccgtcggcggggcggtggcggcccgacatcgcggacctgatgacgcagatggtgcagttcctgagcaaccacagcgcgcccttcaccgtgaacatctacccgttcatcagcctgttcctcaacgacaacttccccgtggacttcgccttcttcgacggcggcgcgacgcccgtggtggacaacggcgtgtcctacaccaacgtgttcgacgccaacttcgacaccctggtggcggcgctcaaggcgtccgggcacggcgacatgcccatcgtcgtcggcgaggtcggctggcccaccgacggcgacaagcacgccaccaacgcgtacgcgcagcgcttctacagcggcctcctcaagcggctcgccgccaacaccggcacccccgtccggcccaaccagtacatcgaggtctacctcttcggcctcctcgacgaggacgtcaagagcgtggcgcccggcaacttcgagcgccactggggcgtcctccggtacgacgggcagcccaaattcccgatggacctgacggggcagggccagaacacgatgctggtgccggcgcgcggcgtggagtacctgtcccggacgtggtgcgtcgtcaacaccgagtcgcccaacatggacaagctcgccgacaacatcaacttcgcctgcaccttcgccgactgcacggcgctgggctacggctcgacgtgcggcggcatggacagcaacggcaacgcgtcctacgccttcaacgccttcttccagatgaaggaccaggacgaccagtcctgcgacttccagggcctcgccaggcccacgcagacggacccgtccacgcccgcctgcaacttcaccatacagatcgccaccacctcggcggcgggccaccggcggccgcgccgcgtggccgccgccgccgccgtgctgttcttggcgcagctgatgatcctgctgcattagagactgtgtgtgcacttagtgcgtactacttagatatgcaggttattgttcatctttggttggtttggggcatttttcgcagggcactcttggagattatagtttgttcgttcgtcggggttattcttggtgaaataattggtactaggaactagtagaaagtgttgtgctggagatatacatgtatacttcaggttcgggatattatatactgatgtgagatgctggactgtatc

SEQ ID NO: 2770 - protein, 491 aa, Panicum virgatum
  misc_feature: Ceres CLONE 1786326
  misc_feature: Great-hit functional homolog of the protein sequence encoded by LOCUS At2g19440
  misc_feature (1)..(322): Pfam Name: Glyco_hydro_17 Pfam Description: Glycosyl hydrolases family 17
  misc_feature: Useful for making plants with altered cell wall content and/or composition
MANLAAVRPWLCLLAAMAAASWSGVATVDALGMNWGTQATHPLSPKVVVQMLKDNGIKKVKLFDADQSTLSALAGSGIEVMVAIPNVLLDRITDYDTAKEWVRHNVSRYNFDGGVTIKYVAVGNEPFLAAYNGTFDKVTFPALQNIQNALDEAGLGDTIKATVPLNADVYMSPADNPVPSAGRWRPDIADLMTQMVQFLSNHSAPFTVNIYPFISLFLNDNFPVDFAFFDGGATPVVDNGVSYTNVFDANFDTLVAALKASGHGDMPIVVGEVGWPTDGDKHATNAYAQRFYSGLLKRLAANTGTPVRPNQYIEVYLFGLLDEDVKSVAPGNFERHWGVLRYDGQPKFPMDLTGQGQNTMLVPARGVEYLSRTWCVVNTESPNMDKLADNINFACTFADCTALGYGSTCGGMDSNGNASYAFNAFFQMKDQDDQSCDFQGLARPTQTDPSTPACNFTIQIATTSAAGHRRPRRVAAAAAVLFLAQLMILLH

SEQ ID NO: 2771 - DNA, 1944 bp, Panicum virgatum
  misc_feature: Ceres CLONE 1786333
  misc_feature: Encodes the peptide sequence at SEQ ID NO. 2772
aaagcgaaccgagtccacaccaccaccagtaaaccgcaccaatcatcaatcaggcagtggagccacagcgagcggcggcagcgcccgcgccggagcccgagccccgatggatctcccgccgctctcccaccaggcgctcttcgcggcggtccgatccgccgacgcggccgccgtccgcgcgctcctggccgacgccgaggcctcgggcacctccctggccgcgctcgccgccgcgcagacggacgccggggagaccgcgctgtacgtggccgccgaggccgggagcgaggagcttgtccgcatcctcctcccgctctacgacctcaaggacgcctccgtccgctcccgcctcgacctcgacgccttccacgtcgccgccaagcaggggcacacgggggttgtgaaagagttcttggggcggtggccaaagctttgttctgtctgcgactcttccaataccagccccctttactccgctgctgtcaaggaccacctggatgttgtaaatgctatactggacactgatgatagctgcataaggattgttcggaaaaacgggaagacgtcactgcatactgctgcaagaattggataccatcgtattgtcaaggcacttatagagagggatccaggtatcgttccaataagggataggaagggacaaactgcacttcacatggctgtgaaaggtaaaaatacagatatagtggaagagttactcatggctgatgtttccatcctcaatgtgcgtgacaagaagggaaatacagctttgcatatagctacacgaaaatggaggcctcagatggtacaacttctgcttagtagctacgagtcacttgaagtcaatgctatcaatagtcaaaatgaaacagctatggatttggctgacaaagttccatatggtgagtctaaaacagaaataatagagtggctgacagaggctggtgcaaagaatgccagaaatgtgggaaaaattgatgaggcatcagaactaaggagaactgtgagtgatatcaagcacaatgttcaggcgcagcttagcgagaacgctaagaccaacaaacgagtgacagggattcgcaaagaattgcagaaactacaccgagaagctattcagaacaccatcaactcagttaccatggtagcaaccctgattgcctccattgcattcgttgcaatattcaatctgccaggtcaatacttccaggatgtgaataatgggggagacattggtgaggcgcatatagccaaactcaatggtttccgtgtcttctgtcttctgaatgccaccgctcttttcatttcccttgcggtagttgtcgtgcagatcaccttggtcgcctgggaaactggtgcccagaagcaagtcatcaagattgtaaataagctcatgtgggccgcatgccttagcacatgcgcggctttcatctcactcgcctatgttgtagttggcccgcaacatgcctggatggccttcactgcatcagccattggagggccaatcatgatcggaaccctcctgttcctagcctatctgctgttgcgcccacgattcaagtttggcaaagacagacagcggcgcatcaagagggctagcggcagcaaatccttctcctggtcactccatgatggtttttcagatctggaagccttctctgatcatgagaagaaaatctatgccctgtagggaggattaacagtaactactcttgttgtagctgcgtgtaacattaagaggaggcaattgtgagaatacagattctccatgtatatatttgctgtagcctttttaggtctgtggtcaggcaccacagttagacctttcttccgagagacatggcctgcctactcggggacttcttgctgatgtacagtacctgataatgtactgagcatgcctgagaatctgagatgaattccgaaaaaaaaaaaaaaaaaaaa

SEQ ID NO: 2772 - protein, 527 aa, Panicum virgatum
  misc_feature: Ceres CLONE 1786333
  misc_feature: The sequence is a functional homolog of  SEQ ID NO 340 in the  10/666,642 US patent application
  misc_feature: Useful for making plants with modulated growth and phenotype characteristics
MDLPPLSHQALFAAVRSADAAAVRALLADAEASGTSLAALAAAQTDAGETALYVAAEAGSEELVRILLPLYDLKDASVRSRLDLDAFHVAAKQGHTGVVKEFLGRWPKLCSVCDSSNTSPLYSAAVKDHLDVVNAILDTDDSCIRIVRKNGKTSLHTAARIGYHRIVKALIERDPGIVPIRDRKGQTALHMAVKGKNTDIVEELLMADVSILNVRDKKGNTALHIATRKWRPQMVQLLLSSYESLEVNAINSQNETAMDLADKVPYGESKTEIIEWLTEAGAKNARNVGKIDEASELRRTVSDIKHNVQAQLSENAKTNKRVTGIRKELQKLHREAIQNTINSVTMVATLIASIAFVAIFNLPGQYFQDVNNGGDIGEAHIAKLNGFRVFCLLNATALFISLAVVVVQITLVAWETGAQKQVIKIVNKLMWAACLSTCAAFISLAYVVVGPQHAWMAFTASAIGGPIMIGTLLFLAYLLLRPRFKFGKDRQRRIKRASGSKSFSWSLHDGFSDLEAFSDHEKKIYAL

SEQ ID NO: 2773 - DNA, 1558 bp, Panicum virgatum
  misc_feature: Ceres CLONE 1786334
  misc_feature: Encodes the peptide sequence at SEQ ID NO. 2774
ccaagcaagtctgctccctcgcagagtcgcagtgcacgcacacggcagcaggacagccgaagcaagagcagagccggtgagggggtcggagcagcaagcgccatggcggcgtccaacggcggcgatgcccccgggcggttcgacgtgatcgtggtgggcgcgggcatcatgggcagctgcgcggcgtacgcggcgtcctcccgcggcgcgcgcgcgctgcttctggagcggttcgacctgctccaccaccggggctcctcgcacggcgagtcccgcaccatccgcgccacctacccgcaggcgcactacccgcccatggtgcgcctgtcgcggcgcctctgggaggaggcccaggccgacgccgggttccgcgtgctcacgcccacgccgcacctcgacctgggcccgcgggacgaccccgagctccgcgctgccatcaggaacggcggcggcgccgtggtcgccggcggcggcgcggagtcggcgtcatcctggccgtgggcgggcgtgttcagggtgcctgacgggtgggcggcggcgagcagcgagctcggcggggtgatgaaggcgaccaaggcggtggccatgttccaggcgctcgccgtcaagaaaggcgccgtcgtgagggaccggatggaggtggttgacatcgccaggcgaggagaaggatcaatcttggtcaggacagcgagcggcgaggaattccatggcgccaagtgcattgtaacggtcggcgcctggacaagcaagctggttaagtcggtcgtcggcatggacctgccggtgcagccggtgcacacgctcatctgctactggaaggtgaagcccggccacgagagcgagctcaccgcggaggccggcttcccgacgttcgccagctacggcgacccctacatctacagcacgccgtcgatggagttccccggcctcatcaagatcgccaagcacggcggcccgccgtgcgacccggacagcagggactggtccacgggcgccgccggcctggcggagcccgtggcccggtggatcgacgccgtcatgccgggccacgtcgacaccgccggcgggccggtcatccggcagtcgtgcatgtactccatgacgcccgacgaggactacgtgatcgacttcctgggcggggagtttgggaaggacgtcgtcgtcggcgcggggttctccggccacgggttcaagatggggccggctgttgggaggatcctggccgagatggccatggacggggagtcaaaatcggcggtggaggccggcgtggatttcgaacccctcaggatcggcaggttcgtggacaatcccaagggaaacctcaatactcgtggagatcagggccaaaaatgaacaccttcttcgtctacttgagatcacatatttattcaaccattcgtgatcaagtcaaagtgtgcgcatgtcaattgctttgtttggaataatctgttgaacattgcattgtgaaactttcctttgttctgttggagtgtcaggaaattgaaatgcatgcatctgtaccaaaattaaaagttaaaaaaaaaaaaaaaaaaaa

SEQ ID NO: 2774 - protein, 417 aa, Panicum virgatum
  misc_feature: Ceres CLONE 1786334
  misc_feature (1)..(369): Pfam Name: DAO Pfam Description: FAD dependent oxidoreductase
MAASNGGDAPGRFDVIVVGAGIMGSCAAYAASSRGARALLLERFDLLHHRGSSHGESRTIRATYPQAHYPPMVRLSRRLWEEAQADAGFRVLTPTPHLDLGPRDDPELRAAIRNGGGAVVAGGGAESASSWPWAGVFRVPDGWAAASSELGGVMKATKAVAMFQALAVKKGAVVRDRMEVVDIARRGEGSILVRTASGEEFHGAKCIVTVGAWTSKLVKSVVGMDLPVQPVHTLICYWKVKPGHESELTAEAGFPTFASYGDPYIYSTPSMEFPGLIKIAKHGGPPCDPDSRDWSTGAAGLAEPVARWIDAVMPGHVDTAGGPVIRQSCMYSMTPDEDYVIDFLGGEFGKDVVVGAGFSGHGFKMGPAVGRILAEMAMDGESKSAVEAGVDFEPLRIGRFVDNPKGNLNTRGDQGQK

SEQ ID NO: 2775 - DNA, 2170 bp, Panicum virgatum
  misc_feature: Ceres CLONE 1786346
  misc_feature: Encodes the peptide sequence at SEQ ID NO. 2776
atgattctcctccgcttatcctcttcctcctcttccccaactgggcaactcccacgaaattccccgcaaaaccccacagccggagcgcgcagtcgccggtcgccaccacaaatggcaccacccgccatggcgttccaagcgctcaccctcacgccactccccctctcgctccccaactctcgccgccgcgtccgggtccgcgtcctggccgtcgcggccgaccagacccctccgccgccgccggtcccctcatcggagccggcgaacagcccgaggcgcctcctccgggagctcgcgcagaggaagaaggccgtatcccctaagaagaagcacccgccgcgccgctttatcctcaagccgccgctcgacgacgagcgcctcacccggcggttcctcagcagcccgcagctgtcgctcaaggcgctcccgctgctctcgtcctgcctcccctccgccccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgctctacctcgcattccagcatctggacccctcctgcgagcgcacgcgcccgcggcacgtccggaacggccactccaggctctggttcctgggtcagtacgttctggagctcgctttctgcgagtttttcttgcaaaggtaccccagggagtcacccgggccgatgagggagcgggtgttcgctctgattgggaagaaggtgttgcccaaatggctcaaggcggccagcctgcacaatttggtgttcccttatgatgatttggataagatgatacgcaaggaccgggagccaccatccaaggctgtattctgggcattatttggggctatatatttgtgctttgggatgcccgaagtctatcgagtccttttcgaggcatttgggatggaccctgacgatgagagctgtcagccaaaattgaggcgccaactagaagatgttgattatgtttcggtggagtttgaaaagagacaactcacatggcaggacgttgctgcctacaggccaccaccagatgctcttttcgctcatccaaggcttttccgagcttgtgtgccaccaggcatgcatcgattcagaggaaacatttgggattttgacagtagacccaaggtcatggacaccctaggatatcccttgcccatgaatgacagaattcccgaaatcacagaagctaggaatatagagctcggacttggtcttcagctctgctttttgcacccgtcaaaacataagtttgagcatccaagattctgttttgagcgactcgaatatgtcggccagaagattcaggatcttgtgctggctgagaggctgctcatgaagcatctagatgcaccgggcaggtggctggcggagaagcataggaggatgttgatgaacaagtattgcggacgatacttgcgggacaagcacttgcaccactatgttatctatggggagtcagtgcaagacagattcgaacacaaccgacgtctcaggaatccttcgaccacttctgtccagcaagcgttacatgggcttgcatactgtgtgtatggcaaacctgacgtgcggcgcttgatgtttgaggtgttcgacttcgaacaggttcatccgaaagctgtatgaggatgttctccatgggtaatcgatgccaaatcgcttgccaagagactgccagtggcagtgctaaaaatactgcagcatcttgaagtgaaataataggagatcattctattctgaagcctgaaacctgagctgggagtctgggacagcagatgagccagtggggatctggaatcctgaattcggcactttccaatcaactgttcctccgcaatggtggaatagagatgttgcaacttgcaaatcggcaactgcagcatttagagttacagcttttacagttgtttgtaaattactatttgagcaggaatgcaaataggagcagcaccagcgatatgacggatttcctgtcagaaaagtttaatttgtaactgagagcagagtgatggattatacacatacagtttcatcggccatgtagggcgtgtatttatgcagataattcagttgcgaaaaaaaaaaaaaaaaaaaa

SEQ ID NO: 2776 - protein, 529 aa, Panicum virgatum
  misc_feature: Ceres CLONE 1786346
  misc_feature (1)..(94): Pfam Name: Ribonuclease_3 Pfam Description: RNase3 domain
MAPPAMAFQALTLTPLPLSLPNSRRRVRVRVLAVAADQTPPPPPVPSSEPANSPRRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLLYLAFQHLDPSCERTRPRHVRNGHSRLWFLGQYVLELAFCEFFLQRYPRESPGPMRERVFALIGKKVLPKWLKAASLHNLVFPYDDLDKMIRKDREPPSKAVFWALFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMDTLGYPLPMNDRIPEITEARNIELGLGLQLCFLHPSKHKFEHPRFCFERLEYVGQKIQDLVLAERLLMKHLDAPGRWLAEKHRRMLMNKYCGRYLRDKHLHHYVIYGESVQDRFEHNRRLRNPSTTSVQQALHGLAYCVYGKPDVRRLMFEVFDFEQVHPKAV

SEQ ID NO: 2777 - DNA, 2716 bp, Panicum virgatum
  misc_feature: Ceres CLONE 1786359
  misc_feature: Encodes the peptide sequence at SEQ ID NO. 2778
acaaggtacaccaacccaaagatgcggccacagccagatcaagtcgttccatgacgacggccttggctcgctccatgattagtactccggcagtaatgcttgataattaaggaaaaaataaattaaaaatccaaatgagccggataaggcgacagtgctgttcatcgggcccacatgaccgcagccgcgcgcagccaaccgccgccgaaccaagcccgctccggcaagcaactcgccgcggcgcgtccccctgacgtccgccgtctccggcatcggatgggcgtctagaccgcggagggctccaccacactccttgcgtggcttccgtagtccggaggcacacttcccttcaaagccactgcttcgtcttcctctacttaagcgcacgccccccgggccctgccctgtactcgcgtccgggaccgggagctcgcctcttcttcctgaggaggtgttggatggtgaatgcatgacactctcattgcattagttcttacaaaggaagcctatgggtttcaaggaagtgtcatctgctacaatcttctgcctcttgcttctattctgcctgggctgcagatgcctggcatcagaactagtgacctcacaggcagcaactctcaatgttgacgcctcaccgcagtcagcccgaaagatccctgaaacactatttgggatatttttcgaggagatcaatcatgcaggagctggtggaatttgggcagagcttgttagtaacagaggtttcgaagctggaggcccacatactccctcaaatattgacccatggtccattattggagatgactcttctgtatttgtggcgactgatcgtacatcatgtttcagtcgaaacattgttgctctgaggatggaggtcctctgtgatgactgtcctactggtggtgttggtatttacaacccggggttctggggcatgaacatagaagatggaaaggcgtacaatcttgttatgtacgttaagtcaccagaaacaacagacttgactgtttcactaacaagctctgatgggttgcaaaacctggcttcaactactataacagtttctggtacatcaaattggacaaaagtggagcagaagttggttgctaatggaaccaatagaacctcaaggcttcaaataacaactaacaagaaaggagttgtttggtttgatcaagtttcactcatgcctgaagacacatacaagggacatggttttcgcacagaacttatatccatgcttttggatttgaaaccgcgattcttgagattttctggcggatgctttgtagaaggcgattggttaagaaatgcattcaggtggagagaatctattggtccatgggaaaagaggcctggacactttggggatgtttggcattactggactgatgacggcctcggatattatgaatttcttcagcttgcggaggacctgggtgctgccccaatctgggtattcaacaatggagttagccacaatgatgaagttgataccgctgctattgctccatttgtaaaggatgtattggacagtctagaatttgcaagggggagtgcagattcgacatggggctctgttagggctgcgatggggcaccctgaaccattcccagtgaaatatgttgcaattggaaatgaagattgtgggaaaaaattttaccgcggtaattacctcaagttctacaatgctataaggcaggcctatccagatattcaaatgatttcgaactgtgatggttcatctagaccacttgatcatcctgctgatttatacgacttccatgtatataccgattctaagactttgtttaacatgaggagcacattcgacagcacatctcgtagtggaccaaaggcttttgtgagtgaatacgccgtttggagaagtgatgcaggtagaggaagtcttcttgcttcattggcggaagctgctttccttactggtctggagaagaacagtgacattgttcagatggcaagttatgctccattatttgtaaacgacaatgacagaacgtggaaccctgatgctatcgtcttcaactcgtggcaacattatggaactcctagttactggatgcagacacttttccgtgagtccagcggtgctatggttcatccaattacagtcaattccagctactctggttcgctagcagcatctgcaattacttggcaggattcagagaacagcttcctaagagtaaaggttgtaaattttggatcagatgccgttagccttacaatctccacaagtggacttcaggccagtgttaatgctctgggatcaaccaccactgttctcacatccgggaatgttatggatgaaaattctttcagtaacccaaacaaggttgtgccggtgaagagcgagctgagcaatgccgcagagcagatgcaggtcacgctggctcctcactccttcagtgcgttcgatctcgcgttggctcagtccaaacttgttgcggagatgtgaagtggtatcacccttactaggctggtgacagatacacgaggaataccctacgcatggtgtgatacgcaaataacagttcttttccaaaaaaaaaaggatacgcaaataccagccaccagggagttgctgctgttagcatcttgataaagctttgtatagtgtaacacgatgcagatatactaaataaaaatcacatcatgttggtttgggttgactgaaaaaaaaaaaaaaaaaaaa

SEQ ID NO: 2778 - protein, 656 aa, Panicum virgatum
  misc_feature: Ceres CLONE 1786359
  misc_feature: Great-hit functional homolog of the protein sequence encoded by LOCUS At3g10740
  misc_feature (1)..(186): Pfam Name: Alpha-L-AF_C Pfam Description: Alpha-L-arabinofuranosidase C-terminus
  misc_feature: Useful for making plants with altered cell wall content and/or composition
MGFKEVSSATIFCLLLLFCLGCRCLASELVTSQAATLNVDASPQSARKIPETLFGIFFEEINHAGAGGIWAELVSNRGFEAGGPHTPSNIDPWSIIGDDSSVFVATDRTSCFSRNIVALRMEVLCDDCPTGGVGIYNPGFWGMNIEDGKAYNLVMYVKSPETTDLTVSLTSSDGLQNLASTTITVSGTSNWTKVEQKLVANGTNRTSRLQITTNKKGVVWFDQVSLMPEDTYKGHGFRTELISMLLDLKPRFLRFSGGCFVEGDWLRNAFRWRESIGPWEKRPGHFGDVWHYWTDDGLGYYEFLQLAEDLGAAPIWVFNNGVSHNDEVDTAAIAPFVKDVLDSLEFARGSADSTWGSVRAAMGHPEPFPVKYVAIGNEDCGKKFYRGNYLKFYNAIRQAYPDIQMISNCDGSSRPLDHPADLYDFHVYTDSKTLFNMRSTFDSTSRSGPKAFVSEYAVWRSDAGRGSLLASLAEAAFLTGLEKNSDIVQMASYAPLFVNDNDRTWNPDAIVFNSWQHYGTPSYWMQTLFRESSGAMVHPITVNSSYSGSLAASAITWQDSENSFLRVKVVNFGSDAVSLTISTSGLQASVNALGSTTTVLTSGNVMDENSFSNPNKVVPVKSELSNAAEQMQVTLAPHSFSAFDLALAQSKLVAEM

SEQ ID NO: 2779 - DNA, 1694 bp, Panicum virgatum
  misc_feature: Ceres CLONE 1786362
  misc_feature: Encodes the peptide sequence at SEQ ID NO. 2780
ctgctctggtcaggttccctcggagtctcgccgaacgggagcggggggccgcctagactcgcgaggggccgagatggcgtccgagctcacctaccgcggcggcggggcctccccggtcgccggcgccggcgccggcgcggggggatactccgcgaagccgtccaagccgcttgcgtggctgccccgcgccgcgcgctacgccgccgccgagcaccgcccggtcttcgcgctcgccgggatgctcatcgccgccgccgtcatctgcatcgcctccccgtccgccccctcctcctccgccgccgccgccgtctcctcctactcctcctccagcagcaccaacaacccgctcgcccgcttctccgtcgagccggcacaccaccgcgacctggcctccacgaggcacttcgtcggcggcaaggtgccgctgggcctcaagcgcaaggcactccgcgtgctcgtcaccggcggcgccggcttcgtcggcagccacctcgtcgaccgcctcctcgagcgcggcgacagcgtcatcgtcgtcgacaacctcttcaccggccgcaaggacaacgtcgtgcaccacttcgccaaccccaacttcgagatgatccgacacgacgtcgtcgagcccatcctgctcgaggtcgaccagatctaccacctcgcctgcccggcatcgcccgtccactacaagtacaaccccgtcaagacaatcaagaccaatgtagttgggactctgaacatgcttggattggcaaagaggatcaacgccaggttcctcctcaccagcaccagcgaggtctatggtgatcccctccagcacccccaggtggagacttactggggcaatgtcaatcccatcggtgtcaggagctgttacgatgagggcaagcgtacagctgaaacgttgaccatggactaccaccgtggtgccaaccttgaggttaggattgcgcgtatcttcaacacatatggccctcgcatgtgcattgatgatggccgtcttgtcagcaactttgttgctcaggcacttaggaaggagcccttgactgtttacggtgatggcaagcaaaccaggagcttccaatatgtttctgatctggttgagggtctaatgaagctgatggaaggggatcaagttggtccattcaaccttggaaaccctggcgagttcaccatgcttgagctcgccaaggttgtccaggacaccattgacccgaatgcacggattgagttccgtcaaaacacccaggatcacccgcacaagcgcaagcctgacatcagccgcgccaaggagcttcttggctgggagccgaagatccccctgcgcgagggacttccccttatggtcactgacttccgcaagcgcatcttcggggaccaagacagcgctgcgaccaccggaaaccaacaaggttaggacgaaggagcatgagacttggaaaatttttggtggcctgcttctagctgcttggttactctcctcactgacaaaagctatggccgtatagttcgttgggaacatgttactgaaatacctttggttgctgctgtaatgctattctttttccatgtaattgttttatcagttatctcagtcagctatacaaaattttcagttgaattttggagataaacccggatgatcttattctttgttgagagcatagcattatatgatataaatcacacatttctgt

SEQ ID NO: 2780 - protein, 446 aa, Panicum virgatum
  misc_feature: Ceres CLONE 1786362
  misc_feature: Great-hit functional homolog of the protein sequence encoded by LOCUS At2g47650
  misc_feature: Great-hit functional homolog of the protein sequence encoded by LOCUS At3g62830
  misc_feature (1)..(234): Pfam Name: Epimerase Pfam Description: NAD dependent epimerase/dehydratase family
  misc_feature (97)..(431): SWISSPROT Homolog: EC 4.1.1.35 UDP-glucuronic acid decarboxylase 1
  misc_feature: Useful for making plants with altered cell wall content and/or composition
MASELTYRGGGASPVAGAGAGAGGYSAKPSKPLAWLPRAARYAAAEHRPVFALAGMLIAAAVICIASPSAPSSSAAAAVSSYSSSSSTNNPLARFSVEPAHHRDLASTRHFVGGKVPLGLKRKALRVLVTGGAGFVGSHLVDRLLERGDSVIVVDNLFTGRKDNVVHHFANPNFEMIRHDVVEPILLEVDQIYHLACPASPVHYKYNPVKTIKTNVVGTLNMLGLAKRINARFLLTSTSEVYGDPLQHPQVETYWGNVNPIGVRSCYDEGKRTAETLTMDYHRGANLEVRIARIFNTYGPRMCIDDGRLVSNFVAQALRKEPLTVYGDGKQTRSFQYVSDLVEGLMKLMEGDQVGPFNLGNPGEFTMLELAKVVQDTIDPNARIEFRQNTQDHPHKRKPDISRAKELLGWEPKIPLREGLPLMVTDFRKRIFGDQDSAATTGNQQG

SEQ ID NO: 2781 - DNA, 1208 bp, Panicum virgatum
  misc_feature: Ceres CLONE 1786381
  misc_feature: Encodes the peptide sequence at SEQ ID NO. 2782
aaaaagcctcacagctgcgcagttccagcctccatagctcggccagcaaactcttcagcctcgtcatatccatcgcctccgattccctggcgtttgcttcctccctgggaggtcatagctagctgctcgccctgtctaggtgaggagcgacgagctgagggtacgctaatcacggtcgggatgaagagccggaggcagagcagcgggggcagctcgggcggcgcgacggccgctggggtggggaacacgcacagcagcggcggcgggtgcaagctggagaggaaggacgtggagaagaaccggcggctgcacatgaagggcctctgcctcaagctctcctccctcatcccgcccgccgccaggcgcgcgtccctgctctcggaggcggcggcgtccgcgtccaaccccaacaaggacgcggcgacgcagctggacagcgcggcggcgtacatcaagcagctcaaggagcgggtcgatgcgctgaagcggaggaaggagggcggcggcggccgtgaggggggcgccgccgccggcgccgtgcgcatgccggtggtcgaggtgcggtgccaggacggggcgacgctggacgtggtgctaatcagcgaggccgggcggccgttcaagctgcacgaggtgatcacggcgctggaggaggagggcgccgagttcgtcagcgccagcttctccgtcgtgggcgacaagatcttctacaccatccactcgcaggcgctcagcccccggatcgggctcgacgccgccagggtctccgagaggctgcacgacctgctgctcctcgtctgacgaaccacctactgaagatcaccagcgacggtgctgacgagggagagatctactgtattgttagcgtagctatagtcgagttcaggacacacggagcgcggtagcaggggacggatccaggggagggaagctgcaggttttttagcagttgtgcatatgtaggagcaagcgagcagactgctttttttttggcttgttttttcagctcttagaacgaaacggccggtgctgtgtaccacactggagtgtacatgcatcctgtctctgttctattacgtgctgtttcagcttcctgtactactgatgctcactccacggaatcggatgcacacttgtgttcctgaatcctgtgtgttgcagttgcagcacgtttccagaatctaatcacaagctccagctcaggtgtc

SEQ ID NO: 2782 - protein, 206 aa, Panicum virgatum
  misc_feature: Ceres CLONE 1786381
  misc_feature: Great-hit functional homolog of the protein sequence given in SEQ ID NO 9607
  misc_feature (2)..(72): Pfam Name: HLH Pfam Description: Helix-loop-helix DNA-binding domain
  misc_feature: Useful for making plants with altered Lignin content
MKSRRQSSGGSSGGATAAGVGNTHSSGGGCKLERKDVEKNRRLHMKGLCLKLSSLIPPAARRASLLSEAAASASNPNKDAATQLDSAAAYIKQLKERVDALKRRKEGGGGREGGAAAGAVRMPVVEVRCQDGATLDVVLISEAGRPFKLHEVITALEEEGAEFVSASFSVVGDKIFYTIHSQALSPRIGLDAARVSERLHDLLLLV

SEQ ID NO: 2783 - DNA, 1630 bp, Panicum virgatum
  misc_feature: Ceres CLONE 1786387
  misc_feature: Encodes the peptide sequence at SEQ ID NO. 2784
cccgtgtctgcccgctctcccgacgatttccctctctccctccattttgccccctcctcctcctcctcctccttgtcgctttagggtttctccagctcggcgccccggctcgctccctccctccccgattccgcgcacccgattcggcgcggccgccgcgtcgccatggtctccggcgtcgcggacaacccggacggggacggcggcgcccagcgcccgccgccgcctgtgggggccggggccgcccttggcacgccgcctgtctccgcgggcgccgcgcactccgcgtctactagtggggggagcgccggctccccgtccagccgcatcgagcagcacgcccccgacggtgctggcaagggtgccgcccccggggctgcggcggcggcgtcggcgtccacgccggccagcgagagcacgttcctccgcctgaataatctcgacatcaacggcgacgacgcgccgtcgtcgcaggctcctacgagcaagaagaaaaagagggtctcacgggcagttggtcctgaaaaaggtaaccggggactgcgccagtttagtatgaaagtttgtgagaaagttgaaagtaaagggagaacaacatataatgaggtggcagatgaacttgttgctgagtttacagaccccaataataatattgaggcaccagatcctgataatcccaatgcacaacaatatgatgagaaaaatataagacgaagagtttacgatgctttaaatgttctgatggctatggacattatatctaaagataaaaaggaaatccagtggaagggcttgccccggactagtataagtgatattgaagaattgaagacggagcttgtgggactgaaaggtaggattgagaagaaaagtgcttatttacaggagctacaagatcaatatgtaggtctgcaaaatctgattcaacgaaatgagcaattatatggttcgggaaacacaccttctggtggagtggcattgccatttatcctagttcagacccggcctcatgcaaccgtggaagtcgagatatcagaagatatgcagttggtgcattttgatttcaatagcacaccatttgagttgcacgatgactcatatgtcctaaaagaaatgcagttctgtggaagagaacaacatgacagcactcatgagccaacctcaaatggaggtgagggctcaagcatgtcaaatatttactggcaacaggtacagcatgcagggcggccaaataacggcacagttaggttaccaggctcatcgcctattccaggaatattgaaagggcgtgtgaagcacgagcactaacactagggtgttcgttcactggcctttttatctgagtctgagctgtttgtttttattacatttcttatttatatgtaaagggcctgtaaattattggaaggggacggtagcttgatctaatttagttctgcaccagattggtagaacgacaggtgccctgagtaattctagccgtctttatatcggttccttttgtatggttgagaaaagcattgacgtgttgtaatttttgtagagcattgtaaaataggtgacgttgatttcggtaaaatgtcagcagcttgagtgctttattctgggcgaaaaaaaaaaaaaaaaaaaa

SEQ ID NO: 2784 - protein, 380 aa, Panicum virgatum
  misc_feature: Ceres CLONE 1786387
  misc_feature: The sequence is a functional homolog of  SEQ ID NO 1550 in the  10/666,642 US patent application
  misc_feature: The sequence is a functional homolog of  SEQ ID NO 610 in the  10/666,642 US patent application
  misc_feature: Useful for making plants with modulated growth and phenotype characteristics
MVSGVADNPDGDGGAQRPPPPVGAGAALGTPPVSAGAAHSASTSGGSAGSPSSRIEQHAPDGAGKGAAPGAAAAASASTPASESTFLRLNNLDINGDDAPSSQAPTSKKKKRVSRAVGPEKGNRGLRQFSMKVCEKVESKGRTTYNEVADELVAEFTDPNNNIEAPDPDNPNAQQYDEKNIRRRVYDALNVLMAMDIISKDKKEIQWKGLPRTSISDIEELKTELVGLKGRIEKKSAYLQELQDQYVGLQNLIQRNEQLYGSGNTPSGGVALPFILVQTRPHATVEVEISEDMQLVHFDFNSTPFELHDDSYVLKEMQFCGREQHDSTHEPTSNGGEGSSMSNIYWQQVQHAGRPNNGTVRLPGSSPIPGILKGRVKHEH

SEQ ID NO: 2785 - DNA, 2573 bp, Panicum virgatum
  misc_feature: Ceres CLONE 1786408
  misc_feature: Encodes the peptide sequence at SEQ ID NO. 2786
gtcggagtacacgcgggcgccatcatttaacagtttcctttttggtttccttccccaccgtccggcctatgggctatcgatgattgataactgattggccgacttcaattccagccgtctcgttggcagccgcgcgatccttcgaaagccgacgaaccccaccaccgccaccaacgcagaggagggagagagagagagagcggtttgcccgccccgtgacccgccaacgcaactgacaccgacgcggtcgtcccgtcttccttctccagtcctcctcctcgtcgtcgttgtcgcgcgatggcttcgggcgcctccggggtcgcggcgctcgggatctccggcgccgacggcgagtgggcggccgcgtgcccaccgctgcgtcggaacctgcacctgctcgcgcccgacgaggttgaacttgcaaaaatgctgttgaatgaggggcagatgcacctgtttgaacactggccagaaccaggtgttgataatgacaagaaaaaaagcttctttgatcaggttcgtcgacttaattcaagctatcctggagggctggtatcgtacatccagaatgccaaaaaacttttggcagattcaaaggcaggcaaaaatccatatgatggttttactccttctgttccttcaggggaggtattgacctttggcgatgacaattttgtttcactggaagcagctggggtaaaagaagcacggagtgctgcatttgttcttgtagctggagggcttggtgaaagacttggctataaaggaattaaggtagcactccccagggaaacaattactggaaaatgtttccttcaacattatatagagtctattctgtctttacaagaggccagctgcaaaatggttgatgacgggtgtcatacacagattccatttgttattatgacttctgatgatacaaatgcgctaaccatccagcttttggagtcgaactcctattttggaatggaaccatctcaagtgaaaatactaaagcaggaaaaagtagcgtgtctaactgacaatgatgcaaggcttgcattagacccaaatgacaagtacaaaattcagacaaagccacatgggcatggagatgttcattctcttctttattcaagtggcttgcttgagcaatggaaaagtgaagggcggaagtgggttctctttttccaggatacaaatggactgcttttcaatgcaataccatcagcattaggtgtcagtgccactaagggttacaacgtaaattctcttgcagttcctaggaaggcaaaggaagcaattggaggaattaccaaacttactcacgttgatggtagaacaatggtcatcaatgtagaatacaatcagcttgatccactccttcgtgcaactggatatcctgatggagatgcaaattgtgaaacagggtattctccatatcctggaaatattaaccagctgatactggagcttggaccatacattgaggagctcaaaaaaacacatggcgccatttctgaatttgtaaatcccaagtatactgattcgaccaagacggcatttaaatcttccactcgtctagaatgcatgatgcaagactatccaaagacactgcctccttcagcaaaagttggattcacggtgatggatacatggcttgcttatgctcctgtgaagaataatcctgaagatgcagctaaagttccaaaaggcaatccttatcatagtgcaacctcgggagagatggcaatttacagggcgaacagccttattttgaaaaaggctggtgcccagatagctgaccctgtagtggacaccttcaacgggcaagaggtagaggtttggccacgcataacctggagtccacggtggggtcttaccttcaagaatgtcaaggagaaagtgcgtggggactcttccatttctcagaggtcagctttggccatcaatggtcggaacatcttccttgaaggcctttcattggacggcactcttattatcaacgctgttgatgaagctgaggttaaaattaccggtcatgtacaaaataaaggctgggctatccagcacgtcgactacaaggacatctcagagaaggaggagatcaggatccgtggatttaagtttgagaaggttgaacagctagaggtgaactacacggaaccaggaaagtattccttgagtgcatgaacaaagcattcccttgattacttgatcgacctgaccaggttccaaccactggaaatagttcacgtcatgattgcctcccagattttaggaggccattaccaatgacctgaaagtgttctagtccttggcaagtactaataaggtgcaatgtgcttccccaatcagtcatcattcttaatgtatatttgtacttgtatagtaccctcgtttatagccaaacctttttcccacttttgtgtaatcaaagttgaatatttatatttgatccgatgttgctgcaataatttatagtgaatcaaaacttggtgctgaatcaaaaagtacgcgcgggcaaaatgttgtttgtgttatgtataatgtattgcaccttttttttggcaaaaaaaaaaaaaaaaaaa

SEQ ID NO: 2786 - protein, 625 aa, Panicum virgatum
  misc_feature: Ceres CLONE 1786408
  misc_feature (1)..(334): Pfam Name: UDPGP Pfam Description: UTP--glucose-1-phosphate uridylyltransferase
MASGASGVAALGISGADGEWAAACPPLRRNLHLLAPDEVELAKMLLNEGQMHLFEHWPEPGVDNDKKKSFFDQVRRLNSSYPGGLVSYIQNAKKLLADSKAGKNPYDGFTPSVPSGEVLTFGDDNFVSLEAAGVKEARSAAFVLVAGGLGERLGYKGIKVALPRETITGKCFLQHYIESILSLQEASCKMVDDGCHTQIPFVIMTSDDTNALTIQLLESNSYFGMEPSQVKILKQEKVACLTDNDARLALDPNDKYKIQTKPHGHGDVHSLLYSSGLLEQWKSEGRKWVLFFQDTNGLLFNAIPSALGVSATKGYNVNSLAVPRKAKEAIGGITKLTHVDGRTMVINVEYNQLDPLLRATGYPDGDANCETGYSPYPGNINQLILELGPYIEELKKTHGAISEFVNPKYTDSTKTAFKSSTRLECMMQDYPKTLPPSAKVGFTVMDTWLAYAPVKNNPEDAAKVPKGNPYHSATSGEMAIYRANSLILKKAGAQIADPVVDTFNGQEVEVWPRITWSPRWGLTFKNVKEKVRGDSSISQRSALAINGRNIFLEGLSLDGTLIINAVDEAEVKITGHVQNKGWAIQHVDYKDISEKEEIRIRGFKFEKVEQLEVNYTEPGKYSLSA

SEQ ID NO: 2787 - DNA, 1878 bp, Panicum virgatum
  misc_feature: Ceres CLONE 1786411
  misc_feature: Encodes the peptide sequence at SEQ ID NO. 2788
attccccttccacctcgctctctctctctctcctcgcactgccctctctctctctcttacgcgcgcgtgacacctccacgggcgcgccgcgcgcgagagcagccgccaccgactgatcgccggctggcgcgggggctggggcgatctgatgctggcgcggcggtgatggctgcgccgtccgccggcgcagggggcgggagcggcggcgcgggggagggctcctcctcctcggccgccgcggctgccgcagccgcgacgatcggggcccacggtgtcgaccaagttgcagaagcgatgtggcagatgaacttaggagaagctgttgaactggggccttacccagagcgtgttggtgagccagattgtagttattacatgaggactggcatgtgtaggtttgggatgacctgtaaatttaaccatccagcagataggaagctggctgttgctgctgcaagaatgaagggagaatatcctcaaagaaatggccagcctgaatgtcaatactatctgaagaccggcacatgcaaatttggagcaacttgcaagtttcaccacccccgagaaaaggctgcaatggcaactcgagtgcagttgaatgaattgggctacccattccgcccgagtgaaaaggaatgtgcctattatttaagaacagggcagtgcaagtttggaagcacatgtaaatttcaccatccacaaccatctaccatgatggttgctgtacgtggctctggttattcacctggacagtctgcaacttctcctggccagcatgcgtaccaaggggctgtaacaagctggcccttgtcaagatctacttctttcattgcaagtccaaggtggccaggtcattcaagctatgcgcaagtgcttgttcctccaggccttgttcaggtcccagggtggaatccttacactgcacagattggttcatcatcctcagaggaccaacaacagacacctggagctgcccaatactatactggttcacgccagagtggaacaccttgcatcggagatcaaggaatgttttcatcataccaagctggttcagttcctgttggactttatgcagtacagagggaaaatgtgtttccagagagacctgaccaacctgaatgtcagttctatatgaaaactggagactgtaaatttggtgttgtatgcaagttccatcatcccagggagcgaataattcctgctcccaattgtgcactgagttcattgggccttcccctgcgtccgggagaacccatttgcagtttctattctcgctatggcatgtgcaagttcggtccaaattgcaaattcgatcatccaataggaacagtcatgtatggccatgtttcatcaccaactagtgaggtcccaacttctcgacgaatgctggcatatgtaccatctcatccagaagtattgcctgacaatggctcgggaaggtcacggaggattacccattcagattcccagcaaataccctcaggtgaaaggagcactgagagagaggcgtcctaagccatcctcggttccatgttcatgctgcctcccattcttgactggagtaattatctgcaacaacatttgaggagctgtacaggtcttttgcgcttttacctcaccttcgagctttacataccggagcttgcttcaacatgtattgcattcaggctggaaaaagttcctagcctgttcgggatgcccatttgcccaatggaaacaggaacaaaccttaccttatttaaaacatatgtatggaaccaactcacctttggacatacgaaccgactcgagtgatgtgtgccgtgatggtgttgttgtagctatagaggtgcattgaaatggacacgcttttgtgaaaaaaaaaaaaaaaaaaaa

SEQ ID NO: 2788 - protein, 450 aa, Panicum virgatum
  misc_feature: Ceres CLONE 1786411
  misc_feature: Great-hit functional homolog of the protein sequence given in SEQ ID NO 9406
  misc_feature (1)..(27): Pfam Name: zf-CCCH Pfam Description: Zinc finger C-x8-C-x5-C-x3-H type (and similar)
  misc_feature: Useful for making plants with modulated low light sensitivity
MAAPSAGAGGGSGGAGEGSSSSAAAAAAAATIGAHGVDQVAEAMWQMNLGEAVELGPYPERVGEPDCSYYMRTGMCRFGMTCKFNHPADRKLAVAAARMKGEYPQRNGQPECQYYLKTGTCKFGATCKFHHPREKAAMATRVQLNELGYPFRPSEKECAYYLRTGQCKFGSTCKFHHPQPSTMMVAVRGSGYSPGQSATSPGQHAYQGAVTSWPLSRSTSFIASPRWPGHSSYAQVLVPPGLVQVPGWNPYTAQIGSSSSEDQQQTPGAAQYYTGSRQSGTPCIGDQGMFSSYQAGSVPVGLYAVQRENVFPERPDQPECQFYMKTGDCKFGVVCKFHHPRERIIPAPNCALSSLGLPLRPGEPICSFYSRYGMCKFGPNCKFDHPIGTVMYGHVSSPTSEVPTSRRMLAYVPSHPEVLPDNGSGRSRRITHSDSQQIPSGERSTEREAS

SEQ ID NO: 2789 - DNA, 1752 bp, Panicum virgatum
  misc_feature: Ceres CLONE 1786433
  misc_feature: Encodes the peptide sequence at SEQ ID NO. 2790
gtcgctcctacctcgctgcaccggccagtcccccccccccaccccccccctccgcctcgccgcgccgcgcctccgtcgccgggagtagggagggagaggcgccggcagatcgatcggggaggcgcgcgcgggctcggcggccggttgctgctatggcggaggcggtgcgggagctgcgcgcgagcttcgcggcggggcggacgcggccggcggagtggcgggcggcgcagctccgggcgctggtgcggatgatcgacgagcgggaggccgacatcaccgccgcgctccacgacgacctcgccaagccgcacatggagtcgtacctccacgagatatcgctcgcgaagtcctcgtgcaagttcgcgctcaacaggctcaagaactggatgaagccagagaaggtacctgcggccataactacgttcccgtcctctgcgcaaatcgtgcctgagcccctcggtgtggtgctcgtcatctccgcctggaactacccattcctgctctctattgatccggtgattggagcaatagctgctggaaatgctgttgttctgaagccatcagaaatagcgccggcaacctcgtcaatgttcgcaaagctgctacctgagtatgttgacagtacatgtattaaagttgtagaggggggtgttgaggaaacgaccgcgctcttggaacaaagatgggataagatcttctacacaggtagcgggactgtagcacgcatagttttggcagccgccgcaaagcatctgaccccggtggctctggagcttggtggaaaatgccctgttattgtcgattctgacgttgatcttcatgttgctgttaagaggcttgctgttggcaaatggggatgtaacaatggccaagcatgcatcgctccagattacgtcataacgacgaaatcatttgcaccagagctggtgaactctttgaaaagagttctggagaggttctacgggaaggatcctctggaatcggcggatctgtctcgtatcgttaattctaaacattttcagagattgacagaattgatagcagaaaagaaagtagctgacaagattgtgtacggaggccagactgacgagaagaaactaaaaattgctcctacaatattgctggacgttccccaggatacagcactcatgacagcagaaatttttggccccttccttcctatcgtgacggtcgagaagatcgaagacagcattgacgtggtgaactccaagacgaagccgcttgcggcctacctcttcaccaagaacaagaagctgcagcaggcctttgtggcgaacgtccccgcgggagggatgctcgtgaacgacgtcgcgctgcatctcacgaacccgtacctgcccttcggcggcgtgggcgacagcgggacgggcagctaccacggcaagttcagcttcgactgcttcagccacaagaaggcggtcctggtccgcggcttcggcggcgaggcggcggcgaggtacccgccctacacgacggagaagcagaagatcctgaggggcctcatcaacggcagcttcatcgcgctcatcctggcgctcctgggcttcccgagggagaggcgctaggctggacgatcgaccccccgttccagtacagacttctgttcgtgttcgtccggtgcagagtactagtagcatactccctccatcccaaaaaacccgttgttctttgactcttagaaattgcgtttgaccgctcgtcttattcaaataaaaaaaaaaaaaaaaaaaa

SEQ ID NO: 2790 - protein, 477 aa, Panicum virgatum
  misc_feature: Ceres CLONE 1786433
  misc_feature (1)..(419): Pfam Name: Aldedh Pfam Description: Aldehyde dehydrogenase family
  misc_feature (5)..(471): SWISSPROT Homolog: EC 1.2.1.3 Aldehyde dehydrogenase 3H1
  misc_feature (5)..(475): SWISSPROT Homolog: EC 1.2.1.3 Aldehyde dehydrogenase 3I1, chloroplast precursor
MAEAVRELRASFAAGRTRPAEWRAAQLRALVRMIDEREADITAALHDDLAKPHMESYLHEISLAKSSCKFALNRLKNWMKPEKVPAAITTFPSSAQIVPEPLGVVLVISAWNYPFLLSIDPVIGAIAAGNAVVLKPSEIAPATSSMFAKLLPEYVDSTCIKVVEGGVEETTALLEQRWDKIFYTGSGTVARIVLAAAAKHLTPVALELGGKCPVIVDSDVDLHVAVKRLAVGKWGCNNGQACIAPDYVITTKSFAPELVNSLKRVLERFYGKDPLESADLSRIVNSKHFQRLTELIAEKKVADKIVYGGQTDEKKLKIAPTILLDVPQDTALMTAEIFGPFLPIVTVEKIEDSIDVVNSKTKPLAAYLFTKNKKLQQAFVANVPAGGMLVNDVALHLTNPYLPFGGVGDSGTGSYHGKFSFDCFSHKKAVLVRGFGGEAAARYPPYTTEKQKILRGLINGSFIALILALLGFPRERR

SEQ ID NO: 2791 - DNA, 2190 bp, Panicum virgatum
  misc_feature: Ceres CLONE 1786440
  misc_feature: Encodes the peptide sequence at SEQ ID NO. 2792
aatccagccatcaatcccatcaccgagcagtcgtcgtcttcccccatggcactcgttctccctccgcccccttgaagggtctatttcctttccttcctgcctctcttcagctgaggcctggtcattggagtaccgcggtccgtgagtcgtttcttgctggtcaaaagacattcaagaatcgcctggggactcctgtttcttgatgtggatgacatgaggacactgaatacaattgtgataaagatggcaggatctgctccctgctaagtttttacctacgagttggcaaaggacaatatgtcatctggggcttctaaccgtcgtccatacaaaatttcagaagattctcaaatgccgtactacaataattcagcaactgtagaagaaaatgataggttacatgtgatgcaaaataatctagatcatcgccactcttctcccgatgatgaatcgcagaagattaatagttccaacacacaaatatttgaagcacagtactgcactctggaatcatcctcagcaaatggtgtttatcctgcacaaagctccacatcttctcacagcatttcccctttaagtgggagccccctgtctcagcatgatagccactcagaccacacatatagttctcccccaagtgcttcctgtctaactgaagttgcagatctccaaattaaactaaaagagctagagaatgccattcttggacctgaattggacattacttctgacagacctgagagcttcttacaagccaatgttcaattgagaccagacaactggagacaacttctgggaattgatgcaggagacttgaagcaagtaatcattgcatgtggtaaggctgttgcggagaatgatgtctttgcaacagatttgcttatatctgagctaggtcagctcgtatctgtatcaggagatccaatgcaacgacttggagcatatatgttggaaggaattgttgcaagactttcttcctctggcagtatgctatataaatctttgaaatgtaaagaacctacaagctctgagctcatgtcatacatgcatctcctttatgagatctgcccattcttcaagtttggttatttgtcagcgaatggtgccattgccgaggctattaagggggagaactttgttcacgtcattgacttccaaattgctcaggggagccagtggattactctgatacaggcccttgctgcaaggcctgggggtccaccatacattaaaatcacaggtattgatgactcaaattctgcttatgccagagggggtgggcttgatatagttgggaggagattgcatagtgttgctcagtcgtgtggtcttccctttgagttcaatgctgttccagctgctagccatgaggttcagcttgggcatcttgcattaagacctggggagattattgctgtcaattttgcctatcagctgcatcatgttcctgatgaaagcgtaagcatggaaaatcatcgagataggattataagaatgatcaagagcatcaatcctagggttgttactctcgttgagcaggaatcaaatacaaacacagctccattcttcccaaggtacatggaaactctcaactactatacagccatgtttgagtcgatagatgttgctctcccaagggatgaccggaggaggatgagtgcggaacaacactgtgttgcaagggatattgttaatttaatcgcatgcgagggtgctgaaagagttgagaggcatgaactgtttggaaaatggaaggcaagatttgctatggctggatttaggccttacccgctgagttcagtagtgaacaacaccatcaacacactgttgcggagttataacagctgctacaggcttgaggaaagtggtggtgtcctttaccttggatggaagaacagagtgttagttgtatcttcagcatggtgttgacatttccatataagaagctcatgtacgtgtacattgttaacatatctgaactttaattttttagaaagtagtgatctgtactttgtagctgcaaactgttataaatcattttcatgtgtatatagggtaaagaaatagatactcatatgtggcataaacacacataacacatatgcatatttgatatatcccattatttgtccatgccaagcgatttgaatcgttgggcatgccttatagtaaaaaaaaaaaaaaaaaaaa

SEQ ID NO: 2792 - protein, 543 aa, Panicum virgatum
  misc_feature: Ceres CLONE 1786440
  misc_feature: Great-hit functional homolog of the protein sequence given in SEQ ID NO 9454
  misc_feature (1)..(307): Pfam Name: GRAS Pfam Description: GRAS family transcription factor
  misc_feature: The sequence is a functional homolog of  SEQ ID NO 474 in the  10/666,642 US patent application
  misc_feature: Useful for making plants with modulated low light sensitivity
  misc_feature: Useful for making plants with modulated growth and phenotype characteristics
MSSGASNRRPYKISEDSQMPYYNNSATVEENDRLHVMQNNLDHRHSSPDDESQKINSSNTQIFEAQYCTLESSSANGVYPAQSSTSSHSISPLSGSPLSQHDSHSDHTYSSPPSASCLTEVADLQIKLKELENAILGPELDITSDRPESFLQANVQLRPDNWRQLLGIDAGDLKQVIIACGKAVAENDVFATDLLISELGQLVSVSGDPMQRLGAYMLEGIVARLSSSGSMLYKSLKCKEPTSSELMSYMHLLYEICPFFKFGYLSANGAIAEAIKGENFVHVIDFQIAQGSQWITLIQALAARPGGPPYIKITGIDDSNSAYARGGGLDIVGRRLHSVAQSCGLPFEFNAVPAASHEVQLGHLALRPGEIIAVNFAYQLHHVPDESVSMENHRDRIIRMIKSINPRVVTLVEQESNTNTAPFFPRYMETLNYYTAMFESIDVALPRDDRRRMSAEQHCVARDIVNLIACEGAERVERHELFGKWKARFAMAGFRPYPLSSVVNNTINTLLRSYNSCYRLEESGGVLYLGWKNRVLVVSSAWC

SEQ ID NO: 2793 - DNA, 1872 bp, Panicum virgatum
  misc_feature: Ceres CLONE 1786472
  misc_feature: Encodes the peptide sequence at SEQ ID NO. 2794
aatctgcctccacccatctcgtcgaaaaccctagcctccaaatctccctccctctctccgatctcccgatccagcagccagcaccagatttgcgccatggccgccgccgccccggtgccgtcccgcaagacggagacctacaccgacaccaagcgccgcgacgacgtccgcggcgccaacatcgccgctgcgcgcgccgtcgccgacgccgtgcgcacctcgctggggccccgtggcatggacaagatgatctcctcgggggaccaggaggtcatcattaccaacgacggcgccaccatcgtctcccgcatgtcgctcgtccagcccgctgcgcgcatgctcgccgagctctcccgttcccaggacgctgccgcgggggacggaaccaccaccgtcgtcgtcctcgccggatccctcctccgccgtgcccagtcgctcctctccgcgggcgcccaccccaccgccgccgccgacgccctccaccgcctctccacgcgcgccgtcgagattctccaatccatggccatccccatcgagctctccgaccgggaatcgctcgtcaaatccgcctcaactgcccttaactccaaggttgtttcccagtactccactctcctctcacccctctctgtcgacgccgctctctctgtggtcgatcccgctcacccggacctcctcgacctccgtgacatccgcatcgtcaagaaacttggtggaactgtcgacgacactgagctcgtccgtggcctcatcttcgacaaaaaggctagccacgctgccgggggaccaactcggatggagaatgctaagatcgctgtcatccagttccaaatctcgccacccaagactgacattgagcagagcgtcattgtgtcggactatgcacagatggaccgcatccttcgtgaggagcgcaactatatcctcgggatagtcaagaagatcagggctgctggatgcaatgtcttgctcattcagaagagcatcttgcgtgatgcggtcactgagttgtctctgcactatcttgctaaggcaaagattctggtggtgaaggatgtggagagggatgagattgagtttatcaccaagaccttgaactgccttcccattgcaaacattgagcacttccgcacagaaaagcttgggtatgcagatcttgttgaggaaatctcagtcggggagggcaaggtcgttaagatcactggtatcaaggacatggggaggaccgcaactgtacttgtcaaggggtcaaaccagttggtcattgatgaagctgaacgcagtctccatgatgccctatgcgtcatcaggtgcttggtgaacaagaggtttatgattgctgatggtggtgctccagaaatagagatgtcaatgcaactggctgcttgggcaaaggagcttcaagggatggagagttactgcatcaaggagtttgctgaggcactagaggtcatcccgtacacgctggctgagaatgcagggcttaacccaatatccattgtcactgagctcaggaatcggcatgctagaggtgagaagaacgcaggcatcaatgtgaggaaagggcagatcacaaacatcctggaggagaacgttgtgcagcccttgctggtgagcacaagcgccattacgctagcttgcgagtgcgtcagaatgatcttgaagattgatgatattgtcacagtaagatgagggcgtagagttgattatcacgtcagcctgccctgctgtctggattgatagtgtactacttataatttagaacttcattcctgggctttggtgttgtaaacctggatgttttgaactcgtggttttgatgtcagtagaggaggggagtttgtttattgtcaaaaaaaaaaaaaaaaaaaa

SEQ ID NO: 2794 - protein, 531 aa, Panicum virgatum
  misc_feature: Ceres CLONE 1786472
  misc_feature (1)..(508): Pfam Name: Cpn60_TCP1 Pfam Description: TCP-1/cpn60 chaperonin family
MAAAAPVPSRKTETYTDTKRRDDVRGANIAAARAVADAVRTSLGPRGMDKMISSGDQEVIITNDGATIVSRMSLVQPAARMLAELSRSQDAAAGDGTTTVVVLAGSLLRRAQSLLSAGAHPTAAADALHRLSTRAVEILQSMAIPIELSDRESLVKSASTALNSKVVSQYSTLLSPLSVDAALSVVDPAHPDLLDLRDIRIVKKLGGTVDDTELVRGLIFDKKASHAAGGPTRMENAKIAVIQFQISPPKTDIEQSVIVSDYAQMDRILREERNYILGIVKKIRAAGCNVLLIQKSILRDAVTELSLHYLAKAKILVVKDVERDEIEFITKTLNCLPIANIEHFRTEKLGYADLVEEISVGEGKVVKITGIKDMGRTATVLVKGSNQLVIDEAERSLHDALCVIRCLVNKRFMIADGGAPEIEMSMQLAAWAKELQGMESYCIKEFAEALEVIPYTLAENAGLNPISIVTELRNRHARGEKNAGINVRKGQITNILEENVVQPLLVSTSAITLACECVRMILKIDDIVTVR

SEQ ID NO: 2795 - DNA, 2073 bp, Panicum virgatum
  misc_feature: Ceres CLONE 1786486
  misc_feature: Encodes the peptide sequence at SEQ ID NO. 2796
atggccagcgcgggactccaccactccaccccatcttcctcgcccgcccgaatctcctcccaccgaacccacgcgaggccggcgtccaggtcttctcccccgcggttcagatccccggatcgagccggcgcctcgtgaaagtccgcagcggcgacgaggtgtcgaggtttcttgcagctgtggatctgctgaggcggcgacatggggctggatttgggagctaatctcagacccggcactttcggggtctcggaccacgacgcgatcgtttctatcaacatcttcattgcgctgctctgcagctgcattgtaatcgggcacctgctcgaagggaaccgatgggtgaacgagtccaccactgcgcttgtcatgggtctgatcactggagctgtgattctgctcgctactaatgggacaaattcacgcatcctcgtgttcagcgaggacctgtttttcatctatttgcttccgccaataatcttcaatgctgggtttcaagtaaagaaaaagcaattcttccgcaacttcatgacaattattttgtttggagctgttgggactctgatttcctttgtaataattagtcttggtgccatgggattgttcgagaaacttgatgttggtccactcgatcttggagactatcttgcaattggtgctattttctctgcaacagattctgtttgcaccttacaggtgcttaaccaggatgaaacacccctactctatagtctagtttttggtgaaggtgttgttaatgatgcgacatctgttgtgctcttcaatgcaattgaaaaccttgatattggtcattttgatgctcttgttctgttgaatttcatcggaaatttcctctatctgttcttcaccagcacaatacttggagtagctactgggttgcttagtgcgtacattatcaagaagctttgctttgcaagacattcaactgatcgagaagtttctatcatgatgctcatggcatacctttcatacatgctgtcaatgctgttggacctgagtggcattcttactgtcttcttctgtggaatagtaatgtcacattacacatggcataatgtgacagaaagctctagagttaccactaagcatacttttgcaactttatcattcattgcagaaatttttctctttctctatgttgggatggatgcattggacatcgaaaagtggaaattagctagtagcagtcctaagaaaccaattgctttaagtgcaattatattgggcttggttatggttggaagagcagcatttgtgttccctttgtctttcctatccaatctaagtaaaaaggaggcacgtccaaagatatccttcaagcaacaagtaatcatttggtgggctggtctaatgagaggagcagtatcaattgcacttgcctataacaagtttacagcatctggtcatacagaagtgcgagttaatgctatcatgatcaccagcacagtcattgttgttctgttcagcacaatggtttttggtttgctgactaagccgctgcttactctccttatcccaccaaggactggcccaaacacgtcatctctgctatcaagccagtcaattctcgacccacttctcactagcatgatggggtctgacttcgatgtaggccagatctcccctcagtacaacctccagtttattctcaccgcgccaactcgctccgtccaccgcctatggcgcaagtttgatgatcgattcatgcgcccaatgttcggggggcgaggttttgtgccatttgtgcctggatcgccagtggaacaaagcgatcctgattctcacctgggcactgtggctgaggcagagcgttgagttgaggagcagaaggcatggcaattttctgtacgtgttcaggcagataccactctattttgtcctcacaatcatttggtgtagatttttgtattacctgtagagctacacaagcttttgtaaatttctgggagccagtgccaactgtagattagtacgattcatgtgtaaatttaatgttgttcaaagagaataatcacatttctgggatgcctctaaaaaaaaaaaaaaaaaaaa

SEQ ID NO: 2796 - protein, 544 aa, Panicum virgatum
  misc_feature: Ceres CLONE 1786486
  misc_feature: Great-hit functional homolog of the protein sequence given in SEQ ID NO 9430
  misc_feature: Useful for making plants with modulated drought sensitivity
MGLDLGANLRPGTFGVSDHDAIVSINIFIALLCSCIVIGHLLEGNRWVNESTTALVMGLITGAVILLATNGTNSRILVFSEDLFFIYLLPPIIFNAGFQVKKKQFFRNFMTIILFGAVGTLISFVIISLGAMGLFEKLDVGPLDLGDYLAIGAIFSATDSVCTLQVLNQDETPLLYSLVFGEGVVNDATSVVLFNAIENLDIGHFDALVLLNFIGNFLYLFFTSTILGVATGLLSAYIIKKLCFARHSTDREVSIMMLMAYLSYMLSMLLDLSGILTVFFCGIVMSHYTWHNVTESSRVTTKHTFATLSFIAEIFLFLYVGMDALDIEKWKLASSSPKKPIALSAIILGLVMVGRAAFVFPLSFLSNLSKKEARPKISFKQQVIIWWAGLMRGAVSIALAYNKFTASGHTEVRVNAIMITSTVIVVLFSTMVFGLLTKPLLTLLIPPRTGPNTSSLLSSQSILDPLLTSMMGSDFDVGQISPQYNLQFILTAPTRSVHRLWRKFDDRFMRPMFGGRGFVPFVPGSPVEQSDPDSHLGTVAEAER

SEQ ID NO: 2797 - DNA, 1381 bp, Panicum virgatum
  misc_feature: Ceres CLONE 1786491
  misc_feature: Encodes the peptide sequence at SEQ ID NO. 2798
accacacctcaggccctgacactcccctctgccagtgccaccccatcccttcccttctccgatccacagtctccagctagcctcctcctgctccgctcacctcaccgcgccaggatggccgcgcgctgcccttacttcgccgccgacgagaccacccgcgtcatccgccggggggagtccccggccgcggccctccgccggatcctcgccatgcccggcgcgcaccaggcgccctgctgcttcgacgcgctctccgcgcgcctcatcgagcgcgccggcttcgagatcggcttcatgagcggtttctgtgtttctgccaccaggcttggcttgcctgacgttggcctcatctcctatggagaaatggtagaccaagggcgcctactcaacgaagctgtatctatcccagtgcttggtgacggcgacaatggctatggaaactctatgggcatcaagagaaccatcaaagggtacatcaatgctggttttgctggaatcatgcttgaagatcaggtgtcgcctaaagcatgtggacatactgaaggaaggaaagtggtctcaagggaggacgctgtcatgcacataaaagctgctgttgatgctaggaacgagagtggctcggaccttgttattgtggcaaggacagattcacgtcaagccatttctttcgatgaagcattatggagagtgcaagcttttgctgatgttggtgctgatgtcctgttaattgacgcccttggttcagtggaagagatgaaggcattctgcgcagttgccccaggaattccaaagatgataaacattatcgaaggtggcaaaactcccatactgagccctgtggaacttggaaaaattggttacagcctcatagtctattcagtatccttacttggcgtgtcaatgcgtgcaatgaaggaggctctaggtgcaataaaaggtggccatgtagctccacctagcatcatgccatcttttcaggatatcaaggacactctagcgttcgaccgctactacaaagaagacaagaaataccaagtggtagagaagaaatacaaagtggactccaatggcacaaatggacacgactccaatggcacaaatggacacgactccaacggcacaaatggacacatatgaatctaccattagtttggcaattctggattctactggatatatgctgccatgcaaggtgctcatgcatggctcaagtaccatatgtgggagatataatatttgggaagctgtagccttcattattattgctcattttttgattttctactgtgttacggtttcaatattctgatttttgtgtttccaatttcaataaaacagacctactattgatgatttgaattaaaaaaaaaaaaaaaaaaaa

SEQ ID NO: 2798 - protein, 340 aa, Panicum virgatum
  misc_feature: Ceres CLONE 1786491
  misc_feature (1)..(83): Pfam Name: ICL Pfam Description: Isocitrate lyase family
MAARCPYFAADETTRVIRRGESPAAALRRILAMPGAHQAPCCFDALSARLIERAGFEIGFMSGFCVSATRLGLPDVGLISYGEMVDQGRLLNEAVSIPVLGDGDNGYGNSMGIKRTIKGYINAGFAGIMLEDQVSPKACGHTEGRKVVSREDAVMHIKAAVDARNESGSDLVIVARTDSRQAISFDEALWRVQAFADVGADVLLIDALGSVEEMKAFCAVAPGIPKMINIIEGGKTPILSPVELGKIGYSLIVYSVSLLGVSMRAMKEALGAIKGGHVAPPSIMPSFQDIKDTLAFDRYYKEDKKYQVVEKKYKVDSNGTNGHDSNGTNGHDSNGTNGHI

SEQ ID NO: 2799 - DNA, 1935 bp, Panicum virgatum
  misc_feature: Ceres CLONE 1786502
  misc_feature: Encodes the peptide sequence at SEQ ID NO. 2800
aagcaaacccagccgagccgagccaccccagcccacacgcctcccaccattcctcaaccgcctcgctcccgctccgggccgcttcccgcctcgccggagcagcgggcagcgacgggaggatggagatcgacgaggcagtgcgcgggtgcagcgaccgccgcatgcgcaccaagtacggcaacgccgtctacgtcgtccagcgggccttcgcgctctacccgtttgaggaaatagccttcagctttaatggtgggaaggattcaactgttctcctgcatttgattcgggctggttactacctttacaagaaggattctggtgatgtagcccaaatggatgctattaaaaactgtccattgcgtaccatctattttgaaagcccttgtgcttttcctgaaatcaactcattcacttatgagaccgtctcaacttacggattaccactggaaactatccattcagatttcaagtctggtctagaaggcctattgaaagaaaagccaaccaaagcaattttcattggcacaagaattggtgatccaaacgcggttggtcaagaacagttctctcctagttcacctggatggcctccttttatgagggtgaatccaatcttggattggtcatacagggatgtttggtcttttctcttaacatgcaaggtcaaatactgcagcctttatgaccaagggtatacttccattggaagcatacatgatactgttccaaatgcacttcttagtgattcatcaaccgagaaaagcttcagaccagcatacatgcttacagatggaaggcttgaaagagctggtcgaacaaaaaagactaatcacaaaatagaaatgaattctgttgcaagcaatggcatgaacaatattgagggagaacagatgatttcacgtgcggcttcaattattgtagtcggtgatgaaatattgtttggcacaactgaggataaactaggagcagcattgtgcaagaagcttcatgcaattggctggcgggtttctcatgtagcagttgttcgcaatgagattgattctgttgctgaagaagttgaacgttgtaaatctatggatgatatggtgtttatctttggaggacttgggcctctacattcagatgtttctgtggctggtgttgcgaaagcatttggagttcgtctggctcctgatgaagagtttgaggattatcttagtcaactcatgggaaacaattacactggtgatcgaaatgagatggcattgttgccagaaggtattactgaactactgcaccacaaaaagctactggtaccattgatcaaatgcagaaatgtcatcactcttgctgcaaccaatgtgcatgaactagatactgagtggggttgtcttctagacaatcaggagagtggtttagtgcaggcaaaacctttcgtgtcaaagcatctcggcactacactttcagatgttcaaattgctccagtccttgcaaaactgtgcttggagttttctgatgtttacatagggtgtcatcggatatcaagagctgggcctttggttgtaaatcttactggaaaggataaccagagggtggaggcagctgcacagaagctgacgagtagcttcgaaggacaatttttccaagtcggcaattgcaaataagctgtcagagtacacacttccgtattcttggcatattctttccgcctgaagctctgagattgtccaggactaatgatggtgctccactgccctaaaccaacgaccaaaataaaccaccgagctggtactctgaagcgacaaatattatttaggacacataggaattttgtactagaaattggtaactggctgggtctagcataacactagccttgcgcagctaatattttgatcgggttaagagcccataattattgattcaaaatcaattcaaaaaaaaaaaaaaaaaaaa

SEQ ID NO: 2800 - protein, 507 aa, Panicum virgatum
  misc_feature: Ceres CLONE 1786502
  misc_feature (1)..(165): Pfam Name: PAPS_reduct Pfam Description: Phosphoadenosine phosphosulfate reductase family
MEIDEAVRGCSDRRMRTKYGNAVYVVQRAFALYPFEEIAFSFNGGKDSTVLLHLIRAGYYLYKKDSGDVAQMDAIKNCPLRTIYFESPCAFPEINSFTYETVSTYGLPLETIHSDFKSGLEGLLKEKPTKAIFIGTRIGDPNAVGQEQFSPSSPGWPPFMRVNPILDWSYRDVWSFLLTCKVKYCSLYDQGYTSIGSIHDTVPNALLSDSSTEKSFRPAYMLTDGRLERAGRTKKTNHKIEMNSVASNGMNNIEGEQMISRAASIIVVGDEILFGTTEDKLGAALCKKLHAIGWRVSHVAVVRNEIDSVAEEVERCKSMDDMVFIFGGLGPLHSDVSVAGVAKAFGVRLAPDEEFEDYLSQLMGNNYTGDRNEMALLPEGITELLHHKKLLVPLIKCRNVITLAATNVHELDTEWGCLLDNQESGLVQAKPFVSKHLGTTLSDVQIAPVLAKLCLEFSDVYIGCHRISRAGPLVVNLTGKDNQRVEAAAQKLTSSFEGQFFQVGNCK

SEQ ID NO: 2801 - DNA, 1578 bp, Panicum virgatum
  misc_feature: Ceres CLONE 1786503
  misc_feature: Encodes the peptide sequence at SEQ ID NO. 2802
acggaaaagtatacttttcttttgggcccgaaattcacaagataaaaatgattttgacggccatctttgcccctaaacccagccgcaaaacgattactaaccaccagtatatatccctacacgcagcaccacccttgtggataaggctctgtccgtgcgctagttaattactactactaatcgtaccgcgccgccggccgccgccgccgctcccgccgcaaacgtacgccgctccgccactaccaccgcagccatatcatcgcaggagcacgcacgccacgcggcgaaccagacgtcccacgatgaccaatctggcaacgaccgcggcggcgtggaccagggaggaggacaaggcgttcgagaacgcggtcgcggtcaccgcggcgccgcccggggacgggccgcctgacgacggctggttcacggcgctcgccgcgagcgtgccggcgcggacggcggaggaggtgcggcggcactacgaggcgctgttggaggacgtggcctccatagaggccggccgcgtcccgctcccgcgctacgccggggaggagtccgccgccgcggcgcccgacagcgccgccggtgctgcgtccacgccgaaggacggcggcggcggaggggggcaccggcacgaggagcggaagagcggcgtcgacgtggggaagagctgctccaaggcggagcaggagcggcgcaagggcatcccgtggacggaggaagagcacaggttattcttgctggggctggacaagttcggcaagggcgactggcggagcatctcgcgcaatttcgtcatgtcgcggacgccgacgcaggtggcgagccacgcgcagaagtacttcatccgcctcaactccatgaaccgcgaccggcgccgctcaagcattcacgacatcaccagcgtcaccgcgggcgaggtcgcggcggccggcgccccgatcacgggcggccccgccgccgcaggcgcgatgccgatggggccagcaggcatgaagcaccaccacccgccggggccgccgatgggcatgtacgggcacgcgcccatgggccaccccgtcgccggccacatggtggcgcccgcggccgtcggcacgcccgtcatgttcccgccgggtcactcgccatacgtcgtgccggtgggctacccggcgccaccggccaagatgcaccaatgatcccggcccttacctgcacgatctcgatgcacttcttcttgctcatgcttttgcacatctgcaaagctgcaattgtttgcctttgttctttcttgatttctgttcatcttgtgtagccaaagccatccacccatccttccctgatctcccattgatgtaacatagatgacttgagagagtgcagggtaggcaggcgaataataagtatctgctgactgttgcaagagctacttataatcacacccagggaggctccagaaacgtgtaattagcatttagcagcagccttccagggtgcattggtctatcatttgtgcagagttggggattgatggattccatttagtggatgtaaattgattgcatatatctcatttgtgcagaaaaaaaaaaaaaaaaaaaa

SEQ ID NO: 2802 - protein, 290 aa, Panicum virgatum
  misc_feature: Ceres CLONE 1786503
  misc_feature: Great-hit functional homolog of the protein sequence given in SEQ ID NO 9344
  misc_feature (1)..(48): Pfam Name: Myb_DNA-binding Pfam Description: Myb-like DNA-binding domain
  misc_feature: Useful for making plants with modulated nitrogen use efficiency
MTNLATTAAAWTREEDKAFENAVAVTAAPPGDGPPDDGWFTALAASVPARTAEEVRRHYEALLEDVASIEAGRVPLPRYAGEESAAAAPDSAAGAASTPKDGGGGGGHRHEERKSGVDVGKSCSKAEQERRKGIPWTEEEHRLFLLGLDKFGKGDWRSISRNFVMSRTPTQVASHAQKYFIRLNSMNRDRRRSSIHDITSVTAGEVAAAGAPITGGPAAAGAMPMGPAGMKHHHPPGPPMGMYGHAPMGHPVAGHMVAPAAVGTPVMFPPGHSPYVVPVGYPAPPAKMHQ

SEQ ID NO: 2803 - DNA, 1412 bp, Panicum virgatum
  misc_feature: Ceres CLONE 1786516
  misc_feature: Encodes the peptide sequence at SEQ ID NO. 2804
aagtgcctgctcataatcaatcgtgtggttgagcaatcaggataggctctgacgtatacagtgccgttggcaaggccagatcgagctctcaggatgaagatgagcagcggcctggcaggcccggtggcgctggccgccgccgtgtgcctgctgctgccggcggcgagcctggcgcagctgcaggtggggttctacaacacctcctgccccaacgccgaggcactcgtgcgtcaggccgtcacggccgccttcgccaacaactccggcgttgcgcccgggctcatccgcctccatttccatgactgctttgtcaggggctgcgacgcctccgtcctcctgaccgtgaaccccgccggcggcaacaccgagcgcgacgccccgcccaacaacccgagcctgcgcggcttcgaggtgatcgacgccgccaaggccgccgtggagcgcagctgcccgcgcaccgtctcctgcgccgacatcgtcgccttcgcggcgcgcgacagcgtgaacctcaccggcaacaccttctaccaggtcccctcgggccgccgcgacgggcgcgtgtccaacgcgacggaggccctctccctcccggggcccaacagcacggcgcagaacctcaccgacggcttcggccgcaagggcctcagcgccgaggacatggtggtgctctccggctcccacaccatcggccgctcccactgcgcctccttcctgttccggaaccggcagcggctcgccgccgggaccatcagcccggcgtaccaggcgctgctggaggcgctgtgcccgcccaccacgggccagctcacccccaacaccacggagatcgacctcagcacgccggcgttgctggacaacaactactacaagctgctgccgctcaacctgggcctccacttctccgacgaccagctcatccggaacgcgacgctcgcgcccttcgccagcgccttcgccgccaacgagacgctctggaagcagaagttcgccgccgccatgatcaagataggcaacatcgaggtcaagactggcacgcagggggagatccgcctcaactgcagcgtcgtaaacccggggtcgtcgtgggccgccgggatcgagatgatgccgttccccgccggcacctcagatgctacagccggcgaggtcgccaccagctgatctcgatcggccgagatgttgtattcatgtgcgtgcgtgcataattatatatattgtagtgtgcccgatcggtgtacacaacaacttattgtttgttgcgtgcagtcgtcatcggtacacactacacactactggcctggtacgatgctgttacgtacggggtaatggaagtctgaataaaatttggttgcgtgacaatatttaggcaagcataactatagcttgcgatcgaaaaaaaaaaaaaaaaaaaa

SEQ ID NO: 2804 - protein, 355 aa, Panicum virgatum
  misc_feature: Ceres CLONE 1786516
  misc_feature (1)..(244): Pfam Name: peroxidase Pfam Description: Peroxidase
MKMSSGLAGPVALAAAVCLLLPAASLAQLQVGFYNTSCPNAEALVRQAVTAAFANNSGVAPGLIRLHFHDCFVRGCDASVLLTVNPAGGNTERDAPPNNPSLRGFEVIDAAKAAVERSCPRTVSCADIVAFAARDSVNLTGNTFYQVPSGRRDGRVSNATEALSLPGPNSTAQNLTDGFGRKGLSAEDMVVLSGSHTIGRSHCASFLFRNRQRLAAGTISPAYQALLEALCPPTTGQLTPNTTEIDLSTPALLDNNYYKLLPLNLGLHFSDDQLIRNATLAPFASAFAANETLWKQKFAAAMIKIGNIEVKTGTQGEIRLNCSVVNPGSSWAAGIEMMPFPAGTSDATAGEVATS

SEQ ID NO: 2805 - DNA, 1831 bp, Panicum virgatum
  misc_feature: Ceres CLONE 1786527
  misc_feature: Encodes the peptide sequence at SEQ ID NO. 2806
accccttctcccgtcttcacccccagctggagcgttccggccgacggcgtcgctcgatctcctagctcccgcggagccagcaaggggccgccggctgccgctctccgccgcgccgcgccagaatggctttcctcttcaacaaattccaggaggcggtcaaaacacttgctaagaaccccatgtttgctcgtgatccaagacatcttcaatttgaagctgatgtgaaccgtctgtttctctatacgagctattatcgtctgggagagaatgctgaagagaaggatgcagaggagattattgatttggctggcaaagcatctgttgccgaacagcagaatcaagtgcaggaaaatgtccactatcaacttacgcatatgtgccgagcaatggatggcattcttcgtcctgatataacaaatgacccgtcaaaagatccttcagaaacacatagctattctcggcgtagtggattgagttttgctgttggcggagctgcatctgcaaacaagcaaagtgcagctatccctgctacacggcctataactcgagcagaactgtcaaataaattcagggatcattttgggtacacccttgacatcagaccatctggaattcctcacaaagatgcaggccaaggtctgttcttatctggagaagcaaatgttggtgctgtccttgccatctatcctggtgttatatattcacctgcttattatcgatatatacctggatacccaagaattgatgcatgcaacaactatctgatcacaagatatgatggaacaataattgatgcaaaaccatggtctttggatggtgaaactagagatttatgggatggttcatatttggtggaccataacgctgtgccacctaaaggctcagataacaactctgatcgagtgtggagaatgcttagcaagcctcttgagaaaaatatgagggaaaattttggtgaagtgcttgaacgaagaaatccccttgcttttggtcattttgcaaatcatccaccaaaaggttcaagtcctaatgtcatgatctgcccatatgattttccgctgtcagagaagaacatgagagtatacatccctaacattacgtttggtggtgaagagcccattaagatgaagaggtttggctccttctatttcaagtctggaagttctgataatcaggctggggattctctagttctaaagacactagtattggtgagtacaagatccattcgcgatgaagagctcttccttaactaccgttacagtaactcaaagcggcgaccagaatggtatagccctgttgatgaagaagaggacaagaggagatggagctagttcagcacttctgtaccattctggctatgcaattgtttgctaacacttctgtttttcctggaaattgcaacagagcactaagctcctgaaatgagatggcagtttccggttcctattgtttggcctggcatttatcagcatgaaaaaagtagtccgcctccttgaaactctactcatgggtcgtttgtagcgcataaagaatactggttacattgttgttactccttttttgtgttccctatcccagtgatttaagggagattttatgaatccacaacaatagttttggcatggcatttatcatcatgagaaaaagtagagtgcctccagtaaactctactcgcgggtactttgtagcatataaagaatactgattacatttgttgttactccttttatgtgttccctacccccctgattgatttaagggagataaataatttatgaatctattgcctgatatcaaagtttactttgaaaaaaaaaaaaaaaaaaaa

SEQ ID NO: 2806 - protein, 403 aa, Panicum virgatum
  misc_feature: Ceres CLONE 1786527
  misc_feature: Great-hit functional homolog of the protein sequence given in SEQ ID NO 9369
  misc_feature: Useful for making plants with modulated oxidative stress sensitivity
MAFLFNKFQEAVKTLAKNPMFARDPRHLQFEADVNRLFLYTSYYRLGENAEEKDAEEIIDLAGKASVAEQQNQVQENVHYQLTHMCRAMDGILRPDITNDPSKDPSETHSYSRRSGLSFAVGGAASANKQSAAIPATRPITRAELSNKFRDHFGYTLDIRPSGIPHKDAGQGLFLSGEANVGAVLAIYPGVIYSPAYYRYIPGYPRIDACNNYLITRYDGTIIDAKPWSLDGETRDLWDGSYLVDHNAVPPKGSDNNSDRVWRMLSKPLEKNMRENFGEVLERRNPLAFGHFANHPPKGSSPNVMICPYDFPLSEKNMRVYIPNITFGGEEPIKMKRFGSFYFKSGSSDNQAGDSLVLKTLVLVSTRSIRDEELFLNYRYSNSKRRPEWYSPVDEEEDKRRWS

SEQ ID NO: 2807 - DNA, 1149 bp, Panicum virgatum
  misc_feature: Ceres CLONE 1786552
  misc_feature: Encodes the peptide sequence at SEQ ID NO. 2808
aaagcccactcgatcgatccgagtcagacagtctctctccgtacaccaagatattcaactcttcttcccccttctcctcctgtcgtgtcgtgtctccatctccttcgcctgcgcgcggcggcgttccgtaccgtacacagcgagcgatcatggaggtggaggtggaggcggcggcggtctccttcgccagcacgccggcggcgccgagcggcggcgcgggaggcggaggcaggagcatctcccgcctgctgccggcgcgcgtcgccggggcggtggcccggggcgtcgtcaccgtcgtcttcgcggcagtgggcgtggtcctcggggccgtgacgggcgcgctgatcgggctggccacggagagcggcctggtgcgcggcgccggcgtcggagccatctccggcgccgtcgtctccatggaggtcgtcgactcctccgtcgccatctggcgctcccacgactcggggatctggagcgtcctctacgtgctcgacgtgatctggagcctcctgaccggccgcctcgtgcgcgagaaggttgaccccgccgtgcagagcgccgtcgacagccagatgaacgcggtggactcgccgttcggggagatggcgccgacgttggcggacatgttcgagactggcgccgccggggcggcgaagggcatgccggccgccgccatcgaggcgctcccgtccgtgaccttcaccgagcgcgccgccaccggcgacgaccggaccggctgctccgtctgcctccaggaattcgaggccggcgagacggcgcggagcttgccggtgtgcgggcacacgttccacctgccgtgcatcgacgtctggctgctccgccacgcgtcgtgcccgctgtgccgccgcgcggtcgaggccgttgccgcgcctgcagagccccggcacgcggtgtacagtggttagcttagcactctttcgtgctcatgtcttcgtcgtcgctttcgagcttgaggacgtacggtgtacagatacagatactttagttccacgttggctatatacacgccatggttgtgaatatgttgtatagaggtccatgttgtaaatgattgattcttgtagaattgagtttttctctctgttagtaaaattatttttcattgttcaaaaaaaaaaaaaaaaaaaa

SEQ ID NO: 2808 - protein, 258 aa, Panicum virgatum
  misc_feature: Ceres CLONE 1786552
  misc_feature: Great-hit functional homolog of the protein sequence given in SEQ ID NO 9231
  misc_feature (1)..(42): Pfam Name: zf-C3HC4 Pfam Description: Zinc finger, C3HC4 type (RING finger)
  misc_feature: Useful for making plants with modulated nitrogen use efficiency
MEVEVEAAAVSFASTPAAPSGGAGGGGRSISRLLPARVAGAVARGVVTVVFAAVGVVLGAVTGALIGLATESGLVRGAGVGAISGAVVSMEVVDSSVAIWRSHDSGIWSVLYVLDVIWSLLTGRLVREKVDPAVQSAVDSQMNAVDSPFGEMAPTLADMFETGAAGAAKGMPAAAIEALPSVTFTERAATGDDRTGCSVCLQEFEAGETARSLPVCGHTFHLPCIDVWLLRHASCPLCRRAVEAVAAPAEPRHAVYSG

SEQ ID NO: 2809 - DNA, 1022 bp, Panicum virgatum
  misc_feature: Ceres CLONE 1786607
  misc_feature: Encodes the peptide sequence at SEQ ID NO. 2810
agacgagcgacgcccccaacgcacgcgagttgagctcttctcgttcggcggcggcggcggcggagatggcggcgaacctggaggacgtgccgtcgctagatctgatgcacgagcttctccgccgcatgaaatgcagctccaagcccgacaagcgcctcatcctcatcggcccacccggctctggaaaggaaactcagtctccccttattaaggatgaatattgcctgtgccatttagccactggtgatatgctgagggttgccgtggctgccaagactcctctaggaatcaaagctaaagaagctatggacaagggagagcttgtttccgatgacttggttgtggggatcattgatgaagccatgaagaaaccctcatgccagaatggtttcatccttgatggcttccctagaactgtcactcaagcacagaagcttgatgagatgttggcaaagcaaggtgctaatgttgacaaggtcctgaacttcgcaattgatgatgctatattggaagaacggattactggtcgttggatccacccagcgagtggtaggacttaccatacaaaatttgcacctccaaaggctccgggagttgatgatgtcactggagagccattgattcagaggagagatgatacagctgaggtcttgaagtcaaggcttgaagccttccacagacaaactgagcctgtgattgattactactccaagaagggcttagtggcgaacttgcctgcggagaaaccaccaaaggaagtgactgttgaggtgaagaaagctctctcatgatgaagtatccattcttgagcttaagcatgatgacatgtactgaagtcccttgttggggttccttcaaagtttatactgatgccgacatcctgcggtttccattttcaatttttcatttgtgcatctgcaccattttatcacatctttgacgagctcgggaattgtctgaataatttctgtttcaaatgagggaagctgtttttttggaactaaaaaaaaaaaaaaaaaaaa

SEQ ID NO: 2810 - protein, 241 aa, Panicum virgatum
  misc_feature: Ceres CLONE 1786607
  misc_feature (1)..(187): Pfam Name: ADK Pfam Description: Adenylate kinase
  misc_feature (1)..(241): SWISSPROT Homolog: EC 2.7.4.3 Adenylate kinase A
  misc_feature (2)..(241): SWISSPROT Homolog: EC 2.7.4.3 Adenylate kinase B
MAANLEDVPSLDLMHELLRRMKCSSKPDKRLILIGPPGSGKETQSPLIKDEYCLCHLATGDMLRVAVAAKTPLGIKAKEAMDKGELVSDDLVVGIIDEAMKKPSCQNGFILDGFPRTVTQAQKLDEMLAKQGANVDKVLNFAIDDAILEERITGRWIHPASGRTYHTKFAPPKAPGVDDVTGEPLIQRRDDTAEVLKSRLEAFHRQTEPVIDYYSKKGLVANLPAEKPPKEVTVEVKKALS

SEQ ID NO: 2811 - DNA, 792 bp, Panicum virgatum
  misc_feature: Ceres CLONE 1786612
  misc_feature: Encodes the peptide sequence at SEQ ID NO. 2812
aaaaatcagctcatcacagctctcttgatctctagctagagataagcaagcttcctcttcctctcggtcgagcgagcgagtgatcctctctcactcccaccaggagctcgggtaactcaaggaggccagaagaagaaatggcgtcgctgtcgatgaccagtagctcggtgcgggcgcagtggacgaaaaagcagaacaagctgttcgagcaggctctggccgtgtacgacaaggacacgcccgaccggtggcacaacatcgcccgcgccgtcggcggcaagtccgccgaggaggtcaggcgctactacgagctgctggaggaggacgtcaagcacatcgagtccggcaaggtgcccttccccgcctaccgctgccccggcggcgccggcgccggcgccggcgccctcggctacgaggccgacaggatgaagcatctgaagatctaggcgaacttcagaggatgatgatggtcgagaagaggctgctcagtgctcacgcacgtgtatatatgattgggacagcatgcatgtccatgctactcttagcaagtggtctggagaagcaagaagaatcagatgagatgcatgcatgttacaatcaattaataatttgtatggggtgatcgagtagtatcctagcctgtcacgcacgcgagatcgaccgacccatcgatctcccagcatgtgtccttcgtacccacgcgtatctgtattatatcctagctgcatctgtgtaccataccaatcaagaaacatgaacttgatattgatgcaaaaaaaaaaaaaaaaaaaa

SEQ ID NO: 2812 - protein, 102 aa, Panicum virgatum
  misc_feature: Ceres CLONE 1786612
  misc_feature: Great-hit functional homolog of the protein sequence given in SEQ ID NO 9276
  misc_feature (1)..(51): Pfam Name: Myb_DNA-binding Pfam Description: Myb-like DNA-binding domain
  misc_feature: The sequence is a functional homolog of  SEQ ID NO 510 in the  10/666,642 US patent application
  misc_feature: The sequence is a functional homolog of  SEQ ID NO 976 in the  11/435,388 US patent application
  misc_feature: Useful for making plants with altered Lignin content
  misc_feature: Useful for making plants with modulated low light sensitivity
  misc_feature: Useful for making plants with modulated growth and phenotype characteristics
MASLSMTSSSVRAQWTKKQNKLFEQALAVYDKDTPDRWHNIARAVGGKSAEEVRRYYELLEEDVKHIESGKVPFPAYRCPGGAGAGAGALGYEADRMKHLKI

SEQ ID NO: 2813 - DNA, 751 bp, Panicum virgatum
  misc_feature: Ceres CLONE 1786618
  misc_feature: Encodes the peptide sequence at SEQ ID NO. 2814
aagatacgctatccaaacctctcaaaaaccacaccgagcttgctcggctcggcagtcggcaacacagccggaaaatatccccttttcttatccatggaggcggccgcgctcacgatacgctccacctccctgcgtcccgccgccgccgctcctgcgcacggcaaccggcgggccgcgcgcgcggcggccgtgcctcgccgcagccgggcgccgggcggcagacttcgggctttgccgccggagctcagcgagatcctcagccccaagctggtgcccggctcgccgtccgacaccggcgacgtctcgtcgctcatcccagtcagtgctctgatgctgctcttctacttcgtgtccaactgggtggtgcctgagttgctcatgaagcggctccagcccaaggccgaggaccaagaggcatcagcagcggcatccatgtcgttctccggggacgccaccgatggccaatcggatggcgacgacgcccgtcctaagatccggctgaaggtgatgaggaagaagaagaacagaaaagcgcctgtggaggtctagcacgcatacacagtttacatgcatggaggcgtccctgatgattaagtattgacagacatcagaacaaagtgcctctgaagaagaaatgctacaggagtagtacttagcgttgtctgatatatatgcatattgtactttgtctcttctgaataaaacctacactgttattgtttgcgctgtagaaaaaaaaaaaaaaaaaaaa

SEQ ID NO: 2814 - protein, 151 aa, Panicum virgatum
  misc_feature: Ceres CLONE 1786618
  misc_feature: Great-hit functional homolog of the protein sequence given in SEQ ID NO 9520
  misc_feature: Useful for making plants with modulated nitrogen use efficiency
MEAAALTIRSTSLRPAAAAPAHGNRRAARAAAVPRRSRAPGGRLRALPPELSEILSPKLVPGSPSDTGDVSSLIPVSALMLLFYFVSNWVVPELLMKRLQPKAEDQEASAAASMSFSGDATDGQSDGDDARPKIRLKVMRKKKNRKAPVEV

SEQ ID NO: 2815 - DNA, 581 bp, Panicum virgatum
  misc_feature: Ceres CLONE 1786636
  misc_feature: Encodes the peptide sequence at SEQ ID NO. 2816
aacaacaagcaaagcaaagcctaccttcttcctgaacccaactccatcaaccaacgcaggctcgtcctagctagttccaccagcaacatgtcgaacaagtgcggcaactgcaactgtgctgacaggagcaagtgcacaaagggcaacagctatggcgtcttcttattcaacaccaaaagcagccccgtcaagcgccgcgaggaggaggaggtcgcccccggcaaaaacaacggcaagtgcaagtgcggcaccagctgcggctgcggcgccagctgcaactgcggccactgaaaaagcccgccgcgtcgtccatggcctgcgtgcacactccccatccagtacccatcctgtacctgtatgtacgtcgccaatcacagcgtataaataaaattaaataaaccgccatgcccgtgttgaatacttacgtacgtcgggtcctatgtgacctgctgcgtctccgctgctgtcgtgcatgtgaccagcaaccacctgtacctacctacctgtctttgtgacaacgcatgcatgtacttatctctgttatgtgcaatgaaatctactgtgtgctttgactactaagt

SEQ ID NO: 2816 - protein, 67 aa, Panicum virgatum
  misc_feature: Ceres CLONE 1786636
  misc_feature: Great-hit functional homolog of the protein sequence given in SEQ ID NO 9522
  misc_feature (1)..(62): Pfam Name: Metallothio_2 Pfam Description: Metallothionein
  misc_feature: Useful for making plants with modulated nitrogen use efficiency
MSNKCGNCNCADRSKCTKGNSYGVFLFNTKSSPVKRREEEEVAPGKNNGKCKCGTSCGCGASCNCGH

SEQ ID NO: 2817 - DNA, 1174 bp, Panicum virgatum
  misc_feature: Ceres CLONE 1786639
  misc_feature: Encodes the peptide sequence at SEQ ID NO. 2818
aagtccctacctcacccagcatctcaaattctcaagagtttgcagcagcggaaggaattcaaatctctttctttctatattctattcggcggcaattgacaattggatccaatccaatcagaattaagaagatgccttccgagaatttggccggcgccggctggaggcagaagcagaagcgccgccaccaccaccaccagcagcagcagcaccagcagcagcagcctggcctgcagatccgggaggtttgggcggacaacgtggatcgcgagttcaagctcatccgcgccgccatcgagcacttcccctacgtgtccatggacaccgagttcccgggcgtcatccaccgccccgccaagcaccccgccgccatgacccccaccgagcgctacgccctcatcaaggccaacgtcgacgcgctccacctcatccaggtcggcctcaccttcgccgcctccccctccgcgccgcccgcggtcgccttccaggtcaacctccgcgagttcgacccgcgcctccaccgccacgccccggactcgatcgccctcctcgccgccagcggcctcgacctcgccgcgcaccgcgctaggggcgtcagcgcgcgcgccttcgccgcgctgctcatgtcctcgggcctcgtctgcaacccgaaggtggcgtgggtcaccttccactccgcctacgacttcgcctacctcgtccggatcctcatgggccgcaagctgccgaggtcgctgcccgagttcctcaagtacgtgcgcgtctacttcgggcccgaggtctacgacgtcaagcacatgatgcgctcctgcggcctcttcggcgggctcgagcgcgccgccgccgcgctccaggtgcagcgcgcggcggggcggtgccaccaggccgcctccgacagcgtgctcacctgggacacgttcaggcagatgaagagactctacttcgcaaaggaaggcagcctccagctctgcgccggcgtgctcttcggactagagctccaagaggacgcctgcaacctcagatgatcgatcacacattcttgttgtacagagcagctcatcaattgctcctctcccgaaatggattcgatcgggacaataattaaattattaatacgaacagagagaaaaaagaatggttctttgattggttataaaaaaaaaaaaaaaaaaaa

SEQ ID NO: 2818 - protein, 297 aa, Panicum virgatum
  misc_feature: Ceres CLONE 1786639
  misc_feature (1)..(232): Pfam Name: CAF1 Pfam Description: CAF1 family ribonuclease
MPSENLAGAGWRQKQKRRHHHHQQQQHQQQQPGLQIREVWADNVDREFKLIRAAIEHFPYVSMDTEFPGVIHRPAKHPAAMTPTERYALIKANVDALHLIQVGLTFAASPSAPPAVAFQVNLREFDPRLHRHAPDSIALLAASGLDLAAHRARGVSARAFAALLMSSGLVCNPKVAWVTFHSAYDFAYLVRILMGRKLPRSLPEFLKYVRVYFGPEVYDVKHMMRSCGLFGGLERAAAALQVQRAAGRCHQAASDSVLTWDTFRQMKRLYFAKEGSLQLCAGVLFGLELQEDACNLR

SEQ ID NO: 2819 - DNA, 752 bp, Panicum virgatum
  misc_feature: Ceres CLONE 1786650
  misc_feature: Encodes the peptide sequence at SEQ ID NO. 2820
acagaataatcagcatcgtcagagtattccacacataggcccgccggagcatggccaagcagctggaagaccaccggagcgaggtcgaggtgggggcgatgacgacggagtggcagctggaaccgggcgtcgccagcaagctgttcgacgtcttcaccatggccggcctccgcgtcgacgccatcgagcccggccgcgccatgatctgctctttcacggtgccgccgcgccttacggacgcgagcaagcgcatgcatggaggggctttggcgtctctggtcgacctggtcggatcggccgcgttcttcgccggcggctcgccgacgacgggggtgtccctggagatcaccgtctcgtacctaaaagcagcccgtgcaaacgaggagatcgagatcgacgcgagggtcctgggcatcggcgcgacggcggggtgcgtgacggtggaggtcaggaagaaggccaccggcgaggtgatcgcgcacggccgccacaccaagtacctcgccgtctccagcaaactgtgatggatggatcgacggtcaggatgcatggatggagcacgcgcgcgaagcattaggtcgctcgcatacattattcctcgtgtaatacatactaagcacacggtcacggtccagctactacttgtttattatctccccaagtcccccgttgctaagcccttgtttagttgctttcaaaattctaaaattttacaagatttcccatcacatcaaaaaaaaaaaaaaaaaaaa

SEQ ID NO: 2820 - protein, 157 aa, Panicum virgatum
  misc_feature: Ceres CLONE 1786650
  misc_feature (1)..(75): Pfam Name: 4HBT Pfam Description: Thioesterase superfamily
MAKQLEDHRSEVEVGAMTTEWQLEPGVASKLFDVFTMAGLRVDAIEPGRAMICSFTVPPRLTDASKRMHGGALASLVDLVGSAAFFAGGSPTTGVSLEITVSYLKAARANEEIEIDARVLGIGATAGCVTVEVRKKATGEVIAHGRHTKYLAVSSKL

SEQ ID NO: 2821 - DNA, 909 bp, Panicum virgatum
  misc_feature: Ceres CLONE 1786672
  misc_feature: Encodes the peptide sequence at SEQ ID NO. 2822
cgagcgagctcctcccaggcacaggcgcacagcacggctagctagctagctgctagctagctagctgcgtggtcggtcgacatgggcgacggagcggccgccgtgccgagcaggttccgcacgatctgcgtcttctgcggcagcagcaccgggcaccggaaggtgttcgcggacgccgcgctcgagctcggccacgagctggtgcggaggggcatcagcctggtctacggcggcggcagcatcgggctgatgggcgtgattgcgcggacggttcgcgacggcggctgccatgtccttggggtgattcctaaagcgctcatgcctattgagatttcaggcgaaagtgtaggagaagtgaaggttgtagccgacatgcatcagaggaaagctgagatggctcgccaatctgaagcgttcgtcgctctcccaggtgggtatggaacaatggaggagttgttggagatgataacctggtgccaacttggaattcatgacaagccagtcggcttgctgaatgtcgatggttactacgacccgctgattgccctgtttgaaaagggggcaaccgagggcttcatcaaccctgactgcaggcaaatatttgtttctgcaccaaccgcaagcgagctgctgacaaagatggaggaggtagcccccgcgacgagctgggagatctcggagctcggctacgggaacgccggcgcaccggcagaagactcctagctagaactccatcacctgaagctgaagcgaagctctctccactgatgttgcatttgttttccccgctgtttcctcaaagtctccaaaccactcaactaggtatcggcgcgagctcggggcagtttcttgtctgaatccatcaggaaatcgaccccatcctcgtgttaaaaaaaaaaaaaaaaaaaa

SEQ ID NO: 2822 - protein, 213 aa, Panicum virgatum
  misc_feature: Ceres CLONE 1786672
  misc_feature (1)..(133): Pfam Name: Lysine_decarbox Pfam Description: Possible lysine decarboxylase
MGDGAAAVPSRFRTICVFCGSSTGHRKVFADAALELGHELVRRGISLVYGGGSIGLMGVIARTVRDGGCHVLGVIPKALMPIEISGESVGEVKVVADMHQRKAEMARQSEAFVALPGGYGTMEELLEMITWCQLGIHDKPVGLLNVDGYYDPLIALFEKGATEGFINPDCRQIFVSAPTASELLTKMEEVAPATSWEISELGYGNAGAPAEDS

SEQ ID NO: 2823 - DNA, 779 bp, Panicum virgatum
  misc_feature: Ceres CLONE 1786692
  misc_feature: Encodes the peptide sequence at SEQ ID NO. 2824
acagttgaccgttcacacacgagacaatcacagcgtccactagtgctgctgctaccgctaccagacgcctcctcgccgtcgccgaccgcgccgctcccaagtcccaaccccgcagtcccgcacacgcttctcttctccctctcctccgatggcgacgctgcagctcaaccacatcgcgcgggagacctccgacgtggcccgcctcgcggccttctacgaggccgtgctggggttcgagcgcgtgccgtccccggcctactcgggcttccaggtcgcctggctccgcctcccgggctcccccgacgtcgcgctccacctcatcgagcgggacccgaccgcggcccccgtcgcggtggggcccggcgccgagggcgcgccgccgtcgcagctgccccggcgccaccacctcgccttctccgtcgccgactacgacgggttcgtgaccgggctcaaggcgcgcgggaccgagctgttcgagaagacgcagcccgacggccgcacgcgccaggtcttcttcttcgaccccgacgacaatggcctagaagttactagctcagctgcaggcagtgataagtaagcatgatgtgctagctacttctgctttagcctgcaatgtaaatcgaagatgttaccagaccaagcttcgttgcgataaataaacccaaagcttataaagcaatgtacatttgctttcctatgttgtaacacgactctgttcgcgactggactctactgtatgacaaatgaagtttgaatgctaaaaaaaaaaaaaaaaaaaa

SEQ ID NO: 2824 - protein, 142 aa, Panicum virgatum
  misc_feature: Ceres CLONE 1786692
  misc_feature: Great-hit functional homolog of the protein sequence encoded by LOCUS At2g32090
  misc_feature (1)..(124): Pfam Name: Glyoxalase Pfam Description: Glyoxalase/Bleomycin resistance protein/ Dioxygenase superfamily
  misc_feature: Useful for making plants with modulated nitrogen use efficiency
MATLQLNHIARETSDVARLAAFYEAVLGFERVPSPAYSGFQVAWLRLPGSPDVALHLIERDPTAAPVAVGPGAEGAPPSQLPRRHHLAFSVADYDGFVTGLKARGTELFEKTQPDGRTRQVFFFDPDDNGLEVTSSAAGSDK

SEQ ID NO: 2825 - DNA, 690 bp, Panicum virgatum
  misc_feature: Ceres CLONE 1786731
  misc_feature: Encodes the peptide sequence at SEQ ID NO. 2826
ggacaaacagtcacggagccgaaggtgaggtgagaggcagaccaccatgagcgctctcaagttctgcagcgaatgcaacaacatgctgtacccgcgggaggacaaggagacgcgcaccctcctctacgcttgccagttctgcgagcaccaggaggttgcttccgatacttgtgtgtacaaaagggttctccgtaagcctttgggtgaacccaaggatgtcctaaaggatgtagcagctgatcctagtctgcctcgcaccagaagtgttagatgctacaactgcaaccatccagaagctgcttttttccaggctccaactaagggagagcaagccatgacgctgtacttcatctgctgcaacccgagctgtggccacaggtggagggactgaggacccggatctgggaaatcagttccaaaaggatcactattcactccagaaaacttagtcgtagactagcagatcttggcatgaaccttcaccgggattggaacggtgccgcagttaagaagacttgggtgcaaacctgctggctgggtaaatgttgtcaacaagatcaggtgcagtctcgtgtcttaatttgcgggtgttgcacgcttataagcgaaaggtggtcgtgatctgaaaagaaaaactattccgtggattgcaatgcactgtagtttgtactaaaaaaaaaaaaaaaaaaa

SEQ ID NO: 2826 - protein, 114 aa, Panicum virgatum
  misc_feature: Ceres CLONE 1786731
  misc_feature (1)..(55): Pfam Name: RNA_POL_M_15KD Pfam Description: RNA polymerases M/15 Kd subunit
MSALKFCSECNNMLYPREDKETRTLLYACQFCEHQEVASDTCVYKRVLRKPLGEPKDVLKDVAADPSLPRTRSVRCYNCNHPEAAFFQAPTKGEQAMTLYFICCNPSCGHRWRD

SEQ ID NO: 2827 - DNA, 1053 bp, Panicum virgatum
  misc_feature: Ceres CLONE 1787107
  misc_feature: Encodes the peptide sequence at SEQ ID NO. 2828
aaatccacacatcatcccgggacagtcggacagcatccacagacaaaatccgtgttttgttttcctagaatcccggaacagaagaggaaacactaaagaaagaaagaaactgagcatggccagctcgcactgctttgagaacccgccggcgctgaacccggccggcggagtcggcgaggtcgtcgatgacttcggcgggatgaaggcctacgtcgccggctccgcggggtccaaagccgctgtcgtcctcgtctccgacgccttcgggttcgaagcgccaaacctgaggaagatagccgacaaagttgcttcgtctggttactttgttgtggtgccagatttcctgcatggggatccatatgaccacagcaaccccaacaatcctggaatgtggatgcaatcacataatccgcaaaaagcatttgaagaggcaaaaccagtaattgctgctataaaggagaagggagtgccgaacataggggctgctggctattgttggggtgcaaaggtggttgtcgagctggcaaaagttcatgagatccaggctgctgtattgttacatccttctttaataactgttgatgacatcaaagatgtcaaatgtcccatttctatacttggagctgaaatcgacaagttatccccgcctgaattgttaaagcagtttgagcaggttctttcagctaactcgggggtcgaccacgttgtcaagatttttcccggagtagcgcatgggtgggctgtgagatacagcgatgaagacgcagcagctgtcagtagtgctgatgaagctctgcaagacatgagccactggtttaacaagtacctaaagtgaaatctgaagttgcagctctccgtgtaataatcctgacagtgatcattatccagccataccgtgtttgtgctgatatggttcactaggacctgcgtcttggttgggtaggtggtactgtttctatacttaagcttctgcttgtgtatgcatgctacgtaattagcagcacacctttttgtcgtacaattattttctgccaaaaaaaaaaaaaaaaaaaa

SEQ ID NO: 2828 - protein, 239 aa, Panicum virgatum
  misc_feature: Ceres CLONE 1787107
  misc_feature (2)..(210): Pfam Name: DLH Pfam Description: Dienelactone hydrolase family
MASSHCFENPPALNPAGGVGEVVDDFGGMKAYVAGSAGSKAAVVLVSDAFGFEAPNLRKIADKVASSGYFVVVPDFLHGDPYDHSNPNNPGMWMQSHNPQKAFEEAKPVIAAIKEKGVPNIGAAGYCWGAKVVVELAKVHEIQAAVLLHPSLITVDDIKDVKCPISILGAEIDKLSPPELLKQFEQVLSANSGVDHVVKIFPGVAHGWAVRYSDEDAAAVSSADEALQDMSHWFNKYLK

SEQ ID NO: 2829 - DNA, 867 bp, Panicum virgatum
  misc_feature: Ceres CLONE 1787181
  misc_feature: Encodes the peptide sequence at SEQ ID NO. 2830
gttcgagttcagcccgttgaggccgtagctaagcaaacagagaaggcggagccaaaggtcccaaacaacccccgtcttgctgtctctgcccccctgcgcatcagcagttcagcaccccactcgccgccgccggagacatgaaccagccggtgcagaagaacaccctctatgtcggtggcctggcggaggaggtggacgagaagatcctgcacgcggcgttcgtgcccttcggcgaggtcaaggacgtcaagacgccgctcgaccagtccacgcagaagcaccgctccttcgggttcgtcaccttcctcgagcgcgaggacgccgccgccgccatggacaacatggacggcgccgagctcttcggacgtgtcctcaccgtcaactacgccttccccgagcgcatcaagggaggggagcagggatgggccgcgcagccgatttgggctgatgcggacacttggttcgagaggcagcagcaggaagaggagatgcagcgtctgcaggcagagcagcgcgcggcaatgcaagtagcagagaagctgcacagagagaaacttgctgccgaaagagaaggtgagaaagaagaggaggcggatcccatggctgcagcagaagctcaggccttgaagcagagttcttaagaactggatatagacttaagaacatctgccgctttcctgtccatttgtcaaatacacatgcttttctcggccgtggttaaggtgttgctaacatgctagacttgggagtgatgtttgtttagtttgaaagaatcctatttgtcttaacgtgggatgctttgtgttttgtttggccttctgatagactaatatgtactgcacgctcgaaaaaaaaaaaaaaaaaaaa

SEQ ID NO: 2830 - protein, 167 aa, Panicum virgatum
  misc_feature: Ceres CLONE 1787181
  misc_feature: Great-hit functional homolog of the protein sequence given in SEQ ID NO 9455
  misc_feature: Useful for making plants with altered Lignin content
  misc_feature: Useful for making plants with altered terpenoid content
MNQPVQKNTLYVGGLAEEVDEKILHAAFVPFGEVKDVKTPLDQSTQKHRSFGFVTFLEREDAAAAMDNMDGAELFGRVLTVNYAFPERIKGGEQGWAAQPIWADADTWFERQQQEEEMQRLQAEQRAAMQVAEKLHREKLAAEREGEKEEEADPMAAAEAQALKQSS

SEQ ID NO: 2831 - DNA, 918 bp, Panicum virgatum
  misc_feature: Ceres CLONE 1787224
  misc_feature: Encodes the peptide sequence at SEQ ID NO. 2832
aaaaaaaaatctcacgcctgcacaccccacctctcgccctctcgccgtcgccgtcgccgtccatggagtccgtcgcggccgccgcgatcgccaccacctcccggtccctcccgctccccttctcctctacgccgctccaccgccggcgccgtcccgccttcctccccgtcgccgcctccaagcgtcataacgacgacgacgtcaaggaagccgcaaatggccccgggcgcgagcccaccggccttgcgccgcacgggctctccatctcaccgctctccaaggacgcggccatggggatagtggtgagcgctgccacggggagcggctggacgacgggatcgggcatggaggggccgccaacggcgagcagagccggtggggcggacaggccagaggtgtcgacgctcccttggtcgctcttcacaaaatcgccgcggcgccggatgcgggtggccttcacctgcaacgtgtgtgggcagcgtacaaccagggccatcaatcctcatgcctacaccgatggaactgtgtttgttcagtgctgtggttgcaatgtattccataagttggtcgacaacctgaacctgtttcatgagatgaagtgctacgttggtccagacttccgctacgaaggagatgctccattcaactactttgacaataacgaggatggcgatactatcttccctctctaaaccctctcccttatgttccagtgcatgatgttgttctaatttgctcgtgtagctgtatgtaataagcagatgaaccttcctgaacttgtaatatgatacagatgtatataattgtttgtacttaactagtgcagagcttgtgctgcaaaatttatacaggtagtagtagataatggaatagatatgggcgtttatgcgtttggcctaaaaaaaaaaaaaaaaaaaa

SEQ ID NO: 2832 - protein, 209 aa, Panicum virgatum
  misc_feature: Ceres CLONE 1787224
  misc_feature (1)..(64): Pfam Name: zf-DNL Pfam Description: DNL zinc finger
MESVAAAAIATTSRSLPLPFSSTPLHRRRRPAFLPVAASKRHNDDDVKEAANGPGREPTGLAPHGLSISPLSKDAAMGIVVSAATGSGWTTGSGMEGPPTASRAGGADRPEVSTLPWSLFTKSPRRRMRVAFTCNVCGQRTTRAINPHAYTDGTVFVQCCGCNVFHKLVDNLNLFHEMKCYVGPDFRYEGDAPFNYFDNNEDGDTIFPL

SEQ ID NO: 2833 - DNA, 891 bp, Panicum virgatum
  misc_feature: Ceres CLONE 1787238
  misc_feature: Encodes the peptide sequence at SEQ ID NO. 2834
gcatccagcacacacagttgagttgatcgataaggcgccatggcttcttccacgaccaccctgtcctttgtcttcgtcctggccttgctgctctcatgcggtggcgtcagcaacgcggcgcggcggatgcaggagctcccgaagcccgacgtggcgccgctgcccaagcctgaggacccgatgcctgagccgctgccggtgcccccacagcccctgcccaagcccgaggagccgaagccggagccgctgccggtaccaccacagcccctgcccaagcctgagccacttcccgtgccaccacagcccctgcccaagcctgagcccctgcccgtgccaccacaacccctgccgaagcctgagccgcttcctgtgccaccacagcccttgcccaagcctgagcccctgcccatgccaccacagcccctgcccaagcctgagccacttcctgtgccaccacagcccttgcccaaacctgagccgttgccggtgccaccacagcccctgcccgtgccaccacagccgaagcctgagcccctgcccgtgccaccacagccgaagcctgagccgttgcccgtgccaccgcagcccctgccccaaccggagctgccggtgccgccgaagccatgatcgatgagccatggcaactttacaggcgcatattattgacacggcgctccagtgattattttctattgtattttgctcattcgtgtgaccatgcgtgatgctttcaccgatttgtttagcaagtgtatcagatttgcagtgtggaacggtgtgcattgccatgccatctcatctgatccggccgtgatctatgtattctggctgagatccatgtgtataaataaataaatggattcgtttgtacaaaaaaaaaaaaaaaaaaaa

SEQ ID NO: 2834 - protein, 195 aa, Panicum virgatum
  misc_feature: Ceres CLONE 1787238
  misc_feature (60)..(133): Pfam Name: Trypan_PARP Pfam Description: Procyclic acidic repetitive protein (PARP)
  misc_feature (89)..(249): Pfam Name: Peptidase_M10_C Pfam Description: Peptidase M10 serralysin C terminal
MASSTTTLSFVFVLALLLSCGGVSNAARRMQELPKPDVAPLPKPEDPMPEPLPVPPQPLPKPEEPKPEPLPVPPQPLPKPEPLPVPPQPLPKPEPLPVPPQPLPKPEPLPVPPQPLPKPEPLPMPPQPLPKPEPLPVPPQPLPKPEPLPVPPQPLPVPPQPKPEPLPVPPQPKPEPLPVPPQPLPQPELPVPPKP

SEQ ID NO: 2835 - DNA, 655 bp, Panicum virgatum
  misc_feature: Ceres CLONE 1787372
  misc_feature: Encodes the peptide sequence at SEQ ID NO. 2836
atagctagatcgatcggtctcaacagaccccggccgatcagtgctccagatcgaacgacgacgacaatggcttccggcggcgggtcgtcgtcgtctaacagcagcaggggctcgtcgtcgtcccgcgggtggacgcagcggcagaacaagcagttcgagtgcgcgctggcggtgtacgacagggagaccccggaccggtggcacaacgtcgcccgctacatgggcggcgccaagtccgccgacgaggtgcgccgccacttcgagcagctcgtcgccgacgtcgcccagatcgaggccggccgcgtccccttcccacgctacgccgccgacgacgacgcggcggcggccaccagcagcaggaccaagtatctcaagttccagtgatgatcaagacaaaatgacggcgccagatcgagaccatgtccccgagtctccgagatgacacgacgcatgcatatatagtgatagattataggtgtgtagggtgtaataatcactgtgtggctggatatattggatccaaatatggatgtaatttagggaagaaaagtacttttcaacctcatgttgtgtaaattagctaattattaagctggttttcatcggtactatatgctcgttatatcacaagaagcaatgtaaaatgtttcggggg

SEQ ID NO: 2836 - protein, 105 aa, Panicum virgatum
  misc_feature: Ceres CLONE 1787372
  misc_feature (3)..(51): Pfam Name: Myb_DNA-binding Pfam Description: Myb-like DNA-binding domain
MASGGGSSSSNSSRGSSSSRGWTQRQNKQFECALAVYDRETPDRWHNVARYMGGAKSADEVRRHFEQLVADVAQIEAGRVPFPRYAADDDAAAATSSRTKYLKFQ

SEQ ID NO: 2837 - DNA, 789 bp, Panicum virgatum
  misc_feature: Ceres CLONE 1787415
  misc_feature: Encodes the peptide sequence at SEQ ID NO. 2838
acccaccctggcggctggcgcagctcatcgcattagaccgaccctagctcacaagtgtctccttgtttatttcgtttcgtggtgcccacgcacaacatggcggaggccacgactgagcctgctccggcggcggcggagggcgccggttcgggggagcagcagcagaagacggtggtggtggtcggggtggacgacagcgaccacagctaccacgcgctcgagtggacggtgcgccacgtggcggcgggcatggcgggcgctgccgacctcgtcatcgtccacgccaagccctcgccgtcctccgtcgtcagcttcggcgggcccggagccggcgaggccatgaggtacgtggaggccgacctgcgcaagatggccgaagccgtcgtcaacaaggcgcgccgcctctgcatcgccaactcggtgcacgctctgatcgaggtgatcgagggggagcccaggtacgtgctctgcaacgcggccgagaagcaccacgccgacctgctcgtcgtcggcagccatggctacggcgccatcaagagggctttcctggggagcgtgagcgactactgcgcgcaccacacgcactgctccgtcatgatagtgaagcgacccaagcccaagtgctgagctccggtgctctgctcgtcaggtccatactgctctgctccggtgatgatactggactagcgaaatgctgatcatgtacctgcaacagcctcttcagctgtgtgtctgtcaacaaatgatatttattttgtggtgttcgtgcaaaaaaaaaaaaaaaaaaaa

SEQ ID NO: 2838 - protein, 176 aa, Panicum virgatum
  misc_feature: Ceres CLONE 1787415
  misc_feature (1)..(150): Pfam Name: Usp Pfam Description: Universal stress protein family
MAEATTEPAPAAAEGAGSGEQQQKTVVVVGVDDSDHSYHALEWTVRHVAAGMAGAADLVIVHAKPSPSSVVSFGGPGAGEAMRYVEADLRKMAEAVVNKARRLCIANSVHALIEVIEGEPRYVLCNAAEKHHADLLVVGSHGYGAIKRAFLGSVSDYCAHHTHCSVMIVKRPKPKC

SEQ ID NO: 2839 - DNA, 950 bp, Panicum virgatum
  misc_feature: Ceres CLONE 1787540
  misc_feature: Encodes the peptide sequence at SEQ ID NO. 2840
cactaacccgcaactcagacctccctccctttcgatccggccccctcgcgcctccgccgcctcgtcgccgtcgaggtcgctccaccatggcggcgctcctagcccggcaggccgcgcaggcgctccgcgcgaagcagacggcgcagctcggcccggccgcgacggcgatgcaggggcacctccggacctacatgaacgccgggacgcccaagaggttcaaagaggatgaggagaaagaacagcttgcgaaggagatcgcaaaagattggaatgctgtgtttgaaaggagcatcaatacattgtttctgactgaaatggtccgtggtttgagtctgacgttgaagtacttcttcgagaggaaagttactattaactatccctttgagaagggtcctctgagtccccgcttccgaggagagcacgctctcagacgttatgaatctggggaagagcgttgcattgcttgtaaactatgcgaggctatatgcccagctcaggcaattacaattgaggctgaagaacgtgaagatggcagtcgcagaaccacaaggtatgatattgacatgaccaaatgcatttactgtggtttctgccaagaggcttgcccagttgatgctattgttgagggacctaactttgagtttgctactgagacccacgaggaactgctgtacgacaaggagaaactgcttgagaacggcaaccgctgggagaccgagattgctgagaacttgagatctgagagcctctatcgctgaatttttcttcccttgtgatctataaaactgttggttccaccatttccttgttttgctgatctagctgataaataagccaactataacttgggtaccaggtaccatgtttctgtacctcgacaccgtctgactattgttgtattcaaagtgccagagtgaaggtgcactgcagaaaaaaaaaaaaaaaaaaaa

SEQ ID NO: 2840 - protein, 223 aa, Panicum virgatum
  misc_feature: Ceres CLONE 1787540
  misc_feature (1)..(223): SWISSPROT Homolog: EC 1.6.5.3 NADH dehydrogenase [ubiquinone] iron-sulfur protein 8, mitochondrial precursor
MAALLARQAAQALRAKQTAQLGPAATAMQGHLRTYMNAGTPKRFKEDEEKEQLAKEIAKDWNAVFERSINTLFLTEMVRGLSLTLKYFFERKVTINYPFEKGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGNRWETEIAENLRSESLYR

SEQ ID NO: 2841 - DNA, 1006 bp, Panicum virgatum
  misc_feature: Ceres CLONE 1787546
  misc_feature: Encodes the peptide sequence at SEQ ID NO. 2842
caagcaccggccgccggccggcgggcagcagccatctctgccctcctcctctccctcctgctcctgtataaatagcagcagcatgctgctgcagcagcaagcaagcaattccatcaaccaacatcgtttgtagattttgcagcgttgggtacagacccaatcaagaacaagaagctagcagagcaactgagcaagcgatggcgccgcccaaggtgtacggatgggcgatctctccgttcgtgtcgcgcgcgttgctggccctcgaggaggccggcgtcgactacgagctcgtccccatgagccgcccggacggcgaccaccgccgcccggagcacctcgccagaaaccctttcggtcaggtgccagttcttgaggacggcgacctcacgctcttcgagtcccgggcgatcgcgaggcacgtcttccgcaagcacaagccggagctcctgggcgccggcagcctggagcggtcggcgatggtggacgtgtggctggaggtggaggcgcaccagctgaccccggcggcggcccccgtcgtggtggagtgcgtcttcgcgccgttcctcggccgcgcgcgcaaccaggcggccgtcgacgagaacctcgggaagctgcggaaggtgctggaggtgtacgaggcgcggctggcgcagagcaggtacctcgccggcgacttcctcagcgccgccgacctcagccacttcaccatcatgcactacttcatggccaccgagtacgcggcggtcgtggaggcgctcccgcacgtgagggcgtggtgggaggagctcgccgcgcggccggcggcgaggaaggtggcggagttcatgccggtcggcgctgggccggccaagaaagacgagtgaccaccgatcaagttgtggtggtgttgtgcttaatttcccgtcgtgcgggtttctacttctatccttgtaataaaatgcagctgctttcagcgttcataattcacagaaatcttgtcctggaccaaaaaaaaaaaaaaaaaaaa

SEQ ID NO: 2842 - protein, 221 aa, Panicum virgatum
  misc_feature: Ceres CLONE 1787546
  misc_feature (1)..(96): Pfam Name: GST_C Pfam Description: Glutathione S-transferase, C-terminal domain
  misc_feature (4)..(76): Pfam Name: GST_N Pfam Description: Glutathione S-transferase, N-terminal domain
  misc_feature (1)..(214): SWISSPROT Homolog: EC 2.5.1.18 Glutathione S-transferase I
  misc_feature (1)..(221): SWISSPROT Homolog: EC 2.5.1.18 Glutathione S-transferase IV
MAPPKVYGWAISPFVSRALLALEEAGVDYELVPMSRPDGDHRRPEHLARNPFGQVPVLEDGDLTLFESRAIARHVFRKHKPELLGAGSLERSAMVDVWLEVEAHQLTPAAAPVVVECVFAPFLGRARNQAAVDENLGKLRKVLEVYEARLAQSRYLAGDFLSAADLSHFTIMHYFMATEYAAVVEALPHVRAWWEELAARPAARKVAEFMPVGAGPAKKDE

SEQ ID NO: 2843 - DNA, 671 bp, Panicum virgatum
  misc_feature: Ceres CLONE 1787642
  misc_feature: Encodes the peptide sequence at SEQ ID NO. 2844
atgtttatccttgccaaggactcacggatacagaggccattataggggttgaagccagctcaaaatagcctcaccgttccaggtaacaactggcccttctaatggatagcagaggaagcagccgggacaagaagtccaaagataacgatcgtcatgaagcaaaagaagctaatagcactgcacagaattttgttgacttcacagaagcagaggaagatcttgtttccagaatgcacaggcttgtggggaacaggtgggagcttatagcaggaagaattccaggaaggacagcagaagaagtagagatgttttggtccaaaaaacaccaggaaaaatgaaaacgaggccattactttatattgatctataagctatgtattaatatcacatgaaaatatgtgctgataaataatgttaaacatgcaaagttgaagaaagccatatagtattatgagcttactcaaggagcaatgtggattggcacttcaagttaagttagcagagttaactctgttcatttcgtaattgcatcatgttataacattagcagttattttgtatttaaaaacaccaggaaatgtgcattatgttgtagaagattcatggcagtataatatgctacagataaaaagatgagtacagttggctcttaaaaaaaaaaaaaaaaaaaa

SEQ ID NO: 2844 - protein, 78 aa, Panicum virgatum
  misc_feature: Ceres CLONE 1787642
  misc_feature: Great-hit functional homolog of the protein sequence given in SEQ ID NO 9748
  misc_feature (1)..(46): Pfam Name: Myb_DNA-binding Pfam Description: Myb-like DNA-binding domain
  misc_feature: The sequence is a functional homolog of  SEQ ID NO 1049 in the  10/412,699 US patent application
  misc_feature: The sequence is a functional homolog of  SEQ ID NO 1050 in the  10/412,699 US patent application
  misc_feature: The sequence is a functional homolog of  SEQ ID NO 1064 in the  10/666,642 US patent application
  misc_feature: The sequence is a functional homolog of  SEQ ID NO 1065 in the  10/666,642 US patent application
  misc_feature: The sequence is a functional homolog of  SEQ ID NO 2133 in the  10/666,642 US patent application
  misc_feature: The sequence is a functional homolog of  SEQ ID NO 328 in the  11/435,388 US patent application
  misc_feature: The sequence is a functional homolog of  SEQ ID NO 330 in the  10/714,887 US patent application
  misc_feature: The sequence is a functional homolog of  SEQ ID NO 558 in the  10/374,780 US patent application
  misc_feature: The sequence is a functional homolog of  SEQ ID NO 559 in the  10/374,780 US patent application
  misc_feature: Useful for making plants with modulated biomass
  misc_feature: The plant is abnormally small.
  misc_feature: Useful for making plants with modulated growth and phenotype characteristics
MDSRGSSRDKKSKDNDRHEAKEANSTAQNFVDFTEAEEDLVSRMHRLVGNRWELIAGRIPGRTAEEVEMFWSKKHQEK

SEQ ID NO: 2845 - DNA, 1444 bp, Panicum virgatum
  misc_feature: Ceres CLONE 1787717
  misc_feature: Encodes the peptide sequence at SEQ ID NO. 2846
aaaacaccgcgaagcgtgaaaagaaaatggaggcatgagcactagcgcctccgcgtcctcctcctccgtcctcgtcgatcccctcgaagccccctcgcccccgcggccctcgtcgtcggcgggctcgccgggtgccgcgctcccccttctcctcctcggctgcgccggcggcggcggagggaactaggtaaggggaggcggaggggaaggttgaggtagagcggagcggcagcgacgatgccgtcgcacgcggatctggaccgccagatctcgcagctgcgggagtgcaagttcctggcggaggcggaggtcaaggcgctctgcgagcaggccaaggcgatcctcatggaggagtggaacgtgcagcccgtgcgctgccccgtcaccgtctgcggcgacatccacggccagttctacgacctcatcgagctcttccgcatcggcggcgacgcgcccgacaccaactacctcttcatgggcgactacgtcgaccgtggctactactcagtggagactgtgacattgttagtggctctaaaagtacgttatagagacagaatcacaatattgagaggaaatcatgagagcagacaaataactcaagtgtatggcttctatgatgaatgcttacggaaatatggaaatgcaaacgtgtggaagtacttcacagacttgtttgactatttacctctcacagctcttatagaaaatcaggtcttctgcctacatggtggtctctctccatcgctggatacattggataatatccgtgctctcgatcgcatgcaagaggtcccacatgaagggcctatgtgtgatctgttgtggtctgacccggatgatcgatgtggatggggaatttcaccaaggggtgctggatacacatttgggcaagatatcgcgcagcaattcaaccatacaaatggactaacacttatttcaagggcccatcaacttgtaatggaagggttcaattggtgtcaggataagaatgttgtgacggtgttcagcgcaccaaattactgctaccgatgcggtaacatggctgcgatcctcgaaatcggagagaacatggatcagaacttcctccaattcgacccagctccacggcaaatcgagccagacatgacacgcaagaccccggactactttttgtaatcgtcatgttggctctttttaacttctctctgccgcaggcctgggtctgtagatctgccgttagaatatctgtttcctcagccaccttgtacccctcctcattctttggtgtggagattttgttgccgcttctcagaacttcatagagcatgttaaaagtacgtgacattgggattttctttcttttttttatttggctgtacctccattttgtattattctgagacacaagagaagagaagctgcaatagaatacagcgtaatataaaaaaaaaaaaaaaaaaaa

SEQ ID NO: 2846 - protein, 306 aa, Panicum virgatum
  misc_feature: Ceres CLONE 1787717
  misc_feature (1)..(196): Pfam Name: Metallophos Pfam Description: Calcineurin-like phosphoesterase
  misc_feature (1)..(306): SWISSPROT Homolog: EC 3.1.3.16 Serine/threonine-protein phosphatase PP2A-1 catalytic subunit
  misc_feature (1)..(306): SWISSPROT Homolog: EC 3.1.3.16 Serine/threonine-protein phosphatase PP2A-3 catalytic subunit
MPSHADLDRQISQLRECKFLAEAEVKALCEQAKAILMEEWNVQPVRCPVTVCGDIHGQFYDLIELFRIGGDAPDTNYLFMGDYVDRGYYSVETVTLLVALKVRYRDRITILRGNHESRQITQVYGFYDECLRKYGNANVWKYFTDLFDYLPLTALIENQVFCLHGGLSPSLDTLDNIRALDRMQEVPHEGPMCDLLWSDPDDRCGWGISPRGAGYTFGQDIAQQFNHTNGLTLISRAHQLVMEGFNWCQDKNVVTVFSAPNYCYRCGNMAAILEIGENMDQNFLQFDPAPRQIEPDMTRKTPDYFL

SEQ ID NO: 2847 - DNA, 1670 bp, Panicum virgatum
  misc_feature: Ceres CLONE 1787724
  misc_feature: Encodes the peptide sequence at SEQ ID NO. 2848
gaaagccaatccaaatcacatgggaatggggtggattggttgattgatcatccaaggacgaagcgacgcaagaagtcaatcacgatcatcacatgcgttttgtcatttcgtctgactagttgaagagtcctgctcgcttctctctccctcgggtcagtccaatccggaggagttgggtgggagagtggccatccgcgagaagaaggatggcgagcagcaacggcaagccggcggcggcggaggaggggaaggcggcggcggaggggtcgatcggcgggtatgagtccctgcacagcctgctggaggccaacctctcccccgagctcttccaggaagcaagccggttgctgttggggctgaattgtgcacgccctcttgaggctatcgcactgcctgaagccacaatgactcttgcagaaacgcataattttgatgtgcaggccttccgttttagtgcagataaagagtttcttaggcagccacgagttgttcgagttggtctaattcagaactcaattgctgttcccactacttgtcattttgctgagcaaaagaaggctatcatggataaaattagacccatcgttgatgcagctggtgcttctggtgtcaatattttgtgcttacaagaagcctggacaatgccttttgcattctgcacacgtgagaaaagatggtgtgagtttgctgaaccggttgatggagaatctactcagttccttcaagaacttgcacaaaagtataacatggtaattgtgaacccaatcctcgaaagggatgtaaaccatggggagactatttggaatactgctgtcgtaattgggaataatggcaacataattggcattcatcgaaagaatcatatcccaagagttggtgatttcaatgagagtacatactacatggagggtaacactgggcatccagtgtttgaaacagcttatggcaaaataggagtcaacatttgttatggaagacatcatccacttaattggcttgcatttggcctcaacggagctgaaatagtgttcaacccatctgcaactgttggtgaactcagcgaaccaatgtggcctattgaggcaaggaatgccgcaattgcaaacagctacttcgttggatcaattaaccgggttggcacagaagtgttcccaaatcctttcacatctggtgatgggaaacctcagcatgcagacttcggccatttctatggatctagccatttctcagcaccggacgcttcttgcaccccatcactatcacgctaccgagatggcttggccatctccgatatggatctcaacctatgccgccagataaaagacaagtgggccttccgcatgactgctcgttatgatatgtatgcttccttgctatcagagtacttgaaaccagattttaaacctcaagtcattgttgatcccttgattaacaagagggcataaaactgaggttacctggatttaaaaggaggccatttgtgctgggacttcaacagtacgtgtttacagtttggcagaataatctctttgaaggtgcaaatggaatgaagtctctgttttcctttcctttttcacatcttgtaaaaaagcatttggtgtacattccctgaagtttgtccaacctgactttactcaatattggaaacacaaaaaaaaaaaaaaaaaaaa

SEQ ID NO: 2848 - protein, 412 aa, Panicum virgatum
  misc_feature: Ceres CLONE 1787724
  misc_feature (1)..(184): Pfam Name: CN_hydrolase Pfam Description: Carbon-nitrogen hydrolase
  misc_feature (25)..(403): SWISSPROT Homolog: EC 3.5.1.6 Beta-ureidopropionase
MASSNGKPAAAEEGKAAAEGSIGGYESLHSLLEANLSPELFQEASRLLLGLNCARPLEAIALPEATMTLAETHNFDVQAFRFSADKEFLRQPRVVRVGLIQNSIAVPTTCHFAEQKKAIMDKIRPIVDAAGASGVNILCLQEAWTMPFAFCTREKRWCEFAEPVDGESTQFLQELAQKYNMVIVNPILERDVNHGETIWNTAVVIGNNGNIIGIHRKNHIPRVGDFNESTYYMEGNTGHPVFETAYGKIGVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLAISDMDLNLCRQIKDKWAFRMTARYDMYASLLSEYLKPDFKPQVIVDPLINKRA

SEQ ID NO: 2849 - DNA, 2237 bp, Panicum virgatum
  misc_feature: Ceres CLONE 1787731
  misc_feature: Encodes the peptide sequence at SEQ ID NO. 2850
gggccccccattcacacacagtgcgccaccctcaccaccaccgtcaccaacaaaagccaatcggaagctagaccggcgacgaggagccggcgatggattctgactacggcgtgccgcgcgagctctcggaggttcagaagaagcgcgcgctctaccagcccgaggtccccccatgcctccagggcactactgtgagggtagagtacggtgatgctgcaattgctgctgatccagcagacgctcatgtggtcagccaaacgttccctcacacctatgggcagccccttgcacattttctcaggaagacggctgttgtccctgatgctaaggtcatatctgagcaccctgcagtcagggttggcattgtcttctgtggaaggcagtcccctggaggccacaatgtcgtttggggactctatgaggccatcaaggctcacaaccaaagcagcaaactcattggttttcttggtggttctgatggtcttctagcacagaaaaccttggagataaccgatgaagttctttcttcatacaaaaaccaaggtggttatgacatgcttggtcggacaaaggatcagattagaacaaaagagcaggttaacggtgcgatggctagttgccaagctttgaagttagatgctctggtaatcattggaggtgtcacatccaatactgatgctgctcagcttgctgaaacttttgccgaggcaaagtgctcaacaaaggttgttggtgtccctgtaactttgaatggggaccttaagaaccagtttgttgagactacagttggcttcgacactatatgcaaggtgaactctcaacttatcagcaatgtctgcactgatgctttgtcggctgagaagtattactactttattcgcctgatgggacggaaggcttctcatgtggcactggagtgtactcttcaatcacatcctaacatggttattctaggagaggaggtagctgcatccaaacttacaatttttgatattacgaagcagatatgtgatgcagttcaggcgagggcagacaaagacaagaatcatggggtgattcttattcccgagggccttgtggagagtattcctgaactatatgctttgcttcaggaaattcatggccttcacggtagaggtgtttccgctgagaacatctcttctcagctttcaccttgggcatctgcactatttgagtttttgcccccatttattaggaagcagctacttctccatcctgaatctgatgactcagctcaactttctcagattgagactgaaaagcttctagcccaattagtagagactgagatgaacagacgcttgaaggaaggcacttacaaaggaaagaagtttaatgcaatctgtcacttttttggctaccaagctaggggtgcactgccttcaaaattcgactgcgattatgcctatgttttggggcatgtgtgctaccacatcattgccgctggtttgaacggttacatggctaccgtgacaaatctgaagagtccagtgaacaagtggcgatgtggtgcggcccctatttcgtctatgatgactgtgaagcgatggtcacgtggcccttctgccactcagattggcaagcctgctgttcacatggctagtgttgacttgaaaggaaaagcatacgagttgttgagacagagctcttccagctttttgttggaagacatctacagaaacccaggcccactccaatttgaaggaccaggtgccgattcaaagcctatttcgttgtgtgttgaggaccaagactacatgggtcggatcaagaaattgcaggaatacttagagaaggtgaaaagcattgtgaagcctggatgctctcaggatgttcttaaagcggctctcagcgccatggcttctgtgacggagacactgaacatcatgacttcgtcgtccactggccagacacaactgagttaaacaaaaccattttatggtgtgggattcacattttccatggtgactgttggggttagaaacagtagccctgctatcccacgagtttatttttttcgtagttttgggggagttctatcagttttgccttaagtagttcatgagggtttgttgtcgatgaatttgcactggaataatttttcaaacagcctgattgtgttttgtggccacttaataaaccaaagtttgtggcaacataaatatttctgtggtgtaataagttgagaaatggtagaaaaaaaaaaaaaaaaaaaa

SEQ ID NO: 2850 - protein, 617 aa, Panicum virgatum
  misc_feature: Ceres CLONE 1787731
  misc_feature (1)..(281): Pfam Name: PFK Pfam Description: Phosphofructokinase
  misc_feature (1)..(281): Pfam Name: PFK Pfam Description: Phosphofructokinase
  misc_feature (1)..(614): SWISSPROT Homolog: EC 2.7.1.90 Pyrophosphate- -fructose 6-phosphate 1-phosphotransferase alpha subunit
MDSDYGVPRELSEVQKKRALYQPEVPPCLQGTTVRVEYGDAAIAADPADAHVVSQTFPHTYGQPLAHFLRKTAVVPDAKVISEHPAVRVGIVFCGRQSPGGHNVVWGLYEAIKAHNQSSKLIGFLGGSDGLLAQKTLEITDEVLSSYKNQGGYDMLGRTKDQIRTKEQVNGAMASCQALKLDALVIIGGVTSNTDAAQLAETFAEAKCSTKVVGVPVTLNGDLKNQFVETTVGFDTICKVNSQLISNVCTDALSAEKYYYFIRLMGRKASHVALECTLQSHPNMVILGEEVAASKLTIFDITKQICDAVQARADKDKNHGVILIPEGLVESIPELYALLQEIHGLHGRGVSAENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISSMMTVKRWSRGPSATQIGKPAVHMASVDLKGKAYELLRQSSSSFLLEDIYRNPGPLQFEGPGADSKPISLCVEDQDYMGRIKKLQEYLEKVKSIVKPGCSQDVLKAALSAMASVTETLNIMTSSSTGQTQLS

SEQ ID NO: 2851 - DNA, 1778 bp, Panicum virgatum
  misc_feature: Ceres CLONE 1787735
  misc_feature: Encodes the peptide sequence at SEQ ID NO. 2852
gtacctcaatcgattgagggtgtggcgtccagcgattcagctgtgacagaagagtaatagagtactcttcctctcaaaaaaaaaaaccacccggcccggcgaattcaggttccgttcccggtggtccttgtccgtccatggccgcctcgctgcttcgccgcggcgctgccgccgcaggccgccggcggtgcccggcggacgtgctgcggcgcctggtctcgtcggaggcggcgcccgagcgggcaacctcgcgggcgccgcctgagatgccgccgttccaccaccagccccgcccgtacgccgggatgggcggcgccgagatcttcgagaagaggaaggccttcctcggcccgtcgctcttccactactaccagaagccgctcaacattgtggaggggaagatgcagtatctgtatgacgagcatgggaagagatacctcgattgctttgggggtatcgtcacagtttcgtgcggccattgccatccggacattgtcaatgctgtggtggagcagacaaagttgctccagcacacaaccaccatatacttgcatcatgccattgtcgagtttgcagaggcactcacctccaaaatgcctggcaatctcaaggttgtctattttgtcaattctgggactgaagcgaatgaactggcaatgttgatggcccggctatatagtgggaacctcagtatgattgcactcagaaatgcatatcacggtggaagtgctggaacaataggattgactggtttgcagacatggaagtacccgattcctcaggatgaaatacatcatgtcatgaaccctgatccttaccgggggacttttggatctgatgctgcagcttatgccaaggaggtccaagaacatataacttatggaagttcaggaagggttgcaggcttcattgcagaaacatttcagggtgtcggaggtgctgtcgaactagctcctggataccttaagttagcttatgacattgtccggaaggctgggggtgtttgtattgctgatgaagtccagagtggtttcggtcgtactggaagtcattactggggattccagacacaagatgtcattccagacattgtaacaatggcaaagggcatcggcaatggtctaccattgggagctgttgtaacaactcctgagattgcaagtgtgttgtctcaaaaaatccaatttaatacatttggtggaaacccagtttgttctgctggtggtttggctgtgcttaaggttcttgacaaggagaaacgccaggcacattgtgctgatgttggagctcacttggtggagcgtctaaaatcacttcaggagaagcacgaaatcataggtgatgttagaggaaggggactcatgcttggcgttgaactcgttactgacagaaaggagaagacccctgccaaggcagaaactaccgaactgtttgagaaactcaaagatctcggggtactggttggaaaaggtggtctgcatggtaacgtcttcagaataaaaccaccaatgtgcttttcaaaggacgacgcagacttcttggtggacgccatggatcacgcaatgtcaggcctctgaattgagaatgcgtctccgttgaaccgacagttcctgcaatcgcaagatatgcatggcctgatgctgaaaggaaaacattattcgatggcatgttgccggttgatgtgcttctggtggtgacatggtgaaatagaactccgcaggaataaatgaatgaaggggaagaaaatattagaaatttaaaaaaaaaaaaaaaaaaaa

SEQ ID NO: 2852 - protein, 479 aa, Panicum virgatum
  misc_feature: Ceres CLONE 1787735
  misc_feature (1)..(334): Pfam Name: Aminotran_3 Pfam Description: Aminotransferase class-III
  misc_feature (16)..(479): SWISSPROT Homolog: EC 2.6.1.44 Alanine--glyoxylate aminotransferase 2 homolog 1, mitochondrial precursor
  misc_feature (4)..(477): SWISSPROT Homolog: EC 2.6.1.44 Alanine--glyoxylate aminotransferase 2 homolog 3, mitochondrial precursor
MAASLLRRGAAAAGRRRCPADVLRRLVSSEAAPERATSRAPPEMPPFHHQPRPYAGMGGAEIFEKRKAFLGPSLFHYYQKPLNIVEGKMQYLYDEHGKRYLDCFGGIVTVSCGHCHPDIVNAVVEQTKLLQHTTTIYLHHAIVEFAEALTSKMPGNLKVVYFVNSGTEANELAMLMARLYSGNLSMIALRNAYHGGSAGTIGLTGLQTWKYPIPQDEIHHVMNPDPYRGTFGSDAAAYAKEVQEHITYGSSGRVAGFIAETFQGVGGAVELAPGYLKLAYDIVRKAGGVCIADEVQSGFGRTGSHYWGFQTQDVIPDIVTMAKGIGNGLPLGAVVTTPEIASVLSQKIQFNTFGGNPVCSAGGLAVLKVLDKEKRQAHCADVGAHLVERLKSLQEKHEIIGDVRGRGLMLGVELVTDRKEKTPAKAETTELFEKLKDLGVLVGKGGLHGNVFRIKPPMCFSKDDADFLVDAMDHAMSGL

SEQ ID NO: 2853 - DNA, 2625 bp, Panicum virgatum
  misc_feature: Ceres CLONE 1787744
  misc_feature: Encodes the peptide sequence at SEQ ID NO. 2854
aagaatcgcaagaaccccgtcgactcgcctccggccgcctcgatggggtgcgggcagtccaagatcgaccaggaggaggctgtgagccggtgccgggaccggaagaggctgatggcggacgccgtggtggcgcggaacggcttcgccgccgcccacactggttacaccgtgcgcctcaagagcaccggcggcgcgctatccgacttcgcccacggcgaggtgcccgatcctagcctggtagcctcccattcccaccacgctgcggccgccaccgccgcggcggcagcatccgtctccgcgccacctggcccctccgccgcatccgtcatcacagcgccgtccccgccaccgccgccatttcccgacttctcccattccagcctccaacggtcctcctccacccccaacatccctatgccggaccagagggcgaccaccaagaaccgccctcctgctgatgctgctatccgagaggaggatgaggatgagcaggatgatgatgggcatatcaggtcagatagtgacgatgatgatgaagatgacagtgatgatgatgacgacgacgatcaccatgagcatgatgatgttagcgtggacggcatggtgcacgcacagccactgaagcggatcgtaatggacagtgtgggatcttctccagtgacaccgcctccacccccacagctaaaccaaaccccaccaacgcctgccaccacaaccccaccgcctccagtgccggagtcacagatggctacctgggattacttttttggcccaactcccacacccccgcccaccctggagcagcctgcagatgatacttggatggaaaggcgtgacaaggagccagtggctgaggtgaagccgcctatggcaaaaccagctgttagtgaaccagctgctgccgaggaaaggccaccacagacagctgcagagaaggagaaagcaattgaggagatggtggctaacctacctccatcaaaacctattgttaggaagccacccaaagcacctggcccaccaccgactgtacactaccagcatgcctcctcaatgggtgcagttgaaactcggaaggggaagatgatggttgcatcaggaactgccagcttgctacagattgtttctcagcttgatgatcacttccttagagcttcagagagtgcacatgatgtgtcaaaaaagctggaggccacccgaatgcattaccattccaaccatgctgacagccgaggtcatattgatcactctacaaaaattatgaatgttatcacgtggaaccgctccttcaagaatttacccgaccacgatgacctgcatgataattttgagattgatgatagatttgaaactcatgctgcggttctagatagaatgcttgcttgggagaaaaaactgtatgatgaagtgaaggctggggaacttatgaaaatcgattatcagaagaaggtgactctattgcagaagcaaaagaaacagggtgttaaacttgaaaccctggagaagacaaaagctgccgttagccacttacacacaaggtacatcgtagatatgcagtccatggattcaacggtttcagaaataaatcggcttcgggatagacagctattcccaaagttagtggagcttgttgatggaatggccaaaatgtggagtgctatgcaccgtcatcatagaaatcagttcatgatcatttcaggtatcagaggttttgagattcctcctgttccaagagagacaactgatttgcattacaaccagacttgcgagctacgggacattgttagggagtggtacatgcagtttgagaaattgatggacaatcagaaagcgtacatcagagcactcaatgcatggctgaagcttaatctcatccctatcgagggcaacataaaggagaaggtttcgtcccctccaaggctggtagatccacctatcaagaacttgctgcatgcctggcatgatgaactcgaaaggcttccaattgagcttgcaaaaactgccatcaaaacctttgctgaagtcataagcaacatcgtacaccttcaggaggaggaagtaaacctaaggaggagatgtgatggaactcgcaaggatctgagccgaaagagggcacagtttgacgactggcatcaaaagtacatcgaaagacaggcagccataggtgaggatgtgaaccctgaagcagctgaagttcaaaacgtagatcctgtcgaggacaggaaacgtgccatcgaggaattagagattaggctgactgaggaggaaggacaccaccttaggcacgccaggcaggtgagggagaaatcacttgcaaacctccggacacaccttccagagctcttcaggaacatggctgatttttcttacttttgccatgacatgtacaacaatctgagaaaagctgctgccccgcccaaagatgaaatccatggctgatgctgtaggtttgcaactgtactcaaccagcggtaggggaaaaaactttggttgtaggtgtttattagtaccttggaatccggatgtccgtaatttgttggaacgggttgtagtcttgtagagctagtcggcattaatcatgtttgtaaattggaatagttatttcctgaaaaaaaaaaaaaaaaaaaa

SEQ ID NO: 2854 - protein, 797 aa, Panicum virgatum
  misc_feature: Ceres CLONE 1787744
  misc_feature: The sequence is a functional homolog of  SEQ ID NO 230 in the  10/374,780 US patent application
  misc_feature: The sequence is a functional homolog of  SEQ ID NO 260 in the  10/225,066 US patent application
  misc_feature: The sequence is a functional homolog of  SEQ ID NO 66 in the  10/225,068 US patent application
  misc_feature: The sequence is a functional homolog of  SEQ ID NO 732 in the  10/412,699 US patent application
  misc_feature: Useful for making plants with modulated growth and phenotype characteristics
MGCGQSKIDQEEAVSRCRDRKRLMADAVVARNGFAAAHTGYTVRLKSTGGALSDFAHGEVPDPSLVASHSHHAAAATAAAAASVSAPPGPSAASVITAPSPPPPPFPDFSHSSLQRSSSTPNIPMPDQRATTKNRPPADAAIREEDEDEQDDDGHIRSDSDDDDEDDSDDDDDDDHHEHDDVSVDGMVHAQPLKRIVMDSVGSSPVTPPPPPQLNQTPPTPATTTPPPPVPESQMATWDYFFGPTPTPPPTLEQPADDTWMERRDKEPVAEVKPPMAKPAVSEPAAAEERPPQTAAEKEKAIEEMVANLPPSKPIVRKPPKAPGPPPTVHYQHASSMGAVETRKGKMMVASGTASLLQIVSQLDDHFLRASESAHDVSKKLEATRMHYHSNHADSRGHIDHSTKIMNVITWNRSFKNLPDHDDLHDNFEIDDRFETHAAVLDRMLAWEKKLYDEVKAGELMKIDYQKKVTLLQKQKKQGVKLETLEKTKAAVSHLHTRYIVDMQSMDSTVSEINRLRDRQLFPKLVELVDGMAKMWSAMHRHHRNQFMIISGIRGFEIPPVPRETTDLHYNQTCELRDIVREWYMQFEKLMDNQKAYIRALNAWLKLNLIPIEGNIKEKVSSPPRLVDPPIKNLLHAWHDELERLPIELAKTAIKTFAEVISNIVHLQEEEVNLRRRCDGTRKDLSRKRAQFDDWHQKYIERQAAIGEDVNPEAAEVQNVDPVEDRKRAIEELEIRLTEEEGHHLRHARQVREKSLANLRTHLPELFRNMADFSYFCHDMYNNLRKAAAPPKDEIHG

SEQ ID NO: 2855 - DNA, 1759 bp, Panicum virgatum
  misc_feature: Ceres CLONE 1787749
  misc_feature: Encodes the peptide sequence at SEQ ID NO. 2856
agagccgccaacaatggcggacctccaaaccctagccacgcccggccccgcctccgcctccaccaagaagcattccaagaagcgcaagggcgtcgaaggtgaggccaattcctccaaaaccccagagccgtcaccattggcggacctccaaaccgacacacccgtctgcgcttccacgaagaagcactccaagaagaagcgtgcggctgccgacgcctcccccaacgtcacacccaccgtcgacgccactctcaaagtcaccatcgacgcctcccgcacaggcgaccgaaccgccgccgcggcccccgcagtcgcttacttccccaccggctatgacccactcgccgccgcggcggcggcgaaagatgagtccgcccccaacgcgcggctcttccggcacgagaagcatcccacctgggtcgacctcgtggtcagaagccccggcggaggccccgatttcgtcggccggagctatgccggcgaggccgccacgccgcagctctgcgagtacgcgctcggtgtcctcgataaggcctccggcaccctcaggatcgtccccatagccgccaacaaaattttgaggctcgagccacatctcgaagtgcagcaaccagcacattcacagcactctgaggtgacatcagaagtcgattcagttgcaggaaatgatgaattgaaggttcaagatcttaccatgatgtatggagccaaaagagacagggatacggataataagtggaggtcattaaatgaacaaaggaatgatctttctgcttatgaggacattgacctgggagccagtaatgtcaacaccaatgacaggcaggaactaattgttcggaacattccaccttatgaccctacagcagatacatcagaaaatgtgtatcttttggatgagattattccaaagactattcggcaccaccttttagaaattgttgaccattttgaatcaggagaaatttcttcaaaaggctatgggacgtttgtctcaaatcgtgtgcagaagttagagaagcttcagggtgaagataaagagagacttgcttggatactatcctacatccaacatctactatctttattggcacggaatggcaccatgtccaagcgtcactataaggacagaaaggaaagcaaggcgaaccatggtccagtgacccctcaggctgtatatcgcaacctgttgctgaattttgtagaaccagggtctaatgcaatgtcatcagaaaaagaggagctcctgatcaactacatcttggtccttgcactttttgctgatgacttcagatccgatcctaaggatatatgtgtggacctgaaaaagacccgccagatgattaaaccatactatgaccagctgggatgcaaatctgtgtcatcaggtgctttcaatcccactttcatgacgcttcctgcccctctgaagttcccacaagatgttacaaggagaaagcgacggcggtaatcatcataggaagggattgatggttatttatctcagaaatggaaggcagtacttgaaagtgagtgtgattggaaaaggctgttttgagttctgatacacagcaatccaaggcaagttaagcctgtaggttcttgacccaattttgcaatgtactgaaaatgacaaggttgtttcaattttcattttgtactctgctgttcatcgacattcctgtcaagaaaggaaacatatcttctatgtattgctagttatttggctacctgagtgtaaaaaaaaaaaaaaaaaaaa

SEQ ID NO: 2856 - protein, 485 aa, Panicum virgatum
  misc_feature: Ceres CLONE 1787749
  misc_feature (1)..(360): Pfam Name: RNA_pol_I_A49 Pfam Description: A49-like RNA polymerase I associated factor
MADLQTLATPGPASASTKKHSKKRKGVEGEANSSKTPEPSPLADLQTDTPVCASTKKHSKKKRAAADASPNVTPTVDATLKVTIDASRTGDRTAAAAPAVAYFPTGYDPLAAAAAAKDESAPNARLFRHEKHPTWVDLVVRSPGGGPDFVGRSYAGEAATPQLCEYALGVLDKASGTLRIVPIAANKILRLEPHLEVQQPAHSQHSEVTSEVDSVAGNDELKVQDLTMMYGAKRDRDTDNKWRSLNEQRNDLSAYEDIDLGASNVNTNDRQELIVRNIPPYDPTADTSENVYLLDEIIPKTIRHHLLEIVDHFESGEISSKGYGTFVSNRVQKLEKLQGEDKERLAWILSYIQHLLSLLARNGTMSKRHYKDRKESKANHGPVTPQAVYRNLLLNFVEPGSNAMSSEKEELLINYILVLALFADDFRSDPKDICVDLKKTRQMIKPYYDQLGCKSVSSGAFNPTFMTLPAPLKFPQDVTRRKRRR

SEQ ID NO: 2857 - DNA, 1967 bp, Panicum virgatum
  misc_feature: Ceres CLONE 1787754
  misc_feature: Encodes the peptide sequence at SEQ ID NO. 2858
gctaagcgagctgccacggcgactctctcatgatctcatctgctctgcttctccactcgaccactccgccggcagcgcgggccatggcgacgccctcgcgccgactcctcctgctgctgccgctgctcgccgtcgccgtcgccgtcgccgtcgcggcgtctcatccggcgcacgagttctgcacggcggggggtgacgccggctgcggcggtggaggggacggggcgaggatcctgatcaagggcggcacggtggtgaacgcgcaccgggcggaggaggccgacgtctacatcgaggacggcgtcgtcgtcgccgtccggcccaacatcccggtcggtgatgataatgtaagggtgatcgacgcaactggaaaatatgtcatgccaggtggaattgaccctcacacgcacttggcaatggagttcatgggcaccgtgaccatagatgacttcttcagtgggcatgctgctgcactggctggtgggacgacgatgcacattgacttcgtcattcctgtgaacggcaacttgactgcaggcttggagtcctacaagcagaaagcagcaaatgctgccatggattatggctttcacatggccattaccaagtggaatgacgaggttgcaagggaaatggaagtcatggttaaggaacatgggatcaattctttcaagttcttcatggcatataagggttccctgatggtcactgatgacctcctcctgcaaggcctacagaaatgcaagtcgcttggtgccctggctatggttcatgcagagaatggggatgctgttgccgaaggacaacagcggatgatcgaccttgggataactggtccagaagggcatgctctctcaaggcctccaattttggaaggagaagcaactgcacgggctatccgcttagcaaagttcatcaatacgccactgtacgttgttcatgttatgagcattgatgcaatggaggagattgccaaggctaaaagagaagggcagagagttattggtgaaccagtggtttctggactagtccttgatgattcttggctttggaatcctgacttcacaattgcttcaaagtatgtgatgagtcctccaatccgggaagcagggcacggtaaagcactccaagctgctctttcatcgggaattttacagcttgtaggtactgatcactgtacattcaattccacacagaaagcctttggctctgatgattttcggaagattcccaatggtgtaaatggtctggaggaacggatgcatataatttgggatagcatggtggagaccggcaagatttctgtcaccgattatgtcagagtgacaagcacggaatgtgccaagatcttcaacatataccctcggaaaggagcaatcctggaaggttctgacgcagatatcatcatcctaaaccctgaacggagctttgtgatgggtgcccacacacaccattcaaggtccaacacaaatgtatatgaaggcaggaaaggaaagggaatggtggaagtcacgatatcaaggggccgagtggtatgggaggatggtgtgctgaatatagctcctggttcaggaagatacgtcaggatgctgccttttggctacgtctttgatggcattgagaagtcagatgccgcctacagagcttccctccgagctcctgtacagcgtggtaaagcttctgcttaacgatgccctgctccatctagttcgagactgctgcttaacgatgcctcgctccatctagttcgaggagctgctccaatgtgaacgccgttcgttccatgtgtatatacaaaaaagaacaatttattgaagttcagattcagcataggtaaaggccttaacttgcctatgtacatcgaacacatttaccagttccggtcagtttgtacaactagaaacttgctattctaataaatgaaaggaaaaactggtttctaccaccaaaaaaaaaaaaaaaaaaaa

SEQ ID NO: 2858 - protein, 552 aa, Panicum virgatum
  misc_feature: Ceres CLONE 1787754
  misc_feature (1)..(347): Pfam Name: Amidohydro_1 Pfam Description: Amidohydrolase family
MISSALLLHSTTPPAARAMATPSRRLLLLLPLLAVAVAVAVAASHPAHEFCTAGGDAGCGGGGDGARILIKGGTVVNAHRAEEADVYIEDGVVVAVRPNIPVGDDNVRVIDATGKYVMPGGIDPHTHLAMEFMGTVTIDDFFSGHAAALAGGTTMHIDFVIPVNGNLTAGLESYKQKAANAAMDYGFHMAITKWNDEVAREMEVMVKEHGINSFKFFMAYKGSLMVTDDLLLQGLQKCKSLGALAMVHAENGDAVAEGQQRMIDLGITGPEGHALSRPPILEGEATARAIRLAKFINTPLYVVHVMSIDAMEEIAKAKREGQRVIGEPVVSGLVLDDSWLWNPDFTIASKYVMSPPIREAGHGKALQAALSSGILQLVGTDHCTFNSTQKAFGSDDFRKIPNGVNGLEERMHIIWDSMVETGKISVTDYVRVTSTECAKIFNIYPRKGAILEGSDADIIILNPERSFVMGAHTHHSRSNTNVYEGRKGKGMVEVTISRGRVVWEDGVLNIAPGSGRYVRMLPFGYVFDGIEKSDAAYRASLRAPVQRGKASA

SEQ ID NO: 2859 - DNA, 2043 bp, Panicum virgatum
  misc_feature: Ceres CLONE 1787755
  misc_feature: Encodes the peptide sequence at SEQ ID NO. 2860
ataaaattaactctatccccttccacccattttcctcacgccgcacgcctcaccggcccacccgcagccagcccccgccgtatccttccgccgctactagggtttaaccacaacacccgccgcgcctctcgaagcatgtcggcgccgccgtcgcttaagcccccggcaaccgtcgccgcggcctctccccgcgcggccgccgccccgagggccaccgcgctccacagcgcctgtgcccgcccgacgcggcgcctccagttctcagcctcagctgccgtcgccggagcttccaccgagatgactgatgataacctgggctgggcggagaggtcgctggaggagctcggcagcttgccggacaacgatacgttctgcctgatggcgctctcgccgttggatgggcggtacgatcgcttcatcaaggacctgatgcccttcttcagcgagttcggactcatcagataccgtgtcctcatcgaggtgaagtggctactgaaactttctcaaattcctgaaatcactgaggtgccgccattcagcgaggaggcccagctcttcttgaatgagattgtccagaatttcggcattgatgatgcgaaggaagtgaagaaaatcgagaaaataacaaaccatgatgtgaaagctgttgagtactttctgaagcagagatgcagctcaaatccagagattgcaaaggtgtcggagttcttccattttgcatgtacctctgaggacatcaacaacctgtcacatgcattggctctgaaagagggggtaaatggagttatgttccctgccatgattgacatatgcaaagcaatgtgttccttggcaacacaaaattcagcctaccctatgttgtctcgaactcatgggcagccagcttcaccaacaacggtgggaaaggagatggcaaactttgcagccaaattatctgatatagggaagagtttctcagaggtgaagatactagggaaatttgctggtgctgttggtaattataatgcccatgtggttgcttatccagaagttgactggcctaaggtggcagaagagtttgttagatccttgggtttgcaattcaacccttatgtgactcagattgagcctcatgactacatatcaaagctcttcaatctattcatccagttcaacaatgtgttgactgattttgatagggacatgtggtcctacatatcactgggctacttcaagcagataccaaaagctggcgaggttggttcgtccactatgcctcataaaatcaatcccattgattttgaaaatagtgatggcaatttgcatttggcgaatggcattttgtctgctataagcatcaagctgccgatatccaggctgcagcgtgatctgacagactcgactgttctgagaaacttgggtgtgggattaggtcattctctattggcttacaaagctacaatacatggaatcagcaaggttcaggtgaatgaatcacgtttagctgaagacctggagaaaacttgggaagtccttgccgagccaatacagactgtgatgcggagatatggaatacctgaaccttatgagaagctgaaggaactgactagaggccaagctgtcaccaaggatagcatgcagcagttcattgatggtctagacataccagtggaggttcgatcaaaacttgcaaagctaaccccacatttttatactggactggcagaggatttggccaaagacattaagaagttggttgatctagaatttggattcaagatcaagtgagcttccattttagaaaaatggataatcatctccacaattttttcttttgacaatgatggtgcaaaaataaaatagtggagctccagaaaacactaatctgttgaggcctcaagagattgcctgccacgctaatttcacctggttctcatttaaaatattttttggtacatgtaaaatgctgctcatggaatcgtgccagctgcccagctgtatcctgagggaaaattatcaagctaaaagtgctttatcgatttttaaaaaaaaaaaaaaaaaaaa

SEQ ID NO: 2860 - protein, 543 aa, Panicum virgatum
  misc_feature: Ceres CLONE 1787755
  misc_feature (1)..(308): Pfam Name: Lyase_1 Pfam Description: Lyase
  misc_feature (81)..(530): SWISSPROT Homolog: EC 4.3.2.2 Adenylosuccinate lyase
  misc_feature (81)..(531): SWISSPROT Homolog: EC 4.3.2.2 Adenylosuccinate lyase
MSAPPSLKPPATVAAASPRAAAAPRATALHSACARPTRRLQFSASAAVAGASTEMTDDNLGWAERSLEELGSLPDNDTFCLMALSPLDGRYDRFIKDLMPFFSEFGLIRYRVLIEVKWLLKLSQIPEITEVPPFSEEAQLFLNEIVQNFGIDDAKEVKKIEKITNHDVKAVEYFLKQRCSSNPEIAKVSEFFHFACTSEDINNLSHALALKEGVNGVMFPAMIDICKAMCSLATQNSAYPMLSRTHGQPASPTTVGKEMANFAAKLSDIGKSFSEVKILGKFAGAVGNYNAHVVAYPEVDWPKVAEEFVRSLGLQFNPYVTQIEPHDYISKLFNLFIQFNNVLTDFDRDMWSYISLGYFKQIPKAGEVGSSTMPHKINPIDFENSDGNLHLANGILSAISIKLPISRLQRDLTDSTVLRNLGVGLGHSLLAYKATIHGISKVQVNESRLAEDLEKTWEVLAEPIQTVMRRYGIPEPYEKLKELTRGQAVTKDSMQQFIDGLDIPVEVRSKLAKLTPHFYTGLAEDLAKDIKKLVDLEFGFKIK

SEQ ID NO: 2861 - DNA, 3535 bp, Panicum virgatum
  misc_feature: Ceres CLONE 1787756
  misc_feature: Encodes the peptide sequence at SEQ ID NO. 2862
acggcagcctcctgctcgcctcctattcctcctctgctcttcttcatcatcttctttttcccatccgccctccctttctggtaagactcgggcggtttcttgctccatcgaagtgtagtgatgcatgctcgtagccgtcgccgtcgccgtaattgcacttgcacgaacacgcgtgcgctgcctgccctcatgctgatggcatgcagcgcttgtctgggggcgcactctgcgctggagttggaagtctcggaggggggccggccgttcacgcgtgttgggcttttggaaaggagggagatggtggctttgtgtgagggatggggttccaatcggttgcaacaaacccattgaattttgctcgcctttttcctcataggagccgtgctctctgagcctctgaaacgcacgatgtagttgcttcatataaacccaggcccccttgtgctgttcttgccgggctcacacattttgtggcacggcaagggcgccatctcctctgcttttggcgactgattggttcgttctcatggctctagctcccttcttcatccttggtttctctgccatgaagcagcagcagcagcagtagtgccttgcaagcaaatagtttgatgttagcgtgctggtttttccttcattgcacactaatcactcctgacttttggcctttagtctttactaatacgcacaagccttcttcatccttggtttctctgccatgaagcagcagcagcagcagcagtgccttgcaagcaaatagtttgatattagcgtgctggtttttctttcattgcacactaatctctcctgccttttggcctttagtctttactaatacgcacaagcttttgttagattgttttttttttgctgtggccagatttctgttcagccagctggtactgtagtgtgtagtgttatgaatttacagagactgctgcaagaaaatctagtctcccgcatgctagtttaattccctttgtgttttattaaaccatgctgctctgtcagcaaaacactagttaaaactaatgctaccatcgagtcccatcatgtgggcgtccaaaaaaaaagtcccatcatgcggtttctcagagcgcctattgctttcgcaacggcatggatagaaaagggcaggcaccttgatcctgatggcctaccacttaattatttgttaatttctcgtccataatctatttgcaacttgcatgcacctccaacacatggcacggacctcgttagcacaagccatgatggtttcttggatcctctgcatccctgcatccccgtttcttgccgacgttgaccggccatgggcggcggcgagatcgccggccgcatcaggtcgggcgtcctcgagcccctggaggaccgcttcacggagattctgatctggtcgctgcaatgctacgacgcgcaggtccggaagcgcctcgtcccgctccttcgccggcacaggatggcgctgctcacggcgccggcggtggccgcgctgctgttgctcttctggtccgcggcgtacggcggcgcccagttgccgtacaaggaccccagcctgcccgtggaggcccgcgtcaaggacctcctcggccggatgacgctcgccgagaagatcgggcagatgacgcagatcgagcgcaaggtcgcgtcgccgcaggtgctcaaggataacttcatcggcagcctgctcagtggcggcgggagcgtgccgcggctgcaggcgacggcggcggactggatgagcatgatcagtgactaccagaaggcgtgcctgtccacgcggctgggcatcccgatgatctacggcatcgacgccgtccacggccacaacaatgtctacggcgccaccatcttcccccacaatgtcgcgctcggagccaccagggatcctgatctggtgaagaggatcggagccgcgaccgcgctggaagtgcgagccaccggcatccagtacgcgttcgcgccatgcattgcggtgtgccgtgatccgagatggggccggtgctacgagagctacagcgaggaccacaagatcgtgcaggccatgacagagctcatcccgggccttcagggcgacgttccgcagaacttcaccagcggcatgccctacgttgccggacagaacaaggtggcagcgtgtgccaagcacttcgtcggcgacggcggcacgcacgatggcatcaacgagaacaacaccatcatcgaccggccgggcctgatgagcatccacatgcccgcctacctggactcgctccggaagggcgtctccacggtcatgatctcctactccagctggaatggcatcaagatgcacgcgaaccacaacctcatcaccaacttcctcaagggcaggctcaacttcaagggcttcacgatctcagattgggagggtattgacaggatcaccagccctgcaggggcaaactactcctactctgtccaagctggaattcttgctggcattgacatgatcatggtgcctaacaactaccaaagctttatcagcatcctgactggccacgtcaacagcggtgtaatcccgatgagcaggatcgacgacgctgtcacaaggatcctgcgcgtcaagttcaccatgggtttgttcgagaaccccatgcccgacgccaccttggccgaccagctggggaagaaggagcaccgggacctggccagggaggcggtgcggaagtcgctcgtgctcctcaagaacggcaagccaggcgacgcgccgctgctgccgctgccgaagaaggcggccaagatcctcgtcgcgggcagccacgccgacaacctgggctaccagtgcggcgggtggaccatcgagtggcagggcgacacgggccgcatcactgtcggcaccaccatcctcgactccgtgaaagccgccgtggacccgtcgacggcagtggtgttcgcggagaaccccgacgcggacttcgtgaagaacggcggcttctcgtacgccatcgtggccgtgggcgagcacccgtacacggagacccagggcgacagcatgaacctgacgatcccggacccggggccgagcaccatccagacggtgtgcggcgcggtgcggtgcgcgaccctgctcgtgaccggccgccccgtggtgatccarccgttcctgggggccacggacgcgcttgttgccgcctgggtgccggggttcgagggccagggggttaccgacgtgctgtttggggaatacgggtttcccgggaaggtgccggggaagtggttcaagtcggtgggccagctgccgaagaaagtgggggaagggccctacgacccgcttttcccggtggggtttgggctccccccaaaaggcaatgggtactaggaggggattggggggggggagggataggaaatttgaatttttaaacggtgttttgggggggggacatgaaccgggagtttttggttccttggtcatttgggttgattagttttggggcaaggtcagctccccctggggaggagcatcccctagaagagggatttcatttttaaaagaaaaaattgctttgatcag

SEQ ID NO: 2862 - protein, 675 aa, Panicum virgatum
  misc_feature: Ceres CLONE 1787756
  misc_feature (1)..(238): Pfam Name: Glyco_hydro_3 Pfam Description: Glycosyl hydrolase family 3 N terminal domain
  misc_feature (1)..(212): Pfam Name: Glyco_hydro_3_C Pfam Description: Glycosyl hydrolase family 3 C terminal domain
MGGGEIAGRIRSGVLEPLEDRFTEILIWSLQCYDAQVRKRLVPLLRRHRMALLTAPAVAALLLLFWSAAYGGAQLPYKDPSLPVEARVKDLLGRMTLAEKIGQMTQIERKVASPQVLKDNFIGSLLSGGGSVPRLQATAADWMSMISDYQKACLSTRLGIPMIYGIDAVHGHNNVYGATIFPHNVALGATRDPDLVKRIGAATALEVRATGIQYAFAPCIAVCRDPRWGRCYESYSEDHKIVQAMTELIPGLQGDVPQNFTSGMPYVAGQNKVAACAKHFVGDGGTHDGINENNTIIDRPGLMSIHMPAYLDSLRKGVSTVMISYSSWNGIKMHANHNLITNFLKGRLNFKGFTISDWEGIDRITSPAGANYSYSVQAGILAGIDMIMVPNNYQSFISILTGHVNSGVIPMSRIDDAVTRILRVKFTMGLFENPMPDATLADQLGKKEHRDLAREAVRKSLVLLKNGKPGDAPLLPLPKKAAKILVAGSHADNLGYQCGGWTIEWQGDTGRITVGTTILDSVKAAVDPSTAVVFAENPDADFVKNGGFSYAIVAVGEHPYTETQGDSMNLTIPDPGPSTIQTVCGAVRCATLLVTGRPVVIQPFLGATDALVAAWVPGFEGQGVTDVLFGEYGFPGKVPGKWFKSVGQLPKKVGEGPYDPLFPVGFGLPPKGNGY

SEQ ID NO: 2863 - DNA, 1711 bp, Panicum virgatum
  misc_feature: Ceres CLONE 1787768
  misc_feature: Encodes the peptide sequence at SEQ ID NO. 2864
accacccacacccgcctcggcctctctctatcctccccgccgcacccatggccgccgcaatcgggagccctagccgcgccagcgccatcgccccgccccgctccgccgcccccgcgcccgcggtgctgagagtggcggcgcccgccggcccggggaggaggggcgcggtggctgcggccgcaatgcagccggcgaaggcggcggccctggaggccgcccccgcggccgcggggcttgggaacggcgcggcggtcgcggggatggccaggcccgacgccatggggcggttcggcaagttcgggggcaagtacgtgcccgagacgctgatgcacacgctcaccgagctcgaggccgcgttccacgcgctcgccaccgacgacgagttccagaaagagctggacggcatcctcaaggactatgtcggccgtgagagccccctgtacttcgcggagcgcctgaccgagcactacaagcgccctgatggcacaggtccgctcatctacctcaagagggaggatctgaaccacaccggtgcccacaagatcaacaatgccgtggctcaggccttgctcgccaagcggcttgggaagcagcgcatcattgccgagaccggtgctggtcagcatggtgttgccactgccacggtgtgcgcccgttttgggctgcagtgcatcatctacatgggcgcccaagatatggagaggcaggcgctcaatgttttcaggatgaagcttcttggtgcagaggtcagggcagtgcattctgggacagcaaccctgaaggatgcgacttcgcaggctatccgcgactgggtcactaatgtggagaccacacactacatcttgggctcggttgctggtccgcacccgtacccaatgatggtgagggagttccataaggttattggccaggagacccggaggcaggccatggacaagtggggtggcaaacctgatgtgttagttgcctgtgttggtggtggatccaatgctatgggcctcttccatgagtttgttgatgatcaagatgtgagactgataggagtggaagcggctggtcatggtgttgacactgacaagcatgcagcaactttgacaaagggtgaagttggagttctccatggctcaatgagctatttgctgcaggatgatgatggacaagttattgaaccccactccatcagtgcagggctggactaccctggtgttggacctgagcacagtttcttgaaggatattggacgtgctgagtatgacagtgtgacagatcaggaggcactggatgctttcaagcgcgtctctcgtctggagggcatcatccccgccctggagacctcccacgccctcgcctaccttgagaagctctgcccgaccctgcccgacggcgtgagggtggtggtgagctgcagcggacgaggagacaaggatgtgcacaccgccagcaagtacctcgaagtctaagcaccaaagaggaaggctgaacgaagacttttccatgtcagagttgtgaagggtccgatgataatttagcgttgttcattcggataaattacccaataatacctggaagcttgtattgtattagctggtagcgcctttgttttttgttgttgtcctgtttgtttgtttgttgtcttgtatcagaatgatgttgacgtggataactgaataaataaatgccaagctttctccaaaaaaaaaaaaaaaaaaaa

SEQ ID NO: 2864 - protein, 470 aa, Panicum virgatum
  misc_feature: Ceres CLONE 1787768
  misc_feature (7)..(470): SWISSPROT Homolog: EC 4.2.1.20 Tryptophan synthase beta chain 2, chloroplast precursor
  misc_feature (72)..(470): SWISSPROT Homolog: EC 4.2.1.20 Tryptophan synthase beta chain 2, chloroplast precursor
MAAAIGSPSRASAIAPPRSAAPAPAVLRVAAPAGPGRRGAVAAAAMQPAKAAALEAAPAAAGLGNGAAVAGMARPDAMGRFGKFGGKYVPETLMHTLTELEAAFHALATDDEFQKELDGILKDYVGRESPLYFAERLTEHYKRPDGTGPLIYLKREDLNHTGAHKINNAVAQALLAKRLGKQRIIAETGAGQHGVATATVCARFGLQCIIYMGAQDMERQALNVFRMKLLGAEVRAVHSGTATLKDATSQAIRDWVTNVETTHYILGSVAGPHPYPMMVREFHKVIGQETRRQAMDKWGGKPDVLVACVGGGSNAMGLFHEFVDDQDVRLIGVEAAGHGVDTDKHAATLTKGEVGVLHGSMSYLLQDDDGQVIEPHSISAGLDYPGVGPEHSFLKDIGRAEYDSVTDQEALDAFKRVSRLEGIIPALETSHALAYLEKLCPTLPDGVRVVVSCSGRGDKDVHTASKYLEV

SEQ ID NO: 2865 - DNA, 2038 bp, Panicum virgatum
  misc_feature: Ceres CLONE 1787774
  misc_feature: Encodes the peptide sequence at SEQ ID NO. 2866
aagagagacgcatccgcccccaccacccactcccacacgcacaagccttcccatccctcccctccacctccagcaacgccaacccaacccagaacccactccacttccctggtgaggctgagcgatccaccaacaccaccacacaccacaacggcgacgacgacggcgagccaccgcgtgcacggtggcgacaggtttgttctctgaacccttctcgtaggagttaagctaggaagaggaggcctttgtccgggagcctttcttgctggtgctatttgatcgagcaaggaagcgtgacccggagaagactggagcttcatttccaactgttcgtcttcgtcttcctcgcagtagggaagaacagagatccggggaaccttttttctctcctggattaattgctgtctgttcttcgtagaactttctggttttcttttagcttcttttttcttcttctgtctctttcgtctagcaagccggaaaggggctatttttaagccccctttcaggctgcaccagccaaaccatccctgttcttcgcttttacagaagaaacaggccacctttttttcaaatttctttttcagcttttttggacaaaaaaggtttgatttctccccctgtttttagctcatcttcgtaatggcagccatagatttgtacacaaaccagctgagctcctcctcgtcgtcctcctcggaccaggagctcatgaaagcactcgaaccttttatccggagtgcttcttcgcccacctcctccacctccaccaccacctcccccttctacccctacacctctgctttgcctcaagattcgtactactacacctaccctgccgcctcctcctcttacaccgtgctcctgccaccgccgcttgctccgaccgccacgtccttctcgcagctcccgcccctgccgccttcctcctcgtcgtacaccacgccggcggcgccgtacccaacgtcgtcggtggatgccgcggcggggctggcgctgaaccacctgggcccggcgcaaatcgagcagatccaggcgcagatcatgttgcggcagcagcggggcctggcggcgtcgctcctcgggccgcgggcgcagcccatgaagcaggccggggcggcgccgccgtcggccgccgcgaagctgtaccgcggcgtgcggcagcggcactggggcaactgggtggcggagatccgcctgcccaggaaccggacgcggctgtggctcggcaccttcgactccgccgaggacgcggcgctcgcctacgacaaggcggccttccgcctccgcggcgacgcggcgcgcctcaacttcccgtccctccgccgggccggcgcgcacctcgcgggcccgctcgacgcctccatcgacgccaagctcaccgccatctgccagggcctcgccgccgcgcccgcgcccaaggccgccgccggcaccgcctccgccccggactcgcccaaggcctcggcgtcgacgaccacgacggagggcgacgagtccgtgcactccgccggctcgcctccttccctcccggcgttccagcagcagcagccggcgacgccgctcccggagatggcgagcctggacttcacggaggcgccgtgggacgagtccgccgccttgcacctcaacaagtacccatcctgggagatcgattgggactccatcctctcgtgatcaaacccagcaagcagatgctcaatcacgcgctgtaatttttgccagtggattcaattaattattaatccgcagccgccgcgggatccgatggaatattaggcatcggccgcggcggctgcgagtagggtttaagggtctcgtcgaaacgtagcggtctcagtgaggagagggtttaagctcaagcttggagtagtacatcaagtgttgtattaagattattcattagtgtcagtgtatgtagtgatctcctggttgcttggccggttgttttttctctggcaagaccagttgaggttgtaagtgttatgaattattatgtaactgttggttactactgtaaaaaaaaaaaaaaaaaaaa

SEQ ID NO: 2866 - protein, 344 aa, Panicum virgatum
  misc_feature: Ceres CLONE 1787774
  misc_feature (2)..(64): Pfam Name: AP2 Pfam Description: AP2 domain
  misc_feature: The sequence is a functional homolog of  SEQ ID NO 1291 in the  10/374,780 US patent application
  misc_feature: Useful for making plants with modulated growth and phenotype characteristics
MAAIDLYTNQLSSSSSSSSDQELMKALEPFIRSASSPTSSTSTTTSPFYPYTSALPQDSYYYTYPAASSSYTVLLPPPLAPTATSFSQLPPLPPSSSSYTTPAAPYPTSSVDAAAGLALNHLGPAQIEQIQAQIMLRQQRGLAASLLGPRAQPMKQAGAAPPSAAAKLYRGVRQRHWGNWVAEIRLPRNRTRLWLGTFDSAEDAALAYDKAAFRLRGDAARLNFPSLRRAGAHLAGPLDASIDAKLTAICQGLAAAPAPKAAAGTASAPDSPKASASTTTTEGDESVHSAGSPPSLPAFQQQQPATPLPEMASLDFTEAPWDESAALHLNKYPSWEIDWDSILS

SEQ ID NO: 2867 - DNA, 1694 bp, Panicum virgatum
  misc_feature: Ceres CLONE 1787776
  misc_feature: Encodes the peptide sequence at SEQ ID NO. 2868
atttcgatccgggaggggaggagctgaggccggggaggaggaggaggaggaggagctgctgggactgactgtgaggggcagcaggccagcagccgtagcacgcggcggcagccatgagctggagacgaggcggagggggtggaggcctctccaggaggtgggccttcctgctctgcgtcgggagcttctgcctcggtctgctcttcaccaacagaatgtggacgctgcctgaggcaagcgagattgctagaccaaatgcaaatgtagaggaaagcaacatgcctgttgctgcagagtgcggttctaagaagatccaagaaaaacaagattacagggatgttttacaagttcaagatgctcatcacgatgtgcagtcactagacaagacgattgcaagcttagagacagagctctcagctgcaagatctctgcaagagtctttgctcaatggttcccctgttgcagaagagttcaaagtttctgaatcaattgggagaagaaagtaccttatggtcatagggatcaacaccgcttttagcagccgcaagaggagagattccatacgttacacctggatgcctcaaggtgaaaagaggaaaaatcttgaagaagagaaggggatcataattcgtttcgttattggccacagtgctatatcaggtggaattgttgatagagcaattgaagcagaggacagaaaacatggggatttcatgaggattgatcatgttgaaggataccttgcattatctggcaaaaccaaggcctactttgctacagctgtttcactatgggatgcagatttttatgttaaggttgatgatgacgtgcacgtgaatatagcaacgcttggacagattttatccagacttgcattgaagccaagggtatatattggatgcatgaaatctggacctgtcctatctgaaaagggtgtgagatattatgagcctgagcattggaaatttggggaatcgggaaacaagtatttccgacatgctaccggtcaattatatgctatttcgaaagatctagcaacctacatatctataaacaagcatatcctgcacaagtatataaatgaggatgtttcattgggttcttggttcatcgggttagatgttgagcatattgatgacaaaagactttgctgtggtactccacctgattgcgaatggaaagctcagacggggaacatttgcgccgcgtcattcgactggaggtgcagcggcatatgcaactccgaggggaggatctgggaagtccacaataagtgcgccgaaggcgagaaggtgctgtggaactccacgttctagcacaaacgaggcagtggcagaagtcgcatagtagatccagctattttgactgtgttgtttgtaaattgtcccaccctttgtatctatttcgtttgtaggtagttgtgattttgtgacgggctaacaccgacgaaagcggaccacaattttaggtagtgtctgtctgccggtggcggtgaagaagctgaagaagggtataagaggtggtgcattcttttgagcgaaaatgttagggtggtcattttgtaccgatcttctgtactgtatgtatggctgccaatatgtgagaccaacaaataaaaacttttgtacacccacacccccggtgctacgtttcgtaattctcaaatattcatcgaaaaaaaaaaaaaaaaaaaa

SEQ ID NO: 2868 - protein, 400 aa, Panicum virgatum
  misc_feature: Ceres CLONE 1787776
  misc_feature (1)..(199): Pfam Name: Galactosyl_T Pfam Description: Galactosyltransferase
MSWRRGGGGGGLSRRWAFLLCVGSFCLGLLFTNRMWTLPEASEIARPNANVEESNMPVAAECGSKKIQEKQDYRDVLQVQDAHHDVQSLDKTIASLETELSAARSLQESLLNGSPVAEEFKVSESIGRRKYLMVIGINTAFSSRKRRDSIRYTWMPQGEKRKNLEEEKGIIIRFVIGHSAISGGIVDRAIEAEDRKHGDFMRIDHVEGYLALSGKTKAYFATAVSLWDADFYVKVDDDVHVNIATLGQILSRLALKPRVYIGCMKSGPVLSEKGVRYYEPEHWKFGESGNKYFRHATGQLYAISKDLATYISINKHILHKYINEDVSLGSWFIGLDVEHIDDKRLCCGTPPDCEWKAQTGNICAASFDWRCSGICNSEGRIWEVHNKCAEGEKVLWNSTF

SEQ ID NO: 2869 - DNA, 1251 bp, Panicum virgatum
  misc_feature: Ceres CLONE 1787796
  misc_feature: Encodes the peptide sequence at SEQ ID NO. 2870
agtcccaggctcccagctctagcgtgcgcaatggccgcaaacgtggcgctgttctccgcctcctcgccttccacttccgccgccgtcgcctcatcgttcctctcccgccgtcctctacctcgctgctgcgcggcctcccgccgaagagcaagctcccgactctccatcatggcggcgttgggcgatgacccaatcaaggaatggattcttacagaagggaaggccacgcagatcaaagggaccaggtccattggtggtggctgcattaacgccgctcagcgctatgatactgacgctggccccttctttgtgaagaccaatagccgcattggtcctgaaatgtttgaaggagaagctcttgatttgaaggcaatgtatgacacaaagtcgatccgtgttcctttgccatacaaggttggatcattgcccactggtggttcttttatcatcatggagttcatagaatttggtcgttctagaggagaccagtcagctttgggaaggaagcttgctgaaatgcataagtctgctaagtctgataagggatatggtttccatgttgacaatactattggcagcactccacaaattaacacttggactgccgactggattgagttttactctaagcatagattgggctaccagttggagttggcatcgagacgatatggagattcagccatatacgaaaaaggtcagcgattgatcaagaatatccgtccactttttgatggcgctgttcttgagccctgcttgcttcatggtgatttgtggagtggaaacataagctctgatgctaaaggagatccagtgatattggatcctgcttgctactatgggcacaatgaggcagagtttgggatgtcctggtgtgctggattcggtggggacttctataatgcctattttcaggtgatgcctaaacagccagggtttgagaagaggagggacctctatctcctctaccactacctgaatcactacaatctttttggctctggataccgctcgtcggcgatgtccataatcgaagactacttatatctgcttgcggcttagtttctgctgtttactctcacatgaaaactgaagcagcaatgtacatgctccattgtgtatctcagtatgttgtgggttcaatttcttgtaaaatgtctacctcttttgtgcatagatcatactacatccttgtatcatcatcaatcactaaaagatcctcagtttgtgcaaaaaaaaaaaaaaaaaaaa

SEQ ID NO: 2870 - protein, 343 aa, Panicum virgatum
  misc_feature: Ceres CLONE 1787796
  misc_feature (1)..(289): Pfam Name: Fructosamin_kin Pfam Description: Fructosamine kinase
MAANVALFSASSPSTSAAVASSFLSRRPLPRCCAASRRRASSRLSIMAALGDDPIKEWILTEGKATQIKGTRSIGGGCINAAQRYDTDAGPFFVKTNSRIGPEMFEGEALDLKAMYDTKSIRVPLPYKVGSLPTGGSFIIMEFIEFGRSRGDQSALGRKLAEMHKSAKSDKGYGFHVDNTIGSTPQINTWTADWIEFYSKHRLGYQLELASRRYGDSAIYEKGQRLIKNIRPLFDGAVLEPCLLHGDLWSGNISSDAKGDPVILDPACYYGHNEAEFGMSWCAGFGGDFYNAYFQVMPKQPGFEKRRDLYLLYHYLNHYNLFGSGYRSSAMSIIEDYLYLLAA

SEQ ID NO: 2871 - DNA, 1702 bp, Panicum virgatum
  misc_feature: Ceres CLONE 1787800
  misc_feature: Encodes the peptide sequence at SEQ ID NO. 2872
agaaggggaagaaaaggtttgcaaaatggtggagctcacctgcttatccccagcgctgcggcgcccgtctccgactccggcagctcctcgccgcgggccgccacctcgcggccgtgcctactctccccgcggcgtgatcctccgcgccgccaccgtcgcggacgccacgcccggcgccgacgactaccactccaccatccgctccctcaactcccgcggccgccacgtcccccgcaagtcgctcggccagaactacatgctgaactccaaggtgaacgaggagctggcggcggcggcgggggtggaggagggggacgtcgtgctcgagatcggaccgggaaccgggtcgctcaccgccgcgctgctcgaggccggcgcaaccgtcttcgccgtcgagaaggataagcatatggctacccttgtgaaagataggtttggatctacagagcgactgaaggtcatcgaagaagacctcacaaaatttcacattcgctcccattttcttcctttcatgaaggagaaatatcataacaccacaaagcgtgcaaaggttgtgtcaaacttaccattcaatgtcagcaccgaagttgtcaaactacttctcccaatgggggatattttctctgtcgtggtgcttatgcttcaggatgaaacggcagtgcgtcttgcagattcttcgatacaaactccggagtaccgacctataaatgtgtttgtcaatttctactcagaacctgaatacaagttcagagtagacagagagaatttttttcctcgaccaaaggttcatggtgctgttatcagctttaaactaaggaacgctgaggagtatccaccagttggttccctcaaaagcttcttttcaatggtgaattctgcttttaatgggaagcgcaagatgcttaggaaatctcttcagcacctatgctcttcttctgagatcgaggctgctcttcacaaaattggtcttccagttacagctagaccttctgacctgacattggacgatttcgtgagattgcacagtcacctggtggatgtttgattatatatgcagtgccgtcgaaatgcctagggacttgcttgttggcatgatgatgaagtgagcagggcctaactgcccgagagttgctctgcaggtaaaacctgatccttaagacgggaagtaaattggctagaaggataggatcttgcaacttgccttgagttcagattttctaatcctgacatttgagcaattgagagtatgctaacctccgataaccagctgggttttcttcatgggttacaactgccgcaattgatctactggcacacagtcagcagttctccatggatggtgatgttcaaacttgaaagtaatatttttccatgccgtggaaattgtacagtcctgcagaaaagaatggcgctatatgtgtcacgtatttacagttcacttgatctatcaactaaatgactaccatgtaccttttttttttttttgcgaactaccatgtacatactggatcttctaccctggttcatctcttcggaaatagaggaggggatgtaaaggccaaagatgcatgccggagcaatgtaaggcaaagacgcctcacgccggtgcatggtatgttgatagatagaggtgccaggtttatacgtcaatcataaactgtcctgaaaggacactttatccgaaaaaaaaaaaaaaaaaaaa

SEQ ID NO: 2872 - protein, 339 aa, Panicum virgatum
  misc_feature: Ceres CLONE 1787800
  misc_feature (1)..(271): Pfam Name: RrnaAD Pfam Description: Ribosomal RNA adenine dimethylase
MVELTCLSPALRRPSPTPAAPRRGPPPRGRAYSPRGVILRAATVADATPGADDYHSTIRSLNSRGRHVPRKSLGQNYMLNSKVNEELAAAAGVEEGDVVLEIGPGTGSLTAALLEAGATVFAVEKDKHMATLVKDRFGSTERLKVIEEDLTKFHIRSHFLPFMKEKYHNTTKRAKVVSNLPFNVSTEVVKLLLPMGDIFSVVVLMLQDETAVRLADSSIQTPEYRPINVFVNFYSEPEYKFRVDRENFFPRPKVHGAVISFKLRNAEEYPPVGSLKSFFSMVNSAFNGKRKMLRKSLQHLCSSSEIEAALHKIGLPVTARPSDLTLDDFVRLHSHLVDV

SEQ ID NO: 2873 - DNA, 1837 bp, Panicum virgatum
  misc_feature: Ceres CLONE 1787829
  misc_feature: Encodes the peptide sequence at SEQ ID NO. 2874
ccagaggaaaggctcacaccacccacctccatttagctagcttctctctctctcctctcgcgctctcccccatccaaccaacaaatcgagctagctgagaagaggggaggaccagaggtggagagcggcgcaacgcagcatcgaggggcggcggcggcgagaccaatctagaaggagcagaggccgggcgcgcgcagggatgggcgcgccggcgcacggcgctcttctcctctccctcctgctcctggcgggggcggcggcggcggccgaggacgcggcgccgcgggaacccacattgcccgccgcgggtgccggcggcggcggcggggcggcggtggggatcaactccaactcggtgctggtggcgctgctggactcgcactacacggagctggcggagctggtggagaaggcgctgctcctgcagacgctcgaggacgccgtcgggaggcacaacgtcaccatcttcgcgccgcggaacgaggcgctggagcgggacctcgacccggagttcaagcgcttcctcctcgagccccgcaacctcaagtcgctccaggcgctgctcctctaccacgtcctccccgcgcgcctcccctccgactcctggcccgccgcctcccaccccacgctctccggcgaggaggtcgagctcgccgccgcggccggcggcgcagccgccggcatgcgcgtcggccacgccgccgtcacgcgcccggacgcggtgctccgccccgacggggtcatccacggaatcgagcgcctcctcgtgccccgctccgtgcaggaggacttcaaccgccgccgcagcctcgccgcgatctcggccgtgctgcccacgggcgcgcccgaagtcgacccgaggacgcaccgcctcaagaagcctgcgccgccggtgccccccggcgcgccccccgtgctcccgatctgggacgccatggcgcccggcccgtccatcgcccccgcgccggcgcctgggcccagctccgggaagcaccacttcgacgggcacagccaggtcaaggacttcatccagaccctgctcctctacggcggctacaacgagctcgccgacatcctcgtcaacctcacctcgctcgccaccgagatgggccgcctcgtctctgagggctacgtgctcaccgtcctcgcccccaacgacgaggccatggcgcgcctcaccaccgaccagctcagcgagcctggctcgccggagaacatcctctactaccacatggttcccgagtaccagaccgaggagtccatgtacaacgccgtgcggcggttcggcaaggtgcgctacgacacgctgcggctgccgcacaaggtggtggcgcgggaggccgacggctccgtcaagttcggccagggcgagggctccgcctacctcttcgacccggacatctacaccgacggtaggatctcggtgcagggcattgacgccgtgctgttcccgccgggtgacaagaacgccacgcagaccgccgaccctcacaggaagcctcccgccatcaccacccacaagaaaatcaagctccggcgaggcaagttgttagaagcatcgtgccaaatggctgccctcttcggtcagcgatcgcgtttcgtaagctgccaagattgatctccattgataccgaaagacgaacgaactgaaacaaccaagtgatggccgatgggggctgtgctggagggagccgtccacaatattatttgttttcttttttttgtttattgataagaataatgaatcaggtgggtatgtaaactcggtggttgttggtgtgtccagagaaagagagggggggaaaaagagaaaaggcaaaaaaaaaaaaaaaaaaaa

SEQ ID NO: 2874 - protein, 472 aa, Panicum virgatum
  misc_feature: Ceres CLONE 1787829
  misc_feature: Great-hit functional homolog of the protein sequence encoded by LOCUS At3g52370
  misc_feature: Useful for making plants with altered cell wall content and/or composition
MGAPAHGALLLSLLLLAGAAAAAEDAAPREPTLPAAGAGGGGGAAVGINSNSVLVALLDSHYTELAELVEKALLLQTLEDAVGRHNVTIFAPRNEALERDLDPEFKRFLLEPRNLKSLQALLLYHVLPARLPSDSWPAASHPTLSGEEVELAAAAGGAAAGMRVGHAAVTRPDAVLRPDGVIHGIERLLVPRSVQEDFNRRRSLAAISAVLPTGAPEVDPRTHRLKKPAPPVPPGAPPVLPIWDAMAPGPSIAPAPAPGPSSGKHHFDGHSQVKDFIQTLLLYGGYNELADILVNLTSLATEMGRLVSEGYVLTVLAPNDEAMARLTTDQLSEPGSPENILYYHMVPEYQTEESMYNAVRRFGKVRYDTLRLPHKVVAREADGSVKFGQGEGSAYLFDPDIYTDGRISVQGIDAVLFPPGDKNATQTADPHRKPPAITTHKKIKLRRGKLLEASCQMAALFGQRSRFVSCQD

SEQ ID NO: 2875 - DNA, 1977 bp, Panicum virgatum
  misc_feature: Ceres CLONE 1787831
  misc_feature: Encodes the peptide sequence at SEQ ID NO. 2876
gcgagctcaccactcaccaccacgccacgcgatccacgctgacgctgacgccgagggaggaaaaccatccagaaatatatacccgtaggccgtagatccacccatcccgtcccccccccccccccaccgcgcagccaagccagagccgtccggagtccacgaggacagcgtcgtcctccactcctcctccgccgccgccgccgccggccgcagcagaacagaggagcccacgcgccggcgcgcgctccgtccgggcggagcgcacgagcgcgggtccagggagcgaggggggatcggggcggcggctctcggcttcactgctgcgcgggatggcgggccgcaacgatgtcgggatcctcgccatggacatctacttcccgcccacctgcgtgcagcaggaggcgcttgaggcccatgacggcgcgagcaaagggaagtacaccatcggccttgggcaagattgcatggccttttgcagcgaggtggaggatgtcatctcaatgagtttgaccgttgtcaattccctactaaaaaagtacaacattgatccaaagcttattggtcgcttggaggttggaagtgagacggttatagacaaaagtaaatccatcaaaacttggctgatgcaaatttttgagaaaagtggcaatactgacattgaaggagttgactccagcaatgcttgttatggtggaactgctgccctgctgaattgcttgaattgggttgaaagtaactcctgggatggacgctatggtcttgtcgtttgcacagacagcgcagtttatgctgaagggccagctcgtccaactgggggtgctgctgcaattgcaatgctcattggccctaatgctcctatttcatttgagagcaaatatagagcttctcacatggctcatgtctatgatttctacaagcctgatctcgcaagtgaatatccggttgttgatggtaaactatcccaaacatgctacttgatggccctagactcatgctacagacaattttgcaacaaatacgagaagattgtggggaaacaattctcgatttctgatgcagaatattttgtgttccattctccatacaacaagctcgtgcagaagagttttgctcgactttactacaatgacttcatgcgcaactgcagctctattgatgatgatgctaaagagaagcttcagccattttctaatctgactggtgaagagagctaccagagtcgcgacttggaaaaggcctcgcaacaagtcgcgaagcacttgtatgacatcaaagttcagccatcgactctgcttcccaaacaaattggcaacatgtatactgcatccctttatgctgcattggcatctgtactatataacaagcatgatagtctggatggacaaagaatcgtgatgttctcttacggcagtggcttgacatccactatgttttcgttgaggctaaacaatggccagcatcccttcagtttatcaaacattgcttcagtgcttggtgtcacagagaagcttcagtcaaggcatgagacgttacccgagaagttcattgacacattgaagctgatggagcaccggtacggtgcaaaggatttcgagaccagcagggacacgagcctgctgccgcctggtacattttacctgacccatgtggactccatgtaccggaggttctatgaccagaagcctgtagagggtggcaaagccaagtgctgcaacggcttcgcaaatggccactagtggcgtgccgtggactctaaggtcgcctcgcctgccttgttgctcatagactcatcgttctctgtactctgatatgcttatggttagaatttccagcctagtgtgtttctgaaataatttattgtctgcagctgttctcctagatcagctagtttttgtaatatttttatctgaccggtgaaatcagtcttgatattcttgtttctgtagtttgttggttcaaaaaaaaaaaaaaaaaaaa

SEQ ID NO: 2876 - protein, 468 aa, Panicum virgatum
  misc_feature: Ceres CLONE 1787831
  misc_feature: Great-hit functional homolog of the protein sequence given in SEQ ID NO 9379
  misc_feature (1)..(275): Pfam Name: HMG_CoA_synt_C Pfam Description: Hydroxymethylglutaryl- coenzyme A synthase C terminal
  misc_feature (5)..(452): SWISSPROT Homolog: EC 2.3.3.10 Hydroxymethylglutaryl-CoA synthase 1
  misc_feature (6)..(458): SWISSPROT Homolog: EC 2.3.3.10 Hydroxymethylglutaryl-CoA synthase
  misc_feature: Useful for making plants with modulated nitrogen use efficiency
MAGRNDVGILAMDIYFPPTCVQQEALEAHDGASKGKYTIGLGQDCMAFCSEVEDVISMSLTVVNSLLKKYNIDPKLIGRLEVGSETVIDKSKSIKTWLMQIFEKSGNTDIEGVDSSNACYGGTAALLNCLNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIVGKQFSISDAEYFVFHSPYNKLVQKSFARLYYNDFMRNCSSIDDDAKEKLQPFSNLTGEESYQSRDLEKASQQVAKHLYDIKVQPSTLLPKQIGNMYTASLYAALASVLYNKHDSLDGQRIVMFSYGSGLTSTMFSLRLNNGQHPFSLSNIASVLGVTEKLQSRHETLPEKFIDTLKLMEHRYGAKDFETSRDTSLLPPGTFYLTHVDSMYRRFYDQKPVEGGKAKCCNGFANGH

SEQ ID NO: 2877 - DNA, 2639 bp, Panicum virgatum
  misc_feature: Ceres CLONE 1787841
  misc_feature: Encodes the peptide sequence at SEQ ID NO. 2878
tcgcctcggcgcctcccccccgctttcgtctcctcccgccccggaatccgccggcctccctccccaccagattccccaccaccaccgcccaaccgcctccgccttccttcctttaaaccccactccactaggctccgcccgcgtccaccgccccgcaaggccgcaacgacccaaccgcagccgcccgtctccggcgtcgcgccatgccgccgctcgccgcgcgggtccacgccccgcctctcctcgcccccgccgcccggccggccgcgcgcctccgggcctcgagcgggccccgcggcggcggcggcgtgaggaggggcgcgctggcttcggagaagccggtggcggtggcggtcgcggagaaggccggcgagggcgggggaggaggcggatggggcgagggcccgtacgacgcgatcgtcgtcgggtcggggatcggcgggctggtggcggcgacgcagctggcggccaagggcgcgcgggtgctggtcctcgagaagtacctcatcccggggggaagctccgggtactaccgccgcgacgggttcaccttcgacgtcggctcctccgtcatgttcggcttctccgacaagggtaacttgaatttgatcacacaagcactggaagcagttgggcgtaagatggaagtcctacctgacccttctacggttcatttccacctacctggagatctttctgtccttgtgcatagaaagtatgaagacttcgtcaatgaacttatcagcaaattccctcacgagaaggaagggatccttaagttctatggcatatgttggaagatcttcaattcattaaattcattggagctgaagtccctagaggagcccctttatctttttgggcaatttttccagaagcctctagaatgcttaactctagcttattatttgccgcagaatgctggggatattgctcgcaagttcataaaagatcaggagctactctccttcatagatgccgagtgtttcattgtgagcacagtcaatgccttgcaaacacccatgataaatgcaagcatggtgttgtgcgataggcactttgggggaattaattatccagttggtggtgttggtggtattgcgacatccctggcagatggccttgttgaaaagggtagtgaaatccattacaaggcgaatgtaaccaatgttattcttgaaaatgggaaagctgttggtgtgaggctatcgaatgggaaggagttctttgctaaaacagtgatatcaaatgccacaagatgggacacctttggaaagctcttgaaagacaaagagcttccagaagaggagaaaaacttccaaaagaattatgttaaggcaccatcattcctttcaattcatacgggcgtcaaagcctcggttttgcctgctggcacggactgccaccattttgtacttgaggatgattggaataacttggagaagccttatggaagcatatttctaagtatccctacagttcttgatccatcattagctcctgaaggacatcatatacttcatatatttactactgcaggcatagaagattgggagggtctttcgaggaaggagtatgaagagaaaaaggaggcagtggccaatgagattatcagaaggcttgaaaagaagttgtttcctggtcttcaagattcaatagtcctcaaagaggtaggctcaccaaaaactcaccggagatttcttgctcgaaacgatggtacatatggaccgatgccacgcagtaaaccaaagggcttgctggcaatgcctttcaacactacgtcaatagatggcctttactgtgttggtgacagctgttttcctgggcaaggtgtcattgctgtagcattctcaggggtcatgtgtgctcaccgagtcgctgcagatattgggctagagcaaagatctcccgttcttgatgctggtcttcttgggctactgagatggttgagaacacttgcatagaatggtgtcagacagaaaaatggatgaagaaggctgacttttcactgatgttaggattctgcacaatctgttatgatgatatggagctgcagtctttgttatctatgctatctatcttgcatggaattgaatttaggaataatctcagcggtggtctcctgaaactctcagacgaaaaaaaatgggaatacaaataggtgtacagatttcagatctaggcgtcagggccatgtcatattagcatgctaactttaaagcaccggagtgatcagatgtcgacatctccttgtctactgtgtacttcaaagctgattacatcgctgagctgtacatttcgagcaatgtaaattatatgtttatactaccacaccttcaactttctgttttgtgatacccttgaactttatttagaataagctttagatatgggacacttcggctatccaggttcttgacgacggagagggcttaacacctgagcggccggattctggcaagggtgaactgtaggacgttgtccttgatctgtccatcaacgccgggctcacagcatgtgatggccgactggtccatagaacaagaagagtgccagagtcctgctcaccaaatgacgcatttatttatgtttttttggttataaatattcagttaaatcaaaaaaaaaaaaaaaaaaaa

SEQ ID NO: 2878 - protein, 586 aa, Panicum virgatum
  misc_feature: Ceres CLONE 1787841
  misc_feature (1)..(113): Pfam Name: DAO Pfam Description: FAD dependent oxidoreductase
  misc_feature (2)..(47): Pfam Name: Amino_oxidase Pfam Description: Flavin containing amine oxidoreductase
  misc_feature (1)..(37): Pfam Name: Pyr_redox_2 Pfam Description: Pyridine nucleotide-disulphide oxidoreductase
MPPLAARVHAPPLLAPAARPAARLRASSGPRGGGGVRRGALASEKPVAVAVAEKAGEGGGGGGWGEGPYDAIVVGSGIGGLVAATQLAAKGARVLVLEKYLIPGGSSGYYRRDGFTFDVGSSVMFGFSDKGNLNLITQALEAVGRKMEVLPDPSTVHFHLPGDLSVLVHRKYEDFVNELISKFPHEKEGILKFYGICWKIFNSLNSLELKSLEEPLYLFGQFFQKPLECLTLAYYLPQNAGDIARKFIKDQELLSFIDAECFIVSTVNALQTPMINASMVLCDRHFGGINYPVGGVGGIATSLADGLVEKGSEIHYKANVTNVILENGKAVGVRLSNGKEFFAKTVISNATRWDTFGKLLKDKELPEEEKNFQKNYVKAPSFLSIHTGVKASVLPAGTDCHHFVLEDDWNNLEKPYGSIFLSIPTVLDPSLAPEGHHILHIFTTAGIEDWEGLSRKEYEEKKEAVANEIIRRLEKKLFPGLQDSIVLKEVGSPKTHRRFLARNDGTYGPMPRSKPKGLLAMPFNTTSIDGLYCVGDSCFPGQGVIAVAFSGVMCAHRVAADIGLEQRSPVLDAGLLGLLRWLRTLA

SEQ ID NO: 2879 - DNA, 1569 bp, Panicum virgatum
  misc_feature: Ceres CLONE 1787843
  misc_feature: Encodes the peptide sequence at SEQ ID NO. 2880
cacgtctccctagtccttggcgcgggcgcaagcgcggcgcaaccccctcgcttgctcgcggccgcgcggaagagacaggcgcggagaatggcgccgctacacgccgccccgccgccgccctcggcctgctcatcctcctccccggcgggcccggccttcctcgccaggccgcaccaccaccaccgcagggcggtggcgacggcctcctgctgctcccccgcagtgaccgccgcagcagccgctccgtcgaggaaagcgttcctgtcatgcccggatcacagccccgggcgtgcactggcgccgccacgcatcaccccgtcgtcgtccccggcgctcgtcgagtccgtgaaggacctgtacgacttcatctgcagcgggccgctggtggacaggatcggctactccaaggagaagatcgccgagtccatcgaccggtggctgcgctgcggaagtcagatcgctcgactgttccgcctcaacgagctccagctgtcggaggccgagaaagtcaggatataccacttctacatccccgtcttcctctggtgcgaggaccaggtcatcgagcacagggacaaatacaaggagggcgacgacatcccaccattggtgattggggtcagcgctcctcaaggaagtggaaagacgactcttgtcttcacgcttgattacctttttcgtgttgctggtaggaattccaccacgttgtctatagatgacttctatttgacagcaaaagaacagaatgaactgagggaaagaaatcctggaaatgctcttttagagctccgtggaaatgctggaagccacgatctccaattctcagttgaaacacttgagtcacttaccaaactaactaaggaaggtatgaagatgaaggttccacggtatgacaagtctgcttttgggggaagaggtgatcgtgctgatccttcagtgtggccagatgttgaaggaccattggaggttattctctttgaaggatggatgcttggatttaaacctcttccaaatgaagttgtgaaagcagtggatcctcagctcgaggtggttaacaagaacctagaagcatactataatgcttgggacaggttcatcgagtcatggatcgttataaaaatacgagaacccaattgtgtattccagtggaggctgcaggcagagatagctatgagagcggatggaaaacctggaatgtccgatgaggaggttatggattttgtatcgcgctacctaccggcataccatgcgtatttgcccacgctatacaaagagggaccaaatggttcaaaaccagagcagctgctggtcattgacatagatgaagggaggaaccctttgtggggcagctgaggttgtgaattcctaatgtacatgctgaaaaagtgaaaatggattttttttctgactccacagagcagcttgggatctctgctctttatgagacttcttatgttaagcaagcactataggcatctttgttcccatggttcgaatatattgtgaacctgtaaattccatgcataacgaattttgttatctatcatggaaaaaaaaaaaaaaaaaaaa

SEQ ID NO: 2880 - protein, 421 aa, Panicum virgatum
  misc_feature: Ceres CLONE 1787843
  misc_feature (77)..(418): SWISSPROT Homolog: EC 2.7.1.31 D-glycerate 3-kinase, chloroplast precursor
MAPLHAAPPPPSACSSSSPAGPAFLARPHHHHRRAVATASCCSPAVTAAAAAPSRKAFLSCPDHSPGRALAPPRITPSSSPALVESVKDLYDFICSGPLVDRIGYSKEKIAESIDRWLRCGSQIARLFRLNELQLSEAEKVRIYHFYIPVFLWCEDQVIEHRDKYKEGDDIPPLVIGVSAPQGSGKTTLVFTLDYLFRVAGRNSTTLSIDDFYLTAKEQNELRERNPGNALLELRGNAGSHDLQFSVETLESLTKLTKEGMKMKVPRYDKSAFGGRGDRADPSVWPDVEGPLEVILFEGWMLGFKPLPNEVVKAVDPQLEVVNKNLEAYYNAWDRFIESWIVIKIREPNCVFQWRLQAEIAMRADGKPGMSDEEVMDFVSRYLPAYHAYLPTLYKEGPNGSKPEQLLVIDIDEGRNPLWGS

SEQ ID NO: 2881 - DNA, 2059 bp, Panicum virgatum
  misc_feature: Ceres CLONE 1787851
  misc_feature: Encodes the peptide sequence at SEQ ID NO. 2882
accaccaaggcaccaagtaccaaccaaatcgtccgcgcgcactgaggcgaggcccccgcgctcccctcctcgccgcccgtcgagcacaacggatcaacgccggtgcatcgtcgctatccctccctctctcccatcggcgaaagcattgactgcttcggcttcatgagttcagggaaagcactggcacccagcatctcttattcgacagtgaacagcaccatcttctttctctgcctttttgccggatacttgggaattcctggtggaagcttccacttgcttaaggctattcgcagtggaggaagcctaatttagtcctcactgtggccgaagtcttagttcaaaagcctttcctaggagttgctaagcctttgaaacatggtttcttctcagccttccaccctgacagaaaccctcgcacagggccccaaactctgcccagtcaagatacttctcccaatgggccccccagatgttgtctcctcagaaagtgtggagtatgatttctctgatgttttcggttccaccccagtccaaacaccaacaaacctttgtggccatggtccagacagccctgcacctactgctgagtccaatgaagaggtttacaatgatcctgttgtcatcatcaagcgatcccattctcttgtcggtccaacatcacttgttagccggtccttgcgacttagcaagcgcagtctaggaaaaacagcgggatcatcagaacttgcaaagtgcctctcagaagaaaaggaaggggaacaaaggcagctcagcgatgaagagtttgataatgctacaacagaggacgagggcgttgggcttgatgattttgaaatcttgaagcttgttggccaaggggcatttggcaaagtatttcaggtgagaaagaaaaatacttcggagatatatgcaatgaaagttatgaggaaggataagatactggaaaataatcatgctgagtatatgaaagccgagagggatatattgacaaaagtagaccactctttcatagtgcagctgaggtactcatttcagacgaaatatcgactttatcttgtcctggacttcgtaaatggggggcatcttttctttcagctctacaagcagggattatttagggaggagcttgcacgaatctatacagctgaaattgtatctgctgtagcgcatcttcatgccaatggaattatgcatagggatctcaagcctgaaaacatccttctggatgccgatggccatgccatgctcactgactttggccttgcaaaggaattctgtgaaaataccagatcaaactcgatgtgtggcactcttgagtacatggccccagaaattattcttggccgggggcatgataaggctgcagactggtggagcgtgggaatcctcctcttcgaaatgcttacgggcaagcccccatttgttgggaacagggacaaagttcagcagaagattgtaaaagaaaaactgaagcttccttcatttttgtcaagtgaagctcattccctcctgaaaggcctgctgcacaaggagcccaacaatcggctgggcagcggccctagaggcagcgacgagataaagaaccacaagtggctcaaaccaatcaactggaggaagctggaggcccggcagatccagccaagcttcaggcctaacgtcgctgggctgacctgcattgccaacttcgacgagtgctggacgaagacgcccgtgctggactcgccggtggccacccctgctggcggtgggcacaacaacttcgcagggttcacttatgtcaggcctgcgccgatccttgaggaggtgcagccatcgagctctaggctgaaagactagggtgctagcgcattggaaatgtgcgtacaattttgatcgagtgatattttggtagtgggtgtcttctgcgatgatccgcaaaagagacgttctctgtaattctgtggcgtgttgtatatcaaacatgtaccatttgcatgtaaacatggactaggggcagacagttttttttatatatcacaatgtacgagagtttgctcaaaaaaaaaaaaaaaaaaaa

SEQ ID NO: 2882 - protein, 486 aa, Panicum virgatum
  misc_feature: Ceres CLONE 1787851
  misc_feature (1)..(470): SWISSPROT Homolog: EC 2.7.11.1 Serine/threonine-protein kinase AtPK19
  misc_feature (26)..(472): SWISSPROT Homolog: EC 2.7.11.1 Serine/threonine-protein kinase AtPK1/AtPK6
MVSSQPSTLTETLAQGPKLCPVKILLPMGPPDVVSSESVEYDFSDVFGSTPVQTPTNLCGHGPDSPAPTAESNEEVYNDPVVIIKRSHSLVGPTSLVSRSLRLSKRSLGKTAGSSELAKCLSEEKEGEQRQLSDEEFDNATTEDEGVGLDDFEILKLVGQGAFGKVFQVRKKNTSEIYAMKVMRKDKILENNHAEYMKAERDILTKVDHSFIVQLRYSFQTKYRLYLVLDFVNGGHLFFQLYKQGLFREELARIYTAEIVSAVAHLHANGIMHRDLKPENILLDADGHAMLTDFGLAKEFCENTRSNSMCGTLEYMAPEIILGRGHDKAADWWSVGILLFEMLTGKPPFVGNRDKVQQKIVKEKLKLPSFLSSEAHSLLKGLLHKEPNNRLGSGPRGSDEIKNHKWLKPINWRKLEARQIQPSFRPNVAGLTCIANFDECWTKTPVLDSPVATPAGGGHNNFAGFTYVRPAPILEEVQPSSSRLKD

SEQ ID NO: 2883 - DNA, 1879 bp, Panicum virgatum
  misc_feature: Ceres CLONE 1787856
  misc_feature: Encodes the peptide sequence at SEQ ID NO. 2884
aacatcgagcagccgcagccgcagccgcgccaaacctccgcgagctcgctaatggcgctcgcactgtccacgctcccgctcctgccctccaatccctctccatcctccggcgccacccctgccgccgccgcgttccctcctcgtcgggtccaaatcgctgccgccggtaggagcggcggcggcgtcctcccgctcgcgtgtgccgcgccgcggcatcgcgggcgggttccgaggcggcgccgtggagggagcctggtggtctgggcgtcggctgactactacgcgacactgggcgtgccgcgctctgcgaccaacaaggacatcaaggccgcctaccggaagcttgcgcgccagtaccatcctgatgtgaataaggagcctggagcaactgaaaagtttaaagagataagtgcagcatacgaggtgttgtcagatgaaaagaagaggtcattatatgaccaatatggtgaagctggggttaagagtgcagttggaggctcgggtggaacttacacaactaatccattcgatctgtttgagacattctttggagcaagcatgggtggcttttccggcatggaccggagcacatttaggacacgcaggcgaggcactgctgttcagggtgaagacatcagatatgatgtgattctgggcttcacagaggcgatatttggaacagagaaagacattatattatcgcatttggaaacatgtgatacatgtggtggttctggatcaaaggctggctccaagctgagaatatgttccacatgtggtgggcgaggacaagtaatgcgaactgagcaaacaccatttggtctgttctcccaggtttctatttgccccacttgtgctggagagggcgaagtcatttcagagtattgcagaaaatgttctggagagggacgtattcgtgtcaggaaggagatcaaagtgaaaatccctccaggagtgagtaaaggtagcactcttcgtgtacgtggagaaggtgatgcaggaccaaaaggtgggccaccaggagatctttatgtttgccttgatatagaggagccatcagatatcaaaagggatggtataaacttgtattcaactctgtcgataaactaccttgaagctattttgggcaccactaagatggtcagaactgtggatggaaccagtgaacttcgaatacctccaggtacccaacctggtgatgtaattgtcttggcgaagcaaggtgttccatcactgaataagccatctatacgtggtgatcatctattcactgttacggtcacaatacctagacgtataagtgggcgcgaaagggagttacttgaggaacttgcatctttgagtgatggtggttttgctcgaacagccgccaagccgaaacccgccaagccaaaacacgtacatgaagggacagaagttggcacaagtcaagaaggtacagataaatccaatgaaggagaggatgactggttgaagaaacttacagattttgcagggtccgttgtcaatggtgctgcgaagtggctgaaagacaacctgtaggttgtaaatatttactatagtccgatctgcaatttttcaattcatcggggttcccacgagctcttacattcattttgttggagggcttaaagattttcaggctggcaaccgagagagtgagacctgtcaactaatatagtggagacattgatatgttctgtcttggaaaggaatgattattatgtagttgcagttatttcaattttccaagcacatgtagatgtagcagcctgaagttgcgggatgctgatgtgaaacccagagattcggcaatgttgtaaatatgtttttaattccccctgaagtagggtttcatgaaaaaaaaaaaaaaaaaaaa

SEQ ID NO: 2884 - protein, 496 aa, Panicum virgatum
  misc_feature: Ceres CLONE 1787856
  misc_feature (1)..(62): Pfam Name: DnaJ Pfam Description: DnaJ domain
  misc_feature (1)..(123): Pfam Name: DnaJ_C Pfam Description: DnaJ C terminal region
  misc_feature (1)..(85): Pfam Name: DnaJ_CXXCXGXG Pfam Description: DnaJ central domain (4 repeats)
MALALSTLPLLPSNPSPSSGATPAAAAFPPRRVQIAAAGRSGGGVLPLACAAPRHRGRVPRRRRGGSLVVWASADYYATLGVPRSATNKDIKAAYRKLARQYHPDVNKEPGATEKFKEISAAYEVLSDEKKRSLYDQYGEAGVKSAVGGSGGTYTTNPFDLFETFFGASMGGFSGMDRSTFRTRRRGTAVQGEDIRYDVILGFTEAIFGTEKDIILSHLETCDTCGGSGSKAGSKLRICSTCGGRGQVMRTEQTPFGLFSQVSICPTCAGEGEVISEYCRKCSGEGRIRVRKEIKVKIPPGVSKGSTLRVRGEGDAGPKGGPPGDLYVCLDIEEPSDIKRDGINLYSTLSINYLEAILGTTKMVRTVDGTSELRIPPGTQPGDVIVLAKQGVPSLNKPSIRGDHLFTVTVTIPRRISGRERELLEELASLSDGGFARTAAKPKPAKPKHVHEGTEVGTSQEGTDKSNEGEDDWLKKLTDFAGSVVNGAAKWLKDNL

SEQ ID NO: 2885 - DNA, 1678 bp, Panicum virgatum
  misc_feature: Ceres CLONE 1787867
  misc_feature: Encodes the peptide sequence at SEQ ID NO. 2886
atccccgccgccgcgcctcccatcctctcctctcctctccgccccgcgccgaagaacccccggccaaacccccagcccgtgataacctcgcacctgccttcgccccgtcgaccatggcgctccaggcggcgacgtccttcctcccctcagccctctccgcgcgcaaggaggtgagccgcgggagctctttctccgtgcgtgcgcgtgcgtttcccccggcgagcaccccggctgcggctgcgattgcggggtcggtgaaggactcggcgttcctgggtgttcgtctcgcggatggtctcaagctggagaccagcgctctgggccagcgcaccaagagggcgagcacgtcggtggccatccgcgcgcagacggcggcggtgtcctccccgtcggtgacgcccgcgtcgccgtcgggcaagaagaccctccgcaagggcaccgcggtcatcaccggcgcgtcgtcgggcctcggcctggccacggcgaaggccctggcggagaccggcaagtggcacgtcatcatggcgtgccgcgacttcctcaaggcgtcgcgcgcggccaaggcggcgggcatggacaaggacagctacaccatcgtgcacctggacctggcgtccctggacagcgtccgccagttcgtgaagaacgtgcggcagctggagatgcccatcgacgtggtggtctgcaacgccgccgtgtaccagcccaccgccaaggagccctcctacaccgccgacggcttcgagatgagcgtcggcgtcaaccatctcggccacttcctcctcgcctgcgagctcctcagcgacctccagtcctccgactacccctccaagcgcctcatcatcgtcggctccatcaccgggaacacgaacacgctggccgggaacgtgccgccgaaggcgaacctgggcgacctgcgcgggctcgccggcggcctgaacggcgtgggcagctcggtgatgatcgacggcggggagttcgacggcgccaaggcgtacaaggacagcaaggtgtgcaacatgctgacgatgcaggagttccaccggcggtaccacgaggagacgggcgtgaccttcgcgtcgctctacccggggtgcatcgccaccacggggctgttccgggagcacatcccgctgttccggctgctgttcccgccgttccagaagtacatcaccaaggggtacgtctccgaggaggaggccgggaagcggctggcgcaggtggtgagcgaccccagcctcaccaagtccggcgtctactggagctggaacaagaactcggcgtccttcgagaaccagctctccgaggaggccagcgacgccgacaaggccaagaagctctgggagatcagcgagaagctcgtcggcttggcatgatcgatgtacatcaccatggccggcgccggctgccggtgacagtttttttaattcccctctaggacaagttcgttagttgatctcagacagagtgttaatgcccccgcgtcaagagtgccaagaacacaagtgtgtacacgtgtacaatatatgctactgcaccgtgatggtttttgcagtggactgtaactctagccttttgctctgcttttggtcattgattacgggtaataagaagtcactattgggctaccaaaatcaaatcagcaattgcctttcagcaaaaaaaaaaaaaaaaaaaa

SEQ ID NO: 2886 - protein, 420 aa, Panicum virgatum
  misc_feature: Ceres CLONE 1787867
  misc_feature (1)..(129): Pfam Name: adh_short Pfam Description: short chain dehydrogenase
  misc_feature (30)..(420): SWISSPROT Homolog: EC 1.3.1.33 Protochlorophyllide reductase B, chloroplast precursor
  misc_feature (47)..(420): SWISSPROT Homolog: EC 1.3.1.33 Protochlorophyllide reductase, chloroplast precursor
MALQAATSFLPSALSARKEVSRGSSFSVRARAFPPASTPAAAAIAGSVKDSAFLGVRLADGLKLETSALGQRTKRASTSVAIRAQTAAVSSPSVTPASPSGKKTLRKGTAVITGASSGLGLATAKALAETGKWHVIMACRDFLKASRAAKAAGMDKDSYTIVHLDLASLDSVRQFVKNVRQLEMPIDVVVCNAAVYQPTAKEPSYTADGFEMSVGVNHLGHFLLACELLSDLQSSDYPSKRLIIVGSITGNTNTLAGNVPPKANLGDLRGLAGGLNGVGSSVMIDGGEFDGAKAYKDSKVCNMLTMQEFHRRYHEETGVTFASLYPGCIATTGLFREHIPLFRLLFPPFQKYITKGYVSEEEAGKRLAQVVSDPSLTKSGVYWSWNKNSASFENQLSEEASDADKAKKLWEISEKLVGLA

SEQ ID NO: 2887 - DNA, 1611 bp, Panicum virgatum
  misc_feature: Ceres CLONE 1787870
  misc_feature: Encodes the peptide sequence at SEQ ID NO. 2888
ccgcctccccactgcacgctccagctcagtttcccaggtaagcaaagcctcccccagccatgtcggcgctcggcgcgctctccggcggcgccgccggtgtcgccggcctcctcagcctccgccgccgcgccgcgccaccaccctctgggctcgcaaccccggcgcacctcccgcctctcaagtgcgccgtcctgcccgatgccggccagctcgtctggggccgccagctccgcccggcgctccttcccgctgccctgctcccgccgcagcccgccaggaggcacgccctgtgcccgcccgccgcagccgcagcctcaggggaggccaagcccgcgggtttcctcgacaagtaccctgccctggtcaccggcttcttcttcttcatgtggtacttcctcaacgtcatattcaacatcctcaacaagaagatctacaactacttcccctacccatactttgtgtcgctcatccatctggtagttggtgtcgtatactgcctcatcagctggtctgtcggtctccccaagcgtgcgcctatcaattccaatctcctgaagctgctctttccagtggcgctgtgccatgctcttggtcatgtcactagcaacgtctccttcgctgctgttgcagtctcatttgcccacactatcaaagctctggagcccttcttcaacgcagcggctactcagtttgtccttggacagcaggttcccttgtctctgtggttgtcccttgcccctgttgtcattggtgtttcgatggcatccctcactgagctctcattcaactggactggcttcatcaatgccatgatctctaacatctcattcacttacaggagtatttattccaagaaagctatgactgacatggatagcaccaacgtgtatgcttacatctcgataatttcgctccttgtttgcattccacctgcactgatttttgaaggacctcaactgatgcagcacggatttagcgacgctattgcaaaagtaggtctgcaaaagtttgttactgaccttttcttggttggactgttctaccatctgtacaaccagcttgctacaaatactttggagcgagtggctcctctgacacacgctgttggcaacgtgttgaaacgtgtgtttgtcattggtttttcaatcattgtttttggcaacagaattacgacacaaactggaattggaacttgcattgccatagctggtgtggccatgtactcttacatcaaggctaggattgaagaggagaaaaggaaaaggagcgcatgatgaggtgactactgtgaatatgtgtcgggtggctgagttgtgcttcctgagacaacatcgtcgacaatcatgacttccttctctgccttgtttttttttcccaccttgagtcatttggtcaattgtttgttcccaaactggtgttgaacagcagcacattgcagatggcaagtatattgctcttcttaccatcagaacagataatcgttgcgtgcgcatgaatgtgtagaaaataaacgctcatacttgaaaggctttttggtttgtactatgtggtaactctgtaagactgtaaattctgtttgtggaactatcagggatgcagatttgggttctt

SEQ ID NO: 2888 - protein, 404 aa, Panicum virgatum
  misc_feature: Ceres CLONE 1787870
  misc_feature (1)..(145): Pfam Name: TPT Pfam Description: Triose-phosphate Transporter family
MSALGALSGGAAGVAGLLSLRRRAAPPPSGLATPAHLPPLKCAVLPDAGQLVWGRQLRPALLPAALLPPQPARRHALCPPAAAAASGEAKPAGFLDKYPALVTGFFFFMWYFLNVIFNILNKKIYNYFPYPYFVSLIHLVVGVVYCLISWSVGLPKRAPINSNLLKLLFPVALCHALGHVTSNVSFAAVAVSFAHTIKALEPFFNAAATQFVLGQQVPLSLWLSLAPVVIGVSMASLTELSFNWTGFINAMISNISFTYRSIYSKKAMTDMDSTNVYAYISIISLLVCIPPALIFEGPQLMQHGFSDAIAKVGLQKFVTDLFLVGLFYHLYNQLATNTLERVAPLTHAVGNVLKRVFVIGFSIIVFGNRITTQTGIGTCIAIAGVAMYSYIKARIEEEKRKRSA

SEQ ID NO: 2889 - DNA, 1559 bp, Panicum virgatum
  misc_feature: Ceres CLONE 1787884
  misc_feature: Encodes the peptide sequence at SEQ ID NO. 2890
gcccatccgctccatttccgatccaccgcgcttgtcatcgttgccctcgccgccgtcgtgcccagagactgggaccttcaaagagcaacaggactcatggaggctggagacgcaggaaacggttctgcagcagcggcacagataaagggaagtggggatgatgcctcctgcaaaccgctgcctccttgctgcgtcaaggccaaggcaggcgtgcctgaagctgaggccaagtgccatgataccgttgtttcgggctggttcactgaaccccggtcacgcttcggtaaaacaagcaaagtgcagtactacaacaaccctatgtggcctggagaggctcattcactgaaagtggagaagattttgtaccaagggaaatcgccctaccaagagattttagtttttgagtcttcaacctatggaaacgttcttgtgcttgatggtatagttcagttgactgacaaagatgaatgcgcataccaggaaatggttactcaccttccactgtgctcaattccatcaccaaaaaatgttttggttgttggaggtggtgatggtggtgtactgcgggaaatagccagacatgattcagtggagactattgatatatgtgagattgatcagcttgttattgatgtttgcaaagaattctttccaaacttatccatggggtttaaagatcctcgtgtccgacttcatgtcggtgatgctgttgatttcttgagggattctcctgaagggaaatatgatgctattattgttgattcatcagatccaattgggccagctcaggcacttgtggagaaaccatttattcagacaattgctagagctttaaaggccggtggtattctttgtaatcttgctgagagcatgtggctgcacacacatctaatccaggatatgctctctatatgtcgtcagacattcaaaggtggtgtgcactatgcctggacaagcgttccaacataccccagtggtgtcattggatttttgctatgtgctaaagaaggtccgccagtgaacttcttaactcctgtgaacccaattgagaaaatacaaggagctacaaaagctggaaaggaactcagattttacaattcagagattcatagggctgcttttgttctgccaacatttgtaagaagagaactggaatcatatgatactagtagtacttctactgaaaaggagaacccaaaagaatcagtttcaaaatcgcagaagataaagattttgccgaacaattccattcttacagcttcctaagcttgaatcatactcaatctacctctgagttctgacagaaaaaaaaaacagttgctgagaagtggcgcggcgccaggagtataagtatatactgggtttgtgagtgatgactgattgaataatggggtaattgaactgctgtgatgcctaccggaataatgtgtttcccctttgtttcatgtgtttggtgtgcataatttcccaacttggaacttgtaagacctgttgatgtaatatgggccatttgcataactgccctcgttttcacctcttaaaaaaaaaaaaaaaaaaaa

SEQ ID NO: 2890 - protein, 389 aa, Panicum virgatum
  misc_feature: Ceres CLONE 1787884
  misc_feature (1)..(260): Pfam Name: Spermine_synth Pfam Description: Spermine/spermidine synthase
  misc_feature (73)..(354): SWISSPROT Homolog: EC 2.5.1.16 Spermidine synthase
  misc_feature (73)..(354): SWISSPROT Homolog: EC 2.5.1.16 Spermidine synthase 2
MEAGDAGNGSAAAAQIKGSGDDASCKPLPPCCVKAKAGVPEAEAKCHDTVVSGWFTEPRSRFGKTSKVQYYNNPMWPGEAHSLKVEKILYQGKSPYQEILVFESSTYGNVLVLDGIVQLTDKDECAYQEMVTHLPLCSIPSPKNVLVVGGGDGGVLREIARHDSVETIDICEIDQLVIDVCKEFFPNLSMGFKDPRVRLHVGDAVDFLRDSPEGKYDAIIVDSSDPIGPAQALVEKPFIQTIARALKAGGILCNLAESMWLHTHLIQDMLSICRQTFKGGVHYAWTSVPTYPSGVIGFLLCAKEGPPVNFLTPVNPIEKIQGATKAGKELRFYNSEIHRAAFVLPTFVRRELESYDTSSTSTEKENPKESVSKSQKIKILPNNSILTAS

SEQ ID NO: 2891 - DNA, 1944 bp, Panicum virgatum
  misc_feature: Ceres CLONE 1787888
  misc_feature: Encodes the peptide sequence at SEQ ID NO. 2892
gttctccctccctgcctgcctccattgctgctgctgctttgcttcctctccctccccccgcctgctatcaaatcccatcccaccaaccccctctgctctgctctgctctcccttggaatgcgaatgctccatccatagcaacaaaacaataccctaggcctgacctcctactccgatggcgaccgccgccagggtcagggaggcgcgtctgccgccgccaccgctgcccctggccacgctcatcggccgcgagctccgcgccggcggctccgagcgcccggccctgcgctacggccacgcaggcttcgccaagcgcggggaggactacttcctcgtcaagcccgactgcctccgcgtccccggagatccctcatcggtcttctccgtcttcgctgtcttcgacggccacaacggcgtctccgccgcggtctacagcaaggagcatctgctcgagcacgtcattagcgcgctgccgcccgacatcggccgcgacgactggctgcaggccctgccgcgcgcgctcgtcgcgggctttgtcaaggccgacatcgatttccagcgcaagggcgaggtctcgggaaccacggcaacgctggtcgtcgtcgacggcttcaccgtcaccgtggcgtccgtgggcgactcgcgctgcatcctcgacacgcagggcggcgaattgcagctgctcaccgtcgaccaccgcctcgaagagaatgcagaggagcgggagcgcgtcacggccagcggtggggaagtcggccgcctcaatctctttggtggccaggaggtcggtcctctccggtgctggccaggtggcttgtgcctttcaagatccatcggggacatggatgttggggagttcattgtgccaattccacacgtcaaacaagtcaagttatcgaatgtcggaggaaggctaataatagcatcggatggcatatgggatgcgctatccaatgaagcagctgcaaaggcatgccgaggattgcctgcagaactggctgcaaagcttgtggttaagcaagctctgaaaacaagtgggctcaaggacgacaccacctgtgtagttgttgacattatcccatctgatcatttgacatcaccgcaattgtctccaaagaaaaatcagaacaagttgaagtcacttttccgtagaaggtcgcatagttcagttggaaaacttggaggcaagtctgcctcatttggttctgtggaggagttgtttgaagaaggatctgcgatgttagaagaaaggttgggtaggaatctgtccttgaaagcagcttcaccacctttccgttgtgcaatctgccaagtggaccaagaaccatttgaaggtttgatgacagataacagtggcggttactgctcttccccatacgcgccatggggtggtccacatctttgtttggaatgtcggaaaaagaaagacgcaatggaaggtaaaagatccagccgctctacagcatgcaggtgaaacgaatcaaagctctgattcttaagtcaagtcagctgctcagaatgcagaaactaagagagggtaataagctgctggatccaagtatgataataattgtttggtgaagctaactgtattctcagcctggtacaaaaagatattggctgctaaccagtttgttgtctacggataacccggagtgaaaagtttgattgatattcttcttgagggaatagttgaaataatttggagcttgtagttttgatgtagcctggcctatctatagtgtgccgccttgtgcagggaaaaaattgacctgcctagtgttgtctgtgaatcgttatttatttataaatagatggtttatagtatctacttctaggatgctctttggattaattgttgcatgtatttttatttttattttattactggaactgaagtacgaaacgtgtgctagtaatgtgcaaaaaaaaaaaaaaaaaaaa

SEQ ID NO: 2892 - protein, 432 aa, Panicum virgatum
  misc_feature: Ceres CLONE 1787888
  misc_feature (1)..(253): Pfam Name: PP2C Pfam Description: Protein phosphatase 2C
MATAARVREARLPPPPLPLATLIGRELRAGGSERPALRYGHAGFAKRGEDYFLVKPDCLRVPGDPSSVFSVFAVFDGHNGVSAAVYSKEHLLEHVISALPPDIGRDDWLQALPRALVAGFVKADIDFQRKGEVSGTTATLVVVDGFTVTVASVGDSRCILDTQGGELQLLTVDHRLEENAEERERVTASGGEVGRLNLFGGQEVGPLRCWPGGLCLSRSIGDMDVGEFIVPIPHVKQVKLSNVGGRLIIASDGIWDALSNEAAAKACRGLPAELAAKLVVKQALKTSGLKDDTTCVVVDIIPSDHLTSPQLSPKKNQNKLKSLFRRRSHSSVGKLGGKSASFGSVEELFEEGSAMLEERLGRNLSLKAASPPFRCAICQVDQEPFEGLMTDNSGGYCSSPYAPWGGPHLCLECRKKKDAMEGKRSSRSTACR

SEQ ID NO: 2893 - DNA, 2212 bp, Panicum virgatum
  misc_feature: Ceres CLONE 1787899
  misc_feature: Encodes the peptide sequence at SEQ ID NO. 2894
cggtccggtgcgggcgtgagatccatccaacccggctgcgggtcggccgttctcctcctcgcgtcggtgagcaacccgcaatcacgcctcgctcggtttccgcaggctccgtgcgcggtccagtccgggcaattcgccctcctcgtccggtttcctgtggattttgcggactgcgttgtgccctacctatccaatccgcgcgtaattcgagtaggctcttctaattcgccgcggggcgccgccggcgcgaggccagtccggcccgtggtgcggagcggtttgtgctgcggaaattgaaggggttcttgtggtttatcacccccgttcctcgcgcccgtttgggaattcttgtggtttgtcacttactgggcatctattggctcctgtttggaacgcaggaatttcgtatgagacagctagttcaaattggcacaggaaccgagggcaattcactcatttgcgaactagccctaaattttctaggcaactgcaccagcctgtcaactctggtggcaggtggttgtatagtaccgtgtattgctgtttggaaattagccacggatacagatacccggaccttttgtaaagattgctctgccttggtactatatagggcacttggagtaattctgacatgcatgcttttgaattattcccggtcaattccctgctgcaatgaggtttaatacatgtttctatggttgggatcaatgatatatgacacacttggagtatttctgacatgcatgtgtttgaattattcccggtcaattccctgctgtgatgaggtttagtacctgtttcgatggttgggatcaatgataaatgacgcctgttccatggtcttcttaaaagctcgtttttatccaaaaaaataccacgtgaagtttctgcctctctggatatgctttaaacttgcatttagaattttttttggtgtgctttatccacgaagtgctaatgagctttgtgcttggtttcaggaaagtttttgtgtgcttcatccatgacaagctaaagatatcgcatgaacagtgccagttagtctgcctttgctctgtcttgatcctgattgttttgtgctttgccttgcaaagaaaggaatcatgacttcagttgttcatagtgtttcaggtgaccacagagctgaggatcaacatcaacagcagaagcaagctgaacctgaggaccagcaagaagccccagttactagttcagatagtcaaccaacagtgggcacaccatcagctgattatgtgactccctatgcccctcatgacatggctcatgcaatgggtcaatatgcctacccaaatattgatccatactatggaagcctatatgcggcttacggtggacagccaatgatgcatccaccgttggtcggaatgcatccgactggcttacctttgcctactgatgcaattgaagagcctgtgtatgtaaatgcaaaacaatacaatgccattttaaggcgacgccaatctcgggctaaagctgaatcagaaaggaagcttgtcaagggccgtaagccctatctccatgagtcacgtcatcagcatgccttgaaaagggccaggggagctggaggcaggtttctcaattcaaagccagatgacaaggaagagaactctgactcgagtcacaaagagaaacaaaacggagtcgcgccccacaagagtggccaaccgtcaacccctccctctcccaacggtgcatcttcagctaatcaggcagacagtcaccaatgaggcttcgagaactcacagccgaagagagttaagcccctgacgctagatgtggcaacagatctgtacagcaagtgctagcgggcaacagcaaggatggtgtcggttggttgtggtaggacatattccatagaaaaacatagacgagtcagacaggttttgcagtttggtttgttcctctaagtttattcacctttgtgtacaattctagtagcattgtgtcctcatggatagctcagtcagttcttcagaaagcctttgtagcatatcagcccattgtttgttgcttggagttggagatttgggattggagttcataacctgctgtcctgcatcatcatccgcagcacagaataatcgctggctatgtgtatgttagatgacaataaaccctaatgtaggacatgtgagcacctcatctgaatctagctttgtttcctctgcaaaaaaaaaaaaaaaaaaaa

SEQ ID NO: 2894 - protein, 214 aa, Panicum virgatum
  misc_feature: Ceres CLONE 1787899
  misc_feature (1)..(57): Pfam Name: CBFB_NFYA Pfam Description: CCAAT-binding transcription factor (CBF-B/ NF-YA) subunit B
  misc_feature: The sequence is a functional homolog of  SEQ ID NO 2852 in the  10/374,780 US patent application
  misc_feature: The sequence is a functional homolog of  SEQ ID NO 696 in the  10/225,066 US patent application
  misc_feature: Useful for making plants with modulated growth and phenotype characteristics
MTSVVHSVSGDHRAEDQHQQQKQAEPEDQQEAPVTSSDSQPTVGTPSADYVTPYAPHDMAHAMGQYAYPNIDPYYGSLYAAYGGQPMMHPPLVGMHPTGLPLPTDAIEEPVYVNAKQYNAILRRRQSRAKAESERKLVKGRKPYLHESRHQHALKRARGAGGRFLNSKPDDKEENSDSSHKEKQNGVAPHKSGQPSTPPSPNGASSANQADSHQ

SEQ ID NO: 2895 - DNA, 2036 bp, Panicum virgatum
  misc_feature: Ceres CLONE 1787929
  misc_feature: Encodes the peptide sequence at SEQ ID NO. 2896
ccctccccagctcgtcttcacctcccaacccctcgttgtttctataattccccccaactccaccgccaccaacctcctccgcttctccctcccaccatcgccaccaccgcctgctgttccatgaaggactagtcaatccgtccaccacagccatggcgccgctcgcggagctctcgttgctcctcttattggtcctcctctcgccgttcgtggcgtcagctggtgtcgccaagctcaactcttcgtcgcccctgtttggcatcgagttcccgccgttcaacaccgccgtcgccgacaccggctgcgacggcaagctggtagcgggggatgagcggaagcagccggcgagcctgtccccgtcgctgaagctgcacatgacccgccgcgccgatgcggcgggcaggacgcggaaagactcgttcttggattcggcccacaaggacgccgtccgcatcgagacgatgcgccggagggcgtcgccggcacggcctggtggccaacgggcggcggcggcgtactccccgcggcgcgctctgtcggagcggctggtggcgacggtggagtccggcgtggcggtcgggtccgacgagtacctgatggacgtctacgtcggcacgccgccgcggcggttccagatgatcatggacaccggcagcgacctcaactggctgcagtgcatgccgtgcctggactgcttcgagcagcgcggcccggtgttcgagcccgcggcgtcctccacctaccgcaacgtgacctgcggcgaccagcgctgcggcctcgtggcgccgccggaggcgccgagggcgtgccgccgcccgggcgacgacccctgcccctactactactggtacggcgaccagtccaacaccaccggcgacctggccctcgagtccttcaccgtcaacctgacggccccgggcgcgtcccggcgcgtggacggcgtggtgttcgggtgcgggcaccggaaccgcggcctcttccacggcgcggcggggctgctcggcctcgggcggggcccgctgtcgttcgcgtcccagctccgcgccgtgtacgggcacaccttctcctactgcctcgtcgaccacggcagcgacgtcggcagcaaggtggtgttcggggaggacccgctgctgctggcgcacccgcggctccactacacggcgttcgcgcccgcgtcctcgccggcggacacgttctactacgtccagctcaggggcgtgctcgtcggcggcgagctgctgaacatcagctcggacacgtggggcgtgtccaaggacgggtccggcggcacgatcatcgactccggcacgacgctgagctacttcgcggagccggcgtacagggtgatccggcaggcgttcgtggaccgcatgagcaggtcgtacccgctgatcgccgacttcccggtgctcaacccgtgctacgacgtgtccggcgtggagcggcccgaggtgccggagctgtcgctggcgttcgccgacggcgcggtgtgggacttcccggcggagaactacttcatccggctggacgacgggattatgtgcctggcggtgctgggcaccccgcgctccggcatgtccatcatcggcaacttccagcagcagaacttccacgtggtgtacgacctgcagaagaaccggctgggcttcgcgccgcggcggtgcgccgatgtctaggcggcggcggcgaggccgcgccgcagttccattgatttcgttcaacaacagtatgtagcaatagctgattgggaggcgaattgggtgtagaaatttttggttgggaaggatggtggcacgcacacaagctctagtactagtagtattttaaaaaaaacaaaggtttttggtgctcaaatctccaagcagaggagattgggaactagaagtaggaacaccctagtcgtttctaccattccgtctgtacacagtaagtcattacgggtcaaaaagaattttgcctgatttcctttttgttccgcgttgtttgggcgataacaggaagaagtattcattcagtaaaaaaaaaaaaaaaaaaaa

SEQ ID NO: 2896 - protein, 507 aa, Panicum virgatum
  misc_feature: Ceres CLONE 1787929
  misc_feature (1)..(359): Pfam Name: Asp Pfam Description: Eukaryotic aspartyl protease
MAPLAELSLLLLLVLLSPFVASAGVAKLNSSSPLFGIEFPPFNTAVADTGCDGKLVAGDERKQPASLSPSLKLHMTRRADAAGRTRKDSFLDSAHKDAVRIETMRRRASPARPGGQRAAAAYSPRRALSERLVATVESGVAVGSDEYLMDVYVGTPPRRFQMIMDTGSDLNWLQCMPCLDCFEQRGPVFEPAASSTYRNVTCGDQRCGLVAPPEAPRACRRPGDDPCPYYYWYGDQSNTTGDLALESFTVNLTAPGASRRVDGVVFGCGHRNRGLFHGAAGLLGLGRGPLSFASQLRAVYGHTFSYCLVDHGSDVGSKVVFGEDPLLLAHPRLHYTAFAPASSPADTFYYVQLRGVLVGGELLNISSDTWGVSKDGSGGTIIDSGTTLSYFAEPAYRVIRQAFVDRMSRSYPLIADFPVLNPCYDVSGVERPEVPELSLAFADGAVWDFPAENYFIRLDDGIMCLAVLGTPRSGMSIIGNFQQQNFHVVYDLQKNRLGFAPRRCADV

SEQ ID NO: 2897 - DNA, 1348 bp, Panicum virgatum
  misc_feature: Ceres CLONE 1787934
  misc_feature: Encodes the peptide sequence at SEQ ID NO. 2898
gatgaagcgagctctttgccacaagatcgcagcgattccatgctgtggtaggaccgagcgccggattttctctacgccatggatgccagcgacttggccgggttcagcagctaacggagcccgaaaaaatccatctcgtcttctttggaagcctgccactgtcaccgccaaggccacaccgacaccttcctccacgtccatggagcccgccgcggacgaggtggccttcgagtccccggcgcacttccgcatctacaagagcggcaggatcgagcgcctcaaccggcctctggccctccccgccggcctcgacgaggccaccggcgtcacctccaaggacgtcgtcctggacgccgggaccggcctctcagcgcgcctctacctcccgaagctccaggcggagccgtccaagaagctccctgtcctcgtctacttccacggcggcgcgttcctgatcgagtcggccgtctccgccacgtaccacacctacgtcaaccccctcgcggcggcggcgggcgtcctcgcggtgtccgtgagctaccgcctggtgccggagcacccgctcccggcggcctacgaggactcctgggccgcgctccagtgggcggcgtcggcggaggacgagtggatcgccgagcacggcgacgtggcgcgcctcttcctcgcgggcgacagcgccggcgccaacatcgtgcacgacatgctgctgagggcgtctggcgacggcggcgggccgcgcatcgagggcgccgtcatgctccacccgtggttcggcgggaacgcgcccatcgagggggagcccgagggctcttcggcggccaccgctgggctctggacgtacgcgtgcccgggcgcggtcggcggcgccgacgacccgaggatgaacccgctggcgcccggcgcgccgccgctggagaagctcgggtgcgcgaggatgctggtgtgcgccgggaagaaggacgcgctctacctgcgggaccgcgcgtactacgaagccgtggcggccagcgcgtggcccggggacgtggcgtggctcgagtccgagggggaggatcacgacttcttccttgggaagcccgagtgcgagaacgccaagaagctcatggaccgcgtcggggccttcatagccggagcctgatttgctctacctgcgcgctcgaagcatgattcgaggttcgagccgccatggaacttattgtgctagttttctgatgattgaataaatcggtcttggtccggatatatgattgtttttctagaggcactccgtagtattgaactgcttgttgaaactgaaacttttaagcaaatggaaacaatttctactcaaaaaaaaaaaaaaaaaaaa

SEQ ID NO: 2898 - protein, 378 aa, Panicum virgatum
  misc_feature: Ceres CLONE 1787934
  misc_feature (1)..(215): Pfam Name: Abhydrolase_3 Pfam Description: alpha/beta hydrolase fold
MKRALCHKIAAIPCCGRTERRIFSTPWMPATWPGSAANGARKNPSRLLWKPATVTAKATPTPSSTSMEPAADEVAFESPAHFRIYKSGRIERLNRPLALPAGLDEATGVTSKDVVLDAGTGLSARLYLPKLQAEPSKKLPVLVYFHGGAFLIESAVSATYHTYVNPLAAAAGVLAVSVSYRLVPEHPLPAAYEDSWAALQWAASAEDEWIAEHGDVARLFLAGDSAGANIVHDMLLRASGDGGGPRIEGAVMLHPWFGGNAPIEGEPEGSSAATAGLWTYACPGAVGGADDPRMNPLAPGAPPLEKLGCARMLVCAGKKDALYLRDRAYYEAVAASAWPGDVAWLESEGEDHDFFLGKPECENAKKLMDRVGAFIAGA

SEQ ID NO: 2899 - DNA, 2331 bp, Panicum virgatum
  misc_feature: Ceres CLONE 1787942
  misc_feature: Encodes the peptide sequence at SEQ ID NO. 2900
gtgaccgcgcgagctagacccgacccagcaatcgggccaccgcccctttcctctccgatccggatcttccccgcccgctccggcgagccgtcgccgcgtcgcctccacgcgaccagtcacctcatatatctatctagcagacttccccgccgccgcgcgcgcgcgcccaaccctaggctgcgcccccccccccatttacctgtttgctctatcagctcccgagcccagcaaaccctagtcgccgccgcccatggacatagagaccgacgggcgattcggcaataagcgcgtgcacaatcgcctcggcccgggccccggcggcgccccgtcatctaccaccggcaaggtctgcaacttctggcgcgccgggcggtgcaaccgcttcccgtgcccctacctccacagcgagctccccgaggcggcggcgccgcccaagcgctccgctggacccgggggcaacgtctggcgcaaccccaacaccggaggacgaggaggcggcggtcacaatagatgggggaggggccctggaggcggcagcggggctgcgacccacaggccgccggacaggccctgcaagttcttcctcgccggtaccgattgcagctatggggagaggtgccgctacccccacagctactgcataagcgatagcatcacgatgctcaccctgctcaagggccacgagaagggtgttaccggcattgcgctgcccactgggtcggacaagctgtattctgggagtaaggatggaactgttcgcacgtgggattgccaaactgggcagtgtgctggtgtcatcactatgggtcgtgaagttggctgtatgatcagtgaaggtccgtggttattcgttggtatacctgatgcggtgaaggtttggaatatgcaaacagcagcggaaatgaatcttactggaccaactgggcaagtctatgcgctcgctgttgccagtgagttactctttgccgcaacacaggatgggaggattttggcatggagatttagctccgcaactaactgtttcgagccagctgcttctcttgatggccataagcttgctgttgtttcattaatagtaggaggcatgagactttattcagcttcaatggataaaacaatcagagtgtgggatttggcaacattgcagtgcatacagactctttctgatcataccgatgttgttatgtctgtgctgtgttgggatcagtttctattatcgtgctctttagatcaaaccataaaagtttgggcagctacagagagtggaaacttagaagtaacatatacacacaaagaggagcagggtgcacttgccctcagtggtatgcccgatgcacagtcaaaacctgtgctactgtgttcgttaaatgacaatactgtccgcctatatgatctgccatcgttcagtgataggggcagaatattctccaaacaagaaattagggcaatacaaatgggtcctggtggtttattttttaccggggatggaactggggagctgaaggtttggcaatgggtagatgcagcccaaacctaatgaacatagtgtgctagattagttttgctcatgtgttttatgagggagtgctcgcaaatacacataatgagttgaggttgtggttggcggccggttcttttttggtgatatgccctacatttatttgcaaaggatacaagattcaatcgatgtggctggcagttcatgctggcacaagcagtctgtgttatggactgtagttttgtcctggcatgaatttcaagacgtgagaataattgcttgtagtttgtaaagcactgcgaccagcaagtatccgatcattgcttggaggtgccgacagtttcaaaaggatagctaatataaagggtttgttgagctgcatttgtatacgaggaacttggttgcttttctcacagcagtgccatttttcgttgtttgaggactatgagcatctttaccttcagagaactgttgagtaatttaatttggcccagtgagctagcaatttttttgccaatcggatcagcttcagttcttgtgagttgatttggcccagtgagtggcagctagagcagcacaagtattcgggagctccgcgcaaagcttgtaccagtatttatctagatttgtgtttagatagcagccaagtctttgttgatgttattgtttctatttgttgctgaatcatgaggacaaatggtgaaatcattggaattgtgtactacgcggcgttgtactgactttacattcttcttcggatcagaaatgggagcaacggtaaaatctgtgtgctttgtttttcagttcacctttaaaaaaaaaaaaaaaaaaaa

SEQ ID NO: 2900 - protein, 428 aa, Panicum virgatum
  misc_feature: Ceres CLONE 1787942
  misc_feature: Great-hit functional homolog of the protein sequence given in SEQ ID NO 9334
  misc_feature: Great-hit functional homolog of the protein sequence given in SEQ ID NO 9529
  misc_feature: Useful for making plants with altered terpenoid content
  misc_feature: Useful for making plants with modulated biomass
  misc_feature: The plant is abnormally small.
MDIETDGRFGNKRVHNRLGPGPGGAPSSTTGKVCNFWRAGRCNRFPCPYLHSELPEAAAPPKRSAGPGGNVWRNPNTGGRGGGGHNRWGRGPGGGSGAATHRPPDRPCKFFLAGTDCSYGERCRYPHSYCISDSITMLTLLKGHEKGVTGIALPTGSDKLYSGSKDGTVRTWDCQTGQCAGVITMGREVGCMISEGPWLFVGIPDAVKVWNMQTAAEMNLTGPTGQVYALAVASELLFAATQDGRILAWRFSSATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEEQGALALSGMPDAQSKPVLLCSLNDNTVRLYDLPSFSDRGRIFSKQEIRAIQMGPGGLFFTGDGTGELKVWQWVDAAQT

SEQ ID NO: 2901 - DNA, 1816 bp, Panicum virgatum
  misc_feature: Ceres CLONE 1787953
  misc_feature: Encodes the peptide sequence at SEQ ID NO. 2902
agcgattgccgcccacccacccacgcagtgccgaccttcttgttgcccccgccggggtccagcccgctggccggcggcgctcccgcgccgccttgccttcgctgtcggccgaaccgccaaaaccaccagatcctctgcaacgagttcctctccttcccacgccgtcaccgcggcggaggcgacagccgctgaccgctcagccctctccggccggccaccgcctgcctcgtcgtggcttcgaagtgactccggcgatcggtccctcgctggcgctgccgcgcacggctcgacaagagtaggcggcgccccctggttgcgggttggggcgtgaaggatgagcgggaggaagaatgccggaagcacctccccctggatgctcatcctcatctccctagtatgcttcttcgcgacctacaacttcctgacgatgcccagccggggttgggacgggccgcgcaagttcctcggcgggggcggcggggatcgggactcggctgtctcgtacaggtcgggctctggttcggaccccaataagcggttccacgtcgcgctgacggcgacggatgcgctttacagccagtggcagtcccggataatgcactattggtacaaggagatgagggaccggcctgggtccgatatgggcggcttcacaaggatccttcactcggggaagcctgatggattgatggatgagatacccaccatggtggttgacccgcttcctgaaggcaaggataagggatacattgtcttaaataggccttgggcgtttgtccagtggctgcagaaagcaaagatcgacgaagactatatactaatagcggagccagatcatatctttgtgaagcctttgccaaacttagcccatggtgatgaaccagcggcttttccatttttctacatcaaaccaaccgagaacgagaagatattgaggaagttctttccagaagaaaaaggacctgtctcaaaaatcgatcccattggcaactctccggttataatcaagaaggctcaacttgagaagattgcaacaacctggatgaatgtttcactacaaatgaaagaggatcaggagacagacaaagcatttggatgggtcttggaaatgtatgcatatgctgttgctagtgcactgcacggtgtgcaccatagtctccgtaaagattttatgattcagcctccttgggacctgaaatcagacaacacattcatcatccattacacatatggatgcgattattcgatgaagggtgagctaacttatgggaaaattggtgagtggcgttttgacaaaagatcttaccttcaatcaccaccaccaagaaatctttcactaccccctccaggagttcctgaaagtgtggtcacccttgtgaagatggtcaacgaggccacggcaaacattccagggtgggaggacgaaagataactgatggtattgctgagtcgtagcttgtttcagcttccagctagtatggtctttgttggaaaacatggaagagtaccactggccaattaaagaagagtattcaatctcatagtgtagggctggccaattttctacggtttaacataggttagtgtttgggaaggaaaagttatattcactttgatctagcgagtcacatcatttttgtattgtaaatcagaaatataggcttttggttactcttggttcattttgccacgttataaagcggagatgtagtttagaatcctccaatgcataccatgagaggtctgtaaaaactaaaaagtcatcttgggaaaaaatctgctggagtgctgacaacaaaaaaaaaaaaaaaaaaaa

SEQ ID NO: 2902 - protein, 365 aa, Panicum virgatum
  misc_feature: Ceres CLONE 1787953
  misc_feature: Great-hit functional homolog of the protein sequence given in SEQ ID NO 9662
  misc_feature: Useful for making plants with modulated drought sensitivity
MSGRKNAGSTSPWMLILISLVCFFATYNFLTMPSRGWDGPRKFLGGGGGDRDSAVSYRSGSGSDPNKRFHVALTATDALYSQWQSRIMHYWYKEMRDRPGSDMGGFTRILHSGKPDGLMDEIPTMVVDPLPEGKDKGYIVLNRPWAFVQWLQKAKIDEDYILIAEPDHIFVKPLPNLAHGDEPAAFPFFYIKPTENEKILRKFFPEEKGPVSKIDPIGNSPVIIKKAQLEKIATTWMNVSLQMKEDQETDKAFGWVLEMYAYAVASALHGVHHSLRKDFMIQPPWDLKSDNTFIIHYTYGCDYSMKGELTYGKIGEWRFDKRSYLQSPPPRNLSLPPPGVPESVVTLVKMVNEATANIPGWEDER

SEQ ID NO: 2903 - DNA, 1491 bp, Panicum virgatum
  misc_feature: Ceres CLONE 1787968
  misc_feature: Encodes the peptide sequence at SEQ ID NO. 2904
gcgaaaaacaataccgctgtacacaaacgaggaagtccaggtagtagccggacccgccgacgccgatactatggagggcgacgaccggagggccccgctgctgggcgccggcggccgtcccccgtctctgcggcgccgggactcggctcggtcgctgcgcagcagcttcctgtcgcggctgcccgacaaggtgcgcgccgcgctcgatcccgagcgcaccgccgacgtcgacctcgcccgcgctaaaggcctctcccaaggtgagagagagtactacgagaagcagttcgcgacgctgagaaccttcgaggaggtggaggcgctctgcatgcccggcgaattcgagtcggatgagtctgactatggggccttcgaggacaaggagcagaagcagagcgagttcgccatgaagatttccaactatgccaatattgtgctgctggttttcaaggtgtatgctacgatcaggacggggtccatggcaattgcagcatccacgcttgactcgttgctcgatttcttggccggcggcatcctttggttcacacacctttcgatgaagagagtgaacatttacaagtacccaattggcaagttgcgtgttcagccggttgggatcatcgtctttgctgccatcatggcgactctaggtttccaggtcttggtcacagctattgagcaattggtggagaataaacctggcgagaagatgacctcagagcagctaatatggttgtactccatcatgctttcagcaactgctgtgaaacttgctctctggctgtactgcaagagttcaggaaacagcattgtccgggcttatgcgaaggaccactattttgatgtgataaccaatgttgtcggtctggtggctgctgttcttggggacaaattcttatggtggattgaccctgcgggggctgtactgcttgctgtatataccattgtgaactggtccaaaactgtgttagaaaatgcagctaccctagtgggccaatgtgcccctccagagatgctgcaaatgctgacctacctcgccatgaagcacgacacacgagtcaagcgggttgacactgttagatcttacagcttcggagctctctacttcgtcgaggttgacattgaactctcagaggatatgcggctacgagaggcgcacaccatcggcgaaacgctgcaggagaagatcgagaagctgcctgaagtcgagcgggcatttgttcatattgattttgagagcacgcataagcctgaacataaagtacggagcaggctgccggctactgatccttgagagattttcacatactcgtgaacaatgttagatttaactaagagcattatgcttcattttaaggcgccggagttcagcgacaaactcaatgataaagtttaatttcctttcctcctgtaaaataagagctgcacggatgtctaactggagtaatgcaggagttaacctttccggtctaaaaaaaaaaaaaaaaaaaa

SEQ ID NO: 2904 - protein, 407 aa, Panicum virgatum
  misc_feature: Ceres CLONE 1787968
  misc_feature (1)..(281): Pfam Name: Cation_efflux Pfam Description: Cation efflux family
MEGDDRRAPLLGAGGRPPSLRRRDSARSLRSSFLSRLPDKVRAALDPERTADVDLARAKGLSQGEREYYEKQFATLRTFEEVEALCMPGEFESDESDYGAFEDKEQKQSEFAMKISNYANIVLLVFKVYATIRTGSMAIAASTLDSLLDFLAGGILWFTHLSMKRVNIYKYPIGKLRVQPVGIIVFAAIMATLGFQVLVTAIEQLVENKPGEKMTSEQLIWLYSIMLSATAVKLALWLYCKSSGNSIVRAYAKDHYFDVITNVVGLVAAVLGDKFLWWIDPAGAVLLAVYTIVNWSKTVLENAATLVGQCAPPEMLQMLTYLAMKHDTRVKRVDTVRSYSFGALYFVEVDIELSEDMRLREAHTIGETLQEKIEKLPEVERAFVHIDFESTHKPEHKVRSRLPATDP

SEQ ID NO: 2905 - DNA, 1805 bp, Panicum virgatum
  misc_feature: Ceres CLONE 1787972
  misc_feature: Encodes the peptide sequence at SEQ ID NO. 2906
attggatccccctctgctctctctgctcgcaacgcagtggctcggccgcggaggcagacagaaacctccagactcgggacgccagcacacgctcccgcagtagccgagagcgtgggagtgggaggcgcggggcagtcgccgccggcggagtccaccgctgtcggagatgaaggagaggagcggctcgagggcggcggtggatgagcgctacgcgcagtggaagtcgctcattccggtgctctacgactggttcgccaaccacaacctcgtctggccgtcgctgtcctgccggtggggcccgcaatttgagaaagctacctacaagaatcgccagcgcctttacctatctgagcagacggatgggagtgtgcctaatactctggttattgcgaactgtgaagttgtcaaaccaagggttgcagctgctgaacatatctcacagttcaatgaggaagcacgatcgccttttgtgaagaagtataagactatagttcatcctggtgaggttaacagaatcagggagcttccacagaacagtaagatcatagccactcacaccgacagtccagatgtacttatttgggatgttgaagcccaaccaaatagacatgctgtcctaggagcaactgaatctcggcctgatctgatattaacaggacatcaggaaaatgctgaattcgcgcttgccatgtgtccagcagaaccatatgtactgtcaggaggaaaggacaaatctgttgtcttgtggagcatccaagaccacatatctgcccttggggattcctcatcttctcctggagcatctggcagcaagcagtctggcaaaactgcgaatgaaaaggagagtcccaaagttgatcctcggggtatattccatggacatgacagcactgttgaagatgttcagttctgcccttccagtgcacaggaattctgtagtgtgggtgatgatgcttgtcttattctctgggatgcccggactggtacgagcccggctgttaaggttgagaaagctcatagtggggatgttcattgtgtggattggaatccgcttgatgttaactatatcttaactggttctgctgataactctgtccgtatgtgggatcgtcgcaatctgggttctggaggagctggttctccaattcacaaatttgagggccataaagctgctgttctttgtgtccagtggtctcctgacagagcatctgttttcggaagttctgcggaagatggtttcttaaatgtgtgggatcatgagaaggttgggaagaaaaaaaattctaacgtaccagctgggcttttctttcaacatgctggtcacagggataagattgtagacttccactggaattcatcggatccttggacgatcgtcagtgtctcagatgacggtgagagcactggtggaggtggaacactgcagatatggcggatgagtgatttgatctaccgcccagaggaggaagttctccaagaactggagaatttcaaggctcacttggccagctgcactccgaggaactgaatcctgtgattatctgtggaatccaatgcagtgcagagtgcagactctgagtaggtgttactagtttcctagccatgaacaatggcttcagttgacattggtattgtcctctgattcatgctccaagacccgcgacttgtgagcttgtattaagcttgttgtgtgaacgtagcagagctggatatctccgtagtctgtaggccgactatatattgctggatattgttgacagttattctgaattcttctattggacctaaaaaaaaaaaaaaaaaaa

SEQ ID NO: 2906 - protein, 453 aa, Panicum virgatum
  misc_feature: Ceres CLONE 1787972
  misc_feature: Great-hit functional homolog of the protein sequence given in SEQ ID NO 9487
  misc_feature: Useful for making plants with modulated flowering time
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGATESRPDLILTGHQENAEFALAMCPAEPYVLSGGKDKSVVLWSIQDHISALGDSSSSPGASGSKQSGKTANEKESPKVDPRGIFHGHDSTVEDVQFCPSSAQEFCSVGDDACLILWDARTGTSPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEEEVLQELENFKAHLASCTPRN

SEQ ID NO: 2907 - DNA, 1014 bp, Panicum virgatum
  misc_feature: Ceres CLONE 1787974
  misc_feature: Encodes the peptide sequence at SEQ ID NO. 2908
tccccgcgaataaaaacttttctagcctccctttgaatccatccatccatccacccagccattgctcgtctccctcccaaattcgatgcctttgtagcgctgccgcttcgcccctgcgtcgcgccgcgccgtgcggtgcacttgccgctgcgcttcccatggacgctggggccggtgccagatctggcaatgcctccggcggcggcgcgtccgcgtgctgctactacgccctgctcggcatccgcaagaacgcctccgccaccgacatccgcgccgcctaccggaggctcgcgatgaagtggcacccggaccggtgggcgagcgaccccggcgccgccggcgaggccaagcggcggttccagcggatccaggaggcctattccgtcttgtcggacaaggggaagaaggccatgtacgacgccgggctcttcgatcccctggacgacgacgacgaccaggatttctccgacttcatgcaggagatgctggtgatgatggataacgtgaaaaacgagaagccggacacgctggaggacctgcagaagatgctggaggacatcgtcaacggcgacgatgggagccgcggcgcgggcgggcgcgtgccgccggacggcgcccggcgggcgcgcgtcgcgccgtacccgcagcagcaggggcgcaggtgaccggcgcgccggtgtacgagatgtacacgcgacgagcctgcgctttcgccagcaaagccaacgggaggctctggaaagaagggggagaataaaaatgaaatgaaattgccaagtcggaggcgattgccatctgatgatttgaccgtagtaagtagccgggcgcccgctcggctccggccgcgccgccgcaagaaaccggcggacgcgtggccggggactctgatttgttattggccgtgtttggatgggatgtgaaaacattttcatgaaaactttttttttttgatgctttgaccactaattaaagatattaaataaagtctaattacaaaaaaaaaaaaaaaaaaaa

SEQ ID NO: 2908 - protein, 168 aa, Panicum virgatum
  misc_feature: Ceres CLONE 1787974
  misc_feature (2)..(67): Pfam Name: DnaJ Pfam Description: DnaJ domain
MDAGAGARSGNASGGGASACCYYALLGIRKNASATDIRAAYRRLAMKWHPDRWASDPGAAGEAKRRFQRIQEAYSVLSDKGKKAMYDAGLFDPLDDDDDQDFSDFMQEMLVMMDNVKNEKPDTLEDLQKMLEDIVNGDDGSRGAGGRVPPDGARRARVAPYPQQQGRR

SEQ ID NO: 2909 - DNA, 731 bp, Panicum virgatum
  misc_feature: Ceres CLONE 1787980
  misc_feature: Encodes the peptide sequence at SEQ ID NO. 2910
aaaaactcgccgcgccgcgccgcagccaccccccaccagcaccccgagtcctggagagaagcagatcggcggcgcgtcactccaactgccggtaagcttaaatggcgacggttcctgattctctgatctgggagatcgtgaggaagaataactccttcctggtcgagcagtttggcaatggcaatggcaatgccaaggttcagttcagcaaggagcctaacaacctctacaatgtccactcctacaagcactctggccttgccaacaagaagaccgtgactgtgcaaccagccagtggcaaggagatagcggtggtcctcttgacaaccaagacaaagaagcagaacaagcctgccagcctcaaccacaagtctgtcatgcgcaaggaattccgcaagatggccaaggctgtcaagaaccaggtcggtgacaattactacaggcctgatcttaccaagccagctcttgcaaggctgagcgcagtgtaccgcagcctccagattgccaagtctggtgtcaagaagaagaacaggcaggcgaactaagtcacaaggagttgttttgatgggtggtgtttatgtttcatggtttctagatctggactatgatggatgatgtgcgtacctaagactgccacaaattttcattgtaggttccacctttgtacccaactacccatgacatgattaagcatgtgaatatccttttagtaaaaaaaaaaaaaaaaaaaa

SEQ ID NO: 2910 - protein, 147 aa, Panicum virgatum
  misc_feature: Ceres CLONE 1787980
  misc_feature: Great-hit functional homolog of the protein sequence given in SEQ ID NO 9265
  misc_feature: Useful for making plants with altered oil content
  misc_feature: Useful for making plants with modulated cold sensitivity
MATVPDSLIWEIVRKNNSFLVEQFGNGNGNAKVQFSKEPNNLYNVHSYKHSGLANKKTVTVQPASGKEIAVVLLTTKTKKQNKPASLNHKSVMRKEFRKMAKAVKNQVGDNYYRPDLTKPALARLSAVYRSLQIAKSGVKKKNRQAN

SEQ ID NO: 2911 - DNA, 1549 bp, Panicum virgatum
  misc_feature: Ceres CLONE 1787990
  misc_feature: Encodes the peptide sequence at SEQ ID NO. 2912
cttccccttcctcacaagcagccccaaacccacgaaaccctcctctccttccctcgccgccgcttcctcctcccgccgcccgctcccgtacccaacccgaccttcgtgacagcgggaatcggagccgcggggcaggatgccgccgaagaaggccgccccgtcgaaggcggagctggcgaagaagcagaaggtcgtggaggacaagaccttcgggctcaagaacaagaacaagagcaagaacgtccagaagtacgtccagtccctgcaccaggccgtccagcccaagcccgacccgaccaagactgccgccaagaaaaagaaggaggaggagaaggcgcgcgagaaggagctcaatgatctgttcaaggtcgccgtcagccagcccaaagtcccagttggtgttgatcccaagtcaatattgtgcgagttcttcaaggctggccagtgccagaagggttttaagtgcaagttctcacatgacctaaatgtccagaggaagggtgaaaagattgatatctacactgacaagcgtgatgcagaaaccatggaggactgggatcaggaaactctcgagaaggttgttgaatcgaagaaaacagagtatcagcagaacaaacctactgatattgtctgcaagtactttcttgatgccgtggagaagaaacagtacggctggttttgggtttgcccaaatggtggtaaagattgccactacaggcatgcccttccgcctggatatgtactaaaatcccaaatgaaggccttactggaggaagagagtgaaaagatagctattgaagatgagattgaagatcagcgcaaaaagacaaagtctaccactcctatgaccacggaattgttcatggaatggaagaggaagaaggcagaagaaagagaagctggccaagctgccttgaaggcggagagggctaagagtgatcgcatgagtggtcgtgagttgttcatggctgatgcaagtgtgttcgttgatgatgcggaagcatatgaagtttatgagagagaggaagagtctgaggccaacgaagaatcgagcaagaaaagtcaggatgcaggtccaagttcatcaacttctaatggcaaggaggttgaggagccagacaacgaagacatcgatgttgatgatgacttggacattgatgaattaaatgaacttgaagcaagcctgtcgagaacttccatccaaatccgagagcctgacgatggaacatcatcttgagcaagtggtataatgaaagattgttgagaagtgctctctatttttgggctcctcaaaccaatctagttgctattggaaacggaaaggtggagcatagatgcaagtggagttgatttctaggagactatgtgtcgatgttcacgctatctcgagggagcaatgatccacagatgacgcccagtgtttgattacatgacaattgatgtttgtcgtgtgcccttttatcatgtaacccttttgggagatatgctgctacttgtgaataacaggactcaattatttttgttgacttaaaaaaaaaaaaaaaaaaaa

SEQ ID NO: 2912 - protein, 366 aa, Panicum virgatum
  misc_feature: Ceres CLONE 1787990
  misc_feature (1)..(26): Pfam Name: zf-CCCH Pfam Description: Zinc finger C-x8-C-x5-C-x3-H type (and similar)
MPPKKAAPSKAELAKKQKVVEDKTFGLKNKNKSKNVQKYVQSLHQAVQPKPDPTKTAAKKKKEEEKAREKELNDLFKVAVSQPKVPVGVDPKSILCEFFKAGQCQKGFKCKFSHDLNVQRKGEKIDIYTDKRDAETMEDWDQETLEKVVESKKTEYQQNKPTDIVCKYFLDAVEKKQYGWFWVCPNGGKDCHYRHALPPGYVLKSQMKALLEEESEKIAIEDEIEDQRKKTKSTTPMTTELFMEWKRKKAEEREAGQAALKAERAKSDRMSGRELFMADASVFVDDAEAYEVYEREEESEANEESSKKSQDAGPSSSTSNGKEVEEPDNEDIDVDDDLDIDELNELEASLSRTSIQIREPDDGTSS

SEQ ID NO: 2913 - DNA, 1799 bp, Panicum virgatum
  misc_feature: Ceres CLONE 1787999
  misc_feature: Encodes the peptide sequence at SEQ ID NO. 2914
atcctcagcccaatcctcccagcaaagagctcgagcagcagtgagatctcagcagcacgcgaaaacctccacccggcgagctctgtagcgcgcgcggatcggcgatgcctgcggcggcggcggcggtggcggcggggctggcgacggggccgggcagccgcgtgacgcggttcgccaagtccacggcggcgtcggtgacccccgtgcggccgggcaagacgcacacgctgtcgccgctggacaacgccatggagcgccacacggtgcacgtggtgctctactgccgcgccgcgccgggcctggaccgggagcagctcaaggagtcgctctccgaggtgctctcgctgtacccggccatgaccggccggctcacgcgccgcgaaggcggcgagggggcccccgcggaggccgatcccgcgcagcgcgggtgggtcgtcaagtgcaacgacgccggcgtgcgcatggtggacgccagggcggcggccacgctcgacgagtggctcgccacggcgaccggcgacgaggagatggatctcctctactacgagcccatggggcccgagccttacatctggtcgccgttctacgtccagctgacggagttcgcggacaagtcgtacgcgctggggctgagctgcacccacatccacaacgaccccaccgccgccgcgctcttcttccaggcctgggccgccgcgcaccgccggaccaccagcacctacccgcccttcctccacgcgccggcgttcgaggtctccccggcctcgccacccccggcgccgcctctgctcgccgagatgtctggcgccgcctccccggccagcgccgatgccgccgccatgtcctccgccacgttccacttcccggcgcctgcggtgcgcgcgttgctctcctccctcgagcccgggaccaccccgttcgcggcgctcgccgcgctgttctggctccgcatcaccggcgccgcggacggggagcgggagctcacgctggcgctggacttccgcaagcggatgtacgcgccgctgccgtgggggtactacggcagcgtcgtccacttcactcgcgcgcgcgccgacctcgcctcggggctgcccgccgtcggggcggcgctggacgcgcacgtggccggcgtgccggaggaggatctgtggcgcgccgtggagtggctccacgcgcggcagcagcaggagggcgccgccgctggggcgttccagatgtacgggccggagctgacgtgcgtggcgctggaccacgtgcccatgtacggcgcggagttcgaggccggcgcgccccgcgcgcgcgtgtcgtgccgcgtgggcggggcagccggcgaggggctggtgatcgtcctccccgcggccgagggcggcgaggcgcgggacgtggtggtgacgctgccagcggaggcgacggccagggtctgccgcgacggcgaggtgctccggcacggcgcccaggtggtgttcggggccaaggccggaaaagaggcctaggccggtcctggtgccacgacggaacaacaagaagaaatcccctgatctgcagttggccagttgctgctggttcccctgaacttactcttttttttttgcaaggttcctgaactttctccacgctctgcacttcgtatctgtgccgttggtttggtttcgatgtaccctttccccatgcatgtgtgtgatgtgtgcgtgatggacgctgcaattgcaacggacgtgtgtgtgtgtgtgtgtgatgtgttgccctgaaactgaaacggacgatacctccaacccgtccaaaaaaaaaaaaaaaaaaaa

SEQ ID NO: 2914 - protein, 462 aa, Panicum virgatum
  misc_feature: Ceres CLONE 1787999
  misc_feature (1)..(439): Pfam Name: Transferase Pfam Description: Transferase family
MPAAAAAVAAGLATGPGSRVTRFAKSTAASVTPVRPGKTHTLSPLDNAMERHTVHVVLYCRAAPGLDREQLKESLSEVLSLYPAMTGRLTRREGGEGAPAEADPAQRGWVVKCNDAGVRMVDARAAATLDEWLATATGDEEMDLLYYEPMGPEPYIWSPFYVQLTEFADKSYALGLSCTHIHNDPTAAALFFQAWAAAHRRTTSTYPPFLHAPAFEVSPASPPPAPPLLAEMSGAASPASADAAAMSSATFHFPAPAVRALLSSLEPGTTPFAALAALFWLRITGAADGERELTLALDFRKRMYAPLPWGYYGSVVHFTRARADLASGLPAVGAALDAHVAGVPEEDLWRAVEWLHARQQQEGAAAGAFQMYGPELTCVALDHVPMYGAEFEAGAPRARVSCRVGGAAGEGLVIVLPAAEGGEARDVVVTLPAEATARVCRDGEVLRHGAQVVFGAKAGKEA

SEQ ID NO: 2915 - DNA, 1740 bp, Panicum virgatum
  misc_feature: Ceres CLONE 1788006
  misc_feature: Encodes the peptide sequence at SEQ ID NO. 2916
actactccaacccagatatccaccaagacctctgcactagtgagcaataatggctgctcctgtccagagcaggaagctgcgcatcctcctcatgcccttcttcgcctctagccacatcggcccattcaccaacctcgccgtccacctcgcggctgcgcggtcggacatcgtcgaggccaccgtcgccgtcagcacggcgaacgccgcggtcgtgcggtcagctcttgcacggcagctgagccccggcagcgcgacggcggtgaggatagcgacgtacccgttcccggtggtggatggcctcccgccgggggtggagaacctctcgaccgtcaaggccgaggacgcgtggaggatctccgtcgccactttcgacgagaccgtgatgcggcccggccaggaagccctcatcagggagcactcgccggacgccatcatcagcgatgggcacttcttctggaacaccgacatcgccgccaatctcggcgtgccatgcatctctttccaagtcatcggaaccttcgcggcgacggccatcacacacctcagggatgccgacatccatggcatcgctgaaggaggtgtggtggctctgcctcgagctgaaggcggcggcgacatactgatcccgcacacggagctgcctgagttcgtgaggagccaggaaatcttggacggccccgtcatggatcggatcacctcgagcatcaaaaggtgcgccggccgggccgtgaacaccttctacgacctggagcaagggtactgcgacattttcgcgagcagtataaagacactgccctcctacttcgttgggcctctcgcgctgcagccggcggcggaggcgccggcagaaacaacaacaggagacagtgcaggagcagggcactcgccgccgtgcatcgaatggctggacagaatgccatctcgatcagttgtgttcctatgtttcggcagcttgacccatgtctccgatgcccagctcgtggagctagctctcgggcttgaagcctcggggaagccgttcctttgggccatcaggaaggatacatggtcgccgccggacgggtggatggatcgtgttggggagcggggcatgctcgtcaggggctgggcgccgcagacgcagatcctggaacaccaggcggtgggggcgttcgtgacccactgcggctggaactccgtgctagagacggtgagcgccggcgtgccggcgctgacgtggccgatggacttcgagcagttcatcatcgagcggctgctgaccgaagtcctggagatcggggagcggctgttcccggagggtgccggggtgcggagcaccaggcctcaggagcacgacctggtcacggccgaggtcgtggcgcaggcggtgaccaagttcatggagcccggaggcaggggagatgcggcgaggagacgggtgaaggagctctccgcccgggctcatgctgccgtggcggaaggcggctcctctcaccgcgacctgcaccgcctgatacacgacctcgtgcaagcaagaacagagccgcagcaaactaatagcagcaccctcgaaaagactattccgcacagcctctctgctgtggctagaagttgaacgactagctggtgctattctgaagcttcggaggtggaactggaagcatcgatgatgtattttgtatggctacacgtcggccaacacgaacaaagtagttttattgcaataaacttaggattcattaaaaaaaaaaaaaaaaaaaa

SEQ ID NO: 2916 - protein, 514 aa, Panicum virgatum
  misc_feature: Ceres CLONE 1788006
  misc_feature (1)..(125): Pfam Name: UDPGT Pfam Description: UDP-glucoronosyl and UDP-glucosyl transferase
MAAPVQSRKLRILLMPFFASSHIGPFTNLAVHLAAARSDIVEATVAVSTANAAVVRSALARQLSPGSATAVRIATYPFPVVDGLPPGVENLSTVKAEDAWRISVATFDETVMRPGQEALIREHSPDAIISDGHFFWNTDIAANLGVPCISFQVIGTFAATAITHLRDADIHGIAEGGVVALPRAEGGGDILIPHTELPEFVRSQEILDGPVMDRITSSIKRCAGRAVNTFYDLEQGYCDIFASSIKTLPSYFVGPLALQPAAEAPAETTTGDSAGAGHSPPCIEWLDRMPSRSVVFLCFGSLTHVSDAQLVELALGLEASGKPFLWAIRKDTWSPPDGWMDRVGERGMLVRGWAPQTQILEHQAVGAFVTHCGWNSVLETVSAGVPALTWPMDFEQFIIERLLTEVLEIGERLFPEGAGVRSTRPQEHDLVTAEVVAQAVTKFMEPGGRGDAARRRVKELSARAHAAVAEGGSSHRDLHRLIHDLVQARTEPQQTNSSTLEKTIPHSLSAVARS

SEQ ID NO: 2917 - DNA, 3835 bp, Panicum virgatum
  misc_feature: Ceres CLONE 1788008
  misc_feature: Encodes the peptide sequence at SEQ ID NO. 2918
aacacctctctctctctctctctctctctctctctctctccctccgaaccgaacccaaactctcctcgcgcgccgccgccgccgctccattcgcggccgccgaatgcccgcgcggcccggcgcgtcctgaccctgaaccctaacacgcgtgcctaccccgcgccgcgcggtgttgtccaagacggcgccctgcggcctcggttgcggcggcgggggaaccgggggaggggccgggaggctgaggcggctcgtggggtccatggcgatggccgggacggcgccggcgccggcgcccacgctgctccggcggtgcccgtgctcggcgcctccctgggcgccctcgcccttccgcccccgccgccgcggccgctcgacgatgtcgcccttcaccggtggcagaaggcaggagtactctcatagttcaggtgctggaattcaagacaacaaacctcttaagtttggagtatgtgtcaactttaacatgcaaagtagtggggcgcaagaatgggctgctgagagcaagaggttatctgccatcagaaccagcaacggtacctacaaaggttccagtcacctagggccagctattcttcatcatgaacaccttgaagatttcaagagctccaagcagtcttcagctcacagtttaagacaaagaatggcgccgaattcacttgcaaataggcatgccaatatggaacctgcaaagcatcacatgattaatcgtgctgcaactgctgtgtcagcactggccagtgttgttaaagatgacaccaaaccagttaacaggcatagtgaatccgaagtggaggctcattggccaaatggttccaagtttcatgcttctcttccgaaaatttctgaaattgaaacaagcttgccatttgatgacaaggctacagaaagcgatcctaaagatgaaaatgaatgctcacccaaggagacagtacaaccttctcccgctaaagcacccttgtccaaggagtctaaagatgcacggaaggcacttgctaccatctatgaaaaagttctggtggttgatgatgtcaagtcagctaggagagttgttcagttgcttactacgaagtacagaaattttattcatgcatgtgatacaaaggtagctaatattgatgttaaacaagagacaccagttggccatggaaaggtcacatgctttagcatctactctggcacttctggtgctgaagcagattttggaaatggcaagacatgcatttgggtggatgtgctggatggtggacgggatgtcctcatggagttttccccattttttgaagattcatcaattaggaaggtttggcacaattatagtttcgatagtcatgtcatagagaactatggaattaaagtttctggatttcatgctgatacaatgcatctcgcacgactttgggattcgtcaagaagaacggatgggggatattctcttgagggacttacaaatgatcacagggtcatgggtgttgtcccaaaggaagtgctaaagatcgggaagcggtcaatgaaaaccatctttggtaggaaaaagataaaaaaagatggatcagaaggtaaaattactgcaattgagcctgttgaaattttacaaagagaagatagagaactttggatctgttattcttcactagattccatgagtacgttgaggctttatgaaagcttgaaaagcaagcttgaaaggatgccatggacttttgatggtgtccccagaagttcaatgtatgatttctatgaggagtattggcgtccgtttggtgctattcttgtcaaaatggaaacagctggaatgcttgtcgaccgtgcttacctttcagagattgaaaaagttgctgttgcacagcgcaaattagttgctgaaaaatttcggaagtgggcatctaagtattgccctgatgcaaaatacatgaatgttaatagtgatattcagattcgacaactcttctttggtggtatagagaacagattcaaacctggtgaatttttgccgaagagtagagctattaaagtgcctaatgatgaaactgcagttgcagaaggcaagaagattccaaagtatcgcacaattgaacttttcagtattgtcgaagacctccaaactgaaatattcactgcaagtggctggccttcagttagtggggatgcattgagaaatttggctgggaaagttccatcggatcttgtttacacaacagatgatgtaagtaatgatgaatgtggtagtgattctgaaatttctgattgtgacctagaagacacctcttatggaactgcatatgaagcatttgggggaggcaagaaaggaaaagaagcatgtcatgccattgcagctctatgtgagatctgttctattgactcgttgatatccaacttcattcttcctttacagggaaatcatatatcatgtaaggaggggcggatccactgttctttaaatatcaacacagaaacagggcgtttatcggcgagaacaccaaatttgcagaaccaacctgcacttgaaaaggatcggtataaaattcgccaagcttttgtcgcagctccagggaacactcttattgttgctgattatggtcagctggagctccggatattggcgcatcttgctggttgtaaaagcatgttagatgctttcaaagctggcggtgacttccattccaggactgccatgaacatgtaccagcatattcgcgaggctgttgaagaagagaaagtaattcttgagtggcatcctcaacctggtcaagagaaacctcctgtgccactgttgaaggatgcttttggtgctgagaggaggaaagctaaaatgctaaatttttccattgcatatggaaaaacaacccatggacttgctcgagattggaaggtttctgttaaggaagcaaaggacacactgaaactctggtatagtgatcgaaaggaggttaaggcttggcaaatgaagcagaaagcgctagcacaggagaagtgtgaagtttatactttgcttgggcgatcacgccgttttccaaacatggctcatgcaacttctggccaaaggggtcacattgagcgtgctgctatcaatgctcctgtacagggcagtgcagcagatgttgctatgtgtgcaatgcttgagatagacaggaatactcgtctgaaggaacttggttggacgctactcttgcaggtgcatgatgaagtgatactggaagggcctgccgagtccgctgaactggccaagtccatagtagtcgagtgcatgtctaagcccttctatggcaccaacatcctgaaggtcgacctggctgttgatgccaaatgtgcgcagaattggtatgcagctaagtagaccatgttgagcaaaaacggtaaggttgtgcctcatcaattcctgcggtgaaattcagtgccttttgaactggtatcaactggtagagtagtgcggccccccaggttggatgccatgcactatttatttcgccatgggcagtgggcgatcggcactcggttgggaaggcattgtgcactaccataaagaccggattagcttgactcccactctcccaattaggatctgtgtcgatctgtcgtttgcatgatgtagtttactgtcccgaagagaagtagtaaaaacgaagcatgcaatgtttataagatttgtctaacatgctgacgtgttagttttttttttaacggacgtattaggttagctgacctattctgctgatgctgaacacttcgctacgtactgcaactgaaactatgttttggtagagactcaagggaatgtaatttagcgtcgttctgttcgtaaaaaaaaaaaaaaaaaaaa

SEQ ID NO: 2918 - protein, 1030 aa, Panicum virgatum
  misc_feature: Ceres CLONE 1788008
  misc_feature (1)..(411): Pfam Name: DNA_pol_A Pfam Description: DNA polymerase family A
MAMAGTAPAPAPTLLRRCPCSAPPWAPSPFRPRRRGRSTMSPFTGGRRQEYSHSSGAGIQDNKPLKFGVCVNFNMQSSGAQEWAAESKRLSAIRTSNGTYKGSSHLGPAILHHEHLEDFKSSKQSSAHSLRQRMAPNSLANRHANMEPAKHHMINRAATAVSALASVVKDDTKPVNRHSESEVEAHWPNGSKFHASLPKISEIETSLPFDDKATESDPKDENECSPKETVQPSPAKAPLSKESKDARKALATIYEKVLVVDDVKSARRVVQLLTTKYRNFIHACDTKVANIDVKQETPVGHGKVTCFSIYSGTSGAEADFGNGKTCIWVDVLDGGRDVLMEFSPFFEDSSIRKVWHNYSFDSHVIENYGIKVSGFHADTMHLARLWDSSRRTDGGYSLEGLTNDHRVMGVVPKEVLKIGKRSMKTIFGRKKIKKDGSEGKITAIEPVEILQREDRELWICYSSLDSMSTLRLYESLKSKLERMPWTFDGVPRSSMYDFYEEYWRPFGAILVKMETAGMLVDRAYLSEIEKVAVAQRKLVAEKFRKWASKYCPDAKYMNVNSDIQIRQLFFGGIENRFKPGEFLPKSRAIKVPNDETAVAEGKKIPKYRTIELFSIVEDLQTEIFTASGWPSVSGDALRNLAGKVPSDLVYTTDDVSNDECGSDSEISDCDLEDTSYGTAYEAFGGGKKGKEACHAIAALCEICSIDSLISNFILPLQGNHISCKEGRIHCSLNINTETGRLSARTPNLQNQPALEKDRYKIRQAFVAAPGNTLIVADYGQLELRILAHLAGCKSMLDAFKAGGDFHSRTAMNMYQHIREAVEEEKVILEWHPQPGQEKPPVPLLKDAFGAERRKAKMLNFSIAYGKTTHGLARDWKVSVKEAKDTLKLWYSDRKEVKAWQMKQKALAQEKCEVYTLLGRSRRFPNMAHATSGQRGHIERAAINAPVQGSAADVAMCAMLEIDRNTRLKELGWTLLLQVHDEVILEGPAESAELAKSIVVECMSKPFYGTNILKVDLAVDAKCAQNWYAAK

SEQ ID NO: 2919 - DNA, 2089 bp, Panicum virgatum
  misc_feature: Ceres CLONE 1788082
  misc_feature: Encodes the peptide sequence at SEQ ID NO. 2920
atcgcagcccaatcggcagcagcagcagcagccaagttttccaaccaaaactcagcgatcgatcacctgctagctccttcatctgatcgagtgccatggcctgcactcaggaggtggtgttcgacttgaacctgatcgagaacagcgccctggaggacggcctggccggctggtcgccggtgggctcgtgcacggcgctgtccgtgcacgaggaggagccggccaaggtgccgacggagacgatcaacgacgtcggcgaggactaccgccccagcggccggtacatcctcgcgtcggggcgcgccgacgaggcggacggcctgcggcaggcgatcaagggcgcgctcaagccccgggtcacgtaccgcgtcgccgggtggatcagcctcggcggcgccgccgccgccgacgctgagggggccggccacgcggtgcgcgtcaacctccgcttggacgacgacgagtgcgtcgtggagggcggcgcggtgtgcgccgaggttgggaagtgggcggagatcaagggcgcgttccggctcaagaagagcccgcgcgccgccgcggtgtacgtgcagggcgcgcccgcgggcgtggacgtgaaggtgatggacctccaggtcttcgccaccgaccgcaaggcacggttcaggaagctcaggaggaagactgacaaggtgcgcaagcgcgacgtcgtgctcaacttcggcagcgcggcggcgtcgggcatctccggcgcgtccgtgcgggtgatgcagatggacagcagcttcccgttcggcgcgtgcatcaaccccgccgtcatccaggacccggccttcgtggacttcttcaccaagcacttcgactgggccgtgttcgagaacgagctcaagtggtaccacacggaggcgcagcaggggcagctcaactacgccgactcggacgcgctgctcgacttctgcgaccgctacggcaagccggtgcgcgggcactgcatcttctgggccgtcgagaacaccgtccagcagtgggtcaagagcctcgacaaggaccagctcacggcggcggtgcaggcccgcctccagagcctgctcacccgctacgccggccgcttcccgcactacgacgtcaacaacgagatgctgcacggcagcttctaccgcgaccgcctcggcaacgacgtcgacgccttcatgttccgggaggcggcgcggctggaccccggcgccgcgctgttcgtcaacgactacaacgtggagggtggcaacgaccccaacgcgacgccggagaagtacatcgagcagatcgcggcgctgcagcagaagggcgcgcccgtgggcgggatcggcctgcaggggcacgtcaccaacccggtcggggaggtgatctgcgacgcgctcgacaagctctccgccgccaccgacctccccgtctggctcacggagctggacgtgtgcgagtccgacgtcgacctccgcgccgacgacctcgaggtggtgctccgggaggcgtacgcgcacccggccgtcgagggcgtcgtcttctgggggttcatgcagggccacatgtggcgccaggacgcctgcctcgtcaactccgacggcaccgtcaacgacgccggcgagaggttcgtggatctccggagggagtggacgtcgcacgcgcgcgggcacatcgacagcgccgggcacttcaagttcagggggtaccacggcacgtacgtcgtgcagctcgccacggcgacggggaaggtgcacaagaccttctccgtggagaaaggggacacacctctcgtgctggacatgaacatctgacgatcgctgctacgaccacgcacaccgtacccggcctagttacattacatacagccttgaaacgaaggtcctagtagttatactgatatcatacacgtattacgtattgatttgctcgaacggagtgcatgcgaaaggaagtgtacggcaaacataaagcactctgtagttttacaattctacaattgggtattgtaagagaaacttaaggtattgtactcccttaagaattattggtgatgatgaataaagtgaacgagctattcctcgttttatagcaaaaaaaaaaaaaaaaaaaa

SEQ ID NO: 2920 - protein, 564 aa, Panicum virgatum
  misc_feature: Ceres CLONE 1788082
  misc_feature (1)..(284): Pfam Name: Glyco_hydro_10 Pfam Description: Glycosyl hydrolase family 10
MACTQEVVFDLNLIENSALEDGLAGWSPVGSCTALSVHEEEPAKVPTETINDVGEDYRPSGRYILASGRADEADGLRQAIKGALKPRVTYRVAGWISLGGAAAADAEGAGHAVRVNLRLDDDECVVEGGAVCAEVGKWAEIKGAFRLKKSPRAAAVYVQGAPAGVDVKVMDLQVFATDRKARFRKLRRKTDKVRKRDVVLNFGSAAASGISGASVRVMQMDSSFPFGACINPAVIQDPAFVDFFTKHFDWAVFENELKWYHTEAQQGQLNYADSDALLDFCDRYGKPVRGHCIFWAVENTVQQWVKSLDKDQLTAAVQARLQSLLTRYAGRFPHYDVNNEMLHGSFYRDRLGNDVDAFMFREAARLDPGAALFVNDYNVEGGNDPNATPEKYIEQIAALQQKGAPVGGIGLQGHVTNPVGEVICDALDKLSAATDLPVWLTELDVCESDVDLRADDLEVVLREAYAHPAVEGVVFWGFMQGHMWRQDACLVNSDGTVNDAGERFVDLRREWTSHARGHIDSAGHFKFRGYHGTYVVQLATATGKVHKTFSVEKGDTPLVLDMNI

SEQ ID NO: 2921 - DNA, 1901 bp, Panicum virgatum
  misc_feature: Ceres CLONE 1788087
  misc_feature: Encodes the peptide sequence at SEQ ID NO. 2922
atcggcgaagttacgcacggtggccgccatggatgcctccaggtagcttaaccatatagctttgctgggaggacgacgacgtacggcagcgtctgcaacatctagctactactactactactagctcgagtcttctccgaccattgctgacgtaggaagcagcgttcttgggtgtagatgacgcttgctggtagcggcgtcgacatggaggccggtggcgcggcggcagggcccggcggcgcggccgccgacgacgaggcgcggtgcggcgggcggttcgtggaggactggtgctgcgcctgcgcggggctcctcgccgggcccaacccgatgatggcgcggtacctgtacgcgctcatcttcctcgtcaccaacctcctcgcctggaccctccgcgactacggcaactccgccctcgacgagctccagcggctcaaggtctgccagggcgcgcgctactgcctgggagccgagggcgtgctgcgggtcagcctcggctgctttctcttcttcttcgtgatgttcatgtccaccgtgaacacgaggaaggtgcatgagtgccggaactcgtggcactcggagtggtggccggccaaggtcgtcctctggctgggtctcacagtcgtcaccttcctcgcgccgtcgccgctcgtccagctctacgggaaggtcgcgcatttcggagcaggggcgttcctggtgatccagctcatcagcgtgaccaggttcatcatgtggctcaacgactgctgccagtcggaggtcacccggaagagatgccacctgcagattcaggcggtgtccatcgtcacctacgtcgggtcgctgctggggatcgtgctcatgtacgtgtggtacgcgccgagcccggcctgcaagctcaacatcctcttcatcaccgtcacgctggtgctcgtgctgctcatgaccttcgtctccatgagctcaaaggtgaaggcagggtatctggcgccggggctgatgggcatctacgtcgtgttcctgtgctggtcggcaatcagaagtgagcctcacacggagatctgcaacaagaaggcagaagttgcaacgagtgcggactgggtgaacattgcgagctttgtgatcgcggtcatcgtcatcgtggcggcgaccttctcgaccggaatcgactccaagtgcctccagttcaagaaggcggagagggagtcggaggacgacgacatcccctacgggttcggcttcttccacctggtgttcgccatgggcgccatgtacttcgccatgatcttcgtcggctggaacgcgcaccagacaatggagaagtggacgatcgacgtcgggtgggcgagcacgtgggtgcgcatcggcaacgagtggctggcggcgatcgtgtacatatggatgatgatcgcacccatcatctggaagacgcggcaggtgggatcatcggcggagacatgagctgatgaacaatcaaccactaatgtgacatcagaaaacaaaaaaagaaaaagaaaaggaagaggtctgatcaagaggagttcaagacgcactgcttgctggtcagctaatttttgctaagcagaagaggtgaggcaactagtagtatcatattagtagtaacacccaagtaaccaaggtggcgtgaagctcggttgaacgaggaaggcgctcctcatcgatcgctgtcgctgcacaaaactgaaagcgtcatcttttgcttgtcgctgattctcgctcgctgctgcggggctcattgtttggagtttggaccctgcatctgcattgatgccttgacagaaggaaggcagcacgctacacgcaattgttgtacaaacaaacacgagcaagttctatcaatagctgtagaggccggaataaagaaagacttgccttcgcaaaaaaaaaaaaaaaaaaaa

SEQ ID NO: 2922 - protein, 421 aa, Panicum virgatum
  misc_feature: Ceres CLONE 1788087
  misc_feature (1)..(366): Pfam Name: Serinc Pfam Description: Serine incorporator (Serinc)
MTLAGSGVDMEAGGAAAGPGGAAADDEARCGGRFVEDWCCACAGLLAGPNPMMARYLYALIFLVTNLLAWTLRDYGNSALDELQRLKVCQGARYCLGAEGVLRVSLGCFLFFFVMFMSTVNTRKVHECRNSWHSEWWPAKVVLWLGLTVVTFLAPSPLVQLYGKVAHFGAGAFLVIQLISVTRFIMWLNDCCQSEVTRKRCHLQIQAVSIVTYVGSLLGIVLMYVWYAPSPACKLNILFITVTLVLVLLMTFVSMSSKVKAGYLAPGLMGIYVVFLCWSAIRSEPHTEICNKKAEVATSADWVNIASFVIAVIVIVAATFSTGIDSKCLQFKKAERESEDDDIPYGFGFFHLVFAMGAMYFAMIFVGWNAHQTMEKWTIDVGWASTWVRIGNEWLAAIVYIWMMIAPIIWKTRQVGSSAET

SEQ ID NO: 2923 - DNA, 1210 bp, Panicum virgatum
  misc_feature: Ceres CLONE 1788113
  misc_feature: Encodes the peptide sequence at SEQ ID NO. 2924
atcaaacaaagaggtctaggcgtgcgtgggcacagtcacagcacagacctcctcccattcattcgacgccgctcccgcacggccgccccggcatccctccccaatcccacccatgtggccgtcgtgggtgaagacgcgcagctccgactccaacgcggcgtccacctccaccgcgctcgtcgccgccggcgcgtccccgcgcctctccttcccctccccgtccctcaaggacctccggacgctgctcgcgccggaccaccccgccggggacccgtcctccgcctccccgtcgccgcgcgtcttccaccgcatccgcgtcgcggcctccgcgctccgggtgctccgcacgctccagcagccctcgtccgcggccgcgcccgccagcggctgcgcgggggagctccccgcccccgcccccgccggcgcgggcgggcgggtggtgctctacttcacctcgctccgcgtggtccgccgcacctacgaggactgccgcgccgtgcgggccatcctgcgcgggctccgcgccgccgtcgacgagcgcgacctctccatggaccgcgccttcctccccgagctcgcggcgctcctcccggagcagcaggagcactgccgcgtggcgctgccccaggtcttcgtcggcggccgccacctcggcggcgccgaggaggtccggcgcctccacgagtccggcgagctccgccgcatcgtggcccccgcccccgccttcccctccgcctgcgcccgctgcggcggcgagcgctacgtgctctgcggcgcctgcgacggcagccacaagcggtacagcctcaagggcggcggcgggttccgcgcctgcgccgactgcaacgagaacgggctcgtccggtgccccggctgctgcgcccccgccgcctgatccagatccacccgagatccggctgggcccctccctgcctccctgcttcgggttcccctctctagcaaactcaaaaactctctagaagtactagcactactctgtactacttactccacttgccatcaaaattgattaggaggaggatcataagtccgcgtctagtactgtactactcattgcagttagtgttcttcagccaccagatcaggaactggggctctggagcgagtactatttcccattccctccaaccttggattattagaacataaactagaaaacagtcagtttcaaaaaaaaaaaaaaaaaaaa

SEQ ID NO: 2924 - protein, 260 aa, Panicum virgatum
  misc_feature: Ceres CLONE 1788113
  misc_feature (1)..(68): Pfam Name: Glutaredoxin Pfam Description: Glutaredoxin
MWPSWVKTRSSDSNAASTSTALVAAGASPRLSFPSPSLKDLRTLLAPDHPAGDPSSASPSPRVFHRIRVAASALRVLRTLQQPSSAAAPASGCAGELPAPAPAGAGGRVVLYFTSLRVVRRTYEDCRAVRAILRGLRAAVDERDLSMDRAFLPELAALLPEQQEHCRVALPQVFVGGRHLGGAEEVRRLHESGELRRIVAPAPAFPSACARCGGERYVLCGACDGSHKRYSLKGGGGFRACADCNENGLVRCPGCCAPAA

SEQ ID NO: 2925 - DNA, 2304 bp, Panicum virgatum
  misc_feature: Ceres CLONE 1788119
  misc_feature: Encodes the peptide sequence at SEQ ID NO. 2926
actacagcagcaggcaacagagaacgcaaaagctttaggcggccaggcaaagcgtcgagcacgtggtgaggacacgagagggtaccttgaccctcgctggagcgcgcgaagaggtcggcgtgggtcggaggaggcgggcgggccggggtcgtcgtggtcgccggcggcttcggcttggccttggagggcttgggcacggccacggtggcggcgcccgggttcatgtcccaggcggcgcagacttgtaggcgtgggcgggcgcgggggtggtgcgtagccatggtcatggtcgccgccgcggtcgccattgctgctgcccgcgctctcaccgccgtcgcgagcaaggattcaggataacacagaagatcttttcccccattttcctccgtggcacgggcgggccccacctgccagtacgaagaaacgaatgcgtttcgtaagcgggctggcgtgttgtctagaatacgtcttgtgggccgcggcccgctgctcgagctcttggacgcatcgaggccgccatcgatttcccgatttcgctcgcttcaagcctcctcctctcctcctagaatcttcggggcgagagcgccgcgcgacgcaccgaaccgaacgccaccggccatcgcttcccaatccgtgctgtacctcccgctcctaaaccctagccgtcctcctcgccgccggcgaccaccgctatgagccgcttcgacggccgcgccgcggacccgggctcctaccgcgaccgccgcagcgagggggcgttcgggggcgggtcgagggcgttcgcggcgccgagtaaaggggatgcttctgcggcggcggagctggatgggctgccgcggttcgagaagaacttctacgtggagtcgcccgcggtggccggcatgacggaggacgaggtggaggcgtaccgccgccgccgggagatcaccgtcgagggccgcgatgtgcccaagccggtgcgcgacttccgtgatgttggcttcccagaatatgtgttgcaagaaatcacaaaagctggctttgtggaacctactcctatccaatcgcagggttggccaatggctcttaggggtcgtgaccttattggcattgcagagacaggatcagggaaaactcttgcttaccttttacctgccattgttcatgtgaatgctcagcctattcttgctcctggtgatggtccaatcgtcttggtgttagctcctacacgtgagcttgctgttcagatacagcaagaggcaaccaaatttggtgcatcatcgaagataaaaagtacttgcatctatggcggtgtgccaaaaggtccacaagttcgtgatctccaaaaaggtgttgaaattgttatagccacaccaggacgactaattgatatgatagaatcacatcatacaaacttgcgaagggtcacatatcttgttctagatgaagctgaccggatgctggacatgggctttgaacctcagattaagaaaattgtttctcagattcgtccagatcgccagacactatactggagtgctacgtggccgaaagaagttgagcagctagcaaggaatttcctttttgacccatacaaggtcactattggttctgaagagttgaaggctaatcatgccattgcacagcatgtggagatattatctgagagtcagaagtataacaagctggtaaatctactggaggatataatggatggcagccgaattttaatatttatggacaccaagaagggatgcgatcatattactagacaacttcgaatggatggttggcctgctttgtctatccatggtgacaagagccaagcagaacgagattgggtcctttctgaatttaagtcaggcaaaagtcctattatgacagccactgatgtcgctgctcggggcttagatgtcaaggatgtaaaatatgttattaactatgactttccgggatcgctcgaggattatgttcatcgtattggtcgaactggcagagccggcgcaaaaggaacagcttacacctttttcaccgcagctaacgccagatttgccaaggaacttatcaatattctagaagaagctagacaaaaggtcagctctgaattagctgctatgggtcgtggggcaccacctccttcttcaggttaccgtgatagatataggggttatggggctggccgacaatggagttgacattcaaatacttagttgaagctaagagtaatgctttagtttgtttgtggatggctatgttgttctggctccctgaacattttgactagtattcagtaaagatggattcataaaaaaaaaaaaaaaaaaa

SEQ ID NO: 2926 - protein, 493 aa, Panicum virgatum
  misc_feature: Ceres CLONE 1788119
  misc_feature (1)..(172): Pfam Name: DEAD Pfam Description: DEAD/DEAH box helicase
  misc_feature (1)..(77): Pfam Name: Helicase_C Pfam Description: Helicase conserved C-terminal domain
MSRFDGRAADPGSYRDRRSEGAFGGGSRAFAAPSKGDASAAAELDGLPRFEKNFYVESPAVAGMTEDEVEAYRRRREITVEGRDVPKPVRDFRDVGFPEYVLQEITKAGFVEPTPIQSQGWPMALRGRDLIGIAETGSGKTLAYLLPAIVHVNAQPILAPGDGPIVLVLAPTRELAVQIQQEATKFGASSKIKSTCIYGGVPKGPQVRDLQKGVEIVIATPGRLIDMIESHHTNLRRVTYLVLDEADRMLDMGFEPQIKKIVSQIRPDRQTLYWSATWPKEVEQLARNFLFDPYKVTIGSEELKANHAIAQHVEILSESQKYNKLVNLLEDIMDGSRILIFMDTKKGCDHITRQLRMDGWPALSIHGDKSQAERDWVLSEFKSGKSPIMTATDVAARGLDVKDVKYVINYDFPGSLEDYVHRIGRTGRAGAKGTAYTFFTAANARFAKELINILEEARQKVSSELAAMGRGAPPPSSGYRDRYRGYGAGRQWS

SEQ ID NO: 2927 - DNA, 1516 bp, Panicum virgatum
  misc_feature: Ceres CLONE 1788142
  misc_feature: Encodes the peptide sequence at SEQ ID NO. 2928
ctcttcctcccggccttccaaacccaccgccccgccggagcccgcccgctagctcggcgccgcttcgaggctcccccgcggccgctgcatttgcgggtgacgtctgctacgagagccgcgggcggctgtgagacgggaggtgcgcggtccttggttcgctgcggctgcggcgagctgctccgcgcggccgggcctgggactggaaattcttgcatatattcatcccgttattggtactccggttgctgttgagtgattgggaaagctgattggccagaagcattcttggtcatgggaagcaatgaccctagcacacaggctccaaaggcatcagaacaagatcaaccttcagccactacatccggggcaacagcttcagtttaccctgagtggcccagctttcaggcctactcagcaattccaccacatggattctttccccctaccgtcgctgcaaatccacaggctcatccatacatgtggggagctcagcccatggtgccaccgtacgggacgccgccatcaccttatgtgatgtatccacctggaacagtatatgcccatccctctacaccacctggtatgcatccatttagtcattatcctatgccaacaaatggacatgctgaaactcctggagctgcaccaagtgcttcagaaatgaacggaaaaaatgagcctggcacaatgtctgctccatctgccaatgggattacctcccacagtgagagtggaagtgagagtgagagtgaaggaagtgacgccaattcccaaaatgattcacactcaaaggacaatgatggaaaggaagacggcagttctcagaacagcatatcttattcagcatcacagggaatgttaaatcaaaccatgccgatgattccaatacaaccgggtgcgatggttggagttccaggctccacagctaacttgaatattggaatggactactgggccgctcctggttctgcaactgtccctgcaacacagggcaaagcaacttctggttcagcacgaggagatcaatgggacgaaagggaactcaagaagcagaaacgaaagcaatctaatcgagaatcagcacgcaggtcccggctgcgcaagcaggctgagtgcgaggagcttgggcaacgtgctgaatctttaaggtcagaaaactcctctcttagagctgagcttgaacggattagaaaggagtacgaacagttactttcgcagaatgcttccctcaaggaaaagctgggggcaaccagtgattctattcctgacatgaatgagcagaacgacggcggtggcagcggctacaagaagcagcctgattccgatgcccagcctgggaacgagtcttgacctgtttagctcaggattgttgacacggcattgctatttatttccttgaacaataccgaacagaaaatagggaagatgggagaaaattatgtacacagttctacgtcaaatgactaatatttctaacggcatttgcacatatgcccaaaaaaaaaaaaaaaaaaaa

SEQ ID NO: 2928 - protein, 352 aa, Panicum virgatum
  misc_feature: Ceres CLONE 1788142
  misc_feature: Great-hit functional homolog of the protein sequence given in SEQ ID NO 9621
  misc_feature (1)..(65): Pfam Name: bZIP_1 Pfam Description: bZIP transcription factor
  misc_feature (5)..(58): Pfam Name: bZIP_2 Pfam Description: Basic region leucine zipper
  misc_feature: Useful for biocontainment applications
  misc_feature: Useful for making plants with altered Lignin content
  misc_feature: Useful for making plants with altered alkaloid content
  misc_feature: Useful for making plants with altered terpenoid content
  misc_feature: The leaves start out wild- type green and gradually turn yellow-green in color, while the cotyledons stay wild-type green.
MGSNDPSTQAPKASEQDQPSATTSGATASVYPEWPSFQAYSAIPPHGFFPPTVAANPQAHPYMWGAQPMVPPYGTPPSPYVMYPPGTVYAHPSTPPGMHPFSHYPMPTNGHAETPGAAPSASEMNGKNEPGTMSAPSANGITSHSESGSESESEGSDANSQNDSHSKDNDGKEDGSSQNSISYSASQGMLNQTMPMIPIQPGAMVGVPGSTANLNIGMDYWAAPGSATVPATQGKATSGSARGDQWDERELKKQKRKQSNRESARRSRLRKQAECEELGQRAESLRSENSSLRAELERIRKEYEQLLSQNASLKEKLGATSDSIPDMNEQNDGGGSGYKKQPDSDAQPGNES

SEQ ID NO: 2929 - DNA, 1723 bp, Panicum virgatum
  misc_feature: Ceres CLONE 1788147
  misc_feature: Encodes the peptide sequence at SEQ ID NO. 2930
gtgccacctccgcctcttccttgtgatctccgaattcctatctcagattccaagggccgccccgtgcgatccccggctctccccgcccaccatatatccagaggctccgcccccgcctccaacccctcgcgaaagtccacgccgtcgtcagctgttcttgttctgatttgagccgggcggattgatcccggggagcggtgttgccgttcttgatcctgagaggtgttcttggttggtttgcgggaggaaagtcatgataccctctgtgaggctctctcctgcccctgcagccttctcaggcttcagcctgcgctcaaaatcagcttcaattccaaccatctccagtctcaaaccctcaaaatatgtggtatcctccctcagaccactctaccttgcaccgctagatggtccgcgcactgccgagcttaagcctcggaggcagccacttgagttccggtgcgcagcttctgctgctgatgacaaggagtccaagactgaggtggtgccggtacagtcggaaggtgcacagaagctaaaaatctccatctatttcgcaacctggtgggcgctcaatgtgatatttaacatttacaacaagaaggttctcaatgcttttccgtacccctggctcacctccacactctccctcgcctgtggctctgcaatgatgcttttctcatgggccacccgccttgttgaggcccccaagaccgacctagatttctggaaagttcttttcccggttgctgtggcacatacaattggtcatgttgctgcaacggtcagcatgtctaaggtggctgtgtcattcacacacataattaaaagtgcagaacctgcgttcagtgttttggtgtcgaggttcctccttggagagacattccctgttcctgtctatctttctcttcttccaatcattggtggatgtgctcttgctgctgtaaccgagctaaattttaatatggttggatttatgggtgctatgatatccaaccttgcttttgttttccgcaacatcttctcaaagaggggcatgaaggggaagtccgtcagtggcatgaattactatgcttgcctgtcaataatgtcccttgtcatactgactccatttgctattgctatggagggcccccaaatgtgggctgctggttggcaaaaggctcttgcagaagttggccccaatgttatctggtgggttgctgctcagagcgtgttctaccacttgtacaaccaagtgtcctacatgtctcttgatcagatttctccattgacttttagcattggcaatacaatgaagcgtatatcagtgattgtttcgtcaatcatcatcttccacacacctgtccgccctgtcaatgccctaggagctgccattgccatccttggcacattcctgtactctcaggcgaaggcatgaggttgaaactttggcaagatcagtgggccatggatgatgaacgtctctgcagaatcagtggcaagcaatgaatccagttttgcttgtgcaagtatcatgtagatatagggttaggtttccatatgaggtctaataatggatgactggctgctgtttccctgtccatgtttgttgagcgagcgcaaactgaaatccagaggccatcaagtgtggttgagtgtatctgaataatactgtaacggaattcgccgatgctgtttctttccgggtatataatcggtcatccaaaaaaaaaaaaaaaaaaaa

SEQ ID NO: 2930 - protein, 387 aa, Panicum virgatum
  misc_feature: Ceres CLONE 1788147
  misc_feature (1)..(146): Pfam Name: TPT Pfam Description: Triose-phosphate Transporter family
MIPSVRLSPAPAAFSGFSLRSKSASIPTISSLKPSKYVVSSLRPLYLAPLDGPRTAELKPRRQPLEFRCAASAADDKESKTEVVPVQSEGAQKLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVIWWVAAQSVFYHLYNQVSYMSLDQISPLTFSIGNTMKRISVIVSSIIIFHTPVRPVNALGAAIAILGTFLYSQAKA

SEQ ID NO: 2931 - DNA, 1685 bp, Panicum virgatum
  misc_feature: Ceres CLONE 1788153
  misc_feature: Encodes the peptide sequence at SEQ ID NO. 2932
agtcgtttgcccttgtggcctctcccccctctcacatccgtcctgctcctgccctcctgctgctcaccaaggaagaagagggactcaccaccacttgttcatctttagagcacgacatactacgaggagtggcccggccgtcgccgccgaccaccaaaagggccggaaaggcctctcgcttgtgcgtgcagctcggcgcctgccatcttgctttccaaggctcttcccctgccccgtctcataattagaatcgccgccatttccaaatccttcctgagctgctcgagtgccgatcagaaatgaagaggcagtcgaagaggcccgccagcagccatgaatccacagaagaaggggagaagctggcggtcgcggaggacgaggccctaacggcgcgcaacatggagcacgaggaggccgagctggacgacgtgaacgacgacgacgacgagctcgccggcggccgctcggcgcggtcgccgtgcaggctgggcgagaagaagcggcgcctggcggcggatcaggtgcgcgcgctggagcggtgcttcgagacggacaacaagctggaccccgaccgcaagtcccgcatcgcgcgcgacctcggcctgcagccgcgccaggtcgccgtctggttccagaaccgccgcgcccgctggaagaccaagacgctcgagcgcgacttcgccgcgctgcgcgcccgccacgaggccctccgtgccgactgcgacgcgctccgccgcgacaaggacgcactcgccgccgagatacgggagctgaggcagaagctgtccaagccggaggcggcggcgaagctggaggcggccgccaatgactccgcggaggagcgccaggcgacggtcggcgcgtcggccgcggcgatctgcaaggacggctcctcggacagcgactccagcgtggtgttcaacgacgtcgaggcgtcgccgtactccgacgcggcgttcgagcagacggccttcgctgggttcggtccaccgttcttggacacgtcggcagcgacgacgacaggctgctcgcccctctccatgttcgagaccaagtggcagcaggcgccggcatacccatacgactcgtacaagaacggtggcggctatggcttcacggaggaatggctcgccagctcggacgtgatcggcagcggcgacggcgcggctagcttcttctccgaggagcacgcctccagcctcaacttcggctggtgcgcgagcggcaccgaggcctgggagtgaggaggcgagcttaattttgatctccacggttagtgtaaacaaaacaagcggcaatgttacggtggcattgtacatccatggagcttataacggtgaatgttaagctccaacaaggcacctagtgatctagacttctagtagtggccaaagctggcggacatccaagtatccaacgcaaggcaggaacactggaacaaaaccagcagccagtaacaataacggtgaattttaggcaggctaatggaggatgtaaatgttaagaggccgtcctgctccaccgcctcctgtctttttgcggtggaccacttggatgcaacgaatcagcaacggtagcgtactaggggggaaatgggaaattataagcatgatgcgatttaggattttatgatttctgatgaaataaaacatactgtctctaatcaaaaaaaaaaaaaaaaaaaa

SEQ ID NO: 2932 - protein, 314 aa, Panicum virgatum
  misc_feature: Ceres CLONE 1788153
  misc_feature (1)..(55): Pfam Name: Homeobox Pfam Description: Homeobox domain
MKRQSKRPASSHESTEEGEKLAVAEDEALTARNMEHEEAELDDVNDDDDELAGGRSARSPCRLGEKKRRLAADQVRALERCFETDNKLDPDRKSRIARDLGLQPRQVAVWFQNRRARWKTKTLERDFAALRARHEALRADCDALRRDKDALAAEIRELRQKLSKPEAAAKLEAAANDSAEERQATVGASAAAICKDGSSDSDSSVVFNDVEASPYSDAAFEQTAFAGFGPPFLDTSAATTTGCSPLSMFETKWQQAPAYPYDSYKNGGGYGFTEEWLASSDVIGSGDGAASFFSEEHASSLNFGWCASGTEAWE

SEQ ID NO: 2933 - DNA, 2068 bp, Panicum virgatum
  misc_feature: Ceres CLONE 1788164
  misc_feature: Encodes the peptide sequence at SEQ ID NO. 2934
acacacaaattaggattggtagagcccatccctgcgccctgccttgctggctctgacctctccctctctccccttctctctcctcctcttgttgctccccttcttctattgggttttttgtctccttggatttgcacctgggcgcgtactagttctctcatcagagagaggagagacctctgaactgtttcttcgagtcttcgggattagattgagcagagctgcctgccggaagagagtaaaagagagctcaaggggggcgaaaggagaattttttatccagcttcctgcttgattctctttgatcccggagagctgccgccagtccaaccaatccttgctgttcgtgtgcccgggctttgattgctctccagatctgaggcacctgctcggtggattctgggaatccgagcacaagctcgacagggagttctctgggaaaaggggaggaagagactgaaaggcgagataagagctagctgggtcccttgaggatgccgtcaagaaaccgcgtggaggggagggcgatgagatgagggatgctggccgcagtgatggattacttcagctcctgctggggcccgcgatctccggacgggcaccggggcaagggctccgacgcggccggccggcaggaaggtctcctctggtacaaggacgctggccagctcgtcaccggggagttctccatggccgtggtgcaggccaaccagctgctcgaggaccagagccaggtggaatccggatcgctctccttggctgagcccggtccgcagggcaccttcgtcggcgtctatgatggccatggcggtccggagacggcccggttcatcaatgaccacctcttcaaccatctcaggaaatttgcaactgagcacaagtgcatctcagtggatgtgatccggaaagctttccaagcaactgaggaaggctttctttctctagtcagcagggaatggtctttgaagcctcagattgcatcagtgggctcttgttgcctagtgggagtcatttgttctgggagtctctatgtcgcaaatctcggtgactcacgtgcagttcttggaagacttgttaaggccactggagaggttgtggccatgcagttgtcatcggagcacaatgcgtgcaaagaggaagttagacaagagctacggttagcacatcccgatgatccacagattgtggttctaaaacacaatgtttggcgtgtgaagggtctcatccagatctcaagatctattggagatgtatatttaaagagaccggagtataacaaagaacctcttcatagcaagtttcggcttcgagaaaccttccagaggccaattcttagttctgatcctcaaattaatgaacaccgaatacagcccagtgatcagtttgctatatttgcttctgacgggctatgggagcacctcagcaatcaggaagcagttgaacttgtccaaaatagtccccgtaacggaatcgctcgaaggctagtgaaagttgcgatgcaagaagcagccaagaagagggagatgagatattcagacctcaagaaaatcaaccgtggggtgaggcgccatttccacgacgatataactgtcattgtggtattcctcgactcaaatgccatgagtaaagctagctggagcaaaagcccctcggtttctctccgagggggcggtgttacccttcctgcaaaatcccttgcgcctttctcagctccagcacagctgaacagcacctactgaagatgctatactggaaagaaagcagaatgcagatctgcaggagacgaaagcagctctgcaatcaagtgtagtgtaacacctgctgtggtgccctttgcgaaactactgtctagagtccccatggtaattagtgtactgatagcgaggtataaaaattagattatttcgtagcgacgcaaatccttcttttccttttcctttggccttctctttattcttatcccttttctcttcatcatccatgagagaacaggtggttgtaaattgtccagaacatgttttccgtaatagtccatcatatcccgctttaaaaaaaaaaaaaaaaaaaa

SEQ ID NO: 2934 - protein, 399 aa, Panicum virgatum
  misc_feature: Ceres CLONE 1788164
  misc_feature (1)..(279): Pfam Name: PP2C Pfam Description: Protein phosphatase 2C
MLAAVMDYFSSCWGPRSPDGHRGKGSDAAGRQEGLLWYKDAGQLVTGEFSMAVVQANQLLEDQSQVESGSLSLAEPGPQGTFVGVYDGHGGPETARFINDHLFNHLRKFATEHKCISVDVIRKAFQATEEGFLSLVSREWSLKPQIASVGSCCLVGVICSGSLYVANLGDSRAVLGRLVKATGEVVAMQLSSEHNACKEEVRQELRLAHPDDPQIVVLKHNVWRVKGLIQISRSIGDVYLKRPEYNKEPLHSKFRLRETFQRPILSSDPQINEHRIQPSDQFAIFASDGLWEHLSNQEAVELVQNSPRNGIARRLVKVAMQEAAKKREMRYSDLKKINRGVRRHFHDDITVIVVFLDSNAMSKASWSKSPSVSLRGGGVTLPAKSLAPFSAPAQLNSTY

SEQ ID NO: 2935 - DNA, 1167 bp, Panicum virgatum
  misc_feature: Ceres CLONE 1788172
  misc_feature: Encodes the peptide sequence at SEQ ID NO. 2936
gctgaactccacagcctaccagtatactagctctagtaacctcggcccatagaaaaaccagttcaccatgcttgcaaacaagagcagctctgcagcagacaagactgccgccagtgagaccgcgatcgacctccctctcaagataagcatatacaacaagaacggccgaatcgagcaggtcctgcgcagtcccttcgtgacagcatccgaggaccctggcatcaccggcgtcgcgacgagggacgtcgtcatcgaccgagaagccggcgtggccgcgcgcctctttctacccaccggcgccgtcgcaacaggccggaggcttcccctcgtcttgttcttccatggcggttccttcgccgccggggcggcggagaggagcgcgttctgccggacgtaccaccgttatgccacctccctcgccgcgcacgccaaggcgctcgtcgtgtccgtggagtaccgtcttgtgccggagcatcccgtgaccgcggcctacgatgacgcctggaccgcgctccggtgggcggcatcctccgctgacccctggctcttgtaccacgccgacccccgctgcactttcgtcgccggtgacggcgcgggtggcgacatcgcctaccgcacggccgtacgcgccagccgggatggcgaggacatcaacatcgacatcgaggggctatttctcatccatccctacttctgggaacccgagtggccgcctacagaaaatgccggccatggtggcgggtttctcacgacaccgcaggtggccgcgaccgcgtcactgccatgccggcgtgcgctggtcgccgtggccaagaagcagggcgccgtccgggaacccggccgtaggtctgctgcacgcatgcgcggatgctggtggcgtggggaggtgaccatcgtggaattgaacagtgaggacgaccacggcttccacctgtacggtccggcgagtggtagcaccgagaggctcatggacaccatagtggaattcgtaaacaagaaggagcacggttcaatgttgcatggtgaaaaggaggttgcaccgagcttgtctaatgggccatataaggccgtgtctgcagaagttccaaggggacctctgaccaagagctgcctgtagtgtgtgattcaacatatatatgcctttactaaaaaaaaaaaaaaaaaaaa

SEQ ID NO: 2936 - protein, 349 aa, Panicum virgatum
  misc_feature: Ceres CLONE 1788172
  misc_feature (1)..(137): Pfam Name: Abhydrolase_3 Pfam Description: alpha/beta hydrolase fold
MLANKSSSAADKTAASETAIDLPLKISIYNKNGRIEQVLRSPFVTASEDPGITGVATRDVVIDREAGVAARLFLPTGAVATGRRLPLVLFFHGGSFAAGAAERSAFCRTYHRYATSLAAHAKALVVSVEYRLVPEHPVTAAYDDAWTALRWAASSADPWLLYHADPRCTFVAGDGAGGDIAYRTAVRASRDGEDINIDIEGLFLIHPYFWEPEWPPTENAGHGGGFLTTPQVAATASLPCRRALVAVAKKQGAVREPGRRSAARMRGCWWRGEVTIVELNSEDDHGFHLYGPASGSTERLMDTIVEFVNKKEHGSMLHGEKEVAPSLSNGPYKAVSAEVPRGPLTKSCL

SEQ ID NO: 2937 - DNA, 1884 bp, Panicum virgatum
  misc_feature: Ceres CLONE 1788186
  misc_feature: Encodes the peptide sequence at SEQ ID NO. 2938
cttgtcgcctgccgcgtcgcgtgtcatcacaagctcccaagaagtgcaaaagcgcccgtggccgcgcattgtgtcgccaccggcacccaaagtatggcggcgccgtcgtcctccctcgcctccacctcccacctctcccgccgcgccacggccgcggtcggcccgtgctccacccgccgccagctgcgcatccggtgctgctgggccggcggcagggtggcgtccaggtggcgcgcgccaggtgtttgcttcgtggtctcactcagccagccaggtcttgctgcggtcgacgtgccggcggcgaccatgtccgagcgtacttcggtgtcctcacttttggaggttgtctcggacgatttgctgaagcttaacaacaatctcaaatcgcttgttggtgcagaaaatccagttttggtttctgcggctgaacaaatttttggtgccggtgggaagagattaagaccagcattagtttttctggtgtctagagcaactgctgaattagctggtttgtcggagctaagtacagaacatcaacgcttagcagagattattgagatgattcacactgcaagtttaatacatgatgatgtcatagatgatagtgggatgcgaagagggaaggaaactattcatcagctatatggtacacgggtggctgtacttgctggtgattttatgtttgcacagtcttcttggttccttgcaaacctggaaaacattgaagttataaagctgatcagtcaggtaatcaaggactttgcaagtggtgagataaaacaagcatccactctgtttgactgtgacatcacccttgacgattaccttctcaagagctactacaaaactgcatctctgatagcagcaagcacaaggtcagccgccatattcagtggcgtcagcaccgcagtttgtgaacaaatgtatgaatatggcaggaatcttggcctctccttccaggtagtcgatgacatcctggacttcacccaatcagctgagcaacttggcaaaccagcaggaagtgacttggcaaagggaaacctgacagctccggtcatcttcgctttgcaagatgaaccagagctgagggagatcatcgattctgagttcagtgagacagattcgttagctgctgcaataggccttgttcatagaagtggtggaataaggagggcacatgagcttgcaagagagaagggtgacttggccatccaaaatctgcagtgccttccgagaagcgacttccaaagtacccttgagaagatggtgaaatataatcttgaaaggattgagtagattgatttacttttatgctccttcaagtacagatctcctttgcacgggtttgagtagctcctatataaacccatcattcgacccatttttggtggatacgattttgcaggaaacttgggaggaaatgccctataacatacattttctggggaacccttgatttcgcaggaaacttggaggaaatgcactataacatacattttctggggaaacaggctattacttttgttgaacctgtgaggtgatttatgcaggatcctcagaaaagcaaggacttcacataccccgacccccaacaccttgtgcccatattttatctgaatgtgagcttactttgcagctcctgtaaatgaaagatgcgtaaactaacttagcattcttttattttgcaaattgcgcatgatcagaagcaacaaattatgcgctatacttgtacgtgtcctgactggctgacactttgtataacagttgtgcactcactgggatgtatgtttctacaaatatgatagccaatggtgtacatactccaacatcacttacaatattcatgtatgcaacaattcacagcaaaaaaaaaaaaaaaaaaaa

SEQ ID NO: 2938 - protein, 400 aa, Panicum virgatum
  misc_feature: Ceres CLONE 1788186
  misc_feature (1)..(261): Pfam Name: polyprenyl_synt Pfam Description: Polyprenyl synthetase
MAAPSSSLASTSHLSRRATAAVGPCSTRRQLRIRCCWAGGRVASRWRAPGVCFVVSLSQPGLAAVDVPAATMSERTSVSSLLEVVSDDLLKLNNNLKSLVGAENPVLVSAAEQIFGAGGKRLRPALVFLVSRATAELAGLSELSTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAVCEQMYEYGRNLGLSFQVVDDILDFTQSAEQLGKPAGSDLAKGNLTAPVIFALQDEPELREIIDSEFSETDSLAAAIGLVHRSGGIRRAHELAREKGDLAIQNLQCLPRSDFQSTLEKMVKYNLERIE

SEQ ID NO: 2939 - DNA, 934 bp, Panicum virgatum
  misc_feature: Ceres CLONE 1788197
  misc_feature: Encodes the peptide sequence at SEQ ID NO. 2940
aaatccatcgagcgtcgtgccgtgcgcctgacctgacctctcgccgatccaaggggcggggggagtccgagctcgatctccatggcgaccggcaatctggggagcgtggtggtgtcggtggacggcagcgaggagagcatgaacgcgctgcggtgggcgctcgacaacctccgcctccgccccgacggcgagttcgccgtgctccacgtccagccgccgcccaacatcgccgccgggctcaacccggcgcccatccccttcggcggacccagcgggttggaggtgccggcgttcacgcaggccatcgaggcgcaccagcggcggatcacgcaggccatcctggagcacgccctcgagatttgctccgagaaaaatgtggaggtgaagacggaggtgatcgtgggtgatcccaaggagaagatatgcgaggtgacggccaaccgcaacgccgatctgctcgtcatggggtgccgagccattgggccgctcaagaggatgttcttggggagtgtgagcaactactgcatcaaccatgtgggttgccctgttgttgtgatcaaggggacttgaggccttgagctaccctcgatcaagtgttttgaggttgctattgtgtcatttgtaatcctgtacaatattggacattttgcatctgaagaccatgcatcacatttgtcagtctgctgccgagggaggagggttgctctgtgatctccgttgtaaaggaaaatgtgtcctggttctgtaatcgttgaaataagactgccctgtgggatattgttctgtatattcttgtatttgttggggatacacattgtgctgcctgaactctgaacatctcaaaattgccagaatcccggtttttgtatgttgtcttgccaatgccctagttgatgtcctgagttcagcagactaaaaaaaaaaaaaaaaaaaa

SEQ ID NO: 2940 - protein, 162 aa, Panicum virgatum
  misc_feature: Ceres CLONE 1788197
  misc_feature (2)..(154): Pfam Name: Usp Pfam Description: Universal stress protein family
MATGNLGSVVVSVDGSEESMNALRWALDNLRLRPDGEFAVLHVQPPPNIAAGLNPAPIPFGGPSGLEVPAFTQAIEAHQRRITQAILEHALEICSEKNVEVKTEVIVGDPKEKICEVTANRNADLLVMGCRAIGPLKRMFLGSVSNYCINHVGCPVVVIKGT

SEQ ID NO: 2941 - DNA, 1558 bp, Panicum virgatum
  misc_feature: Ceres CLONE 1788199
  misc_feature: Encodes the peptide sequence at SEQ ID NO. 2942
gcagtcgcagcagtgtgtagtgtagtgtagctcttccctcgctccctctcccggcagcccactagctagctacactctccagagctcggagagagctgaagctagctagctaccaatggctgcacctcctcctcctcctcttagcaggggcagcagcagcagcgtgccacggaatgccgctgccgccgtcgtgccggcattgctgctggcggcggccatggcgatggcggccttccccggcgccggcgcgcagccgtccccggggtactacccgagctcgaggttcaggcccatcccgttcaaccgcgggtacaccaacaagtggggcccgcagcaccagacgctctccggcgaccactccgccctcaccatctggctcgacaagacctgcgggagtggcttcaagtcgaagcacgcgtaccggaatggctacttctccacccgcatcaagctccccgccggctacaccgccggcaccaacaccgccttctacctttcgaacaacgaggcgcaccctgggttccacgacgagatcgacatggagttcctgggcaccatcccgggggagccctacacgctgcagaccaacgtgtacgtccggggcagcggcgacgggcgcatcgtcggccgcgagatgcgcttccacctctggttcgaccccacggcggccttccacacctacgccatcctctggaaccccgacgccatcaccttcttcgtcgacgacgtgcccgtccgccgctacgagcgccgcgccgagctcaccttcccggaccgccccatgtgggcctacggctccatctgggacgcctccgactgggccaccgacgacggccgccaccgcgccgactaccgctaccagcccttcgtcgcgcgcctcgaccgcttcgtcctcgccggctgctccgccgccgccccggcctcctgccgccccgtgccggcctcgccccgcggcgccggcctcacgccgcagcagtacgccgccatgcgctgggcgcagcagggccacatggtctactactactgcaacgacttccgcagggaccactcgctcacgcccgagtgctagtccgccccgccatggatagatcttggccggttgcgctcgcgctcctgggatgatgatcggcgagatctggcggtaaggcagttggtggtgtttgtttcgcctcgccttgtttggttgtttgttttgtttttcctagcactcatctgatctcccgtgaacgaagaaaggctagtgacatcggtcgatcgatcgggatcgatggatggacgtgccgtgccgtggctgccctaccaccaccgccgcttagctgctagtcgtgaggcgagccgggcggggtggttgaggcgttggtcgttggcgcattttgccaacaaaagggggtgtcgtcgccgtctgccgtttgcttgttctgctgcctttttcattgtatttggtctcacatgcgtgccgccccaaaggggcaagcttgcatgattcatggcatcatgcatgcccactgtaatacggaactgttataccatatattattatatgtatttaatatgctgc

SEQ ID NO: 2942 - protein, 317 aa, Panicum virgatum
  misc_feature: Ceres CLONE 1788199
  misc_feature: Great-hit functional homolog of the protein sequence encoded by LOCUS At2g36870
  misc_feature (1)..(187): Pfam Name: Glyco_hydro_16 Pfam Description: Glycosyl hydrolases family 16
  misc_feature: Useful for making plants with altered cell wall content and/or composition
MAAPPPPPLSRGSSSSVPRNAAAAVVPALLLAAAMAMAAFPGAGAQPSPGYYPSSRFRPIPFNRGYTNKWGPQHQTLSGDHSALTIWLDKTCGSGFKSKHAYRNGYFSTRIKLPAGYTAGTNTAFYLSNNEAHPGFHDEIDMEFLGTIPGEPYTLQTNVYVRGSGDGRIVGREMRFHLWFDPTAAFHTYAILWNPDAITFFVDDVPVRRYERRAELTFPDRPMWAYGSIWDASDWATDDGRHRADYRYQPFVARLDRFVLAGCSAAAPASCRPVPASPRGAGLTPQQYAAMRWAQQGHMVYYYCNDFRRDHSLTPEC

SEQ ID NO: 2943 - DNA, 1113 bp, Panicum virgatum
  misc_feature: Ceres CLONE 1788200
  misc_feature: Encodes the peptide sequence at SEQ ID NO. 2944
cacccaatccaccacacaccagccagaactcacgcgacacaccatccagatgacgatgcttagggtttccccgtcaccggccgccgccgccgccgccgccgccaccgccaaccatgtctctcggcccgccgtgaccccggcttccgtccgggtgccggcgccgcgcgtctcgccgtcggccgcggccgcgtgcagggcggcgggcaagggcaaggaggtgctcagcggggtcgtcttccagcccttcgaggagatcaagggggagctctccctcgtgccccagaccgcggacaagtccctcgcgcgccagaagttcgtcgacgaatgcgaggcggccatcaacgagcagatcaatgtggagtacaatgcctcctatgcgtaccactccctctttgcctacttcgaccgcgacaacgtggctctcaaaggatttgccaagttctttaaggaatcaagcgatgaggagagagagcatgctgaaaagttcatgaagtaccagaacacacgtggaggcagggtcagtctccagtccattgtcactcccttaacagagtttgaccaccctgagaaaggcgatgctttgtacgccatggagctggctctggctctggagaaattggttaatgagaagctgcacaacctgcatgctgtggcgaccaggtgcaatgatcctcagctgacagacttcatcgagagtgaatttctctcggagcaggttgaaagcatcaagaagatctccgagtatgttgcccagttgaggagagtgggcaagggacacggggtgtggcactttgatcagaagctgctggaggaagaggcctgaaggaaggaaacaccgtggagtagtaggggtgggaagctgctccaggatcagattatgcggcgggagcaaccaagcgctagggttgtgtagtagcattagggccgaccgtgttgcttagatgcactgagaagcagtagaacttgggatgttattgctgtggcttggggtgctcgttgcctgccggcctttgcaatcttattattatgggaaataaaaatcacacggatggtactgtaccttattgcaagtaccgtggaaagtgggctcgcgaaaaaaaaaaaaaaaaaaaa

SEQ ID NO: 2944 - protein, 257 aa, Panicum virgatum
  misc_feature: Ceres CLONE 1788200
  misc_feature (3)..(257): SWISSPROT Homolog: EC 1.16.3.1 Ferritin-1, chloroplast precursor
  misc_feature (3)..(257): SWISSPROT Homolog: EC 1.16.3.1 Ferritin-2, chloroplast precursor
MTMLRVSPSPAAAAAAAATANHVSRPAVTPASVRVPAPRVSPSAAAACRAAGKGKEVLSGVVFQPFEEIKGELSLVPQTADKSLARQKFVDECEAAINEQINVEYNASYAYHSLFAYFDRDNVALKGFAKFFKESSDEEREHAEKFMKYQNTRGGRVSLQSIVTPLTEFDHPEKGDALYAMELALALEKLVNEKLHNLHAVATRCNDPQLTDFIESEFLSEQVESIKKISEYVAQLRRVGKGHGVWHFDQKLLEEEA

SEQ ID NO: 2945 - DNA, 1284 bp, Panicum virgatum
  misc_feature: Ceres CLONE 1788206
  misc_feature: Encodes the peptide sequence at SEQ ID NO. 2946
ccaaacccccgcttccagtaccttctcgaagctccccatcgccgcctccacccgctccgatggcgaaggaaccgatgcgcgtgctcgtcaccggcgccgcaggacaaatcggatatgcgctcgttcccatgattgctagaggagttatgcttggtgctgaccaacctgttattctgcacatgctcgacattccgccagcggctgaagctcttaatggtgttaagatggagttggttgatgctgcatttcctcttcttaagggagttgttgcaacaactgatgttgtggaggcctgcactggtgtgaatgttgcggtcatggttggtggattccctaggaaggagggaatggaaaggaaggatgttatgtcaaaaaatgtttcaatctacaaagctcaagcatctgcccttgaagcccatgctgcccccaactgcaaggttctggttgttgccaacccagcaaataccaatgctcttatcttgaaagaattcgctccatctatccctgagaggaatgttacttgcttgacccgcctggatcacaacagggctcttggccagatttctgagagacttaatgtccaagtcagtgatgtgaaaaatgttattatttggggtaaccactcgtccactcagtaccctgatgttaaccatgccacagtgaagtcttccagtggagagaaacctgttcgtgaacttattgctgatgatgcatggcttaatggggaattcatcacaaccgtccagcagcgtggtgctgcaatcatcaaggccaggaagctctccagtgccctttctgctgccagctctgcttgtgaccacattcgtgattgggttcttggaacccctgagggaacatttgtttccatgggtgtgtactccgatggttcgtacggtgtgcctgctggactgatctactcattcccagtaacatgcagcggtggtgaatggaaaatcgttcaaggccttcccatcgacgagttctcgaggaagaagatggacgccaccgcccaggagctgtctgaggagaaggcgcttgcttactcatgcctcgagtaaaacccccatactcagagagagcaattgctgcccctatgttttgaataaaagaaactccagcgtcattcatagattctcacactcagaactgctgcacatctgcggtgcaggtcgctggcgtcgcccagcatgtatgaggcttgtagtcctttttgcctgatgatctgcaggacatttatttaaacttgcaattgaacctcttgaccaaaaaaaaaaaaaaaaaaaa

SEQ ID NO: 2946 - protein, 332 aa, Panicum virgatum
  misc_feature: Ceres CLONE 1788206
  misc_feature (1)..(175): Pfam Name: Ldh_1_C Pfam Description: lactate/malate dehydrogenase, alpha/beta C-terminal domain
  misc_feature (1)..(331): SWISSPROT Homolog: EC 1.1.1.37 Malate dehydrogenase, cytoplasmic
  misc_feature (1)..(332): SWISSPROT Homolog: EC 1.1.1.37 Malate dehydrogenase, cytoplasmic
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVSIYKAQASALEAHAAPNCKVLVVANPANTNALILKEFAPSIPERNVTCLTRLDHNRALGQISERLNVQVSDVKNVIIWGNHSSTQYPDVNHATVKSSSGEKPVRELIADDAWLNGEFITTVQQRGAAIIKARKLSSALSAASSACDHIRDWVLGTPEGTFVSMGVYSDGSYGVPAGLIYSFPVTCSGGEWKIVQGLPIDEFSRKKMDATAQELSEEKALAYSCLE

SEQ ID NO: 2947 - DNA, 2672 bp, Panicum virgatum
  misc_feature: Ceres CLONE 1788215
  misc_feature: Encodes the peptide sequence at SEQ ID NO. 2948
attttcagatctctctctcccccctccctcccttcctctctttgaatcctgcccgcctcgccgttctcgcattccgccgctcgccctcgcggatcccaccgcccattcgtcgccggtgttcttgcctccctgcgtccgcggtcccggaagcggctgccgggtcatccacggcgggagtcgagcccgccgcctccggtgggtgggtttgccggatggttgtcgcttcctgatccatccggaccccggatccgccgcaaaggcggcggcttttgtgggttgtccgcgccatgcaggagggtttggggcgtcggcggtgaggcgggccgggcctctggtttagttcttgcgttggactagtccggagatgcttcgaggaacagggcacgtgggtggcgatgcgcggaggcgggcactggagcaccgccgctcggcgcgccggcggctgccggggtggatctggtggctcctcgggatcttcctcctcgttgggctcatgctattcgtcctgcaccacaaccagaaggagcagttccggccgcccgtcgtggataatggttcagaaatcgaggaagtccctcatgagaaggtgaatttcacagaagagcttttgagcagcacatcatttgctcgccaattagcggatcagatgactttagcaaaggcatatgtcatccttgcaaaagagcatggcaatcttcagcttgcatgggagcttagttcgcagataagaaactgccaaagattgctatctgaaggggcagttagtgggcgagcaattactcgagacgaagcccatcctataataagccggcttgcacggttaatatataaggcacaggacgctcactatgatatcagcacaacgatagtgacattgaagagtcatgcccttgcactagaggagcatgcaaaggcagcaattgttcagagtgctgagtttggtcagttagcagctgaatccttcccaaaaagtctgcactgcttaactgtgaaactgacagaagagtggcttcggaacccgaagcataggagtcgctcagaggagcagcggaattccacaagattggtggacaataatctgtatcatttctgtatattctctgataatgtgctggccacttcagtagttgtcaattctacagtctccaatgcgaatcaccctcaacagcttgtgttccatgtggtcactgacaggatccattttggcgcaatgtctacttggttcctcataaatgacttcaaaggttgcactgttgaagtccgctgcatagatgagttctcgtggttgaatgcttcttcatctcctctggtcaggcagctatctgaggtggaaactcagggttactactactcagctggttcaaaacaccctgaaagagaaataaaattccataatccaaagtttgtttctctgctgaaccatttacggttctacattcctcagatactccccaacttggagaaggtggtgtttcttgatgatgatgttgtggtgcagaaggacctgacacagctgttctccatagagttgcatggtaatgttattggagcagtggaaacttgtttagagtcatttcatcggtatcacaagtatctcaatttttcgcacccaactatcagctccaagattgatccacatacttgtggatgggcttttggaatgaacatctttgacttgatagcttggaggaaggcaaacgccacatcactttaccattattggcaagagcaaaattctgatctattgctctggaggaccgggacgctccctgcaggtcttttaacattttatggcctgatggagcccctagaccgcagatggcatgtcttgggtctggggtatgatgtagacatagatgatcggttgattgagagttctgctgttgtgcactataatggaaacatgaaaccctggctgaagttggctattcgccgttacaagtatatatgggagcggtatgtgaatttctcgcatccgtatgttagagagtgtatgttacattagaaagtctgcaaatctctgtatgttcttgcatgccattgaagccctacgcttcagtttcttcacatgaggcttgctgttgagcaccttatgtgagggatgtttcagaggtagaatatatactcaagggacagcatcaaagaagtcaactgctaaagttttctttttgggttgggggaagattcattttgagattaaaataattcatttgcagattattacatacgatttggactggaaattttagcagtctaaccagatacatctggatagatattgtaaaagagatacggttgttgaatcaatgggccaattttttgagatgttaggaaatgtcaattgccagttaagctgtgcaggatcactggtgttgcattcttttcatagtatctcattttatactggtgaagaagcttctttcctctgtataaatagcagctttatactccttagacagtatgaactcggttgaaactggagaaaggaatttgaaatcattttgatgtgctgaacatgaggtggtgtttttcttaggctgactagcttccatgtttgaattcgttcattttctgtatgaccactgcaaatgtcatagtctgttccatttgttgtttctggaaagtttgctacataatctgggcctttagcggaaaaaaaaaaaaaaaaaaaa

SEQ ID NO: 2948 - protein, 546 aa, Panicum virgatum
  misc_feature: Ceres CLONE 1788215
  misc_feature: Great-hit functional homolog of the protein sequence encoded by LOCUS At1g18580
  misc_feature (1)..(315): Pfam Name: Glyco_transf_8 Pfam Description: Glycosyl transferase family 8
  misc_feature: Useful for making plants with altered cell wall content and/or composition
MLRGTGHVGGDARRRALEHRRSARRRLPGWIWWLLGIFLLVGLMLFVLHHNQKEQFRPPVVDNGSEIEEVPHEKVNFTEELLSSTSFARQLADQMTLAKAYVILAKEHGNLQLAWELSSQIRNCQRLLSEGAVSGRAITRDEAHPIISRLARLIYKAQDAHYDISTTIVTLKSHALALEEHAKAAIVQSAEFGQLAAESFPKSLHCLTVKLTEEWLRNPKHRSRSEEQRNSTRLVDNNLYHFCIFSDNVLATSVVVNSTVSNANHPQQLVFHVVTDRIHFGAMSTWFLINDFKGCTVEVRCIDEFSWLNASSSPLVRQLSEVETQGYYYSAGSKHPEREIKFHNPKFVSLLNHLRFYIPQILPNLEKVVFLDDDVVVQKDLTQLFSIELHGNVIGAVETCLESFHRYHKYLNFSHPTISSKIDPHTCGWAFGMNIFDLIAWRKANATSLYHYWQEQNSDLLLWRTGTLPAGLLTFYGLMEPLDRRWHVLGLGYDVDIDDRLIESSAVVHYNGNMKPWLKLAIRRYKYIWERYVNFSHPYVRECMLH

SEQ ID NO: 2949 - DNA, 1090 bp, Panicum virgatum
  misc_feature: Ceres CLONE 1788222
  misc_feature: Encodes the peptide sequence at SEQ ID NO. 2950
agagggcgcaaaaaccaaaagggtggaaaaggaaaaatggcggtgatactccgccccgccgccgccgctgcggcgctcctcgccgtcgcggccgtctgcgccgacggggcctccacgttctactcctcggaccccaatctcggatccgcccgcgtcgtcttccagacaaattatggtgatattgagtttggcttctttcctcatgttgcgcctaagactgttgagcacatcttcaaacttgtgcggcttgggtgctacaacacaaatcatatcttcagggtcgacaagggatttgtggcacaagttgctgctgttgtgggaggtagaactgccccaatgaatgaggtgcagaaaagagaagcagataaaacaattgttggtgaatttagtagtgtcaagcatgtcaggggaatcctatccatgggaaggcactcagatccagatagcggcggttcatccttttctttccttcttggcgatgctccacaccttgatgggcagtatgctgtatttgggagggtcactaaaggtgacgatacattgagaaagctagagaggcttccaacccgcagagaaggcatttttgtgatgccaattgagcgaatcgacatcctatcaacatactattatgatattgatatagagagctgcgaagcagaaaaatctattcttaggaggagactttctgaatcagcatcagaagttgagcgatggagaagaaaatgctttgcttgatgctggattgaggccagggctcatcccttctccaggggctgatggccgaggcagaatacggaccgtatggaaagtaaattccctggatgtgtatgtctttatactcaacagttttacatgagtcaatgacatatatagctgtaatactaagaatatagaaacgggggtaggacattctgtgcatcgtactgttgctacacgatgtctcggtatgtaccagttgcgacaagtttaagttgatctctcttattccctttttagcatggttttgctaaacgatgtatgatactggaacgtataaactatacttgtgagtttgcgtctcagagaaggtgaaaaaaaaaaaaaaaaaaaa

SEQ ID NO: 2950 - protein, 232 aa, Panicum virgatum
  misc_feature: Ceres CLONE 1788222
  misc_feature (1)..(160): Pfam Name: Pro_isomerase Pfam Description: Cyclophilin type peptidyl- prolyl cis-trans isomerase/CLD
MAVILRPAAAAAALLAVAAVCADGASTFYSSDPNLGSARVVFQTNYGDIEFGFFPHVAPKTVEHIFKLVRLGCYNTNHIFRVDKGFVAQVAAVVGGRTAPMNEVQKREADKTIVGEFSSVKHVRGILSMGRHSDPDSGGSSFSFLLGDAPHLDGQYAVFGRVTKGDDTLRKLERLPTRREGIFVMPIERIDILSTYYYDIDIESCEAEKSILRRRLSESASEVERWRRKCFA

SEQ ID NO: 2951 - DNA, 1045 bp, Panicum virgatum
  misc_feature: Ceres CLONE 1788229
  misc_feature: Encodes the peptide sequence at SEQ ID NO. 2952
cattctctgccgagcgccagcatcactattctagttcgcactaggaccaagagcgatgggcggcggcggcgcgaccggtcctccttcgccgccggcaccgggcgaggccgccaagccgttccaggtggaccgggcgcttcaggcgctgggcttcgagttcacccgggtcaccgcgggggaggtcgccggccgcctccccgtcaccgagacctgctgccagcccttcgactggctcaacggcggcgtgtcggcgctcatggcggaggtcacggcgagcatcggctgctacgtcgcctcgggctaccggaggctggccggcgtgcagctctccatcaaccacgtcggccccgcgcggctcggcgacctcgtccaggccacggccacacccatccagctcggccgcaaaatccaggtttgggaagtccagatatggcgaatagatccttccacctcagagcgcaaagatctggtctcaacagcaagggttaccttattagccaacctagcgacatctcaagtgatgaagaaatatgaagaaggcctcaagaatttctcatctaaattgtaaaggcatgctggttacatattcacacataagcatggaacagaaagtttcagtaaaagtttcaggttcagggcacaatttgctacttgtatggcagcatatttgccaaacagaagctactgggtactgcaacagccaacaggcttattttttggaaggaacagccaacagtttcttgaagcaacagccaacaggcttatgatgttcatgtttatggtactgtgagaagcatgtatcatttgatcaagaattttaggagaataataagctcaggactgccatctcacttggagaatagttcatgtatccccatattttggccatccagtccgagaacttgtcttaggactagcctcgttcccaaatctacttattgtgatcctcttcctgcattggcaaaaggagaaacaatgtaaacaccattctgcagctaaattctggagagcttatgaaatgaattaaaaaaaaaaaaaaaaaaaa

SEQ ID NO: 2952 - protein, 170 aa, Panicum virgatum
  misc_feature: Ceres CLONE 1788229
  misc_feature (1)..(78): Pfam Name: 4HBT Pfam Description: Thioesterase superfamily
MGGGGATGPPSPPAPGEAAKPFQVDRALQALGFEFTRVTAGEVAGRLPVTETCCQPFDWLNGGVSALMAEVTASIGCYVASGYRRLAGVQLSINHVGPARLGDLVQATATPIQLGRKIQVWEVQIWRIDPSTSERKDLVSTARVTLLANLATSQVMKKYEEGLKNFSSKL

SEQ ID NO: 2953 - DNA, 903 bp, Panicum virgatum
  misc_feature: Ceres CLONE 1788241
  misc_feature: Encodes the peptide sequence at SEQ ID NO. 2954
gaacccaatccaacgtccgcagcaaacacacccagctgactccccctgtttccactccactcggaccagatcccaagcactccaccaagaacctttccctcccctccgagttactcgaggaatccatgtgcggcggcgccatcatcttcgactacatcccggcccggcgccgggtgtccgccgccgacttctggccggactccgaagccgacgccgaggactcccacgccccgcgcgcctccggcgagagagcgccgcgcgcgaagcggtgccgcaagaaccagtaccgcggcatccggcagcggccgtggggcaagtgggcggcggagatccgcgaccccgtgaagggcgtccgcgtctggctcggcacctaccccaccgccgaggccgccgcgcgcgcctacgaccgcgccgccaggcgcatccggggcgccaaggctaaggtcaacttccccaacgacatctcgtccccagcctctgtgccggcggcagctccggccgtgctcccggcgcccaaggcggaggcagcggtgtccgacgaggtcaaggagctgtccgaggagctgatggcctacgagaactacatgaacttcctcggcatcccctacatggagggcgggagcgcggccgcgcccgccgccgccgccgccgccgcccccgtcgcggaggagccgcaggcgccggtgccctccgggctgtggagcttcgaggactactacccggcgtccctgtcgctcttcactgaataacggacgcctcctgatgttcttttgtccgttaattttgtggaaaaaaatcccccctgctcgtccgctgtcgccatgagtggctaacgccgagctgatgatccttgtcttgtgtcgttgaacccatccattgtttcaaaaaaaaaaaaaaaaaaaa

SEQ ID NO: 2954 - protein, 207 aa, Panicum virgatum
  misc_feature: Ceres CLONE 1788241
  misc_feature: Great-hit functional homolog of the protein sequence given in SEQ ID NO 9580
  misc_feature (1)..(65): Pfam Name: AP2 Pfam Description: AP2 domain
  misc_feature: Useful for making plants with altered terpenoid content
MCGGAIIFDYIPARRRVSAADFWPDSEADAEDSHAPRASGERAPRAKRCRKNQYRGIRQRPWGKWAAEIRDPVKGVRVWLGTYPTAEAAARAYDRAARRIRGAKAKVNFPNDISSPASVPAAAPAVLPAPKAEAAVSDEVKELSEELMAYENYMNFLGIPYMEGGSAAAPAAAAAAAPVAEEPQAPVPSGLWSFEDYYPASLSLFTE

SEQ ID NO: 2955 - DNA, 1928 bp, Panicum virgatum
  misc_feature: Ceres CLONE 1788245
  misc_feature: Encodes the peptide sequence at SEQ ID NO. 2956
gtacccacacacaaagcctgaaacgtatagcaaatcacctatctattcggctattccacggcctctgagaaagacaactagctagctagtctggtgccatggcgggcggtggagaaggcggcggcgccggcagcgacgttgtccacgtcgtcatgttcccctttctcgccttcggccacataagcccgttcgtgcagctggcgcgcaggctggtctccgacgaggccgccggggtccgcgtcacgttcctcacggccgccgggatcgcgccgcgcgtcgaggccatgctggagtccgccgccggcgcggtgagggtcctgcccctgaacctgcccgaggtccccggcctgcccgcgggggccgcgagcaccgcggacgtctccggcgacggcgccgagctgctgaagctcgccctcgacggcacccggcccgaggtgcgcgcgctgctcgccgagctccgcccggacgccgtgctggtcgagttcgccacctcctgggtctgcgacgtcgccgctcctctcggcgccaaggtgctctacttcagcgtcttctccgccgtctccttcgcctacttcaccgtccccgcccgcctcgccggcgggcagccgccggccgccctgaccgcccgcgacctcatggtggcgcctgccgggtaccctgcggcctcgccgctcacctccgcgccgccccagctgcagggaccggccctggtgtacccgtacaccagcttccacggcatgccgtgcgtgtacgaccgcgtagtcgccggcgtcgagggcagcgccggcatcgtcatgaaaacctgccgggagatggagggcccctacatcgattacatctcctcccagttcggcaagcccgtgctcctcgccgggcccgtcgtgccagagccgccgcagggcgagctcgaggagcggtgggccagctggctctcctccttcccggacgacgccgtcgtgttcgcgtcgttcgggagcgagacgttcctgcccgtcgccgccgcgacggagctcctcctcgggctggaggccaccggccggccgttcctcgccgtgctcaacttccccaagggcccggacgcggcggcggagctcgaggcgcgcatcccgccgggcttcgaggagcgggtgagggggagagggctggtgcgcacgggctgggtgccgcagcagcacatcctgcggcaccggagcgtcggctgcttcgtcaaccacgccgggttcagctccgtcgtggaggggctcgtcgccggctgccgcctggtgctgctgccgatgaagggcgaccagtacttcaacgccgcgctgttcgcgcgcgagctcggcgtcggggtggaggtggcgcagcgggatgacgggtggtttgggcgcggggacgtggcagacgctgtcgccgctgcggtggcggcgggaggtgacggagatgcgaagtggagggacttctttactaacgaggccgtgcaaaataagttccaggttgacttcatcagggagctgaagaaggtcgtgagggcgtaagtgcagatgataccagtggcagatctaagaatttaaggattttattatttctcttcttcttcatccatactcttaattcttttttgggagactttgggaggctccatgggatgtatgggactatgggtagaggggctccagcctccagagcctgcccccacgctccccacgctcctcgctcacgctggatccgcctctaaatgatgtgtgtattaattcacaaaataaacaaattttataagatggaaaagatctacgatggtggagcgtagacgtgcaagaagcacaaaacaaattgcggtggtgggagcaggtatatatgatcatcttcaatggtagattgtaatcacaaacgttgcattatatcttcaatggtttccatagctaccataaaaaaaaaaaaaaaaaaaa

SEQ ID NO: 2956 - protein, 472 aa, Panicum virgatum
  misc_feature: Ceres CLONE 1788245
  misc_feature (1)..(135): Pfam Name: UDPGT Pfam Description: UDP-glucoronosyl and UDP-glucosyl transferase
MAGGGEGGGAGSDVVHVVMFPFLAFGHISPFVQLARRLVSDEAAGVRVTFLTAAGIAPRVEAMLESAAGAVRVLPLNLPEVPGLPAGAASTADVSGDGAELLKLALDGTRPEVRALLAELRPDAVLVEFATSWVCDVAAPLGAKVLYFSVFSAVSFAYFTVPARLAGGQPPAALTARDLMVAPAGYPAASPLTSAPPQLQGPALVYPYTSFHGMPCVYDRVVAGVEGSAGIVMKTCREMEGPYIDYISSQFGKPVLLAGPVVPEPPQGELEERWASWLSSFPDDAVVFASFGSETFLPVAAATELLLGLEATGRPFLAVLNFPKGPDAAAELEARIPPGFEERVRGRGLVRTGWVPQQHILRHRSVGCFVNHAGFSSVVEGLVAGCRLVLLPMKGDQYFNAALFARELGVGVEVAQRDDGWFGRGDVADAVAAAVAAGGDGDAKWRDFFTNEAVQNKFQVDFIRELKKVVRA

SEQ ID NO: 2957 - DNA, 2160 bp, Panicum virgatum
  misc_feature: Ceres CLONE 1788257
  misc_feature: Encodes the peptide sequence at SEQ ID NO. 2958
atcgctagcgatccaacagaacctactccttcgtgatccgcacgcgcacgacgatcgagccgaggcggtggcggcgatgggcagcgtggccatggactccgactacggcgcgccgcgcgagctgtcggcgctccagaaggcgcgcgcgctctaccagcccgagctcccgccgtgcctccagggtaccacggtcagggtggagtacggtgacgcagcgaccgcggcggatgttgctggtgcgcatgtcatcagccaggccttccctcacacgtacggccagccgctggcgcacttcctcagcaggacggccgacgtgccggacgctaccatcataacagagcaccctgtcgtcagggttggtattgtcttcagtgggaggcaatcccctggagggcacaatgttatatggggcctgtatgatgctataatggctcacaattcaaacagcaagcttatcggttttcttggaggaactgatggattatttgcacagaaaactatggaaatcactgcagaagctctttcatcctataaaaatcaaggtggttatgacatgcttggtcggacaagggatcaaatcagaactactgagcaagtaaaggcagcaatggctacttgccaagcattgaagttggatgcccttgttataattggaggtgtcacgtccaatacggatgctgctcagcttgctgagacatttgctgagttgaattgtccaacgaaggtagttggtgttcctgtaactctcaacggagacctcaggaaccagtttgttgagacaacagttggttttgataccatatgcaaggtgaactcgcagctcataagcaatgtttgcactgatgctctttctgctgaaaagtattactattttattcgattgatgggacggaaagcatctcatgtggcattgaaatgtgctcttcagtcacatccaaatatggttatcctaggtgaggaggtttctatgtcaaaacttaccattttcgacattacaaagcaaatatgtgatgctgtgcaggcaagggctgaaaaagacaaatatcatggggttgtgctgattcctgagggtcttgttgagagtattcctgagctgtatgctttgcttcaggaaatccatgggctacataacaaaggtgtttccgttgagaacatctcttccagtctttcaccttgggcatctgcactgtttgaatttttgcctccatttattagaaagcagctgcttctccatcctgaatctgacgattctgctcaactttctcagattgagactgagaagcttctggcacaattagttgagattgaaatgaacaagcgccttaaggaaggcacttacaaaggaaagaagttcaatgcaatatgccactttttcggctaccaagcaaggggtgccctgccttccaaattcgactgtgattatgcttatgttcttaggcatgtgtgttatcacatcctagtggctggtctgaatggctacatggccactgtgacaaatctcaagagcccagtgaacaagtggaaatgtggtgctgctcctattacatctatgatgactgtaaaaagatggtcccgtggtcctgctgccagtcaaattggcaagcctgctgtccacgtggccagtgtcgacttgaaaggaaaagcatacgaactgttgcgacaaaattcttccagcttcttgatggaagacatgtaccgaaaccctgggccacctcagtttgaaggactgggtgctgagacaaagcctatttcactgtgtgttgaagatcgagactacatgggaagaatcaaacaattgcaggagtacttggagaaggtgaaaagcattgtgaagcctgggtgttcacaggacgtcctcaaagcagcgctaagcgccatggcttctgtgacggagatgctgacaatcatgtcttctccgtctttcagtggccaggcaaccatctgaaggccatgccaaagactgtatcgtctgaatgctgatctcgtgttctcggtctaggcatattttggcttctgtctgtatcatccgtctatctgaaaccaccgtcttgataggtcctctgctcaatatctgctttgttttttgggtgtttttcatctagacatattttgtttctgattatagatgatgagcaatttcaaaaaaaaaaaaaaaaaaaa

SEQ ID NO: 2958 - protein, 622 aa, Panicum virgatum
  misc_feature: Ceres CLONE 1788257
  misc_feature (1)..(281): Pfam Name: PFK Pfam Description: Phosphofructokinase
  misc_feature (6)..(615): SWISSPROT Homolog: EC 2.7.1.90 Pyrophosphate- fructose 6-phosphate 1-phosphotransferase alpha subunit
  misc_feature (6)..(619): SWISSPROT Homolog: EC 2.7.1.90 Pyrophosphate- fructose 6-phosphate 1-phosphotransferase alpha subunit
MGSVAMDSDYGAPRELSALQKARALYQPELPPCLQGTTVRVEYGDAATAADVAGAHVISQAFPHTYGQPLAHFLSRTADVPDATIITEHPVVRVGIVFSGRQSPGGHNVIWGLYDAIMAHNSNSKLIGFLGGTDGLFAQKTMEITAEALSSYKNQGGYDMLGRTRDQIRTTEQVKAAMATCQALKLDALVIIGGVTSNTDAAQLAETFAELNCPTKVVGVPVTLNGDLRNQFVETTVGFDTICKVNSQLISNVCTDALSAEKYYYFIRLMGRKASHVALKCALQSHPNMVILGEEVSMSKLTIFDITKQICDAVQARAEKDKYHGVVLIPEGLVESIPELYALLQEIHGLHNKGVSVENISSSLSPWASALFEFLPPFIRKQLLLHPESDDSAQLSQIETEKLLAQLVEIEMNKRLKEGTYKGKKFNAICHFFGYQARGALPSKFDCDYAYVLRHVCYHILVAGLNGYMATVTNLKSPVNKWKCGAAPITSMMTVKRWSRGPAASQIGKPAVHVASVDLKGKAYELLRQNSSSFLMEDMYRNPGPPQFEGLGAETKPISLCVEDRDYMGRIKQLQEYLEKVKSIVKPGCSQDVLKAALSAMASVTEMLTIMSSPSFSGQATI

SEQ ID NO: 2959 - DNA, 953 bp, Panicum virgatum
  misc_feature: Ceres CLONE 1788272
  misc_feature: Encodes the peptide sequence at SEQ ID NO. 2960
agaagctccttatcctaaagcccaacaccccgtctccgactctcctctctccgtgccttccggactctcgccctcgaagcagccagccatggcgtcggtgcacctgaccggcccgcgggtggcggtggccgcgaagccggccgcgctgggcgggctccgcctgccgacgccgtcgattgccgtgccgagcgggcggagggcccgagggctcgtggtgagggccgccacggttgtgtcacccaagtatacttccattaaaccattaggagacagagtacttgtgaaggtcaagacctctgaggctaaaagtgatggagggattttacttccagtatcagttcagacaagaccacaaggaggggaagttgttgctgttggagaggggagaagttttgggaataaaagcattgagatcagcgttccgattggtgcgcaagttgtctactcaaaatacgcgggcacagaattggaattcaatgacgctgaccatcttattttgaaagaagatgacatcatcggtattctcgacagtgatgatgtgaaagatctgaagccgctgaatgatcgcattctgattaagattgctgaagctgaagaacaaactgctggtggtttgctatggacgcaggcaactaaagagaaaccttctgttggaacagtggtcgctgttggtcctgggccattgggcgaggatggcagcaggacgcccctgtccatcactcctggaaccaacgtgatgtacaccaagtatgcggggagcgagttcaaggtcaaggagggcgaatacatcgtgctcagggcatctgacgtgatggccgttctttcctaacggcaaacacccatgcaaacattgaaattttgatggtttaggccggaccttaatgtcattcatttgctcttgtttggaagtggtggaagcttttgaactgttgtaaaaaaaaaaaaaaaaaaaa

SEQ ID NO: 2960 - protein, 246 aa, Panicum virgatum
  misc_feature: Ceres CLONE 1788272
  misc_feature (1)..(93): Pfam Name: Cpn10 Pfam Description: Chaperonin 10 Kd subunit
MASVHLTGPRVAVAAKPAALGGLRLPTPSIAVPSGRRARGLVVRAATVVSPKYTSIKPLGDRVLVKVKTSEAKSDGGILLPVSVQTRPQGGEVVAVGEGRSFGNKSIEISVPIGAQVVYSKYAGTELEFNDADHLILKEDDIIGILDSDDVKDLKPLNDRILIKIAEAEEQTAGGLLWTQATKEKPSVGTVVAVGPGPLGEDGSRTPLSITPGTNVMYTKYAGSEFKVKEGEYIVLRASDVMAVLS

SEQ ID NO: 2961 - DNA, 1900 bp, Panicum virgatum
  misc_feature: Ceres CLONE 1788310
  misc_feature: Encodes the peptide sequence at SEQ ID NO. 2962
gtcctgacccccaccacctcgttctttcctcccatcccgccctgtctcggcgcgaggcagcgccggtcagctgacagggacaccctgaacacttgttgatttcttgatgagttggcgtcggtggcggcaaggcggaggaggggattcggcttccccggcgccggcagccgcctgaacatcccttcttcttcctctttggtgggctttcgcgaggtacaagcgccatggggctccttggtatgatgggagattcgtttgggtgctcagctaccggtgagcgactcgtctccgccgcaagggatggagacattcaagaggctagagccctcttggagctcaacccccgccttgcccggtactcaacatttgggatccggaactcgccactccattactcggctgcgaagggtcaccatgagattgtatccctcctaatcgaatccggggttaatatcaaccttagaaattgcagaggacagactgctctgatgcaagcttgtctatatggtcactggaaagttgtacagattctagttcttttcaaagctaatattcacaggagagattgttttagtggcgcgacagctattcattttgccgccctgaaaggtcatactcggtgcattcggcttcttgtggctgattacgtgccgagcttgtcagagttttggaacgttatgcatggaaagtccagagatgaagcaaaaaaggatgtctttgatgcagtatctctccggaggctaattaatggaaagtcggatggtggcgtcaccccgcttcacttggcagcccttcatggccatgctgagagtgtgcagttgctattagatcttggagcttcggtgtctgaggtcacagtcagtgatggttcaactattgacctcattggttcaggtagcactcctctccattatgcggcatgtggtggaagtgctgtctgctgccaactgctcattgcagcaggagcgaacatcggagctgaaaatgctaatgggttgactcctcgagatgtggctcgttcgtggcacaaaaatagtgttgaaggcatcctaagcaaacagccagaaggccgaatatgcattcttccttcaccatatctgtgtctaccattgatgagcattgtcaaaattgctcgtgagtgcggatggagaaagacttctgcctcctccacatgtcaggatccatgtgtcatatgtatggaggtggaatgcacggtggctgcagaaggctgcggccatgagttctgcaccaaatgcgcactctatttgtgttcaaccacaagcagctcaacatccatccgtggcaatcctggctccgtatcatgccctttgtgccgtcatgccattgtctctttcaggaagctcacaagtaccactccaataaaggagcttccatggacaagcacatcactagctctatgtgcggcaggcgcaagcactggttccaatcatgccagctccttgcatcgtcggcctgacacgcatcgattgcgctcctcctcggttcagttgggatgctcctcttttagatccattggctctgggaaactgtcgtcattgaagttgaactgcacaggagctgaagaggcggtgccttgcctcatcagttgtctccggccagatgtgcagcggtcctcatcgtacagggaaagaattagaagatattcagagttttgatagcagccctctgttggttctctgcctcccttcctgcgagtttttggggtttggccgttcaaacttgtttagtgtctgtccatgtttctctttgcttctgtgtttcttgtcatgtaatatgcagcagtctcgtgctgaagatctgtttgtgtacatgactcgttcatctacttatatgtgaagtatataccatctccgttttacaaaaaaaaaaaaaaaaaaaa

SEQ ID NO: 2962 - protein, 483 aa, Panicum virgatum
  misc_feature: Ceres CLONE 1788310
  misc_feature (1)..(50): Pfam Name: zf-C3HC4 Pfam Description: Zinc finger, C3HC4 type (RING finger)
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWNVMHGKSRDEAKKDVFDAVSLRRLINGKSDGGVTPLHLAALHGHAESVQLLLDLGASVSEVTVSDGSTIDLIGSGSTPLHYAACGGSAVCCQLLIAAGANIGAENANGLTPRDVARSWHKNSVEGILSKQPEGRICILPSPYLCLPLMSIVKIARECGWRKTSASSTCQDPCVICMEVECTVAAEGCGHEFCTKCALYLCSTTSSSTSIRGNPGSVSCPLCRHAIVSFRKLTSTTPIKELPWTSTSLALCAAGASTGSNHASSLHRRPDTHRLRSSSVQLGCSSFRSIGSGKLSSLKLNCTGAEEAVPCLISCLRPDVQRSSSYRERIRRYSEF

SEQ ID NO: 2963 - DNA, 2605 bp, Panicum virgatum
  misc_feature: Ceres CLONE 1788311
  misc_feature: Encodes the peptide sequence at SEQ ID NO. 2964
agggtttcgcctccccccaccctcccgctctcccgcctcttcctcccggccaccgcgcgaccgcagcgccgctctcgccgccgccgccatggggacggagcggaagcggaaggtgagcctcttcgacgtggtcgacgagacctccatctccgccaagctcggccgcggcgccaccaacggtgccgccgccgccgcgggcggggccaaccccaccgtcaaccggtggaacgggcggccatactcggcgcggtattttgagatcctcgagaagcgacgcacgctccccgtgtggcagcagaaggaggagttcctccgcgccctccgcgacaaccagaccctcatcctcgtcggcgaaacgggaagcggaaagaccactcagatcccccaattcgtacttgagactgaaggcctgggtaaccgctcaatggttgcctgcactcagccgcggagggttgcagcaatgtcagtctccaggcgtgtggctgaggaaatggatgttactattggggaggaagtgggatacagcatccgttttgaggattgcagcagccacaaaactgttctcaaatatttgacagatggtatgcttctgagagaagcaatggcagacccacttttagagaagtacaaggtgattgttcttgatgaggctcacgagagaacattggcaacagatgttctgtttgggcttctgaaggaggttctaaaaaatagaccggatttgaagcttgtcgttatgagtgctacccttgaagcagagaaattccagggttactttagtggtgcaccattgatgaaggtaccagggagacttcacccggttgaaatcttctatactcaagaaccagaaagggactacctagaggctgctatcaggacagttgtgcaaatacacatgtgtgaacctgctggtgatatccttgtattccttacgggagaagaggagattgaagatgcctgtcgtaaaattaataaggaaattaataacatgggagatcaggttggcccagttaaagtcgtgcctttgtattctacgctgcctccagccatgcagcagaagatttttgaacctgctcctgccccattgaaggaaggaggccctcctgggagaaaaattgttgtgtccacaaacattgctgagacgtccttaactatagatggtatagtttatgtgatagacccagggttttccaaacagaaagtttacaacccaaggataagggtggaatccctcctggtgtcaccaatttccaaggcaagtgctcatcagagagctggtcgtgctggaagaacgcagcctggaaagtgcttcaggctatacactgagaagagttttaacgaggatttgcaaccacaaacctacccagaaattcttaggtcaaacctggcaaatacagttcttaccttgaagaaacttggaattgatgatttagtacattttgactttatggaccctccagcaccggaaactcttatgagggctttagaagttttgaactacttgggggcacttgatgatgacggtaatctaacacagttaggtgaaatgatgagcgagtttcccctggatccacaaatgtcgaagatgcttgtcatcagtccaaagtacaactgttcgaatgagatcctatcaatatctgccatgctttcagtacccaattgcttcctccggcctagggaggctcaaaaggctgctgatgaggcgaaggctcgatttggccatattgatggggaccatctcacgcttctgaatgtataccacgcatacaagcaaaacgatgaagatccccagtggtgttacgagaactttatcaatgccagagcacttaagtctgcggacaatgtcagacaacagcttgttcgcatcatgactagattcaatctcaagatgtgcagcacagacttcaatagccgtgagtactatgtcaatatcaggaaagcactgctcgcagggtatttcatgcaggttgctcacctggagcgcactggacattacctgactgtaaaagacaaccaggtcgtccatcttcatccctcgaactgcatggaccataagccagagtgggtcatctacaacgaatatgtcctgacgactaggaatttcatccgcacagtcacagatatccgtgggaaatggctgattgatatcgctccacactactatgatctgagcaactttccatcatgcgaggcgaagcgtgttctcgagaggctgtataacaagcgggagagggaaagggccacgaacagaggttgaagttgatgcttcttttttacccggtgcccgtgattgtactgccagttaagggccagagccagaactcaagtgaagccttggccgtcccccctgatacatcttgccatcttgggccccaaccataagcaaaggcaccacatttcatcagcagggtgattattttgtaaacaatttcaaatgtttgctgatgcaactgtgtaacagcgacgaggtcgtatctttgtttttcttcccttagaagggtagtgcagattggttgggtatcatctccgtataaatgcggagaagactttaatttttcttatttttgccattttgcaccggtttcaaaaaaaaaaaaaaaaaaaa

SEQ ID NO: 2964 - protein, 722 aa, Panicum virgatum
  misc_feature: Ceres CLONE 1788311
  misc_feature (1)..(164): Pfam Name: DEAD Pfam Description: DEAD/DEAH box helicase
  misc_feature (1)..(101): Pfam Name: Helicase_C Pfam Description: Helicase conserved C-terminal domain
MGTERKRKVSLFDVVDETSISAKLGRGATNGAAAAAGGANPTVNRWNGRPYSARYFEILEKRRTLPVWQQKEEFLRALRDNQTLILVGETGSGKTTQIPQFVLETEGLGNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEINNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDDGNLTQLGEMMSEFPLDPQMSKMLVISPKYNCSNEILSISAMLSVPNCFLRPREAQKAADEAKARFGHIDGDHLTLLNVYHAYKQNDEDPQWCYENFINARALKSADNVRQQLVRIMTRFNLKMCSTDFNSREYYVNIRKALLAGYFMQVAHLERTGHYLTVKDNQVVHLHPSNCMDHKPEWVIYNEYVLTTRNFIRTVTDIRGKWLIDIAPHYYDLSNFPSCEAKRVLERLYNKRERERATNRG

SEQ ID NO: 2965 - DNA, 1696 bp, Panicum virgatum
  misc_feature: Ceres CLONE 1788324
  misc_feature: Encodes the peptide sequence at SEQ ID NO. 2966
aaccatctccgatctgattccttccagccgacgacctccgcatcctcctccccggcgccgccattcacttgccgcccggccagttaccgcgacccccgagcaccgacttgggcgcgggccggcggggcagcgcggccgcggcgcggcgaagatgatcagcaggcagctcgtgctgacctacctctacctgctgatctacgtctgcctctcgtcgggcgtcatcctgtttaacaaatgggtcctttctccaaagtacttcaaatttcccttccctatcacccttacaatgattcacatggcattttccggaattgtgacattcttccttgtccgagtttttaaggttgttgcacctgtcaagatgactttccatatatatgccacatgtgtgattccaattagcgccttctttgcttcaagcctgtggtttggcaacacagcatacttatatatttctgtggccttcatccagatgctcaaggccttgatgcctgtagcaacatttataatggctgttttatgcggtactgacaaattaagatgggacctcttcttgaacatggtattggtcagtgttggtgttgtagtttcatcatatggcgagattcactttaatgtgattggaacattataccaagtaactggcatttttgcggaagccctcaggctggtcctaacacaggtccttctccaaaagaagggtttaaccctgaaccctattacaagcctctattacatagccccttgcagttttatattcttgtttattccatggtatttactggaaaagcctgaaatagactcatcacaaattcaagtcaactattcaatattttttctgaatgcgctctctgcattcgctttgaacatatcaatattcctagttattggaagaactggagctgtcacgattcgagttgctggtgttctgaaggactggatacttattgctctctcaaccatcatctttcctgaatctgttattacaagcctcaacataattggatacgcagttgctctctctggtgttgtcctgtacaattatttgaagatgaaagatgtgaaaacaaaccagcttccagcagataacaatcctgatagatctacaaaggacaagaaggcgttaaatacatacaggcctgacaattccatggacaacaatgacgggactgtcataggaggcctggcatcagaagcagcagcagcagttgatgaggaagcccctttgatcccttctgcacgcctctcctatgttacacggacccaaacaggcagcttcagtaacagatgacaatggtttacctatttgtttgggtagaccatcatatatttttgtccaggcgaatcagaaagaggtgcatacatgtgcgaaaatgtctgttttaagaagctcaggtgagtagtcagtctttcgcgcagctcttcgcataccgtgtcgcctggatgtctcctctaggtgtacccttttccctaggcgtggattctttggggagatacctagtggtgaattagataagttgaagaggtaggtcatgacttttccttagtatttggagaaatatgtagggccgcgtgctggacaaattattccttaaccgaaaatatggaatgttgtcaaaccatagatgttgtaaagcactacatataggttctaacttgaattgtacccttgtttcaaaaaaaaaaaaaaaaaaaa

SEQ ID NO: 2966 - protein, 379 aa, Panicum virgatum
  misc_feature: Ceres CLONE 1788324
  misc_feature (1)..(141): Pfam Name: TPT Pfam Description: Triose-phosphate Transporter family
MISRQLVLTYLYLLIYVCLSSGVILFNKWVLSPKYFKFPFPITLTMIHMAFSGIVTFFLVRVFKVVAPVKMTFHIYATCVIPISAFFASSLWFGNTAYLYISVAFIQMLKALMPVATFIMAVLCGTDKLRWDLFLNMVLVSVGVVVSSYGEIHFNVIGTLYQVTGIFAEALRLVLTQVLLQKKGLTLNPITSLYYIAPCSFIFLFIPWYLLEKPEIDSSQIQVNYSIFFLNALSAFALNISIFLVIGRTGAVTIRVAGVLKDWILIALSTIIFPESVITSLNIIGYAVALSGVVLYNYLKMKDVKTNQLPADNNPDRSTKDKKALNTYRPDNSMDNNDGTVIGGLASEAAAAVDEEAPLIPSARLSYVTRTQTGSFSNR

SEQ ID NO: 2967 - DNA, 1589 bp, Panicum virgatum
  misc_feature: Ceres CLONE 1788327
  misc_feature: Encodes the peptide sequence at SEQ ID NO. 2968
actgcagttacctcacctcaccacctcccctgccacaccgatggcacggccacggcgtttcagtctcaccgtatccctgatctccctcgtcgaattcctgtcacttacttctgcgtcaacgttgcagcagctatgcgccgacggcggcgggcctgcagctggagttagagccggctactggtcgccgtcctcgagccgctactccccggtcagtagcatcgacgcctccttgttcactcacctctactacagctcggtgtccatcgacgaggcgagctatgccgtcgcgcctccgccggccgacgaggcctcgctgttcgccgccttctccagcaccgtcaagtccagtagctcgtccgccaagaccatgctgtccatcggcacggatgagtaccgggtggacgtctccaacgccgccttctccagaatggcttcggacaggggcctccggggagtgttcatcaactcctcggtggaactggctcgagccaacggcttcgacggcctcgacttgtcgtggattttcccggccacgcagatggacatggagaacctcggggtcctgctcgccgaatggcgggcgaagatcaccgaggagtccgccacgaactccctatccgagcctcttctcctgacagcaacactgtatttctccaaccacctgttcgacatgcctgacagcaacctcgactacccaatcgatgacatctcgagcaacctcgactgggcgaacattctcaccttcggcttccatggcggcagcaacgtcaccacagccgacgcgcctctctacgacgcgacctcgcacttttcggtgagctacggggtcatctcatggctggatactggagtccctccgtgcaagctggtgatggggatgcctctgtatgggaggtcctggttcctcagaaacaaggccaagaacgggataggatcgccgacggccgctgctgggacgaagcagaggaagagcaaccagactgggataatcgcgtatgccgaggttgaggagtacacgaattctgcaagcaccgttcttacctacgacagccagtcagtggcagagtatttctacaacggtgacctctgggtcagcttcgacagtgcccaggtggtgcagaagaagctggagtttgcagccaggtctcagttacttgggtacttcctctggaccgtcggcttcgacgattcaaacagcacaatagcaaagcaagctacagaatcatggcaccaatatgcacaagatggttttggaaccatgcacgcaggaggttcaaaccagtatgttgcatttagttcatcttcagtatcatctggcagctggtattcgaaaattctcaggtatttgttgtcaccgatacttttattggtgactctatcacactgagagtatcagtaaatatgccagatatgtaaaagtagtttcaaatggtctgttcatcaaagtgaatttctagtatatatgctctgttgtattttttgagctttttttcacagtcattctttcccaaaaggccaaaacaagggttgcagcaagttaaataattaatagttacgttgatttccatcaaaaaaaaaaaaaaaaaaaa

SEQ ID NO: 2968 - protein, 448 aa, Panicum virgatum
  misc_feature: Ceres CLONE 1788327
  misc_feature: Great-hit functional homolog of the protein sequence encoded by LOCUS At4g19810
  misc_feature (1)..(344): Pfam Name: Glyco_hydro_18 Pfam Description: Glycosyl hydrolases family 18
  misc_feature: Useful for making plants with altered cell wall content and/or composition
MARPRRFSLTVSLISLVEFLSLTSASTLQQLCADGGGPAAGVRAGYWSPSSSRYSPVSSIDASLFTHLYYSSVSIDEASYAVAPPPADEASLFAAFSSTVKSSSSSAKTMLSIGTDEYRVDVSNAAFSRMASDRGLRGVFINSSVELARANGFDGLDLSWIFPATQMDMENLGVLLAEWRAKITEESATNSLSEPLLLTATLYFSNHLFDMPDSNLDYPIDDISSNLDWANILTFGFHGGSNVTTADAPLYDATSHFSVSYGVISWLDTGVPPCKLVMGMPLYGRSWFLRNKAKNGIGSPTAAAGTKQRKSNQTGIIAYAEVEEYTNSASTVLTYDSQSVAEYFYNGDLWVSFDSAQVVQKKLEFAARSQLLGYFLWTVGFDDSNSTIAKQATESWHQYAQDGFGTMHAGGSNQYVAFSSSSVSSGSWYSKILRYLLSPILLLVTLSH

SEQ ID NO: 2969 - DNA, 1878 bp, Panicum virgatum
  misc_feature: Ceres CLONE 1788346
  misc_feature: Encodes the peptide sequence at SEQ ID NO. 2970
cgttctaattgtcctttttgtcgaaccacaccacaccgtttgcaggttctggaagcatgagcttgtggttcatctttctcttttctcttctctgtctggctgcacggattcgatcagaggattactccgatgtgactgtaattgttcgaggctctgagacgattgcttcaaccagtgatgagtttatctgcgccaccatggattggtggcccccagagaagtgtaactatgaccaatgtccatggagaatggcctctgtcttaaatttggacttgactaatcctttgttggctaaagctattcaagcctttagcccactgcgaatcagagtgggaggctccttgcaagatcaggtgctatatggcacaccaaatttgggatctccatgcgatccatttacaaaggtttcaggcagtctgtttgggttttctcaaggatgcataaccttggaaagatgggatgctattaatgatctgttcctgaatacaggggcagtagttacatttggtcttaatgcacttcaaggacgacggcagataagcagaagtgtttggggaggtccttgggattcgagcaatgctcgagagttcatggaatacacagtttcaatgaactatcccatagattcttgggaatttggtaatgaattgagtggaagtggaatcggtgcgagtgtgggagctgaacaatatggaaaggacctagttgaactccaaacaatcatcaacgagttatatggagattccaggaaaccactggttgtagcaccaggaggattttatgaccaaaaatggtttgctcaactgcttaaggtctctgggccaaatgttcttagtgcaatgactcatcatatttacaaccttggtgctggtaacgatccacaagttccaaatagaattttgaacccacaatatttgagccggacttccgacacattcagaagtctccaactcacaatacaacgccatggaccatggtcttctccatgggttggggaagctggtgggacatataacagcggcagccgtctcgtgtctaatactttcctgaatagcttctggtatcttgatcaacttgggcaatcagcaaagtatgacaccaaggtttactgcagacagtcgctgatcggtggcaattacgggcttcttgacactgacactttcgtaccaaacccggattactacagtgccttgctgtggcatcggctcatggggacgggagttctttccacagacatcagtggttctccatacttgcgtgcttatgttcattgcgggaagcaaaaggggggcatcacactcctcttgttgaacctgcaccgaagcatgggattcatggtttcagtcaggaacgacctcaatgtcaatctcgaagaggggcaagggatcagaagggacaatgtgtttgtccatggccttaaaaggacagtttcttgggtcgggagcaaagcttcagacgggtattccaagagggaagagtaccatctctcggggaaagatggggacccctttgcccggaccatgctcctgaacggagttcctctagaactcactgaagatggtgacatccctccattgtatcctgtggaagtttcggtcaattcaccaatctatgttgctcctctgaccattgcgttcgtcgtgttcccagactttgaggctaaagcttgtggtcgatgattaactgtagagatgttctgaagaacacgaacactgtaaagatatgtgttttcgttttctgatctgtcccaattgggggccacattttcccaacaaatagagtcccctgtttactaatgttatactgattcatgtcaatgcctcgtgccttcattgatgtacaattcagcaacatctcgaaaaaaaaaaaaaaaaaaaa

SEQ ID NO: 2970 - protein, 540 aa, Panicum virgatum
  misc_feature: Ceres CLONE 1788346
  misc_feature (1)..(319): Pfam Name: Glyco_hydro_79n Pfam Description: Glycosyl hydrolase family 79, N-terminal domain
MSLWFIFLFSLLCLAARIRSEDYSDVTVIVRGSETIASTSDEFICATMDWWPPEKCNYDQCPWRMASVLNLDLTNPLLAKAIQAFSPLRIRVGGSLQDQVLYGTPNLGSPCDPFTKVSGSLFGFSQGCITLERWDAINDLFLNTGAVVTFGLNALQGRRQISRSVWGGPWDSSNAREFMEYTVSMNYPIDSWEFGNELSGSGIGASVGAEQYGKDLVELQTIINELYGDSRKPLVVAPGGFYDQKWFAQLLKVSGPNVLSAMTHHIYNLGAGNDPQVPNRILNPQYLSRTSDTFRSLQLTIQRHGPWSSPWVGEAGGTYNSGSRLVSNTFLNSFWYLDQLGQSAKYDTKVYCRQSLIGGNYGLLDTDTFVPNPDYYSALLWHRLMGTGVLSTDISGSPYLRAYVHCGKQKGGITLLLLNLHRSMGFMVSVRNDLNVNLEEGQGIRRDNVFVHGLKRTVSWVGSKASDGYSKREEYHLSGKDGDPFARTMLLNGVPLELTEDGDIPPLYPVEVSVNSPIYVAPLTIAFVVFPDFEAKACGR

SEQ ID NO: 2971 - DNA, 1612 bp, Panicum virgatum
  misc_feature: Ceres CLONE 1788352
  misc_feature: Encodes the peptide sequence at SEQ ID NO. 2972
aggcacagcgaggagagagagagagagagaggggcagagcagaggaagagcgacatggcggccacggcgtccctgaagagcagcctccgcctcccgtctcctatctccgacttcagcggcgcagccgtctccgtctcgccgcagaagaggaggagatcatggcagccgaggggggcgagggtgcagatctcggcggcggcggcggactccaagaacattcttgtcatggggggaaccaggttcattggtgttttcctgtccagactccttgtcaaggagggccatcaggttacattgttcactaggggaaaggcgcccatcacccagcagctgccaggagagtccgatgcagagtacgcagagttctcctccaagatccagcacttgaaaggtgacaggatggacttcgaattcgtcaagacaagcctttctgctaagggctacgatgtcgtctacgacatcaacggacgcgaggctgtggaggtcgagcctatcgtcgacgccttgcccaacctggaacagtacatctactgctcatcgaccggagtgtacctgaaatcggaccttctcccccactgcgaggccgacgccgtggaccccaagagccggcacaaggggaagctggagacggagagcctgctcaccgcccgcggcgtgaactggacgtccatcaggccggtgtacatctacggcccgctcaactacaaccccgtcgaggagtggttcttccaccgcctcaaggccggccgccccatccccatccccggcgccggcaaccagatcacccagctcggccatgtcaaggacctcgcgacggcattcaacctggtgctcggcaacccgaaggcgagccagcagatcttcaacatctccggcgccaagtacgtcaccttcgacggcctcgcacgggcgtgcgccaaggctggagggttccctgagccggagctcgtccactacaaccccaaagacttcgacttcggcaagaagaaggccttcccgttcagggaccagcacttcttcgcgtcgatcgagaaggcgagcagggagctcgggtggacgccggagttcggcctcgtcgaggggctcaccgactcgtacagcctcgacttcggccgcggcaccttccggaaggcggccgacttcaccacggacgacatgatcctcggcaagaagctcgcgaccgtctgagccttccgtcacctttgggaacgatggctgcaagtgacacgggaaacggggccgctgcagatgctggctgtagagatgtggggaatgcatggaaaaatatctcaatttttgtttggatccgttccggatcgacgcatcgatacagttggagaacttatctcagtgcactagaattatccgcgaaactaaaagcagctcaaattaatggactaaaagcagctcaaattaatgggggcttcagaaggttattggtgatctgtaaccggttggtactattctcgaaaaggaaatgcgtggggaaacttaagctatcgactactgatatatcttatcatgtatatgagatacagacaggaacaaggattcagaagggtaatagtcttacgttctgcttgctgctgatcaaaaaaaaaaaaaaaaaaaa

SEQ ID NO: 2972 - protein, 377 aa, Panicum virgatum
  misc_feature: Ceres CLONE 1788352
  misc_feature (1)..(234): Pfam Name: Epimerase Pfam Description: NAD dependent epimerase/dehydratase family
MAATASLKSSLRLPSPISDFSGAAVSVSPQKRRRSWQPRGARVQISAAAADSKNILVMGGTRFIGVFLSRLLVKEGHQVTLFTRGKAPITQQLPGESDAEYAEFSSKIQHLKGDRMDFEFVKTSLSAKGYDVVYDINGREAVEVEPIVDALPNLEQYIYCSSTGVYLKSDLLPHCEADAVDPKSRHKGKLETESLLTARGVNWTSIRPVYIYGPLNYNPVEEWFFHRLKAGRPIPIPGAGNQITQLGHVKDLATAFNLVLGNPKASQQIFNISGAKYVTFDGLARACAKAGGFPEPELVHYNPKDFDFGKKKAFPFRDQHFFASIEKASRELGWTPEFGLVEGLTDSYSLDFGRGTFRKAADFTTDDMILGKKLATV

SEQ ID NO: 2973 - DNA, 1811 bp, Panicum virgatum
  misc_feature: Ceres CLONE 1788372
  misc_feature: Encodes the peptide sequence at SEQ ID NO. 2974
agccgcggacagccttcctaccctgctttctcagtcatccctttcttccttccaagtaaggagagaacatgacctctatttcttcccgaagctgggtgtgcgttggaggaaggaggaaggaagcctaggaaagccaccgctcaccttctcgctggctccccaccaaacgctgcttggtaggagaaaaattggcggaaaagcttccctttggctgggatctcttcttttaattacccctgggggttggcgggctcataagagcggacagggagagggtcgcgagaggcgagtagagacacagacaacgggtgctcgctggggaaggggcttgtggccttgtgaggaggatcgagaagaagatgaggcggcgggccttggccatagccattcttgctgcagtgctcttccttggagctgaggcacaggcggtgcagcagggccaccagactgagaggatctcaggaagtgctggtgatgtgttagaagataaccctgttgggaggctgaaggtttatatctatgatctccccagcaaatacaataagaaactgctgaagaaggatcccaggtgcttaaaccacatgtttgccgctgagatctttatgcaccgtttcctgttgtccagcgctgttcgaactttcaatcctgaggaagcagattggttctacacgcctgtatacacaacatgcgatctgactccttcaggtcttcctttgccgttcaagtctcctcgaatgatgcgcagcgcaattgagctgattgccacaaactggccttattggaatagatcagagggtgcagaccatttctttgtcacaccacatgactttggtgcttgcttccactaccaggaagagaaagcaatcggacggggaatccttcccttgcttcagcgtgctacactggttcagacatttggacagaagaaccatgtctgcctgaaggacggatccatcacaatcccaccgtttgcacctccccagaaaatgcaggctcaccttatccccccagacacgcctcgatccatctttgtgtacttccgtggtctgttctatgacaccagcaatgatcccgagggtggttactacgcaagaggtgctcgtgcgtctgtctgggagaacttcaagaacaacccactctttgacatctcgaccgatcacccgccgacctactatgaagacatgcaacgttccgttttctgcttatgcccattgggctgggcaccatggagtcccaggctagtggaagccgtggtctttggctgcatcccggtgatcatcgcagatgacattgtcctgcccttcgcggacgccatcccttgggaggagatcggtgtgtttgtcgccgaggaggatgtcccaaagctggacagcatcctgacgtccattcccacagatgttatactgaggaagcaaagacttctcgccaatccgtccatgaagcaggccatgctgttcccccagcctgctcaggcgggagatgcattccaccagatcctgaacgggctcgcgcgcaagctcccgcacgatgacaacgtcttcctcaaggctggggagagggtcctgaactggaccgccggaccaccgggcgacctgaagccttggtagcacctggtgttttactagaactttttataaaaggaaggttgggtacatgatgatatacgtgcgcctttgatattacctatagctgaattaccagtgctgaccacaagccaaatgtacatttttgtatgttctttacttatagctgttatacgatatattttcttctcaattttattaggtgatgaaaaaaaaaaaaaaaaaaaa

SEQ ID NO: 2974 - protein, 415 aa, Panicum virgatum
  misc_feature: Ceres CLONE 1788372
  misc_feature: Great-hit functional homolog of the protein sequence encoded by LOCUS At1g27440
  misc_feature: Great-hit functional homolog of the protein sequence encoded by LOCUS At5g61840
  misc_feature: Useful for making plants with altered cell wall content and/or composition
MRRRALAIAILAAVLFLGAEAQAVQQGHQTERISGSAGDVLEDNPVGRLKVYIYDLPSKYNKKLLKKDPRCLNHMFAAEIFMHRFLLSSAVRTFNPEEADWFYTPVYTTCDLTPSGLPLPFKSPRMMRSAIELIATNWPYWNRSEGADHFFVTPHDFGACFHYQEEKAIGRGILPLLQRATLVQTFGQKNHVCLKDGSITIPPFAPPQKMQAHLIPPDTPRSIFVYFRGLFYDTSNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPKLDSILTSIPTDVILRKQRLLANPSMKQAMLFPQPAQAGDAFHQILNGLARKLPHDDNVFLKAGERVLNWTAGPPGDLKPW

SEQ ID NO: 2975 - DNA, 1638 bp, Panicum virgatum
  misc_feature: Ceres CLONE 1788380
  misc_feature: Encodes the peptide sequence at SEQ ID NO. 2976
gagcaatagagcccctcggctcatctcacctccgaaacctcgcaacgacccccgtgagcgacccaccccatcccatcctccccttcctcgcagttcccaccaaccccggcggcgatgaccggcacggtgtccaagctggcggcgccccggccggcggcggcgctgctcccgccggcgtccctccgctccgccgccctcgccttcgccccctccccgcgccggctccgcgtctccatcgccggccgcgccaggagccccgtcgttgcgatggcttctgccaaggaagggaatggtgctccgaccaagaagaccgcacttcacgatctctatgagctccagggcctatccccatggtacgacaacctctgcaggcctgtcaccgacttgctgccccttattgccagcggtgttcgcggagtcaccagcaaccctacgattttccagaaagccatttcatcgtcaagcgcatatgatgatcaattcaagcagctcatttcagctggaaaggatgcagagagtgcttactgggaactcgttataaaggacatccaagatgcgtgcaaactttttgagcctatctacaacgagacagatggtgctgatgggtatgtctctgtggaggtgtctcctaggttggcaaatgacactcaaggaacagttgaggccgcaaagtggttgcacaaagtggtcaaccgccccaatgtctacataaagatccctgctactgcggaatgtgttccttctatccgggaagtcatctctaatggcattagcgtcaacgtcacacttattttctctattgagagatatgaggctgtgattgatgcttaccttgatgggctagaggcttcgggtttgagtgacttatctcgagttaccagtgttgcgtccttctttgtcagccgagttgacacccttattgataaaatgctcgaaaagattggaacacctgaggcacttgcccttagaggaaaggctgctgtagcacaggcaaaattagcaaatcagctctaccagaagaaattctctggcccgagatgggaaactttggctaagaaaggtgccaagaagcagaggttgttgtgggcatccactggcgtcaagaaccctgcttatcctgacaccctttatgtggacagtctgattggacctgacacggtcaacacgatgcctgaccaagcgttgcatgcattcatagaccacggcactgtttcaaggacagttgatgcgaatgtgtcggaggcagaaggtgtatacagtgccctggagaagcttggcatcgactgggatgaggtggggaagcagcttgagctggaaggagtggactcgttcaagaagagctttgacagcctacttgtgagtctccaggagaagggcaacagcctcaagacggcaagcgtgtaaaactgaaatgatgtggtaccggctggtgaacgattactaaataaaatgctagctcgctggctctccttagttttgtgactctgcggatgctcttgattctgtgaatcagctttgtattctagtcttgcctggctgtcattgtgtaaccaatgttcatggcttgtaactgttatgcgctatccaatgaataatttttgagcaagtttatagagtcaaaaaaaaaaaaaaaaaaaa

SEQ ID NO: 2976 - protein, 429 aa, Panicum virgatum
  misc_feature: Ceres CLONE 1788380
  misc_feature (1)..(340): Pfam Name: Transaldolase Pfam Description: Transaldolase
  misc_feature (75)..(418): SWISSPROT Homolog: EC 2.2.1.2 Transaldolase 2
  misc_feature (75)..(421): SWISSPROT Homolog: EC 2.2.1.2 Transaldolase 1
MTGTVSKLAAPRPAAALLPPASLRSAALAFAPSPRRLRVSIAGRARSPVVAMASAKEGNGAPTKKTALHDLYELQGLSPWYDNLCRPVTDLLPLIASGVRGVTSNPTIFQKAISSSSAYDDQFKQLISAGKDAESAYWELVIKDIQDACKLFEPIYNETDGADGYVSVEVSPRLANDTQGTVEAAKWLHKVVNRPNVYIKIPATAECVPSIREVISNGISVNVTLIFSIERYEAVIDAYLDGLEASGLSDLSRVTSVASFFVSRVDTLIDKMLEKIGTPEALALRGKAAVAQAKLANQLYQKKFSGPRWETLAKKGAKKQRLLWASTGVKNPAYPDTLYVDSLIGPDTVNTMPDQALHAFIDHGTVSRTVDANVSEAEGVYSALEKLGIDWDEVGKQLELEGVDSFKKSFDSLLVSLQEKGNSLKTASV

SEQ ID NO: 2977 - DNA, 1737 bp, Panicum virgatum
  misc_feature: Ceres CLONE 1788390
  misc_feature: Encodes the peptide sequence at SEQ ID NO. 2978
ccagtgtgcctgccccttgttcctatcgcgtggtgcgaccccgggatcccctcgtgctcccctgtccccctccgccgccctgagcggagggaccccgcagatcccatcgaaattcacggccgcatccaggtcggccctcccccggctcccggcggcgaccaattctccccctgttatcgtttctcctacccttcatgatgtttagataatcagcggtgctgggttttagccctgttttgaaatcttaaatcctgctaaggattcagtcttagccgtgaaggatgaatggctcaaatggttcccaagagcatcatgtcaatggagaggagggagtgcatcatgttagccggcccattctgaacaatggaccaaagcaccgtccattgaccctcatgaggcgttgccgtggtgtagcatgtgtagcgattatactgtcaacagcattcttattgatagtctacttggcccctataactacttttgttgtgcggctgttcagcgtgcattacagccgaaaggcgacttccattctgtttggaatttggttatctttatggccattcttgtttgagaagataaacaaaaccaaggttgtcttctctggtgaaaatgtgactccaaaaaggcgtgtattgttatttgctaaccacaggactgaagttgactggatgtacttgtgggatcttgcactgcggaaaggctatttaggatatatcaagtacatacttaagagcagcttgatgaagttacctatttttagctgggcatttcacattttcgagtttatcccggtagaacggaaatgggagattgatgaagcaattatccagaacaaattatcaacatttaagaaccccagagatcctatctggttggcggtttttcctgaaggcacagattatactgagaagaaatgcatcaagagccaagagtacgcttcagagcatggtttacctaagctagaacatgtcctccttccgaagacaaaggggttcatttgttgcttgcaacagctgagatgttccttagatgcagtctacgatgtcacaatcgcatacaagcatcgactgccagattttctggacaacgtttatggcgttgatccctctgaagtccacatccacatcaggacggttcagctctctgacatccccacatcggaggacgaaataactgaatggatgatagagaggttcaggcagaaggaccagctcctgtcagattttctcgcgaagggccacttccctgatgaaggaactgaaggagatctatccacaccgaagtgcctagcaaactttttcaccatagtcggcttgacgggcatctgcctctacctaactctttgctcatctgtgtggttcaaggtatatgtcgtagcgagctgcgcttacctttcctttattacctattactccatactaccaccacaactggtaggctcaccggagggtgccaaaaaggctgtgtagaagatgatgtagcttttgactgaaaactgtatatccgccaaagatgcttactgctggaagtcatggcgtgtgccatcttaaggtttccgttcttctgtaaagcgatgatatgtgtatggagaaattttctggtggttcatcagtgtaggagtaggactattatctcaaggcggtgaaacgcgctgtgagctagagattgaacattgacatgatactggacggagctaattttcatccgcagtttcatcaaaaaaaaaaaaaaaaaaaa

SEQ ID NO: 2978 - protein, 395 aa, Panicum virgatum
  misc_feature: Ceres CLONE 1788390
  misc_feature (1)..(136): Pfam Name: Acyltransferase Pfam Description: Acyltransferase
MNGSNGSQEHHVNGEEGVHHVSRPILNNGPKHRPLTLMRRCRGVACVAIILSTAFLLIVYLAPITTFVVRLFSVHYSRKATSILFGIWLSLWPFLFEKINKTKVVFSGENVTPKRRVLLFANHRTEVDWMYLWDLALRKGYLGYIKYILKSSLMKLPIFSWAFHIFEFIPVERKWEIDEAIIQNKLSTFKNPRDPIWLAVFPEGTDYTEKKCIKSQEYASEHGLPKLEHVLLPKTKGFICCLQQLRCSLDAVYDVTIAYKHRLPDFLDNVYGVDPSEVHIHIRTVQLSDIPTSEDEITEWMIERFRQKDQLLSDFLAKGHFPDEGTEGDLSTPKCLANFFTIVGLTGICLYLTLCSSVWFKVYVVASCAYLSFITYYSILPPQLVGSPEGAKKAV

SEQ ID NO: 2979 - DNA, 1126 bp, Panicum virgatum
  misc_feature: Ceres CLONE 1788392
  misc_feature: Encodes the peptide sequence at SEQ ID NO. 2980
accgatcgaccaaccaccgcactccgaccactgatcgatcattagctctctttcccaagaagaagctctagctagtagatcgagctgctgcgagcaaccatggtggcgcggctgcctccgctggctctgctcgcggcgtccctcgccgtcatggcggccgtcgcgtcggccgactcctggctctacgagaagttcaacacggacggcaccgtccgcgcggactacgacgcgtcgggccagcaggtcgccatgctcaacctcgaccggagctccggcgccgggttcaactccaaggagcagtacctctacggcgagttcagcatccagatgaagctcatccccggcaactccgccggcaccgtctcgtgcttctacctctcttccggtgacagcaacgaccacgacgagatcgacatggagttcatgggcaactcgagcgggcagccggtggtgctcaacaccaacgtgtgggccagcggcgacggcaagaaggagcaccagttcgacctgtggttcgacccggccgccgactaccacacctacaccatcatctggaaccccaccaacatcctcttcaaggtggacggtaacgtcatccgctgcttcaagcgctacgacgacctgccctacccgagctccaggcccatggcgctgcacgccacgctgtgggacggcagctactgggccaccgagaagggcaaggtctccatcgactgggcgggggccccctttgtcgtctcctaccgcggctactccgccaacgcctgcgtcagcggcggcgcgtgccccgccggcagcgaccggtggatgaacaagcagcccgacgccgccgagtggggcaccgtcaagtgggcggagagcaactacctgcgctacaactactgcgaggacgggtggaggttcccacaggggctccccgccgagtgcagccacagctgatcgagctgatgatgattcgtccgccgtcagatctatccattgttaataagctcttgatttgtttcttttaattttgttggatgtccgtatgattcttgatctgtggctgtgaatttgtgattaaaaggaagccccgcatggagcgagagaatactagttttcttgtgaaagaaaaagctttattccg

SEQ ID NO: 2980 - protein, 279 aa, Panicum virgatum
  misc_feature: Ceres CLONE 1788392
  misc_feature (1)..(180): Pfam Name: Glyco_hydro_16 Pfam Description: Glycosyl hydrolases family 16
  misc_feature (8)..(276): SWISSPROT Homolog: EC 2.4.1.207 Xyloglucan endotransglycosylase/hydrolase protein 8 precursor
MVARLPPLALLAASLAVMAAVASADSWLYEKFNTDGTVRADYDASGQQVAMLNLDRSSGAGFNSKEQYLYGEFSIQMKLIPGNSAGTVSCFYLSSGDSNDHDEIDMEFMGNSSGQPVVLNTNVWASGDGKKEHQFDLWFDPAADYHTYTIIWNPTNILFKVDGNVIRCFKRYDDLPYPSSRPMALHATLWDGSYWATEKGKVSIDWAGAPFVVSYRGYSANACVSGGACPAGSDRWMNKQPDAAEWGTVKWAESNYLRYNYCEDGWRFPQGLPAECSHS

SEQ ID NO: 2981 - DNA, 1650 bp, Panicum virgatum
  misc_feature: Ceres CLONE 1788405
  misc_feature: Encodes the peptide sequence at SEQ ID NO. 2982
acagcctggcttggtcacccgcgcgcagccacagcggctactaactggcctacaagaggagcgagcggacaaggcaagcgccacgggtagcgcccccgcccccgcccccgcccccgcccccgccgcagcccagttcagttcacggccccgtgcccgcccgcccagccgctccaagttctttccgtgcccagctcgattccgcgcgccaattccggcggggggccgcgtttcgcggtctcggccatgccggggcacggcagagcggcggcgagggcggggtgggcctttcttgcggtgctgctgccgcttctcgcggcgggggcggcggaggcccccgggaggtaccgcgcggtgttcagcttcggggactcgctggtggacgccggcaacctcgtcaccgacggcatcccggactacctcgccaccgcgcgcctgccctacggccggacctacttcggctaccccaccgggcggtgctccgacggccgcctcgtcgtcgatttcgtcgcgcaagagctcggcctcccgttcctgccgccttccaaggccaggaacgccagcttcgcgcagggcgccaacttcgccatcaccggcgccaccgcgctcgacaccgacttcttccagaagcgcgggctcggcaagaccgtctggaactccggctccctcttcacccaaatccagtggctgcgtgacctcaagccctcgctctgcaactctgcccaagaatgcaaggagttcttcggcaagtgcttgttcatcgtgggtgaatttggcggaaatgactacaacgcgcccctgttcgccggcaaggacctcaaggaggcctacaagctgatgccccatgtgattcagggcatctccgacggaattgaacaattgattgctgaaggggcaaaggatttgattgtgcctggagtgatgccatcggggtgctttccagtgtacctgaccatgtacgctgacccaaaggaagagcatggctcacgcacgggctgcctcaaacgattcaacacattctcgtgggtgcacaatgcgatgctcaagcgcgcgctggagaagctccgtgcgaagcatcctggagtgagggtcatgtatggtgattacttcacgccaatcatccagttcatacttcagccagagaagtttgggttttacaaacaactgccaagagcatgctgtggtgctcccggtaggggtccttacaacttcaatctaacagcaaaatgcggtgagcctggtgcctcagcatgtgccgatcctaagacacattggagctgggatggtatccacttgacagaggcggcatatggacatatcgccagaggttggctgcatggaccgtttggagatgaacctatcgtgcagtcgtcctgagcacacacagttgtccacttctgttgtacctctagagtgtaccaaaatagcacaccaaatcggagctgataagtgataaggtagttgcatatagttgagtgtatatgttttggattccattgcagtcaggtaaaaagagatgagataggggctattaaagcatgatttattcattcatgatggtggtacaagtacagattgtaatgcagaatacagttcaatgcgatacacagatccttgctctgtggtccatgccaaaaaaaaaaaaaaaaaaaa

SEQ ID NO: 2982 - protein, 376 aa, Panicum virgatum
  misc_feature: Ceres CLONE 1788405
  misc_feature (1)..(326): Pfam Name: Lipase_GDSL Pfam Description: GDSL-like Lipase/Acylhydrolase
MPGHGRAAARAGWAFLAVLLPLLAAGAAEAPGRYRAVFSFGDSLVDAGNLVTDGIPDYLATARLPYGRTYFGYPTGRCSDGRLVVDFVAQELGLPFLPPSKARNASFAQGANFAITGATALDTDFFQKRGLGKTVWNSGSLFTQIQWLRDLKPSLCNSAQECKEFFGKCLFIVGEFGGNDYNAPLFAGKDLKEAYKLMPHVIQGISDGIEQLIAEGAKDLIVPGVMPSGCFPVYLTMYADPKEEHGSRTGCLKRFNTFSWVHNAMLKRALEKLRAKHPGVRVMYGDYFTPIIQFILQPEKFGFYKQLPRACCGAPGRGPYNFNLTAKCGEPGASACADPKTHWSWDGIHLTEAAYGHIARGWLHGPFGDEPIVQSS

SEQ ID NO: 2983 - DNA, 1401 bp, Panicum virgatum
  misc_feature: Ceres CLONE 1788431
  misc_feature: Encodes the peptide sequence at SEQ ID NO. 2984
agcaccgggggcgcatgtgggccgcctccccgttcttccgcaggcagctcgtcctgctccgctccctcctcccccagtctcctccaccctccgtcgccggctgccgcttcgcccacctgtcctccccctcgggtacctccggctccctccgggccgcccgcgccatggcggcggcgacggtgtacgaggcggacgcggaggccgtcgtccaccggatcacgccgccgctcgatcgcgccaggcacaagggtcaggcaggaaagatagcagtaattggtggatgtcgcgagtacacaggcgctccatattttgcggctatctctgccttgaaagttggtgcagatctttcacatgttttctgcacaaaagatgctgcaacagtaattaagagttatagccctgaactgattgtacatccgatactggaggaatcatacagtgtaagagatgatgaaagagcatctgtatcttctaaaattctcactgaagttgcaaagtggatggagcgttttgattgcattgtcgttggtcctggccttggaagggactcatttcttctggattgtgtgagtaatattatgaagcatgcaaggcaggctaatattcctactgttgttgatggggatggcctttttcttataaccaataaccttggtcttgttgagggcaaccctcttgccattttaacaccaaatgtatacgagtacaaacgtcttgttcagaaggtccttaactgtgatgtaaatgaggaaactgcttctgagcaactgatggaactttgccaaaaaattggtggtgtgacaataatgcagaaaggaaaggcagatgtcatttgtgacggtaaaacagtgacgcaagtgagtacttttggttccccaaggcgatgtggtggtcaaggggacatcctttctggaagtgtggcagtatttacatcttgggcacagcactttatcttgtcaaatgagcaacctacagagaagagagtcaatcctacgacacttgggtgcatagctggctctctactgctcagaaaagctgcatcgctggcttttgagaagaacaagcgttcaacagtcaccacagacatcatcgagttcttgggcaagagcttggaagatatctgccctgctgaacactagttcttgtcggttcatgtcatgcatgtacagctctagcccctctaataaggttcatccatgcgttttgatccctagatctccttttactctgtacacgtccaataggaatagggtgttaccatgctttgatccaatgtttattgtccactgttgagaagaactgcggtaaaatcatggaatatatgttttctgagaattgaaactgtggaaagactggtagaatgctaaaaaaaaaaaaaaaaaaaaaaaaaaaaaaaaaaaa

SEQ ID NO: 2984 - protein, 374 aa, Panicum virgatum
  misc_feature: Ceres CLONE 1788431
  misc_feature (1)..(281): Pfam Name: Carb_kinase Pfam Description: Carbohydrate kinase
MWAASPFFRRQLVLLRSLLPQSPPPSVAGCRFAHLSSPSGTSGSLRAARAMAAATVYEADAEAVVHRITPPLDRARHKGQAGKIAVIGGCREYTGAPYFAAISALKVGADLSHVFCTKDAATVIKSYSPELIVHPILEESYSVRDDERASVSSKILTEVAKWMERFDCIVVGPGLGRDSFLLDCVSNIMKHARQANIPTVVDGDGLFLITNNLGLVEGNPLAILTPNVYEYKRLVQKVLNCDVNEETASEQLMELCQKIGGVTIMQKGKADVICDGKTVTQVSTFGSPRRCGGQGDILSGSVAVFTSWAQHFILSNEQPTEKRVNPTTLGCIAGSLLLRKAASLAFEKNKRSTVTTDIIEFLGKSLEDICPAEH

SEQ ID NO: 2985 - DNA, 1597 bp, Panicum virgatum
  misc_feature: Ceres CLONE 1788437
  misc_feature: Encodes the peptide sequence at SEQ ID NO. 2986
atggccaacaactatccaatccaacaccgccagcaagctcctcgagaaggaacagcaactacttgtggtcttgtgcagctgctgcgtaagctcaaagcctcctcctgtgagcctgtgatcttgttaattaattagttctggcggcaatggcgtccaccaagctgcagcttgtgttcttggcgccgttcctcgcgctgctcttctcgtccggcgctctcggggccgccgccgcggcgaccaccaataatggcactgccgccgccgtcggcgggtcgtcgtcgctggcgtcggcgcagagcggcgtgttcttcagcctggacagcttcggcgcccgcggcgacgggagccacgacgacgcgcccgcgctggccagggcgtggaaggcggcctgcgcctcgccgcgcccggccgtcctgctcgtccccggcggcggcaagcgctacctgctcagcagcgtcgtcaagctctccgggccgtgcaggtcggccagcgtcacggtcacggtgcagggcacactggtggcgtcgccgaaccgggccgactggagcggcaaggacacgaggcactggatcgtgttccgcgccgtcgatggcctcaccgtcagcggcggcggcgtcatcgacggcaacggcgaggcgtggtggaagaactcgtgcaagatcaacaaggctctgccgtgcaaggaggccccaacggctttgtcgttccactactgcacgagtttgagagtgcaagaactgaagatcgtcaacagccagcaaatccacatgtccattgaggactgcagtaacgtacaagtggcaggcctgtccatcaccgctcctggcacgagccctaacaccgacggcatccacatcacccgcagcaacgatgtgcaggtcaccaactgcaagatcaagactggagacgactgcatctccatcgagaacgggacgcacaatcttcacgtctcgcaggtcgtgtgcggaccggggcacgggatcagcatcggaagcttaggagatgacaactcgagagctgaagtctccggcatcaccatcgactcggtgcagctgtacggcacgaccaacggagcacgcatcaagacctaccagggagggagcgggtacgcccgggacatcgcgttccagaacatggtcatgagcggcgtcaggaacccgatcatcatcgaccagaactactgcgacaaggccaagccgtgccgggagcagggatcatcggcagtcgaggtcagcaacgtggtgttcaggaacatcagggggacgagcaccaccaaggacgccatcaagctgagctgcagcaagaacgccccgtgccatggcatcaccctccagaacattgacctcgagatggagggcggcaatggtgccgcggagagcccctgccagaacgcgaggtggaggaaagccggcacagttcttccacaaccgtgcacctcccagaactagctaggcagcagctagctgcagctgagcagcctctgtagcatgtacaaagtgggtgtactgtgcttcaaagtcaagtatagattcatgtatacatattcttttatatatagaaaagcaacatccaagcggaaaaaaaaaaaaaaaaaaaa

SEQ ID NO: 2986 - protein, 433 aa, Panicum virgatum
  misc_feature: Ceres CLONE 1788437
  misc_feature: Great-hit functional homolog of the protein sequence encoded by LOCUS At2g41850
  misc_feature (1)..(345): Pfam Name: Glyco_hydro_28 Pfam Description: Glycosyl hydrolases family 28
  misc_feature (56)..(432): SWISSPROT Homolog: EC 3.2.1.15 Polygalacturonase precursor
  misc_feature (59)..(431): SWISSPROT Homolog: EC 3.2.1.15 Polygalacturonase-2 precursor
  misc_feature: Useful for making plants with altered cell wall content and/or composition
MASTKLQLVFLAPFLALLFSSGALGAAAAATTNNGTAAAVGGSSSLASAQSGVFFSLDSFGARGDGSHDDAPALARAWKAACASPRPAVLLVPGGGKRYLLSSVVKLSGPCRSASVTVTVQGTLVASPNRADWSGKDTRHWIVFRAVDGLTVSGGGVIDGNGEAWWKNSCKINKALPCKEAPTALSFHYCTSLRVQELKIVNSQQIHMSIEDCSNVQVAGLSITAPGTSPNTDGIHITRSNDVQVTNCKIKTGDDCISIENGTHNLHVSQVVCGPGHGISIGSLGDDNSRAEVSGITIDSVQLYGTTNGARIKTYQGGSGYARDIAFQNMVMSGVRNPIIIDQNYCDKAKPCREQGSSAVEVSNVVFRNIRGTSTTKDAIKLSCSKNAPCHGITLQNIDLEMEGGNGAAESPCQNARWRKAGTVLPQPCTSQN

SEQ ID NO: 2987 - DNA, 1683 bp, Panicum virgatum
  misc_feature: Ceres CLONE 1788438
  misc_feature: Encodes the peptide sequence at SEQ ID NO. 2988
acaaagccctctttctttacgacccccaggcccctgccccccctcctctcgcccattccctctccgccccgttccacctgccgccgccgccgccgccgccgccttcgggaatccagatggcgtccgcggccgcgcacccgacctcgctctccatcgcggcccgcgcggccaccagggccgccgccgccgccaccccgctgcgcagggggggcctctcggcggcgtgccagccggcgcggtcgctggcgttcacggcggccgacgcgcggctcgcggtccacgtcgcgtcgcggtgccgccaggcgtcgtccgcgcgcgggacccgcgccgtggccaccatggccaagaagagcgtcggggacctcacggaggccgacctcaaggggaagcgcgtcttcgtgcgcgccgacctcaacgtgccgctcgacgagaaccagaacatcaccgacgacacccgcatccgcgccgccgtcccgaccatccagtacctcatcggcaagggcgccaaggtcatcctctccagccacttgggtcgccctaagggtgttactcccaagtttagcttagctcccattgtaccacggctgtctgagcttcttggaattcaggtgcaaaaagctgacgattgtattggccctgaagttgagaaattggtgtctgccttgcccaatggtggtgtttgtctcctcgagaacgtaagattttacaaggaagaggagaagaatgacccagagtttgcgcagaagcttgcctcccttgcagatctttatgttaatgatgcatttggaacagcccacagggcacacgcatcaactgagggagttaccaagttcttgaagccttctgctgcagggttccttttgcagaaggagcttgactaccttgttggagctgtttcaagccctaaacgtccatttgctgccatcgtgggtggctcaaaggtgtcatccaagattggggttattgaatccctgttggaaaagtgtgatatccttcttttgggtggtggtatgatcttcacattttacaaggcacaaggactttctgttggttcttcgttggtcgaggaagacaaacttgagcttgcaacatctctgcttgcaaaggcaaaggaaaagggtgtctcccttatgttgccaactgatgttgtcattgctgataagtttgcccctgatgctaacagccagattgttccagcatcttcaattcctgatggttggatggggctggacattggcccagattctattgcttcattcaatgcagccctggacacaacccagacaatcatctggaatgggcccatgggtgtttttgaattcgacaagttcgctgtaggaactgaggctgttgcgaagaagttggcagagcttagcgacaagggtgtcacaaccatcattggaggtggagactctgttgcagctgttgagaaggtgggagttgctgatgttatgagccacatttcaacgggaggtggtgccagcttggaattgttggaaggaaaagagcttcctggagttgttgcgttggatgaagccgtccctgtgactgtatgagttttcaatttgtttctccttcatcttcgtgtaccatgtaaacttgctacactcttgctcgctccttgtcagccactcgaaatgcaagatcaatgctttatagagcgaaaaaaaaaaaaaaaaaaaa

SEQ ID NO: 2988 - protein, 479 aa, Panicum virgatum
  misc_feature: Ceres CLONE 1788438
  misc_feature (1)..(397): Pfam Name: PGK Pfam Description: Phosphoglycerate kinase
  misc_feature (1)..(475): SWISSPROT Homolog: EC 2.7.2.3 Phosphoglycerate kinase, chloroplast precursor
  misc_feature (1)..(479): SWISSPROT Homolog: EC 2.7.2.3 Phosphoglycerate kinase, chloroplast precursor
MASAAAHPTSLSIAARAATRAAAAATPLRRGGLSAACQPARSLAFTAADARLAVHVASRCRQASSARGTRAVATMAKKSVGDLTEADLKGKRVFVRADLNVPLDENQNITDDTRIRAAVPTIQYLIGKGAKVILSSHLGRPKGVTPKFSLAPIVPRLSELLGIQVQKADDCIGPEVEKLVSALPNGGVCLLENVRFYKEEEKNDPEFAQKLASLADLYVNDAFGTAHRAHASTEGVTKFLKPSAAGFLLQKELDYLVGAVSSPKRPFAAIVGGSKVSSKIGVIESLLEKCDILLLGGGMIFTFYKAQGLSVGSSLVEEDKLELATSLLAKAKEKGVSLMLPTDVVIADKFAPDANSQIVPASSIPDGWMGLDIGPDSIASFNAALDTTQTIIWNGPMGVFEFDKFAVGTEAVAKKLAELSDKGVTTIIGGGDSVAAVEKVGVADVMSHISTGGGASLELLEGKELPGVVALDEAVPVTV

SEQ ID NO: 2989 - DNA, 1929 bp, Panicum virgatum
  misc_feature: Ceres CLONE 1788448
  misc_feature: Encodes the peptide sequence at SEQ ID NO. 2990
cttccatctgacccgtccctcaaccaccaccacccgccgccgccgcccgcctgaccgcctccgctcccctcaccaatccacagcgagacgcgcccccgggcgagcccaactccgaagagccgcgatgaggtcgtctctgctgaaatccacgtccgagctcctccgccgcagccgcggctactcctcatcggccaacccggagaggaaggtggccatcctgggcgcggcgggcggcatcgggcagccgctcgcgctcctcatgaagctcaacccgctcgtctcctccctctccctctacgatatcgcggggaccgtcggcgtcgccgccgacgtgtcccacatcaactcccccgcactggttaaggggttcatgggggatgaccagctcggggaggcgctggagggatccgacgtcgttatcatccccgccggggtgcccaggaagcccggcatgaccagggacgacctcttcaacattaacgctggcattgttaaggcgctcagcaccgccatcgccaagcactgccccaacgcacttgtcaatatgatcagcaaccctgtcaactccactgtcccgattgcagcggaggttttcaagaaggctggtacttatgatgagaagaagctgtttggtgtgaccactcttgatgttgttcgtgctaaaaccttttatgctggaaaggcgggcgtgcctgttactgatgtgaatgttcctgttgtcgggggccatgcgggtattactattctgccactcttctcacaggccactcctgcaagcaattcattggcccaagaagacattgtggccctcaccaagagaacacaggatggtggaacggaggttgttgaagcaaaggctggaaagggctctgcaacattgtccatggcatatgctggtgctgtgtttgcagatgcatgcttgaagggtctcaatggagttcctgacattatagagtgctcttatgtgcaatcaactgtgacggagttgccgttcttttccaccaaggtatgcctcggcaagaatggagtggaggaagtgcttggtctgggagagctctccgactttgagaagcaggggctggaaaacctcaagagcgagctcaaggcttccattgagaagggtatcaagttcgcccacgggaactaggcactttgcctggactctttaacaattcatgccaagctgagatctcttgaaatttttgtttgactgtttttttctgcccctcttctgctgggaagtcgaggcgttgtgctccacaataaaaatccagcagcttagttgccaacctgtacaaaagttgtaccagaaacaaccacaccggtcaccggtgccttttgtgctcggccaatggcttggtgagccgtggcggaaatgggaacggacttgccacttgctaaaaaaaaaaaaaaaaaaccgccggcgatggcgagtgcgaacccggcggcggcggcggagggggcggggcagcgggacgagctcgcggagtcgctggccgagctcttctccaacgtctccctcatggtccgcggcgagctccaggggactaacaatcagctagctctgcttgagaagatgaatgaccgcgtagcacaggaatacagcaactatggtgatgttgcttctggtctgcgagtctttgtggagcagctgaacaagaaaagccgaggctttgacgagtacgtatcgcagattgatgctattgatcaacaggtgactgagttcgaggcggtagtgtccatgctcgacaagcatgttgccctcttggaaaagaaagtaaaatctgcctaccacatttcttcttctacccaatgattccgaatccagaactctggttcttttgccagcacttgagcttatccaagaaatgtatattatattccggagatgctgattttccagcattgcaaaaaaaaaaaaaaaaaaaa

SEQ ID NO: 2990 - protein, 340 aa, Panicum virgatum
  misc_feature: Ceres CLONE 1788448
  misc_feature (1)..(166): Pfam Name: Ldh_1_C Pfam Description: lactate/malate dehydrogenase, alpha/beta C-terminal domain
  misc_feature (1)..(340): SWISSPROT Homolog: EC 1.1.1.37 Malate dehydrogenase, mitochondrial precursor
  misc_feature (4)..(338): SWISSPROT Homolog: EC 1.1.1.37 Malate dehydrogenase, mitochondrial precursor
MRSSLLKSTSELLRRSRGYSSSANPERKVAILGAAGGIGQPLALLMKLNPLVSSLSLYDIAGTVGVAADVSHINSPALVKGFMGDDQLGEALEGSDVVIIPAGVPRKPGMTRDDLFNINAGIVKALSTAIAKHCPNALVNMISNPVNSTVPIAAEVFKKAGTYDEKKLFGVTTLDVVRAKTFYAGKAGVPVTDVNVPVVGGHAGITILPLFSQATPASNSLAQEDIVALTKRTQDGGTEVVEAKAGKGSATLSMAYAGAVFADACLKGLNGVPDIIECSYVQSTVTELPFFSTKVCLGKNGVEEVLGLGELSDFEKQGLENLKSELKASIEKGIKFAHGN

SEQ ID NO: 2991 - DNA, 1662 bp, Panicum virgatum
  misc_feature: Ceres CLONE 1788451
  misc_feature: Encodes the peptide sequence at SEQ ID NO. 2992
agcttcactctcactgccgccttcacactactatactagtgctagctagctcttcagctcgtagctagtaacaagcaagcaaggaggcaagcacggcgacaatggccggcgtcgtcgagaatggcagcggcagcatgagcaccgcggagcagcaggagcaggtagcggtgacggtgacgggcagccgcacggtggcgccggccaagagccggtgcgccctggccaccttcgacctcccctacatcaccttctactacaaccagaagttgctcctgtaccgcaccgccgtggacttccccgaagccgtggcgcgcctcacggccgcgctctccgacgcgctccgcgtcttctacccgctcgccggccgcatccggcaggacgccgacggcgcgctcaccgtagagggcgacgagggcgctgaggtcctggaggccgaggccgagggcgtcgccgtggacgagctcgccggaggggactgcggcgagagggtcatgcagcagctggtgccgtacaccggcgtcatgaacctcgaggggctccggcgcccgctgctcgccgtccaggtgaccaagctcaaggacggcctagccgtgggttgcgccttcaaccacgccgtgctggacggcacgtcgacgtggcacttcatgtcgtactgggccgagctgtgccgctgcactggtccattgcagcagccgcagcccatccacgatcgatccctggcccggtccgtccgcgttcggctggagcttcccgagtccgccgaggcccacgagaagaccgaccccaacgggcccaagaaggccctggtggcccgcgtcttctccttcccggcgcccaccgtggcgcgcatcaaggccgccgccaacgccgcgctcccgcccccgcccgccgccaagcccttctccaccttccagtccctgtccgcgcacctctggcgcgccgtctcccgcgcccgcgccctcggccccgccgacctcaccgccttcgccgtcttcgccgactgccgcgcccgcctcgaccccccgctcccgcccgcctacttcggcaacctcatccaggccgtcttcaccggcgtgcccgcggggatgctcctcgccgggccccccgagctggcggcgggcctgctgcagaaggccatcgacgaccacgacgccgccgccgtgtcgcggcggctcgacgagtacgaggccgcgcccaagctcttccactacagcgacgccgggcccaactgcgtcgccgtggggagctccccgcgcttcaaggtctacgacgtcgacttcggattctgcaggcccgagcgcgtgcgcagcggcgccaacaacaagttcgacggcatggtctacctctacccagcccgcgacggcgacggaggcatcgacgtcgagctggcgctgcagccggagccgatgcggaggctccaggaggacgccgacttcctgctagcctagctaccgacctacctacctacgtacctactttattggtaaaattgcattcaattccgcatgtatgttcaaccggtcgtactctaatgaacctgctagtactcgatcttgtgtctttttttttttggtgcgtgtgacttatttgtacgcctactcttgtactactatctcgttattactatatagagtagtacgtacgtactacttattatgtacc

SEQ ID NO: 2992 - protein, 448 aa, Panicum virgatum
  misc_feature: Ceres CLONE 1788451
  misc_feature (3)..(430): Pfam Name: Transferase Pfam Description: Transferase family
MAGVVENGSGSMSTAEQQEQVAVTVTGSRTVAPAKSRCALATFDLPYITFYYNQKLLLYRTAVDFPEAVARLTAALSDALRVFYPLAGRIRQDADGALTVEGDEGAEVLEAEAEGVAVDELAGGDCGERVMQQLVPYTGVMNLEGLRRPLLAVQVTKLKDGLAVGCAFNHAVLDGTSTWHFMSYWAELCRCTGPLQQPQPIHDRSLARSVRVRLELPESAEAHEKTDPNGPKKALVARVFSFPAPTVARIKAAANAALPPPPAAKPFSTFQSLSAHLWRAVSRARALGPADLTAFAVFADCRARLDPPLPPAYFGNLIQAVFTGVPAGMLLAGPPELAAGLLQKAIDDHDAAAVSRRLDEYEAAPKLFHYSDAGPNCVAVGSSPRFKVYDVDFGFCRPERVRSGANNKFDGMVYLYPARDGDGGIDVELALQPEPMRRLQEDADFLLA

SEQ ID NO: 2993 - DNA, 1791 bp, Panicum virgatum
  misc_feature: Ceres CLONE 1788510
  misc_feature: Encodes the peptide sequence at SEQ ID NO. 2994
aaggttcggtgctcgcagtctctgtctctgcatcccctcttcttaacccgcgagcacgcgcggcgccggcgacgccacacgacgccgcccaccaccaccacctagccgccgccgccaccaccgccatgcggctccccgccggcgcacacctcgcgctcctgctcgcccgccgctccctctcctccgcatcctcctccacctccgccgccgccgcttcccacttcccgcgcgcgcgcgcagggatatggagcgatgcggctcgcgcggcgccctctcggacctcgcccttctcgtctccaagcaccgcccacaggttcttccacgggaccaggccagtgtctgcaaggaactactacgatgtacttggcgtcagcaagaatgcaagccaggccgatataaagaaggcgtattacgggcttgcaaagaagcttcatccagacacaaataaaggtgatgtggatgcagaacgtaagtttcaagaggttcaacgagcttatgagactttgaaggatgaggaaaaaagatcattctatgatcaggttggccccgatcaatatgagaaagcttctgctgctggaggcggaactggcaacccatttgagggtggttttggaaatccatttgaggatatttttagtggtggcggcggtggcggaggtggaatgaatgatttctttaggaacattttcagggatagggaatttggaggacgcgatgttaaggttgtgcttgaaatatcatttatgaaagcagttcaagggtgcaccaaaacgatcaacttccaaacttctgtaacatgtgaaacctgcggtggagctggtgtgcctcctggaaccaaacctgaaacatgcgtgacttgcaggggttcaggatttatgttcatgcaaactgggccctttaggatgcaatccacatgcacaaaatgtggtggttctgggaagactgtgcaggatttctgcaagacatgcaaaggaaacaaagttgtgcccggaacgaaatcaattcgccttgatatattgcctggttcggatgacgaggatactataaagttgatgagatcaggtggagcagatccagatggccgtccaggtgatctttatgtgaccctcaaggtccgtgaggatcctgtattccgaagagagaaaggtgatatccatgttgatgctgtcctgaatgtgactcaggcaattttgggagggacagttcaagtcccaactctcagtggagatgttgttataaaggtcaagcctggtactcaacctggtcagaaggtagttctgagaggaaaaggtatcaagacaagaaactcatcatactacggagatcaatatgtccatttcaatgtcaacatccctgtgaatttgacaccgagacagcgggtgctaatcgaggaatttgcaaaggaagagcaaggcgaagaagagaaggacgcgaaggctgctagtgcatcaggatagccaattttaggagccatccacatttcaatagcgccttagctgatcttatatcatgaggtagaatagtctgctgcctgaaattctcagggggcaagatatagttggtagcgtggaatttccactgcaacatatagatctttgtttgagattttgtagctggaataatgctagaccaccctgcccgatgtgtgtaatcctaagcttaacaccagcaagacgtgcagggtcttttgtataattttgcggatcatgtattataacacacggtaccgatgccaattcatgtctcctgttgaggttgaggtttttaagataaaaaaaaaaaaaaaaaaaa

SEQ ID NO: 2994 - protein, 443 aa, Panicum virgatum
  misc_feature: Ceres CLONE 1788510
  misc_feature (1)..(63): Pfam Name: DnaJ Pfam Description: DnaJ domain
  misc_feature (1)..(81): Pfam Name: DnaJ_CXXCXGXG Pfam Description: DnaJ central domain (4 repeats)
  misc_feature (1)..(122): Pfam Name: DnaJ_C Pfam Description: DnaJ C terminal region
MRLPAGAHLALLLARRSLSSASSSTSAAAASHFPRARAGIWSDAARAAPSRTSPFSSPSTAHRFFHGTRPVSARNYYDVLGVSKNASQADIKKAYYGLAKKLHPDTNKGDVDAERKFQEVQRAYETLKDEEKRSFYDQVGPDQYEKASAAGGGTGNPFEGGFGNPFEDIFSGGGGGGGGMNDFFRNIFRDREFGGRDVKVVLEISFMKAVQGCTKTINFQTSVTCETCGGAGVPPGTKPETCVTCRGSGFMFMQTGPFRMQSTCTKCGGSGKTVQDFCKTCKGNKVVPGTKSIRLDILPGSDDEDTIKLMRSGGADPDGRPGDLYVTLKVREDPVFRREKGDIHVDAVLNVTQAILGGTVQVPTLSGDVVIKVKPGTQPGQKVVLRGKGIKTRNSSYYGDQYVHFNVNIPVNLTPRQRVLIEEFAKEEQGEEEKDAKAASASG

SEQ ID NO: 2995 - DNA, 1584 bp, Panicum virgatum
  misc_feature: Ceres CLONE 1788519
  misc_feature: Encodes the peptide sequence at SEQ ID NO. 2996
acgcacacacgatcgatcttcgccttcttcaatcctgaagttctaatatcattcgccatcaatcttctgaagttctttgatctgaagctctccatggccgacaatgagggccgccgccaccatttcctgctcgtgagctacggcttccagagccacatcaacccggggcgcgtcctcgcccaccgcctcgcgcggctcggcggcgccgacggctccatctcggccacgctctccgtgccggtcgccacctaccgatccatgttcccttcgccggacgccgaggccgcggcggcggaggaggagaccaccaacgacggcgtcatctcgtacgtcccctactccgacggcgtcgacgacggctccatgcccagggacgccgccgacagggcggtgcggcgccgcgcgacctccgcgagcctctccgccgtcgtcgctcgcctcgccggccgcgggcagccggtgacgtgcatcatgtgcacggtggtgtccctcccggttctcgacgtcgcacgggagcacagcatccccgtcgccgtttactggatccagacggcgactcttcttgccatcaactaccactacttcgtccatggctacagcgaggtcatcgtcccccacgccgccgaccctgcccacgaggtgcgcctgcccggtctgagccgtcctcttcagataagcaacatcccgtcctacctgatcgacatgtcaggcagcgagagcgctaaggccttcatcgaggtgttccaagagttcttccagtacatagtccagttgcagcctaaggtgcttgtgaccacactagacgagctggagccgagcgcggtcgcggagatgaagcgacacctggaagtgttcaccattggtcccatggttgggagctcaacggagacgcgcatccacttgttcaagcatgacagcagcgacaagaagaggtacatggagtggcttcagggtcacccggagaagtccgtggtgtacgtgtcgtttgggagcctatcaaagtacaccaaacttcagatggaggagatcgtcggagggctgcggcaatgtgggaggccgtacttgctggttgtgcgcagggacgggctcgtggacgacgatgatgaaagcggcagcttggagaagaacaaccaaagtcagggcatggttgtggattggtgcagccaattggaggttttatcgcaccctgcaatagggtgcttcgtctcgcactgcggatggaactcgacaatggaggccatgttgtccggcgtgccgataatcggtgcgccgaacatgtttgaccaaccaacgaatgtattcttcattgaggaggagtgggaggttggcatcagagccgagagcaacaatgatggtgtgttgatgggaacagagttggcgaggtgtgttgagctggtcatgggtgaaggtgcaaaagcaatggcgataagggaaaaggcaaaggccttgaaagaggtagcgcaagcagcagcaggtataggcggggctgctgagagaaaccttcatgactttgtcaaagcaataccatgtcggaatcaataataaagccatggccgtgtttggtaaaaaaaaaaaaaaaaaaaa

SEQ ID NO: 2996 - protein, 482 aa, Panicum virgatum
  misc_feature: Ceres CLONE 1788519
  misc_feature (5)..(140): Pfam Name: UDPGT Pfam Description: UDP-glucoronosyl and UDP-glucosyl transferase
MADNEGRRHHFLLVSYGFQSHINPGRVLAHRLARLGGADGSISATLSVPVATYRSMFPSPDAEAAAAEEETTNDGVISYVPYSDGVDDGSMPRDAADRAVRRRATSASLSAVVARLAGRGQPVTCIMCTVVSLPVLDVAREHSIPVAVYWIQTATLLAINYHYFVHGYSEVIVPHAADPAHEVRLPGLSRPLQISNIPSYLIDMSGSESAKAFIEVFQEFFQYIVQLQPKVLVTTLDELEPSAVAEMKRHLEVFTIGPMVGSSTETRIHLFKHDSSDKKRYMEWLQGHPEKSVVYVSFGSLSKYTKLQMEEIVGGLRQCGRPYLLVVRRDGLVDDDDESGSLEKNNQSQGMVVDWCSQLEVLSHPAIGCFVSHCGWNSTMEAMLSGVPIIGAPNMFDQPTNVFFIEEEWEVGIRAESNNDGVLMGTELARCVELVMGEGAKAMAIREKAKALKEVAQAAAGIGGAAERNLHDFVKAIPCRNQ

SEQ ID NO: 2997 - DNA, 1793 bp, Panicum virgatum
  misc_feature: Ceres CLONE 1788530
  misc_feature: Encodes the peptide sequence at SEQ ID NO. 2998
gtagtaaactggaagtctgggatcaccaaatggactgtgtcctcctgagctctcacttgacatctcataattttgttaacacaaggtttcagcaaggctttagtggtctcaacagtataggatttgcagtcataagaaaggaatgcttaaaattaaggtgctatgctcttggtgatgaacttggtggttcagggcaagtaaatcaaccatttaacaaaagcaataatggacctattttccaaggactcaatgcatcaggtgcttcttttcgaactgttggtgcggaaatcacgcaggaaacaggagatttcttcgtgagtgatgcagagggtgacccggacaaacctaccgatggtttctcttcaatagaccagtttgtcattgctgtagatgatgaaaacggtgataacgaaggggatcttgtcatggcagccactctagtgaacccggagtcaattgcattcatgatcaggaatggttctggaattatctcagtaggcataaaagaagaggatttaacaagattgatgattcctatgatgtccccaatcacagagatcgaagacatttcaactgctgctgccacagtaacagtggatgccagagtgggtatagctactggtgtctccgctgcagatagagcaaaaaccatccttactctagcctcccctgattcaaagcccagtgatctcagacgaccgggccatatattccccctcaaataccgaaatggaggcgtgctgaaaagagctgggcatacagaagcatcagttgatcttgtcgcattggcgggtttgcgtcctgtatctgtcctgtccacggtcatggacccaaaggatggttcaatggcaggcataacggtcctgcaacagatggctatggaacacgatataccgattgtttcaatcactgatctcatccggtatagaagaaagcgggagaagctggtggagctgattgcggtgtctcgcttgccaacgaaatggggcctcttccgggcttactgctaccaatccaagctcgatggaactgagcacattgctgttgtgaagggtgatatcggcaacggtgaagacgtcctcgtgagggtgcactcggaatgcctgacgggcgacatcctcggctctgcccgctgcgactgcggcaaccagctggacctggcgctggagctcatcgagaaggctggccgtggcgtgctcgtgtacctccgcggccacgagggccgcggcattggcctgggccagaagctccgcgcctacaacctgcaggacgaggggcacgacaccgtcgaggcgaacgtcgagctcggcctcgccgtcgacgcgcgcgagtacggcatcggcgcccagatactccgtgacatcggcgtgcgcacgatgcggctgatgaccaacaacccggccaagttcatcgggctcaagggctacggcctcgccgtggtggggagggtgccggtgatgtccccgatcaccaaggagaaccagaagtacctcgagacgaaacggaccaagatggggcacgtctacggctccgacctccctggcagcctgccggagttcgccaatccgcaagacaccgccgctgacaaagaagacgatatccaaaactgataccgatacgattacaaataacaaattctcgtttctttttggttgttcgttccaaaccatgatcgggattgagaacgatatttttatttttgaaagagaagaattgtgcttacattgcaatttgcgagcaataaattgagaacgagaattgcagagtattatcaaaaaaaaaaaaaaaaaaaa

SEQ ID NO: 2998 - protein, 526 aa, Panicum virgatum
  misc_feature: Ceres CLONE 1788530
  misc_feature (1)..(170): Pfam Name: GTP_cyclohydro2 Pfam Description: GTP cyclohydrolase II
  misc_feature (12)..(199): Pfam Name: DHBP_synthase Pfam Description: 3,4-dihydroxy-2-butanone 4-phosphate synthase
  misc_feature (117)..(510): SWISSPROT Homolog: EC 3.5.4.25 Riboflavin biosynthesis protein ribAB [ Includes: GTP cyclohydrolase-2
  misc_feature (73)..(509): SWISSPROT Homolog: EC 3.5.4.25 Riboflavin biosynthesis protein ribAB, chloroplast precursor [Includes: GTP cyclohydrolase-2
MDCVLLSSHLTSHNFVNTRFQQGFSGLNSIGFAVIRKECLKLRCYALGDELGGSGQVNQPFNKSNNGPIFQGLNASGASFRTVGAEITQETGDFFVSDAEGDPDKPTDGFSSIDQFVIAVDDENGDNEGDLVMAATLVNPESIAFMIRNGSGIISVGIKEEDLTRLMIPMMSPITEIEDISTAAATVTVDARVGIATGVSAADRAKTILTLASPDSKPSDLRRPGHIFPLKYRNGGVLKRAGHTEASVDLVALAGLRPVSVLSTVMDPKDGSMAGITVLQQMAMEHDIPIVSITDLIRYRRKREKLVELIAVSRLPTKWGLFRAYCYQSKLDGTEHIAVVKGDIGNGEDVLVRVHSECLTGDILGSARCDCGNQLDLALELIEKAGRGVLVYLRGHEGRGIGLGQKLRAYNLQDEGHDTVEANVELGLAVDAREYGIGAQILRDIGVRTMRLMTNNPAKFIGLKGYGLAVVGRVPVMSPITKENQKYLETKRTKMGHVYGSDLPGSLPEFANPQDTAADKEDDIQN

SEQ ID NO: 2999 - DNA, 1959 bp, Panicum virgatum
  misc_feature: Ceres CLONE 1788545
  misc_feature: Encodes the peptide sequence at SEQ ID NO. 3000
atttcctccccgccccaaattcccccaaatcgatctccctccgcaccccgaatccccacgccatcgcgccggaatccggcgcgccccgccccgatccgtccgatccgagccgaatcgccgccgctcggggcggaacccttgcctgatcttgaacccccgccgatgggcgccggccgtgtctgccgcggcggcccgtcctcctcccccgccggggccaccgcggggcggccgttcccgccgctcgccgcatcctcctcctccgcctccccttcctcggccccctccgagacggcgtccacgtcggtcaccaagaccgtcaacgggtcgcaccacttcaagattgccggctactccctctccaaggggatcggggtggggaagtacatcgcctccgagtccttctccgtggggggattcgactgggcgatctacttctaccccgacgggaagagcgcggaggacggcgccgcctacgtctcgctcttcatagccctcgccagcgagggcacggatgtgcgcgcgctcttcgagctcacgctcgtcgatcagagcggcaaggggcaagacaaggtgcacacccactttgggaggtcgctcgagagcggcccttacaccctcaagtaccgcggaagcatgtggggctacaaacgtttcttcaaacggtctgccctagaaacatcagactatcttaaagatgattgccttttagtgaactgcactgttggtgttgtgcaatcacatactgaaggaccaaagatatacacaatacctgtaccgccatccaacatgtctcaacatattggtcagctactgacaggtggaaagagaaccaacattacatttgaagttgatggcgagatgtttcctgcccacaaggttgttctttcggctcggtctccagtttttagggcacaactttttggtcctatgaaggataagaatatgaagtgcattaagattgaaaacatggaggctccagtattcaaggctttgctccatttcatgtactgggatgagttaccggatattgaagaacttactggtgtaaatacaacttgggtatccaccttgatggctcagcatttgcttgctgctgcggaccgttatgcattggagagattaaagttgctctgtgaacttaagctgtgtgaagatgttgcaataaacacagttgcgaacactttggcgctggctgaacagcaccactgttatcagctaaaaactgtttgcttgaaattcgtagctctgcctgagaatttgaaagctgtcatgcaaaccgatgggtttgattatttgcagcaaagctgcccgtcccttatgaccgagcttcttgagtatgtggccaaggtaggagagcactctgtcactccctgcttgtattcaactgaagtccttgatggtggcgatgccaatggaagacgtgtgaaaccaagaatctaacggctgcccagatgagcctagaagaggagatccttgtgtcttttttcattgtaaagtgttttcctatatcgggtgcttttgtggtgccatatcatgaatgttgtagcgtttgtttgtgtgtgttgtgacttccaccctttcttcctagcccaattgctgcaactgtggagcgagttatggctaatatatatcctactgactagtgtactccaattgtattgctgcgaagcatggttgcgtcgcagcctgtggtcataagtgcaaacaggtggtacggcaaaggtgcttttgcgcaaggtttgatcaagtggggatgacggcaaaggtttgatcaagtggggatgacggcaaaggtttgatcaagtggggatgacagcgcagaatgttcattttaccaagttttcaccttgtgctaggccagatttgtcgattcgtagtcatctgtatttgactattcaattgaaatgatgaaatgcaatgaaatatgtatctgtggtcgaaaaaaaaaaaaaaaaaaaa

SEQ ID NO: 3000 - protein, 425 aa, Panicum virgatum
  misc_feature: Ceres CLONE 1788545
  misc_feature: Great-hit functional homolog of the protein sequence given in SEQ ID NO 9216
  misc_feature: Useful for making plants with modulated biomass
  misc_feature: The plant is abnormally small.
MGAGRVCRGGPSSSPAGATAGRPFPPLAASSSSASPSSAPSETASTSVTKTVNGSHHFKIAGYSLSKGIGVGKYIASESFSVGGFDWAIYFYPDGKSAEDGAAYVSLFIALASEGTDVRALFELTLVDQSGKGQDKVHTHFGRSLESGPYTLKYRGSMWGYKRFFKRSALETSDYLKDDCLLVNCTVGVVQSHTEGPKIYTIPVPPSNMSQHIGQLLTGGKRTNITFEVDGEMFPAHKVVLSARSPVFRAQLFGPMKDKNMKCIKIENMEAPVFKALLHFMYWDELPDIEELTGVNTTWVSTLMAQHLLAAADRYALERLKLLCELKLCEDVAINTVANTLALAEQHHCYQLKTVCLKFVALPENLKAVMQTDGFDYLQQSCPSLMTELLEYVAKVGEHSVTPCLYSTEVLDGGDANGRRVKPRI

SEQ ID NO: 3001 - DNA, 1795 bp, Panicum virgatum
  misc_feature: Ceres CLONE 1788557
  misc_feature: Encodes the peptide sequence at SEQ ID NO. 3002
aacaaaaccccgcgagatctgcgcagcaatggcgccgccgcggcacctcctgctcctcctcctcgccctcgccgccgcggccgcggccgccgaggaggggccccgcgggcgccgcctgctggtcctcctggacgacctggccgtgcggtcctcgcactcggccttcttcggctcgctccaggcgcgcggcttcgatctcgacttccgcctcgccgacgaccccaagctctcgctccaccgctacggccagtacctctacgacggcctcgtgctcttcgccccctccaccccgcgttttggtgggtcggtggaccagaatgcagttctcgagtttatcgatgctggccatgatatgatcctggcggctgattcatctgccactgatcttatccgtggcattgcgacggagtgtggggttgattttgatgaggatccagaggcaatggttattgaccacatcaattatgctgtcacggatgttgatggtgatcacaccttgattgccggtgatgatctcatccagtcggatgtgatacttgggtccaaaaagattgaggctcctgtattgtttcgaggaattggacacacagctaatccatcaaacagcttggttctgaaagtcctatctgcctctccatcagcatattcagcaaacccaaagactaagttggcatctcctccatctctcactggatcagctatatcactggtttctgttatgcaggcaagaaataacgctcgggtgctgatatccggatcactcgatctgtttagcaaccggttcctaaagtctggtgttcaaaaagctggtagcaagaagaggcatgacagagctggaaatgagcaatttgtgtcagagacaagcaaatgggttttccatgagaggggccatctaaaggcaattaatgtcaagcatcacaaggttggggagacaaatgagcctggcatgtaccgcattaatgatgacctggaatactctgttgagatctataaatggtctggaacaagctggaagccatatattgctgatgatgttcaacttcagtttttcatgatgagtccttatgttttgaaaactatgtcgactgacaagaagggtttatattcaacgtcattcaaagttcctgatgtttatggagttttccagttcaaagttgagtaccaaaggctgggatatactggtctgtcttttacaaagcagattccagtacgcccttacaggcacaatgagtatgagagattcataacatcagcatacccatactacactgcctcattttcaaccatgggagctttcttcatattctcgtttgtgtacctgtaccacaaatagagagcccactggatgctgacgcgaccttgatccgcggcaccaatcgggtgctaagagccaagtgttacccagtgcaatttttatggaaccatatttttgtagtgccaacttagagccgtcgtgctcatgaaaagcttgttcgtgctaggatgtttgatcccctctttttccttgactgtttctgatcagcacttgtgaaaacttttacagcctatatagaattgaaatgacgacaaagatgtagcgagtctgaaagtactccatgccccgattgtttggctcttgctctgatccgagttgtgtattgtgtccccggacgtggaatagttagtttgtgcttgtgagcttgtactgttattcttgctcctgaattatacgcgggatgtggaaaacttagatcccactaagattaaattggaatgttatctcaaattcttggtccaaaaaaaaaaaaaaaaaaaa

SEQ ID NO: 3002 - protein, 434 aa, Panicum virgatum
  misc_feature: Ceres CLONE 1788557
  misc_feature (6)..(435): Pfam Name: DDOST_48kD Pfam Description: Dolichyl- diphosphooligosaccharide-protein glycosyltransferase 48kD subunit
MAPPRHLLLLLLALAAAAAAAEEGPRGRRLLVLLDDLAVRSSHSAFFGSLQARGFDLDFRLADDPKLSLHRYGQYLYDGLVLFAPSTPRFGGSVDQNAVLEFIDAGHDMILAADSSATDLIRGIATECGVDFDEDPEAMVIDHINYAVTDVDGDHTLIAGDDLIQSDVILGSKKIEAPVLFRGIGHTANPSNSLVLKVLSASPSAYSANPKTKLASPPSLTGSAISLVSVMQARNNARVLISGSLDLFSNRFLKSGVQKAGSKKRHDRAGNEQFVSETSKWVFHERGHLKAINVKHHKVGETNEPGMYRINDDLEYSVEIYKWSGTSWKPYIADDVQLQFFMMSPYVLKTMSTDKKGLYSTSFKVPDVYGVFQFKVEYQRLGYTGLSFTKQIPVRPYRHNEYERFITSAYPYYTASFSTMGAFFIFSFVYLYHK

SEQ ID NO: 3003 - DNA, 1558 bp, Panicum virgatum
  misc_feature: Ceres CLONE 1788581
  misc_feature: Encodes the peptide sequence at SEQ ID NO. 3004
actgatcaagcggcagacttagcctctcagcccatcgatccgccacctagctagctctcctagcagaaatggcggtggagatcctcgagtcctgcatggtgacgcccggcgaggcggcgacgcccaagcatggcgtgtggctctccaacctcgacctcctcgtggccaggagccacacgcccaccgtctacgtctaccggcccagccccggcccggccttcttctcgccggacgtcctcaaggccgccctgtccaaggcgctcgtccccttctaccccctcgccggccggctcgctcgggacggcgctggccgcccggagatccactgcaccggcgacggcgcgctcttcgtcaccgcgcgcgccgacgctacgctccaagatctcggcggcttcgtcccgtcggacgagctgcgccggatgcttgtcccctcggtcgacggcggcgacgaccgcgccggcattctggccatgttccaggtgacgttctttaagtgcggcggcgtgtgcgtcggcgcggcgatccaccacacggcggcggacggcctcgcggcgctggacttcgtgaacacctgggccgccatcgcgcgaggcgtcggcgaggcggcgccgcgcccgtggctggaccgcacgctcctccgcgcccgctcccctcccgccgtgcggttcgagcacgccgagtactcccggcgcggcggaggcggttcgaaggcgggcaaggtccagttcgactccgccatcctgcccgtgtccaaggcccagatcgacgcgctcaaggccggcaagaagcagtcgacgttcaaggccgtggtcgcctacgtgtggcggtgcgcgtgcaaggcgcgggggctcgcggcgacggaggacacccgcctgtacatgaccgccgacgcgcgctcccgcgtccgcccgccgctgccggccggctacctcggcaacgccatcttccgcgcgtcgacggtggccaaggtgggcgatgtggtctcggagcctctggacgccgccgcggacaggatctccggcgccaccgcccggctggacgacgagtacatccggtcgctggtggactacctggaccaggtggtgagcgacgcggcggggctgcgcaagggggagtgggtgatgccggagaccgacctgtgggtgataagctggcaggggctgccgatctacgacgcggacttcggctggggccggccggcgttcatgagccgggcgtgcctccaattcagcggcctcgtgtacctcgtccccggccccgacggcgacggacggctcgacgttgtcgtggccatggagcccaagagcttatcccggttcaaggagctgctctacgaggagctcaagtagcactgtagcagactctcgagatgcagcgctccctccgcgctcgcctggaggagcctgcttgcccctgtcgtgctctcgtatctgctggaccaggccttttccttgcattgcatttctgtattgtattttgtactgctagtttgtagagaaaattccctgaatgccaataaaaatgcaactattctttgcaaaaaaaaaaaaaaaaaaaa

SEQ ID NO: 3004 - protein, 426 aa, Panicum virgatum
  misc_feature: Ceres CLONE 1788581
  misc_feature (1)..(442): Pfam Name: Transferase Pfam Description: Transferase family
MAVEILESCMVTPGEAATPKHGVWLSNLDLLVARSHTPTVYVYRPSPGPAFFSPDVLKAALSKALVPFYPLAGRLARDGAGRPEIHCTGDGALFVTARADATLQDLGGFVPSDELRRMLVPSVDGGDDRAGILAMFQVTFFKCGGVCVGAAIHHTAADGLAALDFVNTWAAIARGVGEAAPRPWLDRTLLRARSPPAVRFEHAEYSRRGGGGSKAGKVQFDSAILPVSKAQIDALKAGKKQSTFKAVVAYVWRCACKARGLAATEDTRLYMTADARSRVRPPLPAGYLGNAIFRASTVAKVGDVVSEPLDAAADRISGATARLDDEYIRSLVDYLDQVVSDAAGLRKGEWVMPETDLWVISWQGLPIYDADFGWGRPAFMSRACLQFSGLVYLVPGPDGDGRLDVVVAMEPKSLSRFKELLYEELK

SEQ ID NO: 3005 - DNA, 1878 bp, Panicum virgatum
  misc_feature: Ceres CLONE 1788587
  misc_feature: Encodes the peptide sequence at SEQ ID NO. 3006
tcctattgccaccgctttcccttctccttccgcctctactaccccttaatctcatctctttcctcttgctgcccccattagcccccctcttttgcttccgccactccatgtctcaatcctccccattcttctccatcgcccgagcacatgctggagcaggagggtggactgcggcagccgctcttctgctccgtcagcccgttgctcagctgccacctattcaaagcctgaggtgtttctcttcggctagagtgacagatgccaagacactgcgatcacacctgagtctccctcgtgcctcactatcctcctttgctgatgctgatgatggctctggcacaaaagctggtgatgcagaggcaagggagaagcgaaatggggaaagcgagatgtcagagatggccaaggcattccatatcccgccacggatggcgatgtcaatctccgtgatgattgcattcgctgccctcaccatgccgctggcgatgcggtcactggtctgtcatgggaccttcaagatgagcgtgctggcatatctgacgcttctgtcagggttctatatggcatggaatattggggccaacgatgttgcaaatgccatggggacgtcagtgggatctggggctttgacactacggcaggcggtgctgactgcaacggtgctagagttctccggcgcattccttatgggcacccatgtcaccagcaccatgcagaagggcatactggttgcgtctgtgttccaaggaaaggactctctgctctttgccggattgctatcctcccttgctgctgctggcacatggctccaggttgcttcgtcatatggctggcctgtctcaactacacattgtattgttggggccatggttggtttcgggctggtatatggaggggtgaatgcagttttctggagctccttggctagagtatcttcatcttgggtcatttctcccttgatgggtgcagcagtatcttttcttgtttacaagtgcatacgcaggtttgtatacagtgcaccaaatccaggccaagctgctgctgctgctgcaccaattgcagtgtttacaggtgtcactgcaatctcgtttgttgcttttcctctcagtaaagtctttcccattgctctcctgcaagcattatcctgtggggcagtaggagccatcattgttacccgagtgatacaaaaacagctaggtgagttgctgtcttcggaagcagaaaagatagaatctgctgagaaggcagatgttcagcaggttggatttctttcagacattgctggccctacaggagctcaattgcagatcgtgtatggtgtatttggttacatgcaagtcttatcagcatgcttcatgtcatttgctcacggaggcaatgatgtctccaatgccatagggcccctggctgcagctctgtccattcttcaaggtgtggcaagcagtgctgagatagttatacctactgaagttcttgcttggggtgggtttggaattgttgcaggtcttgcaatgtggggatatagggtgatagcaacaattggcaagaaaatcacagaactgacaccaaccaggggcttcgcggcagagtttgcagcagcttcagtggtcttgtttgcatcaaagcttggtttgccaatttctgccacacatacacttgttggagcagtgatgggtgtcggatttgcaagagggctcaacagagtcagagcagagacagttcgcgaaattgtggcctcctggttggtcacaattccagttggtgctgtgctatgtatcttctacacaatgatcctaaccaagattctggcatactttatgtgagtggattgtgaaatataagaactcatttaagcgacaaaaaaaaaaaaaaaaaaaa

SEQ ID NO: 3006 - protein, 571 aa, Panicum virgatum
  misc_feature: Ceres CLONE 1788587
  misc_feature: Great-hit functional homolog of the protein sequence given in SEQ ID NO 9558
  misc_feature: Useful for making plants with modulated phosphate use efficiency
MSQSSPFFSIARAHAGAGGWTAAAALLLRQPVAQLPPIQSLRCFSSARVTDAKTLRSHLSLPRASLSSFADADDGSGTKAGDAEAREKRNGESEMSEMAKAFHIPPRMAMSISVMIAFAALTMPLAMRSLVCHGTFKMSVLAYLTLLSGFYMAWNIGANDVANAMGTSVGSGALTLRQAVLTATVLEFSGAFLMGTHVTSTMQKGILVASVFQGKDSLLFAGLLSSLAAAGTWLQVASSYGWPVSTTHCIVGAMVGFGLVYGGVNAVFWSSLARVSSSWVISPLMGAAVSFLVYKCIRRFVYSAPNPGQAAAAAAPIAVFTGVTAISFVAFPLSKVFPIALLQALSCGAVGAIIVTRVIQKQLGELLSSEAEKIESAEKADVQQVGFLSDIAGPTGAQLQIVYGVFGYMQVLSACFMSFAHGGNDVSNAIGPLAAALSILQGVASSAEIVIPTEVLAWGGFGIVAGLAMWGYRVIATIGKKITELTPTRGFAAEFAAASVVLFASKLGLPISATHTLVGAVMGVGFARGLNRVRAETVREIVASWLVTIPVGAVLCIFYTMILTKILAYFM

SEQ ID NO: 3007 - DNA, 1637 bp, Panicum virgatum
  misc_feature: Ceres CLONE 1788592
  misc_feature: Encodes the peptide sequence at SEQ ID NO. 3008
attccagcttagctgagagagcaagcacggggagatcagccggcagcgtctgacatggcggcgctgtggctggcgaaagcatcgtcccagctggcgcgccgcgccgccaggaggctcccgccgcttccttcgcgccacggcggcgagaccagcccgtggctcttgggctcatcggccgcagcgccgccgccggttcttggatcaccaccactgccaccgctggagagaatcgtccgccggggcttctgctccgtccggcgcttcgccggggagagcagcgccgccgccgccgccgccgccgctgacgaggaggggccggagaacgggttcgccggcggcgatcaggccattgacttccctggagggaaggtttcatttgtagctgaaatgaacttccttccggagtcacatggggaaaggatcagctgttatcgtgttcttgacgatgatggcagaacaatatctggtagtagattccgagaggtcaataaggaggtggctctgaaaatgtacagggagatggtcaccctccagatcatggataacatcttctatgaagcgcagaggcagggtagaatctcattttatctcacttccaatggcgaggaagcgatcaacatagcatctgctgctgcacttagtattgacgacattgtgctgcctcagtacagggaaccaggtgttcttctgtggcgcagtttcacactgcaagagtttgcaaaccaatgctttgggaacagtatggattatggtaaaggaaggcaaatgccaattcactatggatcaaaccgtcttaactatttcacagtctcatcgcctatttcaacacagctcccacctgctgttggagctgcctactctctgaagatggataaaaaggatgcatgtgccatcacatacttcggcgatggaggcacaagtgagggagacttccatgccgcgctcaactttgcagctgttatggaggcaccagtggtcttcttctgccgcaacaatggctgggcaatcagcaccccaaccactgaacagttcagaagtgatggagtggctatccgtggccaggcttatgggatccgtggtatcagagtagatggaaatgatgctcttgctgtttacagtgcagtccatgctgcccgagaaatggctatagctgaagggagaccaattttaattgaggccctgacttacagagtcggccatcactcaacatctgatgattcaaccaagtacaggccagttgatgagattgagcattggcgaacagcaagggatccaatttccagatacagaaaatgggttcaggggaacgactggtggtctgatgctgaagaatctgaactaaggagcagagtgagaaaagagcttcttcaagccattcaggttgcagaaagaatgccaaaaccaccaattgctgagcttttcactgatgtttatgatcagatcccttccaacctgcgagaacaagagcgattgctgcgggagacaatcatgaagcaccctgcagactacccaactgatgtacctgtttaggtttcaggatttagatgagcaacatcgttgtgtaagtattgatgattcagatccatagcattataagcaatatatgattcagccagcaaaaaaaaaaaaaaaaaaaa

SEQ ID NO: 3008 - protein, 491 aa, Panicum virgatum
  misc_feature: Ceres CLONE 1788592
  misc_feature (1)..(301): Pfam Name: E1_dh Pfam Description: Dehydrogenase E1 component
MAALWLAKASSQLARRAARRLPPLPSRHGGETSPWLLGSSAAAPPPVLGSPPLPPLERIVRRGFCSVRRFAGESSAAAAAAAADEEGPENGFAGGDQAIDFPGGKVSFVAEMNFLPESHGERISCYRVLDDDGRTISGSRFREVNKEVALKMYREMVTLQIMDNIFYEAQRQGRISFYLTSNGEEAINIASAAALSIDDIVLPQYREPGVLLWRSFTLQEFANQCFGNSMDYGKGRQMPIHYGSNRLNYFTVSSPISTQLPPAVGAAYSLKMDKKDACAITYFGDGGTSEGDFHAALNFAAVMEAPVVFFCRNNGWAISTPTTEQFRSDGVAIRGQAYGIRGIRVDGNDALAVYSAVHAAREMAIAEGRPILIEALTYRVGHHSTSDDSTKYRPVDEIEHWRTARDPISRYRKWVQGNDWWSDAEESELRSRVRKELLQAIQVAERMPKPPIAELFTDVYDQIPSNLREQERLLRETIMKHPADYPTDVPV

SEQ ID NO: 3009 - DNA, 1894 bp, Panicum virgatum
  misc_feature: Ceres CLONE 1788595
  misc_feature: Encodes the peptide sequence at SEQ ID NO. 3010
aactgcaagccaagcgaccacacttactcccaagtcacaagctctcgcaaccactgctggcagaggcagtcaggcaggccaacgtgcttagcaaatagcttagctacccagcatcaagagatcgatcgatccggcgcggcgatggagctgctccccctgctcacggcgctcctcctggcgcacgccctggcctacctggcctggacggccgccgcgcgccgccggcagtcgcggtgctacctcctggactacgtctgccacaagccccgcgacggccgcaagatcaccacggagacggccggcgacgtgatccagcgcaacaagcgcctggccctctccgactaccgcttcctcctccgcgtcaccgtccgctccggcattggagaggagacctacgcgccgcagagcatcctcgagggccgcgaggacgcgcccgcgctccgggacgcgctcgacgagatggacgccttcatcgacgaggccatcgcggagctcttcgcccggacgggcttcgcgccccgcgacgtcgacgtgctcgtcttcaacgtctccatgctctccccggcgccgtcgctggcgtcgcgggtcgtgcgccgctacggcctgcgcgaggacgtcgcggcgtacaacctcaccgggatgggctgcagcgccgggctggtcgcgctggacctcgcccggaacgcgctgcggacgcggcggcgcgcgctggcgctcgtggtctcgtcggagtccatcgcgcccaactggtactccggcaccgacaggtccatgatgctcgccaactgcctgttccgcagcggcggcgccgccgtgctgctcagcaacgacccggcgcaccgcgggcgcgccaagatggagctgagctgcctggtgcgcgcccacatcggcgccaacgacgacgcacacgcgtgcgccctgcagcgcgaggacgccgagggccgcgtcgggatcagcctcagcaaggcgctccccaaggccgccgtgcgggcgttcgccgtcaacctgcgccgcctcgcgccgcgcgtcctccccgtcgccgagctcgcgcggttcgccgcgcgcctcctctcccggcagctcctcgcgcatttgcgctcctccggcaagaaggccggcggcggcgacgcccccaggatcgacttcaagaccggtgtggaccacttctgcctccaccccggcggcacggcggtgatcgaggcggtgaagcagagcctgggcctggacgacggcgacgtggagccgtcgcggatgacgctgcaccggtgggggaacacgtcggcgagcagcctgtggtacgtgctgtcgtacatggaggccaaggggcggctcaaggtcggggacagggtgctcatggtgacgttcgggtcggggttcaagtgcaacagctgcgtgtgggaggtgaccggggacatggccgacaagggggcgtgggcggactgcatcggcagctacccgccggagagcctcgacaacccatacatggtcaagtttggctggatcaacgacgtcgaaggcgacgcattgatgctctaattgggctaatttggcaaccacgcacactttattgccttattggtacagcacagtaaagctgatgataacaacggaatcagtgaaaagcacgcacacatacgtccttcagtttcaacagcctttagcttttgggaacagaaatgtgtagcctccagtcagtggcagcatataaaatctgaaaaaaatatatactgttagtacaaagtagcaccgtgtatatcttgtctgcttgtttttttttttgaaaaaagttgttggatgcttcttaaatgatgcggtctctgtccatacagaaacgttgcaaaaattcaagtgcaatatagcacttgtttagttgcaaaaaaaaaaaaaaaaaaaa

SEQ ID NO: 3010 - protein, 464 aa, Panicum virgatum
  misc_feature: Ceres CLONE 1788595
  misc_feature (1)..(288): Pfam Name: FAE1_CUT1_RppA Pfam Description: FAE1/Type III polyketide synthase-like protein
MELLPLLTALLLAHALAYLAWTAAARRRQSRCYLLDYVCHKPRDGRKITTETAGDVIQRNKRLALSDYRFLLRVTVRSGIGEETYAPQSILEGREDAPALRDALDEMDAFIDEAIAELFARTGFAPRDVDVLVFNVSMLSPAPSLASRVVRRYGLREDVAAYNLTGMGCSAGLVALDLARNALRTRRRALALVVSSESIAPNWYSGTDRSMMLANCLFRSGGAAVLLSNDPAHRGRAKMELSCLVRAHIGANDDAHACALQREDAEGRVGISLSKALPKAAVRAFAVNLRRLAPRVLPVAELARFAARLLSRQLLAHLRSSGKKAGGGDAPRIDFKTGVDHFCLHPGGTAVIEAVKQSLGLDDGDVEPSRMTLHRWGNTSASSLWYVLSYMEAKGRLKVGDRVLMVTFGSGFKCNSCVWEVTGDMADKGAWADCIGSYPPESLDNPYMVKFGWINDVEGDALML

SEQ ID NO: 3011 - DNA, 1774 bp, Panicum virgatum
  misc_feature: Ceres CLONE 1788610
  misc_feature: Encodes the peptide sequence at SEQ ID NO. 3012
aaaagcctctcacgcactccaccacgccacctccctccctccactccatccctctcagtagactcttgtctctgcctatccgcccaccgcctcgctgctcgcgagctccctccctccccgaaaccctagccccacccctgggggtggcggaggcgcctccggtgggtggcatcgacgcggctcgccgcggggttgaggcgtggcgagcagggtggcgctcggctcctttgatccgattggttgattgggccccgcgacccctgctgttgctcctcggttaggcggcgtggcgcggggagctcgggaatggggaactgctggggcgcgcggatcaaggatgggagccctcaacctggcgcctcaggtatgttctcaaagagtgggggcaaggatgggagtaggcttagcggctgcagtagtcgagcctcttcagcttccatgcctccaaatgcgaagactgaatgcgaaatcctgcaatctgccaatgttaagatcttcagcttcaataatctcaaagcagccacaagaaacttccgtcctgatagtgtgctaggtgaaggagggtttggatctgtctataaaggatgggtcgatgaaaatacattggcaccctgcaggcctggcactggaattgctgttgctgtgaaaagactcaatcaggatggtttgcaaggacaccgagagtggttggcggaagttaattacctaggtcagttctgtcatcccaaccttgtcaagctaattgggtactgcttagaggatgaacaccgactgctagtgtacgagttcatgccccgtgggagcttggaaaatcatctctttaggaggggctcgtactttcaacctctttcatggaaccttagaatgaaggttgcacttggagctgcgaagggactagcttaccttcacagtgcagaggcaaaagtcatttaccgagattttaagacttccaatattctccttgatgcagactattctgcaaaactatctgatttcggattggcaaaggatggccctgttggtgagaagagccatgtgtccacaagagtaatggggacatatggttatgcagctcctgaatatctttcaacaggtcacctaactgccaagagtgacatctatagctttggagtagtgctcctggagatgttgtcaggtcgccgcgccatcgataaaaaccggccccaaggggagcacaatcttgtcgaatgggctcgaccttacctcacacataagcgcaagatatttcgggtccttgatgccaggctggaaggtcaatactctctcaacggtgcacaaacaattgccacccttgctcttgaatgcctgtcctacgaagctaaaatgaggccgtctatggatgctgtggtcactatcctagaagagcttcaggactccagtgaagcagagaagcaaaaggaaccgaagactggaaccaaacagacgcctgctgctgtgagtgcaagcaagagcagccgcaagcctcgccggaaaagcttgggaggcacgaaggagaccgtcggtccgaatccaaaaccattggctcattctcgttagcggaagggtagcttgatcattaactagattgtagcttgtgaatttgatgtgtatattgagggtaatcagggttttggctacaagtcgttctcttctcatgagctgttcggttccagcttgaccgtgaatggatatctatgtcgaaactcatggcatcagggagagctaatgttttgcatggctattgatgattcttgaaaaaaaaaaaaaaaaaaaa

SEQ ID NO: 3012 - protein, 416 aa, Panicum virgatum
  misc_feature: Ceres CLONE 1788610
  misc_feature (1)..(367): SWISSPROT Homolog: EC 2.7.11.1 Protein kinase APK1B, chloroplast precursor
  misc_feature (1)..(413): SWISSPROT Homolog: EC 2.7.11.1 Protein kinase APK1A, chloroplast precursor
MGNCWGARIKDGSPQPGASGMFSKSGGKDGSRLSGCSSRASSASMPPNAKTECEILQSANVKIFSFNNLKAATRNFRPDSVLGEGGFGSVYKGWVDENTLAPCRPGTGIAVAVKRLNQDGLQGHREWLAEVNYLGQFCHPNLVKLIGYCLEDEHRLLVYEFMPRGSLENHLFRRGSYFQPLSWNLRMKVALGAAKGLAYLHSAEAKVIYRDFKTSNILLDADYSAKLSDFGLAKDGPVGEKSHVSTRVMGTYGYAAPEYLSTGHLTAKSDIYSFGVVLLEMLSGRRAIDKNRPQGEHNLVEWARPYLTHKRKIFRVLDARLEGQYSLNGAQTIATLALECLSYEAKMRPSMDAVVTILEELQDSSEAEKQKEPKTGTKQTPAAVSASKSSRKPRRKSLGGTKETVGPNPKPLAHSR

SEQ ID NO: 3013 - DNA, 1813 bp, Panicum virgatum
  misc_feature: Ceres CLONE 1788618
  misc_feature: Encodes the peptide sequence at SEQ ID NO. 3014
aatacccgttgcccactccctccaatctctccatcatcacccaattccgcgtcggcttcttcctccctacgccgcaagagagaaagccgagcgtctcttgaattcatacgtgctcgcgctcgcgcgcgcgtgcacgtgcacagctgacagcgacagctatagcgccgtcttccatggcggcgagctaccggcaggccctcgcggccgctctggtggcggcggcggtcgccgggctgccggcggcgggagcgctcggggtgaactggggcacgatggcgacgcaccggctgccgtcgggcatcgtggtgcggatgctggaggacaacggcatcaggaaggtgaagctgttcgacgccgaccccgggccgatggacgcgctcgccggcagcggcatcgaggtcatggtgggcatccccaacaacatgctggacatgatgacggactacggcacggccagggactgggtgcaccagaacgtcagcagctacaacttcgacggcggcgtgaacatcaaatacgtagccgttgggaatgagcctttcctgtcgtctttcaacggcacgttcctgaacgtcacgctgcccgccctgcagaacatccagcgcgccctcaacgacgccggcctcggcgaaaccatcaaggccaccgtgccgctgaacgccgacgtgtacaactccccgacgagcaaccccgtcccgtccgccggccggttccgcgcggacatcgacgacctcatgacggagatcgtgcagttcctcaaccagagcggcgcgcccttcaccgtcaatatctacccgttcctgagcctgtacggcaacgacggcttcccgctggactacgccttcttcgacggcacgagcaaccccgtggtggacaccggcagcggcatccagtacacgaacgtgttcgacgccaacttcgacacgctcgtgtccgcgctcggcgcggcgggcgtcggcggcctccccgtggtggtcggcgaggtcgggtggccgaccgacggcgacaagcacgccaccgcggcgtacgcgcagaagttctacgcggggctgctgcggaagctgggggccaaggccggcacgccgctgcggccgaaccagtacatcgagctgtacctgttcagcctcatcgacgaggacgccaagagcgtggcgccgggcaacttcgagcggcactggggcatcgtgcggtacgacggccagcccaagtacccgatggacctgtccgggcagggcgggaacgcggcgctggtggcgacgcgcggggtgcagtacctgccccggcagtggtgcgtggtgaacccgagcgcgccggacatgggcagcaggatcggcgacagcgtcacctacgcgtgcaccttcgctgactgcacggcgctcgggtacggctcgtcgtgcaacggcatggacgccgccggcaacgcgtcgtacgcgttcaacatgtacttccagacgcagaaccaggtggagggcagctgcgacttccaggggctcgcggcgccgacggcgcagaacccgtccacggacacctgcaatttcatcattcagatcgtggcgtcggcggccccggcgccggcgccggcggcgcctgcgctactcctcttggttcttcgcgctgtcctgctggttgctctgtgactagtgtgtgtggtgctgaactgctaatgacggttggaggaggaggtctcgctctcgcctcgcatgtaaagatttttgttcggttttgtagataatctcgtgttatcagatcattctgaggtccatataagggatgtatatacgtaagagagatttggagaaacggcacattttac

SEQ ID NO: 3014 - protein, 487 aa, Panicum virgatum
  misc_feature: Ceres CLONE 1788618
  misc_feature (1)..(322): Pfam Name: Glyco_hydro_17 Pfam Description: Glycosyl hydrolases family 17
MAASYRQALAAALVAAAVAGLPAAGALGVNWGTMATHRLPSGIVVRMLEDNGIRKVKLFDADPGPMDALAGSGIEVMVGIPNNMLDMMTDYGTARDWVHQNVSSYNFDGGVNIKYVAVGNEPFLSSFNGTFLNVTLPALQNIQRALNDAGLGETIKATVPLNADVYNSPTSNPVPSAGRFRADIDDLMTEIVQFLNQSGAPFTVNIYPFLSLYGNDGFPLDYAFFDGTSNPVVDTGSGIQYTNVFDANFDTLVSALGAAGVGGLPVVVGEVGWPTDGDKHATAAYAQKFYAGLLRKLGAKAGTPLRPNQYIELYLFSLIDEDAKSVAPGNFERHWGIVRYDGQPKYPMDLSGQGGNAALVATRGVQYLPRQWCVVNPSAPDMGSRIGDSVTYACTFADCTALGYGSSCNGMDAAGNASYAFNMYFQTQNQVEGSCDFQGLAAPTAQNPSTDTCNFIIQIVASAAPAPAPAAPALLLLVLRAVLLVAL

SEQ ID NO: 3015 - DNA, 1523 bp, Panicum virgatum
  misc_feature: Ceres CLONE 1788624
  misc_feature: Encodes the peptide sequence at SEQ ID NO. 3016
agaggcagacgggagtggaagcccagccgcgtccccctccccactccgcgccaccgcacgctccgctccccatggcgctcgcgctgcgctgccccgccgccacctcctccaggagccccttcctgccctcctcctccccggtcccgccggcgaggctcgcgaggaggccgccagccacctgcaggtgccactactaccacggcgacggtgtcggattccgcaagaactacgaccacatccccaagcagttccgcgaggagaacctcaaggatggactgatggataattacaagaatgttactcagttcctttatggattaaatcctgctcagatggaaatgtttatgaacgatgataatccttataatcggcaatcccagaaagttaccgaggaaagtgtttctgctgctaggagttacgatgaatttggtatgtacaccttgtcaggcatgcatgagggccctgcaagttgcagcttgggcatgggcatggggggcagcatgagcatgggcatgggcagaggtgggagaggatatagaagaatgagaagctctgctccagatctgccatcattgctactagactctcgaattatatttcttggaatgcctattgttccggcagtaactgagcttattgctgctcaatttctgtggctagattatgatgaccgcacaaaacccatttatctgtatataaactccactggaaccatggatgaaaataatgagcttgttgcatctgaaactgatgcttatgcaattgctgattttatcaatcgaagcaaatccaaggtttacacaatcaatcttagcatggcatatggtcaggctgcaatgcttctgtcccttggtttcaagggcaaaagaggagtgcttccaaattcaatcactaaattgcacctgcctagggtccacaaatctggtggagccgccattgatatgtggattaaggcaaaagagttggatacaaacacagattattaccttgatctattgtcaaaaggagttggtaaaccaaaggaagagctcgctgaattccttaagggcccaaggtacttccgtgcgcaagaggccatcgattatggacttgctgatacgattttgcactcattggatggttctttcaagccaaaggatctgactgcgcagctggccaaagcacaggagatgcggcaatcaggtaagcgtgcagcagctggagctgggagatggtcgactccaactgcacctaggtagattagaatgtttcatcaggacggtatgctccatcttgatgatcatgtggttctgcaatacaaagaagccagccccttgtatacgtgcaaagaatcatctccatggagcttggaatcagatgctggatagccaaatgttttgaagtgtagtttaagttgtgatgtgtatcatgtatgtgtaattttggttacaatcaacccacagctattgtttccatatagatttcattcaccagtggaaatgatagcttatctgaattttagccaaaaaaaaaaaaaaaaaaaa

SEQ ID NO: 3016 - protein, 388 aa, Panicum virgatum
  misc_feature: Ceres CLONE 1788624
  misc_feature (1)..(189): Pfam Name: CLP_protease Pfam Description: Clp protease
MALALRCPAATSSRSPFLPSSSPVPPARLARRPPATCRCHYYHGDGVGFRKNYDHIPKQFREENLKDGLMDNYKNVTQFLYGLNPAQMEMFMNDDNPYNRQSQKVTEESVSAARSYDEFGMYTLSGMHEGPASCSLGMGMGGSMSMGMGRGGRGYRRMRSSAPDLPSLLLDSRIIFLGMPIVPAVTELIAAQFLWLDYDDRTKPIYLYINSTGTMDENNELVASETDAYAIADFINRSKSKVYTINLSMAYGQAAMLLSLGFKGKRGVLPNSITKLHLPRVHKSGGAAIDMWIKAKELDTNTDYYLDLLSKGVGKPKEELAEFLKGPRYFRAQEAIDYGLADTILHSLDGSFKPKDLTAQLAKAQEMRQSGKRAAAGAGRWSTPTAPR

SEQ ID NO: 3017 - DNA, 2086 bp, Panicum virgatum
  misc_feature: Ceres CLONE 1788637
  misc_feature: Encodes the peptide sequence at SEQ ID NO. 3018
aaaaacccctcctcacacgcagcgcagcgacccaacccccccgaggccgccagccttatcctctccgcccccgccgccctacgactccaatccgcgaggcagatatggcttcaacattcggtgccacttctacggttggccttatggctgctccaacaggtaagaatgtgcgccttcagaggagggctaacttcagagtaaaagcagctaaggagctgtacttcaacaaggatggctcagctatcaagaagctccagactggagttaacaagcttgcagacctagttggagttacactgggaccaaagggaaggaatgtggttctggagagcaagtatgggtctcctaagattgttaacgatggtgttacagttgcaagaaaggttgagctggaggatccggttgaaaacattggagctaaattggttaggcaagctgcagctaagaccaatgatctagctggagatgggacaactacttctgtggtccttgctcaggggctgatagctgagggtgttaaggttgtggcagctggtgctaatcctgttcagattacccgtggtattgagaaaacagcgaaagcactagttgaggaactacgaaagctttcaaaggaagttgaagacagcgagcttgcagatgttgcagcagtaagtgctggcaacaactatgaaattggaaacatgatagcagaggccatgaacaaggttggtcggaagggtgtggttacccttgaagaggggagaagttctgagaactttctatatgttgtggagggaatgcaatttgagcgtggttacatctctccttacttcgtaactgacagtgagaaaatgaccgccgagtatgagaactgcaagctgcttttggtggacaaaaagatcaccaacgcaagggatcttatcaacgttttggaggaagccatcagaggtggatacccaatcctgatcattgctgaggatattgagcaggaggctcttgctacccttgttgtcaacaagcttagaggatcattgaagattgctgctatcaaagcccctggttttggagagcgcaagacccagtacttggatgatattgccatccttactggaggaactgtaatcagagatgaagtcgggctctcacttgacaaggcggataaatcagtccttggaacagctgcaaaggtcgtccttaccaaagaggcaacaacaatagtaggtgacggcagcacacaggaagaagttactaagagggttgcacaaattaaaaatctcattgaggcagcagatcaagaatatgaaaaggaaaaactcaatgagaggatagcaaagcttgctggtggtgttactgtcattcaggtgggggcacaaacagaaactgaactaaaagagaagaagttgagagttgaggatgccctaaacgcaactaaggctgctgttgaggaaggtattgttgttggtggagggtgcactctcttgcggcttgccgctaaagttgatgccatcaaggacacactggagaatgatgagcagaaggttggagctgaaattgtgaggagggctctgagctacccactcaaattgattgctaaaaatgctggtgttaatggaagcgttgtcactgaaaaggttctttctaacgataatttcaagtatggttacaatgccgctaccggacagtacgaggacttgatggctgctggtatcattgaccccaccaaggtggtgaggtgctgcttggagcacgctgcatcggtggccaagaccttcctcatgtcggatgtcgtggttgtcgagatcaaggagcctgagcctgctcccctcactaaccccatggacaactctggctatgggtactgatgagtgacggccaagccacggttgcccctgggaagaaggtgatcaccatattttttttggtaggcgagtcttggagaggttggtcgaggtagttttttgagataaaaagtgaattagttgtaccgctgaaaggcgaaataagcagaggaaccgtagtccaaaatttgcgatgtaactggaactgaacagcagtcaggttaagcagaaattgctgagatttcgaaaaaaaaaaaaaaaaaaaa

SEQ ID NO: 3018 - protein, 579 aa, Panicum virgatum
  misc_feature: Ceres CLONE 1788637
  misc_feature (1)..(499): Pfam Name: Cpn60_TCP1 Pfam Description: TCP-1/cpn60 chaperonin family
MASTFGATSTVGLMAAPTGKNVRLQRRANFRVKAAKELYFNKDGSAIKKLQTGVNKLADLVGVTLGPKGRNVVLESKYGSPKIVNDGVTVARKVELEDPVENIGAKLVRQAAAKTNDLAGDGTTTSVVLAQGLIAEGVKVVAAGANPVQITRGIEKTAKALVEELRKLSKEVEDSELADVAAVSAGNNYEIGNMIAEAMNKVGRKGVVTLEEGRSSENFLYVVEGMQFERGYISPYFVTDSEKMTAEYENCKLLLVDKKITNARDLINVLEEAIRGGYPILIIAEDIEQEALATLVVNKLRGSLKIAAIKAPGFGERKTQYLDDIAILTGGTVIRDEVGLSLDKADKSVLGTAAKVVLTKEATTIVGDGSTQEEVTKRVAQIKNLIEAADQEYEKEKLNERIAKLAGGVTVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQYEDLMAAGIIDPTKVVRCCLEHAASVAKTFLMSDVVVVEIKEPEPAPLTNPMDNSGYGY

SEQ ID NO: 3019 - DNA, 1629 bp, Panicum virgatum
  misc_feature: Ceres CLONE 1788645
  misc_feature: Encodes the peptide sequence at SEQ ID NO. 3020
agctcctcctcgaaaagcagcacttctcttctgtccacacccgcttggattgcattccattgcattgcggcgattccgcctgtagctattactagctagccaccagagagagagatacctctctctctatatatacaatctcctccattgcattgctttgctccaaataaattaatgttacacgcaccagaccactagccactagcagaaaggaaatgaggcatcgtcaggaagagatgcacctcatcagctgcagcagcttgttgctcgtgctcgtgctggccgcaggcggcggcggtgtatctgctgctgctgctgccgccgccgccaacaccacgacgaccacgacgagatcatcgaccaagccccaggcggccgccctcatcgtgttcggcgactccatcgtcgaccccggcaacaacaacggcatcaacaccatcgtcaaggccgacttccctccctacggccacgacttcctcaaccaccgacccaccggacgcttctgcaacggcaggataccaacggacttcatagcgtcccggctgggcctcaaggacctcctcccgccctacctctcccctgagccgctggacaagcacgacctcctcaccggcgtcagcttcgcctccggcggcaccggcttcgacccgctcacgcccaagctcgcctccgtcatctcgatgcccgaccagctggccatgttccacgagtacctgggcaaggtgcgcgccgccgccggggacgccaaggccgccgagatcctctcccggggcatcttcgccatctgcgccggcagcgacgacgtggccaacacctacttcaccatgcgcgcgcgcagcaactacgaccacgcctcgtacgcgcggctcctcgtgcggcacgcctcgtccttcgtggaggacctcatccacgccggcgcccgccgcgtggccttcatcggcatcccgcccatcggctgcgtgccgtcgcagcgcaccatgtccggcggcccggagcgcggctgctcccggggccacaacgaggtggccgccgcctacaacgccggcatggtcgcggagctggcggcgctccgggcgaagcaccccggcacgctgctcgtcttcatggacatctacggcttcctctacgacatgatgatgcacccgcgcagctacggcttcacgcaggccaccaggggatgctgcggcacgggcctcctggaggtctccgtcctctgcaacggcgtcacctccgccgtctgcgaccccgtcgccgactacctcttctgggacagctaccaccccacggagaaggcctacaagatcctcgccgacttcgtctacgacaactacgtcaagctcatcatctgatgatgatggatttattattattccccattccgtttccgtttccattgatgaaatttaattattccctccttcaattccttttcgatctctaccggacccacccgacccctgtctgctgcgtctgattcatttctttctttctccatttgttttgttattaccactgctagtactctctctctctctctctctcttcatcgataccagcgagagatttcatgttttttgctatatatagtcgcctggtccttgatttccagaaaaaaaaaaaaaaaaaaaa

SEQ ID NO: 3020 - protein, 377 aa, Panicum virgatum
  misc_feature: Ceres CLONE 1788645
  misc_feature (1)..(314): Pfam Name: Lipase_GDSL Pfam Description: GDSL-like Lipase/Acylhydrolase
MRHRQEEMHLISCSSLLLVLVLAAGGGGVSAAAAAAAANTTTTTTRSSTKPQAAALIVFGDSIVDPGNNNGINTIVKADFPPYGHDFLNHRPTGRFCNGRIPTDFIASRLGLKDLLPPYLSPEPLDKHDLLTGVSFASGGTGFDPLTPKLASVISMPDQLAMFHEYLGKVRAAAGDAKAAEILSRGIFAICAGSDDVANTYFTMRARSNYDHASYARLLVRHASSFVEDLIHAGARRVAFIGIPPIGCVPSQRTMSGGPERGCSRGHNEVAAAYNAGMVAELAALRAKHPGTLLVFMDIYGFLYDMMMHPRSYGFTQATRGCCGTGLLEVSVLCNGVTSAVCDPVADYLFWDSYHPTEKAYKILADFVYDNYVKLII

SEQ ID NO: 3021 - DNA, 1962 bp, Panicum virgatum
  misc_feature: Ceres CLONE 1788681
  misc_feature: Encodes the peptide sequence at SEQ ID NO. 3022
taaacctacccatccgtccgccccgccttcccgacgccggcggcgctctccctcccctaaccgctcgccgcttctccccttctccttctcagcgacttggtggcgcgtccgatagtgctcctggtttagcaccgagcgccacaccacaccatggaggtcgaaggcgaggcacgaccgttccgcctcttctccgggagggccaagcccaaacccaagctgaagcccgagccagaggtccggactcagccggagccccgcagccctgaccccgccgccgtcgagaccgaccacgccgacgcccaccctgctccctccatcgtgacggagacaggccaggccgacgacgccgaagccgcggccggcgcggcggccgccacgttcgcggacctcggcctgtcgcagtggctcgtcgacacgtgcagcgccctgggcatgaagcgcccgacggccgtgcagcgccggtgcatcccgcgcgcgctggcgggggaggacgtgctgggcatcgccgagaccgggagcggcaagacggccgcgttcgcgctgcccatcctgcaccgcctcggggaggacccctacggcgtcgccgcgctcgcgctggcccccacgcgcgagctcgcggcgcagctcgccgagcagttccgcgcgctcggggcgccgctgggggtcaggtgcctcgcggccatcggtgggttcgagtcgctcgcgcaggccaaggggctcgcgcgccgcccccatatcgtcgtcgctaccccaggccgcatcgccacgctcgtcaaagacgaccctgacctcgccaaagtattcgcccgcaccatgtttcttgtgttggatgaggcggatagagtgctagatgttaatttcgaagaggaactccgggtgatatttggctgtttaccaaagaagcgacaaacctttttgttttcagcaacaatgtcagataatctgcgatctttgcttgaactttccggcaacaagtcatacttttttgaagcatatgaaggattcaagacagtagagaccttaaagcagcaatacattcatgttcctgatgatggaaaagagcttcatcttacatatctcctatcaaaaattaaggacaaggaagaccctatccataagatgggagaccctatccgctcagccattgtattcgtttcaagatgcagtacttgctactttttggatctgctgctggaagaacttggccatcctgctgtttctttgcactcccacaaatctcaagcgcaaagactcttagcacttaaccgttttaaatccggtcaggttcccgtattgcttgctactgatgtgggcagccgtggattggatatccaaacagttgatcttgtcatcaattatgacattccatggaatccacgcgattacatccatagggttggacgaactgcaagagcttcgaggggagggtttgctataagctttgttacacagaaggatatatgccttttacatgagatagaagatattgtggggaagcagttggaggcctatgagtgcagtgacaaagaagttactaaaaatatcacaaaggtattcaaagcacagcgtctagcaagaatgaagatggatgatgagggccatggagagaaagtacaggcccgaaaagaacagaagaaaagggatctggcgcgaaagcggaaacacgaaggatgaatcccgtggaactggctacagtgatggtatgccgtatgccatctgcgggaatggcagttgtggcttgcttagtgtagtgagtagtaacctcgaggagtcggtggtggcttattccaatgatgagctcgtctagtcggctcttcacttttttgtcaatggggaaattattatgtcggtgcatgtaaaatcttgctagattaacgtgaggaaggcacatgtactactgaattcgtggcgtgtttgcgcagtgccatggattgagttcaccaaaaaaaaaaaaaaaaaaaa

SEQ ID NO: 3022 - protein, 507 aa, Panicum virgatum
  misc_feature: Ceres CLONE 1788681
  misc_feature (1)..(77): Pfam Name: Helicase_C Pfam Description: Helicase conserved C-terminal domain
  misc_feature (1)..(170): Pfam Name: DEAD Pfam Description: DEAD/DEAH box helicase
MEVEGEARPFRLFSGRAKPKPKLKPEPEVRTQPEPRSPDPAAVETDHADAHPAPSIVTETGQADDAEAAAGAAAATFADLGLSQWLVDTCSALGMKRPTAVQRRCIPRALAGEDVLGIAETGSGKTAAFALPILHRLGEDPYGVAALALAPTRELAAQLAEQFRALGAPLGVRCLAAIGGFESLAQAKGLARRPHIVVATPGRIATLVKDDPDLAKVFARTMFLVLDEADRVLDVNFEEELRVIFGCLPKKRQTFLFSATMSDNLRSLLELSGNKSYFFEAYEGFKTVETLKQQYIHVPDDGKELHLTYLLSKIKDKEDPIHKMGDPIRSAIVFVSRCSTCYFLDLLLEELGHPAVSLHSHKSQAQRLLALNRFKSGQVPVLLATDVGSRGLDIQTVDLVINYDIPWNPRDYIHRVGRTARASRGGFAISFVTQKDICLLHEIEDIVGKQLEAYECSDKEVTKNITKVFKAQRLARMKMDDEGHGEKVQARKEQKKRDLARKRKHEG

SEQ ID NO: 3023 - DNA, 1289 bp, Panicum virgatum
  misc_feature: Ceres CLONE 1788684
  misc_feature: Encodes the peptide sequence at SEQ ID NO. 3024
gttttcttgatttggccgtcttggttggttcctagctcttggatgaggtgggattcgtagagcggtgcggcggcggcggcgtttttcttggttggggtaggttgtttccatcttcggcggaggagagatggtgggcggtggagggcagtcgtccatcgaacccgacgccgaagacctcgagcgcggcgagcggcgccgggatgcgcctgagttcgtggacggcgatgacggggacgaggaagaaagccagtacttctcggacgcggaggaccggtcgtggccgtcgcactcgcgccacgactccaccgcctacgaggactacatctcaccgtgcgcatccgcccgcgcgagctctgtcgacgccgatgccgacggcgacggcgacggcgagaccgttggggagcattgcaggaagtcgtcctgcgtgtccgagggctcactggaagacgtcgacctggaggccggactggccgagatcatcaaggccagccccgagaagtccgagcagaactgccgcatttgccacctcggcctggagagtggggcagccgactccggcgccggcatcacgctcggctgctcctgcaagggcgacctgtcctacgcccacaagcagtgcgccgacacctggttcaagatcagaggcaacaagatatgtgagatatgtagctcaactgcaagcaatgtggtagttttgggtgatccagagttcagcgaccagtggagtgaaacaaacaacgtatctactgtgcaagcaccgccagctgaagcccgaaggttctggcaagggcacaggttcctcaacttcctccttgcctgcatggtgttcgcatttgtcatctcttggctcttccacttcaacgtccccggctaagttcttcgcgcacatgggcccgaataaaagcgctccaaagccattactccaaacatgtgggtaagatctagcgaatctgtaagaacaggctgggttgaagtaaaagtttgagatggtacaaaagaaaagagagtacatggtggggatggtgatcctgcatttgtccataatgacgaatgcctttgcgttggtaaagagttaaagattaaagatggcgatccccgtaagaaagggagcatgactgagggtttccctgccggcttgtggaatctagatgtagttgaaagcaaggaatagaaggtgtgttgctgcatggttgacgttatcactgtgcgatgatggagatttgtttagtccgatcatttttctagctttgaaagttgaaaccacctgtcaaaaaaaaaaaaaaaaaaaa

SEQ ID NO: 3024 - protein, 248 aa, Panicum virgatum
  misc_feature: Ceres CLONE 1788684
  misc_feature (1)..(52): Pfam Name: zf-C3HC4 Pfam Description: Zinc finger, C3HC4 type (RING finger)
MVGGGGQSSIEPDAEDLERGERRRDAPEFVDGDDGDEEESQYFSDAEDRSWPSHSRHDSTAYEDYISPCASARASSVDADADGDGDGETVGEHCRKSSCVSEGSLEDVDLEAGLAEIIKASPEKSEQNCRICHLGLESGAADSGAGITLGCSCKGDLSYAHKQCADTWFKIRGNKICEICSSTASNVVVLGDPEFSDQWSETNNVSTVQAPPAEARRFWQGHRFLNFLLACMVFAFVISWLFHFNVPG

SEQ ID NO: 3025 - DNA, 1850 bp, Panicum virgatum
  misc_feature: Ceres CLONE 1788695
  misc_feature: Encodes the peptide sequence at SEQ ID NO. 3026
gcacttccagcttgctctattgctccctctccttctgtgagctctggtgatgcggaagtatttctccaagctttcacatttgttgttcattccaagattatgaagaaattacaggctgatcgataatcctctgtggaggcagcttcatcttttctatgtgcccctgaagatgatagtcctgtgactattactcatccaaaaagatttggtttgttcccaaaggctatggctatgtatgatgcacatcttctccagctgtaatacagttccagcaggcctttgtctggacggtggatcgttcttttgcccttcttttgatctgtcgatagggatagtggctgttcttgaagggactggctgcttttcatctctgataggattatcagttgcatgatattattttccctcaacctcaatcaaaccagctgaggggtatgtatatgtgaaataaaaggggattaaggaacgttggtgtttctggacaattggagatgtactcaggccagcaatctgatcagtgtcctagtgcaaatagtggcagagaattctccgaggcaaatcggaatactgtcacaatgcatcagaagatgggctataacagtggaccgtatggatttggaccttacaacatgggtttagaagaaagacccgggttgtatcaatcttcatctggtacattcagtcagaacatccaaatgagtgatgagcatagcgggggtgtgaagaagaggaaaggaatggatgattgcgtcgcgatgttgcaaaatgctggtgatcaacaaacagaaggttcttctcagccagaacggaattcattggaggggaacagaaagatttcgcccaaaatgcaaagcaaggaagattcttctgatggtgatggtactaaagaggattatgttcatgtccgggcaaaacaaggccaagccaccaacagccacagccttgcagaaagactgaggagaaaaaagataagtgagagaatgaaactgcttcaagatcttgttcctggatgcagtaagatcactggcaaggcagtcatgcttgatgagattatcaactatgtgcagtcattgcaacgacaggtcgagttcttgtcaatgaaactagcaactgtcaacccagagctgggctttgacattgagcagattctatccaaacaaatgatgctttcacaagacagacattttgctttctatggagtggatccaggatcaagcagccttgcttctcagtttagccaaggaatcatgcagccacaaatgatgtgcaacatttccaatcctgctgatgttttgcagggaacaattcatgatgtctcaacaatgaaccagatacctgcaatgtgggaaggacttcaaaacctgccgcagatgaacttcaaccctggtgtggcagccgatagcagcgccaacaactctggttccatgaagatagaacagtgagctgccaatattgctcccaaattgttctgtgaatcactgaatcaccgtaaagcgcttgcggaatgaagcttttttgtatagctggaggcctaaccattcattgctggtttccttctgttgctccccatactatggctcatcgtttatggtatggatgaggatcatgtatagcaggagctgaagaaaaattgattccactgtaaatttctgttgagctttggcctgtggaaattcggatggaaacccagtatcatccatgaactccaagggcagaagcttgttgggaccaagtgctgaatgctgatgggcctaaacgtagtactagtagaatgaaatcgtaggtacaaaaatgcagagtttgaagactaatgcattgtcagaaattccataaaaaaaaaaaaaaaaaaa

SEQ ID NO: 3026 - protein, 316 aa, Panicum virgatum
  misc_feature: Ceres CLONE 1788695
  misc_feature (1)..(51): Pfam Name: HLH Pfam Description: Helix-loop-helix DNA-binding domain
MYSGQQSDQCPSANSGREFSEANRNTVTMHQKMGYNSGPYGFGPYNMGLEERPGLYQSSSGTFSQNIQMSDEHSGGVKKRKGMDDCVAMLQNAGDQQTEGSSQPERNSLEGNRKISPKMQSKEDSSDGDGTKEDYVHVRAKQGQATNSHSLAERLRRKKISERMKLLQDLVPGCSKITGKAVMLDEIINYVQSLQRQVEFLSMKLATVNPELGFDIEQILSKQMMLSQDRHFAFYGVDPGSSSLASQFSQGIMQPQMMCNISNPADVLQGTIHDVSTMNQIPAMWEGLQNLPQMNFNPGVAADSSANNSGSMKIEQ

SEQ ID NO: 3027 - DNA, 2513 bp, Panicum virgatum
  misc_feature: Ceres CLONE 1788697
  misc_feature: Encodes the peptide sequence at SEQ ID NO. 3028
acttcaaatctcgatcaagagcagagcacacagaggctaagaaagagctcgaacaaacagagtagagaatggccggaggcgatggtgagctgaagctgctggggatgtgggcgagcccgttcgtcctgcgggtgaagctcgcgctcagcttcaagggtctgagctacgagtacgtcgaggtggacctcaagaacaagagcggcctcctcctcgcgtccaacccggtgcacaagaaggtgcccgtgctcatccacaacggcaagcccgtctgcgagtcgcggatcatcgtgcagtacctcgacgaggtctacagcgccgccgcagcccccaccttcctccccgtcgacccctacgaacgtgccacggcacgcttctgggccgccttcatcgacgacaagttctttgcctcgtggttgaaggcgggcaggggcaagacggtggcggagaaggcggaggggctgaaggagacgttcgcggccgtggagaccctggaaggggcgttccgggagatctccaaggggaagcccttcttcggcggcgacagcgtcggctacctggacatcgcgctgggggccctgctagcgtggatgctcaccgccgaggtgcgtcatgggttcaggctcttcgatgcctccaggagcccgctgctggagaagttggtggagcgcttcagcaagctggatgaggtcgtcgcggtcttgccggacatcgacaggctggtggagcacaccaaggtgagggaggccgaggttgcagctgctgctgctgccgtgaacaactgaacaaaacgtctcggtgttgaggcggaggatgttgaggcggcgatgtggaagatgtgtaatgaaagaagtactagtacgtggtcgcgtctcttaaaatgtccgaaccagcgagttttcaactttctcgcaagttatctgctcatccattttctaaaagaagaaacgcgagttgcagagttaagccctgtttgaaagtctggaaacggtgtttcgagggtatgcctactgaagtttgccatcaattttactggtttctaaggtactgttcttctttttgaatagtttatcccagtcttttttggatatgacatgtttgatgcatagtgtgttcatgatgcaaatgcaatacaaatgtggccctccggtttcagcgtaatataaaatatgatcatgactgcataggtcatacatgcatgaatatgcccttacacactgatacaatgtgaagtagtgttataaaattactaaatcaagtatgaccagtgcttaagtaaaagagtaaaagaagcacattaatgattgatttctttccggtgtttatgggatgtggctcaattagaaaatcttattattctagggttggtgatgtttaatgacagattaaataacttgaaaatatcaccaataataattgctttcttttcagtgcttaagggatgtgtacccaagtacaagtctacatgattgattcctttcaagtactgttgggataaattttggtttattatgattgctgctccacatgcaattagcgatgttctaaacctactaagttatcatgcatatgtgggagatgtatttgtaaaaatgatttagtggatgttcatgcagcttgattttttatgaactctagcatggccgtgaaagcagtagattgacatggaaaaggtaagatctcaatctaattaatgtgcatttgttatttatttataccctcattctttcatcaattttagtagtaggaatgattaatagttggaaaagaggttttgtgagggtgtgtctttttgatggtgaaatgagctgcagcaagggcctgtggtgtgcagtgctagagatgaaatatcttttttctaaattgagaggcattgaacaaactgacccataaatgggggcatggggcacagctagagttgcttgcttcagtgcacttcatatcatgtgagagcataagatccagaaatgatagtattgtctaaaagttattagctctttgataagtagtatatctatttctcgtgcagtctgtgttgacttggaactgcttataggtgaaatattttcggttgtgattggaagtctttactatgttgcccttgaggttctgatgaaagactatggctgcagcttacagctagagcttgaagatggtgttttgtggaaaatctgtgcaggatttagtggtggggtatatgggcgtgccaaaatagaaatgaaaggtccatcctaggaaagcaattttgcattagctttctgattcgtggagctccttgattttctttcagttgtagtgttgacacggcaaatcacctaattgagcacactgaccatgaggggctcacaggtgagatcttgggctggagcagaaaatatcgtcttggaacaaatggcttgtctagcattgtacccagcaccaagagcctcaacatggagattctgtccctcgaccctcaacatgctctgattataattctagaaaatttggagattcaaaaaaaaaaaaaaaaaaaa

SEQ ID NO: 3028 - protein, 237 aa, Panicum virgatum
  misc_feature: Ceres CLONE 1788697
  misc_feature (1)..(104): Pfam Name: GST_C Pfam Description: Glutathione S-transferase, C-terminal domain
  misc_feature (2)..(74): Pfam Name: GST_N Pfam Description: Glutathione S-transferase, N-terminal domain
MAGGDGELKLLGMWASPFVLRVKLALSFKGLSYEYVEVDLKNKSGLLLASNPVHKKVPVLIHNGKPVCESRIIVQYLDEVYSAAAAPTFLPVDPYERATARFWAAFIDDKFFASWLKAGRGKTVAEKAEGLKETFAAVETLEGAFREISKGKPFFGGDSVGYLDIALGALLAWMLTAEVRHGFRLFDASRSPLLEKLVERFSKLDEVVAVLPDIDRLVEHTKVREAEVAAAAAAVNN

SEQ ID NO: 3029 - DNA, 2259 bp, Panicum virgatum
  misc_feature: Ceres CLONE 1788698
  misc_feature: Encodes the peptide sequence at SEQ ID NO. 3030
aaaaaagtgaaggagagaaggaaaaaaaagagcgacgaggaatgaagcatctgcatccttcttcggtgcgctccctgccctcccccgctataatatcgccacgccctcgtcgccatcgtcaccacaccgccactccctccctgccctctcgctcccgatctatccaccaccaccaccgccctctccgcgccaccactcccctcgcctcgcgcggcgaccggcggcgggacgtcggcgggccgatcatggggctcttcaccgtgacgaagaaggccaccacgcccttcgagggccagaagcccggcacctccggcctccggaagaaggttactgtattccagcaacctcattatctacagaactttgtccaatcaacattcaatgcccttcctgctgaggatgtaaaaggtgcgaccattgttgtctctggtgatggccgctatttctcaaaagatgctgttcagatcataacaaaaatggctgctgccaatggagcaagacgtgtttgggttgggctaaacagtctcatgtctactcctgcagtgtctgctgtcatccgtgaaagagttggtgcagatggatcaaaggctacgggtgccttcatcttaacagcgagccacaacccaggtggtccaactgaggacttcgggatcaaatacaatatgggaaatggtgggcctgcccctgagtctgttactgacaagattttctctaatacaacgacgatctctgaatacctcatcgccgaagaccttccagatgttgatatttctgttgctggtgtcactagcttcagtggacctgaaggcccctttgatatggatgtctttgactccagtgtagattacataaagttaatgaagacgatttttgattttgaggcaataaagaagttgctgacctctccaaaatttacattctgttatgatgccctccatggtgttgctggagcttatgccaaacacatctttgtggaagagcttggtgctgatgaaagctctctgttgaattgcgtcccgaaggaggactttggcggtggccatccggatcctaacctcacctatgcaaaagagttggttgaacggatgggtcttggaaagtcatcttcaaacgtcgaacctcctgaatttggtgcggctgctgatggagatgcggaccgaaacatgattctgggtaaaagattctttgtgacgccatcggactctgttgccattatcgcggccaatgctgttcagtcaattccttactttgcttctggcctgaagggagttgccaggagcatgccaacatctgctgcccttgatgttgttgcgaagaatttaaatctcaagttctttgaggtgcctactgggtggaaattttttggcaacttgatggatgctggaatgtgctcaatctgtggcgaagagagctttggcaccggttctgatcacattcgtgagaaggatggtatttgggctgtgctttcatggctgtctattcttgctttcaagaacaaggacaaccttgaaggagataataagcttgtctcagttgaagatattgttcgtcagcactgggccacctatggtcgtcactattacacacgttatgactacgagaatgttgatgctggtgctgctaaggagcttatggcaaacctagtcagcatgcaatcatcactttctgatgttaacaagttgatcaaggagatcagatctgatgtttccgaagtagttgcagctgacgagtttgagtataaggatcctgttgatggctctgtgtccaagcaccagggtatccgatacctctttggagatggttcacgactggtgttccgtctctctggaaccggttctgttggtgccaccatccgtgtctacattgagcagtacgagaaggattcctccaagaccggcagggattcacaggatgctcttgctccactggttgatgttgcactcaagctctccaagatgcaagagtacactggccgctctgcccccaccgtgatcacataaatttttgaagagcctgtgttttagaatgagcagcacttacacaaaccttctttctggcctcgtgtttgatagttttttccccgtgtccatctcaccagtgaataaagtgtatgtttattgcccatactgcagacttgccgctggcacagcatgcggtaataagtcttgtcacagtgctgtaactgggagcttgtttctcctctcgcaatatatcagatgtgtttttttgtttgtttgagcaaaaaaaaaaaaaaaaaaa

SEQ ID NO: 3030 - protein, 652 aa, Panicum virgatum
  misc_feature: Ceres CLONE 1788698
  misc_feature (1)..(116): Pfam Name: PGM_PMM_II Pfam Description: Phosphoglucomutase/phosphomannomutase, alpha/beta/alpha domain II
  misc_feature (1)..(150): Pfam Name: PGM_PMM_I Pfam Description: Phosphoglucomutase/phosphomannomutase, alpha/beta/alpha domain I
  misc_feature (69)..(652): SWISSPROT Homolog: EC 5.4.2.2 Phosphoglucomutase, cytoplasmic 1
  misc_feature (69)..(652): SWISSPROT Homolog: EC 5.4.2.2 Phosphoglucomutase, cytoplasmic 2
MKHLHPSSVRSLPSPAIISPRPRRHRHHTATPSLPSRSRSIHHHHRPLRATTPLASRGDRRRDVGGPIMGLFTVTKKATTPFEGQKPGTSGLRKKVTVFQQPHYLQNFVQSTFNALPAEDVKGATIVVSGDGRYFSKDAVQIITKMAAANGARRVWVGLNSLMSTPAVSAVIRERVGADGSKATGAFILTASHNPGGPTEDFGIKYNMGNGGPAPESVTDKIFSNTTTISEYLIAEDLPDVDISVAGVTSFSGPEGPFDMDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLSWLSILAFKNKDNLEGDNKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 3031 - DNA, 2227 bp, Panicum virgatum
  misc_feature: Ceres CLONE 1788703
  misc_feature: Encodes the peptide sequence at SEQ ID NO. 3032
tcgccatggacgcgccctccgcgggctcctccacgatctagcgctgcgcgtcatgcggcggacctgaacggagcctgggcgtcggatgccgagagctggccgtctgcggggcacgatctggtgcggcgcggcgtcatggggaggaagcccgacgcggtagccaagccgcactactccgccggcggcgcctcctcgccgagggcggcgcggaaggcgccgccttccccggtgttcctggggaccgcgctgttcgttctagggttcgtgtccctgttcacggggcacgtggtcaccgacgcggactggtcgcggatccggagccggtggcgatccaggcaggttagaatctacgaaccaattgatatttggaaatcgaggtattccagcatctactatggttgcagtgggagaagcacaaatttcagatctgctgtgccggagaacagttccactggttacttgctgattgctactagcggggggctgaatcagcagcgcatagggattacagatgctgttgtggttgcctggattttgaatgccacacttgttgtacctgagttaaaccaccactcattctggaaggatgaaagcgacttctctgacatttttgacgtggactggttcatttcctacctatcaaaggatgtaaccattgttaaaaggatcccttatgaagtgatgttgtcaatggataaactcccatggaccatgcgagcgcctaggaaatcaatgcccgagttttacattgatgaagttttgccaatactcttgcgaaggcgagctttgcaattaacgaaatttgattataggctcactagtgagctcgatgaagatctgcaaaagctacgttgccgagcaaattttcatgcattaagatttacaaattccatacatactctgggtcagaaacttgtgcataagctgagactcatgagcccacgatatgttgcagttcacttgaggtttgaacctgacatgcttgcattttctggctgttactatggtggtggtgaaaaagaaagaaaggaactgggtgaaattaggaaacggtgggatacattacctgagttaagtgctgaggatgagcgcagcaggaggaaatgcccattgactcctcatgaagttggtttaatgctccgagctcttggttttggcaatgatacaaacctttatgttgcttctggagaaatatatggtggagaggaaacccttcaacctctcagagatctctttccgaatttctacaccaaggaggaccttgctggcaatgatttgaaaccattccttcctttttcttcacgtctggctgcaattgacttcatcgtttgtgatgaaagtgatgtcttcgttacgaataataatggaaacatggccaaggttttagctggccgaaggcgatacatgggccacaagagaactattcggccaaatgcgaagaaactcaatgtactgtttcagagacggaatcagatgggctgggatatgttttcgctgaaggtacagaaagtccagaggggtcttatgggagaaccggatgatatcagaccaaaacaggatgatttccatgaatttccatcagcatgcatctgcttaagaaaacctaggaacatatcggtcacaacttgaactgagagcttgagagcacatgaggtagacaagaggaggatgctactagttgtgcctgtgcttgctgcaatgggggaaagatatatttgctttgaaagaaacatggtggaattaagaggacaggccgacagggatgcctgatgtatattccaagacatagatgtcacgggggcatggtgcggtaaagatgaaagacgagctgcatggtaactgccacgtgaaggagagtttccatacaactggagatatgctatgcctgtaaattgttgcttatacacgatcgattctttgaatatggttggcctctgtacatgatcttctgtccaagtaaagcctcggggcagttacaattatctgcccagggcaaatggacaagtacaataacagaggcgaccctcatattttgcgatagctgtactctgttccccttagaagataactgcagtgcgttcttgttactcgattgtaagataaccaccgccacgccacatttacttttccctcctgtcttatgatcatgtaatataccagcaaggacagggctatatggtttatcgaaagcaatatttgtggtcgataaaaaaaaaaaaaaaaaaaa

SEQ ID NO: 3032 - protein, 497 aa, Panicum virgatum
  misc_feature: Ceres CLONE 1788703
  misc_feature: Great-hit functional homolog of the protein sequence given in SEQ ID NO 9302
  misc_feature: Useful for making plants with modulated nitrogen use efficiency
  misc_feature: Useful for making plants with modulated nitrogen use efficiency
MGRKPDAVAKPHYSAGGASSPRAARKAPPSPVFLGTALFVLGFVSLFTGHVVTDADWSRIRSRWRSRQVRIYEPIDIWKSRYSSIYYGCSGRSTNFRSAVPENSSTGYLLIATSGGLNQQRIGITDAVVVAWILNATLVVPELNHHSFWKDESDFSDIFDVDWFISYLSKDVTIVKRIPYEVMLSMDKLPWTMRAPRKSMPEFYIDEVLPILLRRRALQLTKFDYRLTSELDEDLQKLRCRANFHALRFTNSIHTLGQKLVHKLRLMSPRYVAVHLRFEPDMLAFSGCYYGGGEKERKELGEIRKRWDTLPELSAEDERSRRKCPLTPHEVGLMLRALGFGNDTNLYVASGEIYGGEETLQPLRDLFPNFYTKEDLAGNDLKPFLPFSSRLAAIDFIVCDESDVFVTNNNGNMAKVLAGRRRYMGHKRTIRPNAKKLNVLFQRRNQMGWDMFSLKVQKVQRGLMGEPDDIRPKQDDFHEFPSACICLRKPRNISVTT

SEQ ID NO: 3033 - DNA, 1621 bp, Panicum virgatum
  misc_feature: Ceres CLONE 1788773
  misc_feature: Encodes the peptide sequence at SEQ ID NO. 3034
aggccctcatcctcatctctgtcccccctttctcttctctctggctcggtcctcccttggtcttcctttcctgacggcgacgactgggcgggcggcggcgccattcctcacgtcttcgcccaaccctttgccctcaataagcatccacaggttgtgccgtccaaataacttgtgtcttactgcattgaactcgtctgtgcttggaatggcagcacccaagcccttttctcggcttatttcccatgtaattctagatttggatggcaccctcttgaacacagattctgttgtaagtaaggtggtaaagccatttcttgtcaaaaatgggaaaacgtgggatagcaagaaagcgcacaagctagttgggaagacaccttatgaagctgcagctgttgttttggaagactatggactcccttactctacagaagagttcctctcgatgattactccaatgttcagtgagcagtggtgcaacataaaacctcttccaggagctaattggctgataaaacatttaaggagtaacggggtgcctactgcattggcttcaaactcgccaagatctaatatagaagccaaaatttcctgccatcagggttggaaagagtctttctctgcaattgttggtggagatgaagtggagaaggggaagccatccccagatatattttgggaagctgcaaaaagaatgaacaccactccttcaaattgtctagtaatcgaggattccttgccaggtgttacagctggaaaagctgcgggaatgcatgtcatagctgtaccatcagtgcccaaaaagactgctgagttcagcactgctgatgaggtgatcaattccctccttgatgtaaagcctgaaaactggggtttgccaccatttaaagattggattgaaggcaccttaccaatagaaccatggtttatcggtggacctgtgatcaaaggatttggccgtggttctaaagtactaggaataccaacagccaatttgcccgcagagaacttttctgatgtagtgtcagagcatacgtcaggggtatactttggctgggctggactttcaacacgtggtgtatataagatggttatgagcattggctggaatccatattttgacaacactgagaagacagtagagccttggttgcttcatgattttggtgaggacttctatggtgaggagctgcgccttgccattgttggctacataagacccgaggccaactttccttctctcgagagcttgatagagaggattcatgaggatggaagaatagcagagaaggcactagacttaccaatgtatgctaagtataaagactcgccatatttgagaaaccctttgcagcaatgaagtactactgatgggagccaggctgaactgaattccaagtgagagcaggagggcaaataagttgtcgcttattgttctgtttgtgatagaaggaaatacattggtgttgatgcagaaaagattggcctcttgttggttctttccacttccactttttggaagcagtggtagttgactatattactgttcctcaaagacgtgtgctgaactgctgatacccttctaaagaaaaaggtttgatgttaaaaaaaaaaaaaaaaaaaa

SEQ ID NO: 3034 - protein, 383 aa, Panicum virgatum
  misc_feature: Ceres CLONE 1788773
  misc_feature (1)..(186): Pfam Name: Hydrolase Pfam Description: haloacid dehalogenase-like hydrolase
  misc_feature (1)..(131): Pfam Name: Flavokinase Pfam Description: Riboflavin kinase
  misc_feature (238)..(378): SWISSPROT Homolog: EC 2.7.1.26 Riboflavin kinase
MAAPKPFSRLISHVILDLDGTLLNTDSVVSKVVKPFLVKNGKTWDSKKAHKLVGKTPYEAAAVVLEDYGLPYSTEEFLSMITPMFSEQWCNIKPLPGANWLIKHLRSNGVPTALASNSPRSNIEAKISCHQGWKESFSAIVGGDEVEKGKPSPDIFWEAAKRMNTTPSNCLVIEDSLPGVTAGKAAGMHVIAVPSVPKKTAEFSTADEVINSLLDVKPENWGLPPFKDWIEGTLPIEPWFIGGPVIKGFGRGSKVLGIPTANLPAENFSDVVSEHTSGVYFGWAGLSTRGVYKMVMSIGWNPYFDNTEKTVEPWLLHDFGEDFYGEELRLAIVGYIRPEANFPSLESLIERIHEDGRIAEKALDLPMYAKYKDSPYLRNPLQQ

SEQ ID NO: 3035 - DNA, 1968 bp, Panicum virgatum
  misc_feature: Ceres CLONE 1788775
  misc_feature: Encodes the peptide sequence at SEQ ID NO. 3036
aagggagcagccgctgcggagcagagtgtcgcgctgccgccgcggtaaaaacaggggaggagggagagacgcggccgcacccgcacatgctttaagtcccactccccaccgccccagatctccgccctcctccctctgccccccacattccccggcgcgccacctctgcccgcggccgccgccgctgtccggagcgagatcggcgtgggtgcacgggcgcagctcctgtatctgtcggtgggagaccccgcgcgtgtcggtgggagcgggtggggaggaagcgaaggatggcggcgggcggcagatccgtcgcgtgctgcaccgccgtgctgctcgcggccgcgctgctcctctccgcgccgactgccacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactaccgaacagggtgactgctcgaaattcaagggcaacactccccactgctgcaagaaagatcccacgatcgtcgatttacttccgggcactccatacaacatgcaaattgccaattgctgcaaagcaggagttataaatacatttaatcaggacccagcaaatgctgcttcctccttccagattagtgtaggtcttgctgggactaccaataagactgttaaggtgccgaagaacttcactcttaagactccaggtcctgggtacacctgtgggcgtgccattgttggcaggccgacaaagtttttcacctcggatggacgcagggcaacccaagctctaatgacgtggaatgtgacttgcacatattcccaatttctagcccagaagactccgtcctgctgtgtatctctctcatcattttacaatgacacaattgtgaactgcccaacatgctcttgtggctgccaaaatccaagtggctccaactgtgtgaatgaggattcaccgaatctacaatctgcaattgatggccctgggaaatggactggtcagcctcttgtacaatgcacctcccacatgtgcccgataagaatccactggcatgtgaagctcaattacaaggaatactggagagtgaaaatcactatcacaaacttcaacttccgcatgaattacacgcagtggaacttagtcgttcagcatccaaactttgataatatcactcagctgttcagtttcaactacaaaccacttaccccatatggtggtggcataaatgatacggcaatgttctggggtgtaaaattctacaacgatttgctgatgcaagctggtaaacttgggaatgtgcaatcagaactacttcttcgcaaggactcccaggctttcaccttcgaaaagggatgggccttcccacgccgagtgtacttcaatggtgataactgtgtcatgccatctcctgaaaattatccatggctgcccaatgcaagccctctaacaaaacaaccattgacactcccactcttagtattctgggttgtgttggctactctgttggcttatgcgtgatgagtgggatcaagagatttagcgagcttcaagttgatgtcagattccatgaggtgcactgcagcaggccatttgttcattcacttccatggttgcacagaagagatgacaccacgccgagaaaagaaagtttatatgtgtgtgtgtttttggaagttaaggcccaaaatgtatttcttgtctggtatatactggccccacagcactttggtgaacttagttactgcaaattaggtaattacagttgcaccttttgtattttatagcaaactcagaatttttcattgaattatgactgctcttcttgtagcaaaaaaaaaaaaaaaaaaaa

SEQ ID NO: 3036 - protein, 449 aa, Panicum virgatum
  misc_feature: Ceres CLONE 1788775
  misc_feature (1)..(165): Pfam Name: Phytochel_synth Pfam Description: Phytochelatin synthetase-like conserved region
MAAGGRSVACCTAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLLVFWVVLATLLAYA

SEQ ID NO: 3037 - DNA, 1597 bp, Panicum virgatum
  misc_feature: Ceres CLONE 1788776
  misc_feature: Encodes the peptide sequence at SEQ ID NO. 3038
aattcactccggaggagaaacgcatcctacgctcgcgagcccacaatggcgacgagaagaattccgcgtcctgcggccgtggcggtggcgctgtgcgcggcggcgctgctggcggcgtgcgccggcgcgtcccgggcggggtgccggaagcacgtggcgaagatcacggattacggcgccgtcggggacgggaagacgctcaacacggcggcgttcgccaaggcggtggcggacctgtcggcgcgcgcgcggcgcggcggcgcggcgctggtggtgcccccggggaaatggctcacggggcccttcaacctcaccagccacttcaccctctacctcgacgagggcgccgagatcctcgcgtcccaggacatgaaagattggcccctcatagctcccctgccgtcttacgggagaggaagggacgagcctggcccaagatacagcaatttcattgcaggatccaatcttactgacgtcataatcactggtaaaaatgggactatcaacgggcaggggcaagtctggtgggacaagtaccatgccaaggagctccagttcacccgtggctacctcctcgagctcctctactctgacaacatcatcatctccaatgtcaccttcgtcgactcgccgtcatggaacctccaccctacctactgcaccaatgtgaccatcagtggcgtcaccattctcgcgccggtgcattcaccaaacaccgatggcattgaccctgattcttcctcgcatgtcaagatcgaggactgctacatcgtctccggcgacgactgcatcgccgtgaagagcggctgggaccagtacggcatcaagttcaacatgccgagccagcacatcgtgatcaggaggctcacctgcatctcccccacgagcgccatgatcgcgctgggcagcgagatgtccggcggcatccgcgacgtgcgcgccgaggacaacgtcgccatcagcacggagtccgctgtcagggtcaagtccggcgtggggaggggcggcttcgtcaaggacatcttcgtgcgccgcctcagcctccacaccatgaagtgggtgttctggatgacgggcaactacggccagcacccggacaactcgtccgaccccaacgccatgcccgaggtcaccggcatcaactacagcgacgtgttcgccgagaacgtgaccatggccggcaggatggagggcatccccaacgacccctacaccggcatctgcatatccaacgtcaccgcgcagctcgccccggacgccaaggagctgcaatggaactgcaccaacatcaagggggtcacctccgccgtgacgcccaagccgtgcccggagctcggggcggagggcaagccctgcgccttcccggaggaagagctcatcatcggcccgcacaaattgcccaagtgtacctactaactaatggtagtttgccgaatgaggtcatatacaagctcagcgatagtctagacaaacaaatgtgaaaaatgcagctgaaataatatagttctattctatccccaaaataatatccatttacacaacgtttccatttcttatgccaccagtgactcgaaatcatggtatcagaaatttctgg

SEQ ID NO: 3038 - protein, 456 aa, Panicum virgatum
  misc_feature: Ceres CLONE 1788776
  misc_feature: Great-hit functional homolog of the protein sequence encoded by LOCUS At3g48950
  misc_feature (1)..(194): Pfam Name: Glyco_hydro_28 Pfam Description: Glycosyl hydrolases family 28
  misc_feature: Useful for making plants with altered cell wall content and/or composition
MATRRIPRPAAVAVALCAAALLAACAGASRAGCRKHVAKITDYGAVGDGKTLNTAAFAKAVADLSARARRGGAALVVPPGKWLTGPFNLTSHFTLYLDEGAEILASQDMKDWPLIAPLPSYGRGRDEPGPRYSNFIAGSNLTDVIITGKNGTINGQGQVWWDKYHAKELQFTRGYLLELLYSDNIIISNVTFVDSPSWNLHPTYCTNVTISGVTILAPVHSPNTDGIDPDSSSHVKIEDCYIVSGDDCIAVKSGWDQYGIKFNMPSQHIVIRRLTCISPTSAMIALGSEMSGGIRDVRAEDNVAISTESAVRVKSGVGRGGFVKDIFVRRLSLHTMKWVFWMTGNYGQHPDNSSDPNAMPEVTGINYSDVFAENVTMAGRMEGIPNDPYTGICISNVTAQLAPDAKELQWNCTNIKGVTSAVTPKPCPELGAEGKPCAFPEEELIIGPHKLPKCTY

SEQ ID NO: 3039 - DNA, 1374 bp, Panicum virgatum
  misc_feature: Ceres CLONE 1788780
  misc_feature: Encodes the peptide sequence at SEQ ID NO. 3040
gtcctcgtccccgctccagcctgccttggttggccgccccgctcgctaatcccaccggtcattgggcggttactggctgattaagttggcggcgaggtcggggggcgcgatggcgtcggagccggtggcgcgggcggtggcggaggaggtggtgcggtgggggagcatgaagccgacgggggtcagcctgcgctacatgatggagttcggctcgagccccacccagcgcaacctgctcctctccgcgcagttcctgcacaaggagctccccatccgcatcgcgcgccgcgcgctcgagctcgactcgctgcccttcgggctctccaacaagcccgccatcctcaagatgattaaaatggtcaaggtgcggcacaataatgtggttccaacaatggctttgggagtgcagcagctgaaaaaccaactgtgccgcacaaggaaggttccctctggattcgacgagatccacgagttccttgatcgattctacttgtcaaggatcggcatccgcatgctgatagggcagcatgtggctttgcatgatcctgaaccagagcctggtgtcataggcctcattaatacaagattgtcccccatacaggtggctcaagctgctagcgaagatgcccgtgctatttgtttaaggacatatggatcagctcctgatattaacatttatggtgatccgacttttacatttccatatgtcgcatcacacctctatctgatgttatttgaattggtgaagaactcccttcgtgcagtgcaagaacgatatatgaattctgataaagatgtgcccccagttagaattatagttgctgatggagaagaggatgttactatcaaggttagtgatgaggggggtgggataccaagaagtggcctcccaaaaattttcacacatctgtatagcactgcaaagaatccacctgatctagatggacctaatgaaggagcaactatggccggatatggtttcgggctcccaatcagccgcctttatgctcggtattttggtggcgacttgcaaattatttctatggaaggatatggtaccgacgcttacctccacttgtcacgtctgggagattcagaggagcccctgccttgatgacttgatttgatgtgctgacacgaccctcttcctgtaattagtctgcccttcttcttgtaatagaatccagtgctggtctgcaaatattggcctaatgggccagccacctatagctatagttggttgctactccgtatcttctagctctgctgcattgcgagcacaagcactcctacttcctctgatccttcttccaggtttcagaaaaatagtatgattataatctctcatcctcccaaaaaaaaaaaaaaaaaaaa

SEQ ID NO: 3040 - protein, 334 aa, Panicum virgatum
  misc_feature: Ceres CLONE 1788780
  misc_feature (1)..(128): Pfam Name: HATPase_c Pfam Description: Histidine kinase-, DNA gyrase B-, and HSP90-like ATPase
MASEPVARAVAEEVVRWGSMKPTGVSLRYMMEFGSSPTQRNLLLSAQFLHKELPIRIARRALELDSLPFGLSNKPAILKMIKMVKVRHNNVVPTMALGVQQLKNQLCRTRKVPSGFDEIHEFLDRFYLSRIGIRMLIGQHVALHDPEPEPGVIGLINTRLSPIQVAQAASEDARAICLRTYGSAPDINIYGDPTFTFPYVASHLYLMLFELVKNSLRAVQERYMNSDKDVPPVRIIVADGEEDVTIKVSDEGGGIPRSGLPKIFTHLYSTAKNPPDLDGPNEGATMAGYGFGLPISRLYARYFGGDLQIISMEGYGTDAYLHLSRLGDSEEPLP

SEQ ID NO: 3041 - DNA, 1604 bp, Panicum virgatum
  misc_feature: Ceres CLONE 1788782
  misc_feature: Encodes the peptide sequence at SEQ ID NO. 3042
aatttctttccgccgcgactcgcggcgcccgccggtgcgcgcgcgtccgcaaccgccaccaccgccttcccactcccaaatagtagtaatagtcttcctgccactttcctcatccctgtcttgcttgccacctcccctcccctcccctctgctgctctctgcactcccctgccgccctgcggcgtttgcttcacctgctgctgccgcccgtcggccgtcggcagcctccagtcaccaccccgtccggcgtcggctgtccctcccgcgagacggcgagaggacgcgtgtccaagctaggctggcggcaccttggtccgcgtcgcatggacgcccgcatcgccgccaaccgggtgcctgcctaaccggccgatttccttccttgcgtagctccattcaaccgcacaaatagcgcgcggctttcccaattcccgtcccgtggctctccttccgagatctttgccacttcgtgggtcttgtagcggctgggggtgatggagtggggggacagggccaaggctgccgcggcagcggacgagagggccggaggtggggaagggctcggggggtacgtcaaggtgatgaccgacgagcagatggaggtgctccgcaagcagatctccatctacgccaccatctgcgagcagctcgtcgagatgcaccgcaccctcaccgagcaccaggactccattgcaggaatgaggttcagtaatctgtactgtgatcctttaattattcctggaggtcacaagatcacagcaaggcaacgatggcaaccaacaccgatgcagctgcagatccttgagaacatatttgaccaaggcaatggaacaccaagcaagcaaaagataaaggagataacagcagagctctcacaccatggccagatctctgagacaaatgtctataactggtttcagaacagacgggcacggtcgaagcggaagcaggctgctgctttacctaataataacacagaatctgaagctgaagtggatgaggaggccctaaccgacaagaagccgaagtcagataggctgctccatgagaacaaagctatgagtgttcacactgagaggatctcagggatgcaccactttgatgcagatcatgatcaaatcggtggcatgatgtacggatccagtgaaaacagcatgagatcgtctggcaattctggccacatgtccttctatgaaaacatcatgtcgaatccaagaatcgaccatttcccggggaaggtggagagctcccggagcttctcacatctccagcatggggaaggctttgacatgtttggatgacatgtctcggcactgagttaccctgtaaaaagtgattgctgacagcattcgcccaattcgctgacatgaaagttcatcctgagcgacactgtgttgcttgccatggtctgttttaaccaaccgccagatggaagctagctctcctggaacctacttgttggaataggtgtaagaagttgatatatagtatttgcccgtagtctatcatacgctaaaatatttccatgtaatcccttcacgtttgcaaatttagcatgagactgtcgtatgctgtgcggcagcttctaaaaaaaaaaaaaaaaaaaa

SEQ ID NO: 3042 - protein, 268 aa, Panicum virgatum
  misc_feature: Ceres CLONE 1788782
  misc_feature: Great-hit functional homolog of the protein sequence given in SEQ ID NO 9233
  misc_feature (1)..(62): Pfam Name: Homeobox Pfam Description: Homeobox domain
  misc_feature: Useful for making plants with altered Lignin content
  misc_feature: Useful for making plants with modulated nitrogen use efficiency
MEWGDRAKAAAAADERAGGGEGLGGYVKVMTDEQMEVLRKQISIYATICEQLVEMHRTLTEHQDSIAGMRFSNLYCDPLIIPGGHKITARQRWQPTPMQLQILENIFDQGNGTPSKQKIKEITAELSHHGQISETNVYNWFQNRRARSKRKQAAALPNNNTESEAEVDEEALTDKKPKSDRLLHENKAMSVHTERISGMHHFDADHDQIGGMMYGSSENSMRSSGNSGHMSFYENIMSNPRIDHFPGKVESSRSFSHLQHGEGFDMFG

SEQ ID NO: 3043 - DNA, 1806 bp, Panicum virgatum
  misc_feature: Ceres CLONE 1788803
  misc_feature: Encodes the peptide sequence at SEQ ID NO. 3044
aatgacttcaggttctccgcatccggtcccccgctacttcctgtaactgcagttaggcccctctgacacttcggtcccgtttcttggaggtggccgcagctctccggcggaaggcggcggagatggcttcggcgacggcttcggcggcgcagtgcttcagctcctactcctcgtccccggccacgtgggctctgcggcagcgcggtggcgcccgggtgcttcagctctcttcccggcggagcttctgcgtctccgcggcagccggcggattcgacaaccagaaccgcgagtatgtgatcgtcggcggagggaacgcggcggggtacgcggccaggacgttcgtcgagcatggcatggctgatggccgcctctgcatcgtctccaaggagccagttccaccatatgagcggccagcattgaccaaaggctatctctttcctccggacaagaagccggcacgcctacctggttttcatacatgtgttggatctggtggacagcgacagactgctgaatggtacaaggagaatggtatagaggtgttgtatgaggatccagttgtagcatttgatggcaaaacacagaccttgaaaacttcgtcagggaaaattctgaagtatggctcacttattatttctactggctgcgaagcttcaagattacctgagaaaattggagggaaattaccaggagttcactacatacgtgatgttgctgatgctgattctctagtatcctcactgggaagtgcaaaaaaagttcttgtcattggcggaggttatattggcatggaggtagctgcagcagcttgtggttggaatcttgacacaactattgtattcccagaggaccacattatgccaagattatttacaccttcccttgctaagaagtatgaggatctgtatcagcaaaatggtgtcaaattcattaagggagctctaatcgacaaacttgaagctggctctgatggaagggtgtcttctgctgtacttaaggatggatctgtagttgaaacagatacagtaattgttggcataggagcaaaaccagttgttgggccctttgaagctgttggagtcaaccctgaagttggtggaatagaggttgattccttgttcagaactagcgtacctggcatctttgctatcggagatgtagcagcatttcccctgaagatgtacaatagaattgctcgagtggagcatgtggatcatgctcggaaatctgcacaccactgtgttgaaacacttctaacatcccagacaaaagcgtatgattaccttccatatttctactcaagagtttttgagtatgaaggaagttcaagaaaagtttggtggcagttttatggcgataacgttggtgaaacagttgaagtagggaactttgatccaaaggttgctactttctggattgactcagatagtcgactgaagggtgttttccttgagagtggaacctcagaggaattctcgcttcttccacaactcgccaagtctcagcccattgttgacaaatctaagctccaggccggggcttctgttgaagatgcattagagatcgcaagaagctctcttcagtctggtgcttcggtttagctctcgacatctaggaactacttcttggcctgcgtcctggcgctgtcatattttgaatcatcaagaccacatcatcaataacaattccgtagcattcatttccacgggattgtgatattcttactgtacctgtaattgccatttccttcttgaaataaacttgatcaccctttgaggggttgacgaaaaaaaaaaaaaaaaaaaa

SEQ ID NO: 3044 - protein, 492 aa, Panicum virgatum
  misc_feature: Ceres CLONE 1788803
  misc_feature (1)..(296): Pfam Name: Pyr_redox_2 Pfam Description: Pyridine nucleotide-disulphide oxidoreductase
  misc_feature (1)..(488): SWISSPROT Homolog: EC 1.6.5.4 Monodehydroascorbate reductase, chloroplast precursor
MASATASAAQCFSSYSSSPATWALRQRGGARVLQLSSRRSFCVSAAAGGFDNQNREYVIVGGGNAAGYAARTFVEHGMADGRLCIVSKEPVPPYERPALTKGYLFPPDKKPARLPGFHTCVGSGGQRQTAEWYKENGIEVLYEDPVVAFDGKTQTLKTSSGKILKYGSLIISTGCEASRLPEKIGGKLPGVHYIRDVADADSLVSSLGSAKKVLVIGGGYIGMEVAAAACGWNLDTTIVFPEDHIMPRLFTPSLAKKYEDLYQQNGVKFIKGALIDKLEAGSDGRVSSAVLKDGSVVETDTVIVGIGAKPVVGPFEAVGVNPEVGGIEVDSLFRTSVPGIFAIGDVAAFPLKMYNRIARVEHVDHARKSAHHCVETLLTSQTKAYDYLPYFYSRVFEYEGSSRKVWWQFYGDNVGETVEVGNFDPKVATFWIDSDSRLKGVFLESGTSEEFSLLPQLAKSQPIVDKSKLQAGASVEDALEIARSSLQSGASV

SEQ ID NO: 3045 - DNA, 1674 bp, Panicum virgatum
  misc_feature: Ceres CLONE 1788804
  misc_feature: Encodes the peptide sequence at SEQ ID NO. 3046
aaatttgctttgcctccccaccaccaccgcttcgctgctgcggtccgtctatagctgataagctagctagttaggccgcgcttaattgggtgacagccagccgcggcgcggaagagcgagggaagcgatcgacacgaggccggcggctctagctcgggggtcgaggagagctagctgggcagcaggtgcagcggtggttttggtttaggtttctcctatcgatggggtcgtcggcggaccacggcggcgccggcgggaggggcaagaagcaggggtcgcagctgtggaagaaggcgctgctgcattcttgcctctgcttcgtcatgggcttcttcaccggcttcgcgccgtcgtccgtctccgactggacgtccgcggcggtctcggcgggcggggtgagcagcagccacgtcgtccgggcgctgcagacggccgcgggcggggccgtcaaccggagcctgctggcgcacggcggcagcgtcggcggcgcgggcctgctcgacgcggcgaccccgcggccgctgctggtggtcgtcacgacgacggagtcggcgcccgccgcgtccggggagcgcgccgcggcgctgacgcggatggcgcacacgctgcggctggcgccgccgccgctgctgtgggtggtggtggaggccgccccggacgtgccggccacggcgcggctgctgcgcgccacggggctcatgtaccggcacctgacgtacaaggacaacttcacggccgccgacgccgccgcgggcaaggagcggcaccaccagcggaacgtcgcgctcggccacatcgagcaccaccgcctcgccggcgtcgtcctcttcgccggcctcggcgacgtcttcgacctccggttcttcgaccagctccgccagatcagcgcgttcggcgcgtggccggtggcgacgatggcgcgaggcgagcggaaggtcgtggtccggggccccgcgtgcagcgcgtccgcggtcgccggctggttctcccgggactacggcgccaacggcacggcggcggccacgacggcgaggccccccgaggtggacgcccacggcttcgccttcaacagctccgtgctctgggaccccgagcgctggggccgctacccgacctccgagcccgacaagtcccaggactcgatgaagttcgtccagcaagtggttctggaagattttagcaaggtgaagggcattccttccgattgttcagaggtcatggtatggcatgtcgattcgacggccccttcttcctcttcttagcagccatctctggagaacaagagaagatagaaagggtgattatagaagaggtcaatggacgagctggaggacggcctcagagtggtgtacattgtacatgcatagctacaccatcgaggcgctggttgccttcaagctgcaaagaagggaaattttgggtttctcaccaggggatggatcaacccctgaccccagttctccatcatattgtacaattttccactattctttttcttaaaaatttgtgatatatgtatatttttttctttttttcaagagggtttaggtgaatacatacataatacccccttgatgtgtctctcaaggctgtaatgaaatagagggcaagctaaaaatccacttaacaatgatgatacacattgtgctcttttaaaaaaaaaaaaaaaaaaaa

SEQ ID NO: 3046 - protein, 346 aa, Panicum virgatum
  misc_feature: Ceres CLONE 1788804
  misc_feature (1)..(228): Pfam Name: Glyco_transf_43 Pfam Description: Glycosyltransferase family 43
MGSSADHGGAGGRGKKQGSQLWKKALLHSCLCFVMGFFTGFAPSSVSDWTSAAVSAGGVSSSHVVRALQTAAGGAVNRSLLAHGGSVGGAGLLDAATPRPLLVVVTTTESAPAASGERAAALTRMAHTLRLAPPPLLWVVVEAAPDVPATARLLRATGLMYRHLTYKDNFTAADAAAGKERHHQRNVALGHIEHHRLAGVVLFAGLGDVFDLRFFDQLRQISAFGAWPVATMARGERKVVVRGPACSASAVAGWFSRDYGANGTAAATTARPPEVDAHGFAFNSSVLWDPERWGRYPTSEPDKSQDSMKFVQQVVLEDFSKVKGIPSDCSEVMVWHVDSTAPSSSS

SEQ ID NO: 3047 - DNA, 1955 bp, Panicum virgatum
  misc_feature: Ceres CLONE 1788837
  misc_feature: Encodes the peptide sequence at SEQ ID NO. 3048
atcgcgaggtggcgcaaggcgagggcagcacggaggcaacgccgtcttcagcgctcgggaaccgccgccgccgccgttgtccacgctcgggagctgccacaccgctgccgtccgtgctcgtcctccgccttctgtcctcggccgcctccgccgtcgtccgcgctcggtggcccccgtcttccgtgctcggccgcctccgccgtcgtccgcgcttggcggcccccgtcttccgtgctcggccgccgccacaacccatccttacctcgtcctccgccaactgcgatgtagcgttgtattgcgagtgaacacaataccactgagttgacaaatcacaagaagatggctgaactctactcttatttcagtcagctgttgcaatcttgcggagaaacaaagaactatacatggtgaaacaatacgggggaactcgatgctttagagtaacggaaagtgaaaaatatggcctacctttttctcacgatctctacatatcagggcatgcatgggtcaactacagatctctcattgaccattactaccagtatctcctctggactccggcggggggcgagagagagggcggcggcggcgctggctgttccgaggctgatggcgaggggcgcgacggcgggactgcttctgcttctgctcctcgcggcgctcctggcctccgcttctcccgcggcggcggcggaggggcgagggcgacgagtgcttaggacgaagcattctggtgctggttatcattacaaccatactctcgctcatattcttgtcgaatatgcatctgctgtctatacatctgacttaacgtcactgttcgcgtggacatgtccaaggtgcaaaggtcacacaaagggttttaaggtgatagaggtcattgtagatgtggagaactgcttacaggcatttgttggagttgcccctgacccacggtctgtaatcgttgcatttagaggcactcaagaacacagcatttcaaattggattgaagatctcttctggaagcagctcgatgtgacttatccaggcatgcctgatgcaatggtccatcatggcttttattctgcatattataatacaactctgcgacatgagatattgaaatctattcaatgggcatggaagacatatggaaaactacccataaatgttgtgggtcactccatgggaggggccttagcttcattttgtgcccttgatctttctgttaagtttggatcacaagtagttgagctcatgacttttggacagcctcggataggcaatcctgcttttgctgcatactttagtgctcaagttccaagaacaatccgcgtgacccaccagaatgatattgtgccacatttaccaccgtactattattacctaggtgaatggacgtatcaccactttgctagagaggtttggcttcatgtgatcatagatgggaatttggttaccagaaatgtgacaatctgtgatggttccggtgaggacccaacctgcagcaggtcagtctacgggataagtgtagcagatcatcttgagtactatggcgtcacactgcatgctgattcaaggggaacctgtcaatttgtgatgggtgcagccaactcagtatacagctatgttcgtgaagtcgatggagccatcatcttgtcaatatatccgcaagacccatacgctctagaatctatgtgaatttgtatgccacaaaatacacacctgtacagtattttattttcatttttgtgtacagctcatgaaatactactgggcactcccagagctctcctgaggataaggagaggttcgccttttaaatgtgccccctttcgctcaagtgagaattgtacatgtaagctccataacattgtacgcacgcttcaattgatgcacataaaaaaaatgtttgatgctacccttgttcggttttttaaaaaaaaaaaaaacaaaaaaaaaaaaaaaaaaaa

SEQ ID NO: 3048 - protein, 407 aa, Panicum virgatum
  misc_feature: Ceres CLONE 1788837
  misc_feature (1)..(140): Pfam Name: Lipase_3 Pfam Description: Lipase (class 3)
MAYLFLTISTYQGMHGSTTDLSLTITTSISSGLRRGARERAAAALAVPRLMARGATAGLLLLLLLAALLASASPAAAAEGRGRRVLRTKHSGAGYHYNHTLAHILVEYASAVYTSDLTSLFAWTCPRCKGHTKGFKVIEVIVDVENCLQAFVGVAPDPRSVIVAFRGTQEHSISNWIEDLFWKQLDVTYPGMPDAMVHHGFYSAYYNTTLRHEILKSIQWAWKTYGKLPINVVGHSMGGALASFCALDLSVKFGSQVVELMTFGQPRIGNPAFAAYFSAQVPRTIRVTHQNDIVPHLPPYYYYLGEWTYHHFAREVWLHVIIDGNLVTRNVTICDGSGEDPTCSRSVYGISVADHLEYYGVTLHADSRGTCQFVMGAANSVYSYVREVDGAIILSIYPQDPYALESM

SEQ ID NO: 3049 - DNA, 1743 bp, Panicum virgatum
  misc_feature: Ceres CLONE 1788850
  misc_feature: Encodes the peptide sequence at SEQ ID NO. 3050
cttggtgttccttttctggcggcgaccactgggccagcggcagcgccattcgtcacgaattcgcccggccctttgccggcgaggagcatccaccaggtggattgtctgatctgattcttagaaaattgggttggactctacatgtcaagaaggtatggcaccaggaagcaaggcagagagaaaagcagcattagatgctggggcatggatgttcaatgttgtaacatcagttggtatcatcatggtcaacaaagccttgatggcaacacatggttttagttttgctacaacactgactggacttcactttgcaaccacaaccttgatgacacaagtaatgaaatggcttggatatattcagccatcctatttgccattactggaactagtaaagtttgtcttttttgcaaacctatccatcgttggaatgaatgttagtttgatgtggaactcggttggattctatcagattgcgaagttgtgtatcattccagttttgtgcattctggaaatcctatttgacaaagtccgttactcgatagatacaaagctcagtatagtgcttgtcctggtaggggttgctgtatgtactgtgactgatgttagtgtgaactctcaagggttattagcggcagtaatagctgtttggagcacagccctacaacagcattatgttcatcaccttcagcgaaagtactcgctcggttcatttaacctcttaggtcatactgctcctgctcaggcagcatcactgttagtattgggcccttttgtggacttctggctgaccaacaaaagagttgatacttttaactacacatcaatagttacgttcttcattgtgctgtcatgcataattgctgttggcaccaacctaagccaattcatatgcatcggaagattcacagctgtctcattccaagttctaggccacatgaagacgattctcgtgttgaccttggggttccttttctttggcaaagagggcctcaatttccatgtcgcccttggcatgcttctggctgtcatcggcatgatttggtatgggaacgcgtcgtcgaaacctggagggaaagagcgccaggtttactcaacaccaagtgagaaaactcagaagcacgggatactgtcctcgcagtctgagcttgatcagaaagtttgaaacgtgaacagcaaagccatattgtgcttcttgagcgttcatcggcctaatttattctttttatacgtttttagggacatgtttctatagaattgtagggcacagcagaaacagagtacctgggcaaaaagcccaaggctatacttttgcagcaaatatgtcaacatctgagctggcagatacatgttatgtaatagtcattctgtgattgcatgttttcgctctcaatctggcatgttcagtatgttttcggtgttccttttcctattccatggagaagtgtggtgcagcgaggggcttgccgggcgtgcaaggcggacgaccaggagttgctgcgctcatggctcatcacaacagttggccgggcagccccgtctcctaatgtattataaactggggcgcaccgttggtgcgccagtttgagctgtccagtggatgccgtgtgatagtataagcgcaagctatgttttgtaaatttaaaaggctatgtagttattgggaattatttgggaacgacctgatttttaatttttatttgtattgtatgaaactttgaatattaaaaaaaaaaaaaaaaaaaa

SEQ ID NO: 3050 - protein, 335 aa, Panicum virgatum
  misc_feature: Ceres CLONE 1788850
  misc_feature (1)..(144): Pfam Name: TPT Pfam Description: Triose-phosphate Transporter family
MAPGSKAERKAALDAGAWMFNVVTSVGIIMVNKALMATHGFSFATTLTGLHFATTTLMTQVMKWLGYIQPSYLPLLELVKFVFFANLSIVGMNVSLMWNSVGFYQIAKLCIIPVLCILEILFDKVRYSIDTKLSIVLVLVGVAVCTVTDVSVNSQGLLAAVIAVWSTALQQHYVHHLQRKYSLGSFNLLGHTAPAQAASLLVLGPFVDFWLTNKRVDTFNYTSIVTFFIVLSCIIAVGTNLSQFICIGRFTAVSFQVLGHMKTILVLTLGFLFFGKEGLNFHVALGMLLAVIGMIWYGNASSKPGGKERQVYSTPSEKTQKHGILSSQSELDQKV

SEQ ID NO: 3051 - DNA, 2606 bp, Panicum virgatum
  misc_feature: Ceres CLONE 1788860
  misc_feature: Encodes the peptide sequence at SEQ ID NO. 3052
acctctcctcactcgagctcacgccaccaagaatctttcactcttctctcttcttccccctcctctcctgacctccctccctcctcccctttctctctcttcttgagagtgaagcggaggagcatcgcggctgggcgagcgagtgatggcatggggagcttgcattgctgctctgcccctgctgcttctgcttcttcttcttgctgccgcggcagcaggtggtaatggcggcgtgcattgcctggaggaggggagccggagccggagcaggagagccttgcaggggaggcaccaccacctgaggtcaagagcagtgggtggcgccacggtgctcgagctgcggcaccacagcttcagctcggcgccgagcaagagccgggaggaggaggccgacgccctcctgtcctccgacgccgcgcgcgtcgcgtcgctgcaacggcgcatcgagaactacaggctgatcgggtcgtcgtcggcggcggcggcggcggcggcgtccaataataaggcgcaggttcccgtcacctccggcgcgaagctccggacgctcaactacgtggccaccgtcgggctgggcggcggcgaggccacggtgatcgtggacacggccagcgagctgacctgggtgcagtgcgcgccgtgcgactcgtgccacgaccaacaggagcccctcttcgacccgtcctcgtcgccgtcctacgccgcggtgccgtgcgactcgccctcctgcgacgcgctgcgggtggccacgggcatgtcggggcccccgtccccggcgtgcggcggcggcgccggccggcccgcctgcagctacacgctcagctaccgcgacggctcctactcccgcggcgtcctggcgcgcgacaagctgagcctcgccggcgaggccatcgacggcttcgtcttcggctgcggcagcagcaaccagggcgcgccgttcggcggcgcctccggcctcatggcgctcggccggagccagctctcgctcgtctcccagaccgcggaccagttcggcggcgtcttctcctactgcctgccgctcagggactccggctcgtcgggctcgctggtgctcggcgacgactcgtcggtgtaccggaactcgaccccgatcgcgtacacccccatggtgtccgaccctctgcaggggccgttctacttcctcaacctcaccgggatcacggtcggcggccgggaggtgggctccccgggcttcccggccggcaaggtgatcgtcgactccgggaccgtgatcaccagcctcgcgccgtccatctacagcgccgtgagggccgagttcctgagccagctgggcgagtacccgccggcgccggccttctccatcctcgacacctgcttcaacatgacggggtccggggaggtgcaggtgcccagcctgaggctcgtgttcgacggcggcgtggaggtggaggtggactcgggcggcgtgctgtacctggtcagcagcgacgcctcccaggtgtgcctggccatggccgccctgaggtccgagtacgagacctccatcatcggcaactaccagcagaagaacctgagggtcatcttcgacaccgcggcgtctcagtaccatgaattggacagcgctgccagcggcatgctatcgaattcgtcggtgtccgtctgccgcagggcgagtgaggccgcctgcacctgccgcagtaggctgcagtagcacatttggggcacgaggtgaggaggctgtcgcgagacgttgtcacaccaagtactgtacttgtggagttgctgctggtgccgtagtcgaagaatgatggccgcgaactacgatgcttcacggtgaggatactgtaccaatgtctcttctctcctcatctgtatcaggtggagcaaggaacgaggatactgtgctactatctcttctctcctcatctgtatcaggtggagcagggaatagcgtatctggttacatcagtgttcgttgcacgtcaggtgcttgagcaaatgccaatatgctatgaacttagtgagttgatgcacaccgacacaatggaaagggtgagctacgccgagagtggatgttgtagcctagcaaacatggcaggcagattagtgtgttgactgttgaccatcatcatttcttactcgttgtgtatgtgtgcttttggtggatgattagatgaatcatcactgatgcatgatcagtgtttgggtaaatatccccatgttgagttgacacagaaggtgcaagaggccgtcaagaggagagcaagattgggagctggaaaaggtgtcgtggagacattttcagatgctgaagagacatccatggaagaaactacagcagcagcggtagcagcataccaaaacagcatagggatagattagatagatggtgtatatgtagtatttcttagaacgaatcccgctgttatccgttttatagaataaaagtttctagtatattgtgtcctcaatcttcttttcctagcaccttgccgtgtatatattctgaaggggaaaaagtttacatgtatttagaattattttttactgtagaccagaatgttaaactgctgtgcctgtaatccatgaggaaataccaaagacaaaaaaaaaaaaaaaaaaaa

SEQ ID NO: 3052 - protein, 515 aa, Panicum virgatum
  misc_feature: Ceres CLONE 1788860
  misc_feature (1)..(337): Pfam Name: Asp Pfam Description: Eukaryotic aspartyl protease
MAWGACIAALPLLLLLLLLAAAAAGGNGGVHCLEEGSRSRSRRALQGRHHHLRSRAVGGATVLELRHHSFSSAPSKSREEEADALLSSDAARVASLQRRIENYRLIGSSSAAAAAAASNNKAQVPVTSGAKLRTLNYVATVGLGGGEATVIVDTASELTWVQCAPCDSCHDQQEPLFDPSSSPSYAAVPCDSPSCDALRVATGMSGPPSPACGGGAGRPACSYTLSYRDGSYSRGVLARDKLSLAGEAIDGFVFGCGSSNQGAPFGGASGLMALGRSQLSLVSQTADQFGGVFSYCLPLRDSGSSGSLVLGDDSSVYRNSTPIAYTPMVSDPLQGPFYFLNLTGITVGGREVGSPGFPAGKVIVDSGTVITSLAPSIYSAVRAEFLSQLGEYPPAPAFSILDTCFNMTGSGEVQVPSLRLVFDGGVEVEVDSGGVLYLVSSDASQVCLAMAALRSEYETSIIGNYQQKNLRVIFDTAASQYHELDSAASGMLSNSSVSVCRRASEAACTCRSRLQ

SEQ ID NO: 3053 - DNA, 835 bp, Panicum virgatum
  misc_feature: Ceres CLONE 1788868
  misc_feature: Encodes the peptide sequence at SEQ ID NO. 3054
gtgttgcgttgcgttgcggccggaggagagagagacgagaggagtcgagagagcttccgccaccgccaacctccgatgccgccgccgccgggcatgaccctccgccgccttcccacggccgccctcggcctccccctctctctcccttgtttgctgtctcgtcccggcctctccctcgccgcacgtcgcgccagggccgtcgccgccagggcctcctcctcttcctcctccccctcttcgtcaccggactcgtccttcggctcgcggatggaggaatccgtcaagaagacagtggccgacaaccccgtagtcatctactccaagtcatggtgctcatattccatggaggtgaaagcgctcttcaagcggatcggcgtgcagccgcatgtcatcgagctcgaccatctcggtgctcaaggaccgcaactacagaaggtgttagagaggctgactggacagtctactgttcctaatgttttcatcggtggaaagcatgttggtggctgtacagacactctgaagctgcatcgcaagggtgagctagctagcatgctgtcggacctggatattgacattaacaattcatgacaagatggagtgtggcgcgcagagttgaggcttgagaaacttgggcagtcctgtattgagttatttagccttttacagatccattatgttttgatatggcaaaactggtgccacttacacattttttttgtttggcataacacacggaacttgaccagtgtatccgaattgtgtttgctgggcagtttattggctttcgtcagttgtttcctgctcatgcatacagcaaaaaaaaaaaaaaaaaaaa

SEQ ID NO: 3054 - protein, 170 aa, Panicum virgatum
  misc_feature: Ceres CLONE 1788868
  misc_feature (1)..(64): Pfam Name: Glutaredoxin Pfam Description: Glutaredoxin
MPPPPGMTLRRLPTAALGLPLSLPCLLSRPGLSLAARRARAVAARASSSSSSPSSSPDSSFGSRMEESVKKTVADNPVVIYSKSWCSYSMEVKALFKRIGVQPHVIELDHLGAQGPQLQKVLERLTGQSTVPNVFIGGKHVGGCTDTLKLHRKGELASMLSDLDIDINNS

SEQ ID NO: 3055 - DNA, 780 bp, Panicum virgatum
  misc_feature: Ceres CLONE 1788915
  misc_feature: Encodes the peptide sequence at SEQ ID NO. 3056
ccacgactccctgcccttccccttcccccatccgctcatcgcctccgggtttgcgctcccacagcctcgtgtgccttcgcctcggccgatccgcgtcgccgttgtttctcgcgaggatggagcagaccttcatcatgatcaagcccgacggcgtccagcggggcctgatcggggacatcatcagtcggttcgagaagaaagggttctacctcaaggggatgaagtttatgaatgtggagaggtcctttgcacagcagcactacgctgacctttctgacaagcccttttttcccgggttggtggagtacatcatttctggacctgttgtcgcaatggtgtgggaggggaaggacgttgtgttgactggccgcaggatcattggggccaccaagccttgggaggctgcccctggcaccatccgtggtgactatgccgttgaagttggcaggaatgtcatccatggaagtgactccgtggaaaatggaaagaaggagattgctctttggttccctgaaggtgtggcagagtggagaagcaaccttcatccctggatctatgaggcttaaagttatcagttggctctagctgtggagccatgtctagtgttttgtggtatatataacagttaaatgtgcctgaagccctgaacttatgtggcattcgtgtttttgtctttgttcctgctttaatattttaatgcactttgattgcaaaccaattgatgagatctgaaataaaatgtcaatctggtatttgccagaaaaaaaaaaaaaaaaaaaa

SEQ ID NO: 3056 - protein, 149 aa, Panicum virgatum
  misc_feature: Ceres CLONE 1788915
  misc_feature (1)..(134): Pfam Name: NDK Pfam Description: Nucleoside diphosphate kinase
  misc_feature (1)..(149): SWISSPROT Homolog: EC 2.7.4.6 Nucleoside diphosphate kinase 1
MEQTFIMIKPDGVQRGLIGDIISRFEKKGFYLKGMKFMNVERSFAQQHYADLSDKPFFPGLVEYIISGPVVAMVWEGKDVVLTGRRIIGATKPWEAAPGTIRGDYAVEVGRNVIHGSDSVENGKKEIALWFPEGVAEWRSNLHPWIYEA

SEQ ID NO: 3057 - DNA, 859 bp, Panicum virgatum
  misc_feature: Ceres CLONE 1788927
  misc_feature: Encodes the peptide sequence at SEQ ID NO. 3058
atcgattggaccgcgtgagcgtgacacgtgcgcagcgagataagcatgggcggcgaggcggcggcggagcaggggcggcgcatcctggtggcggtggacgagggcgacgagagcgtgcaggcgctgcgctggtgcctcggcaccttcgccgcggcggcgcgcggggacaccgtcatcctgctctacgtccgcccggcgctgcccacctactccgtgctcgacgcctccggctacctgttctcggaggaggtgaccgccgccatcgacaggtacagccgggaggtggcggactccgtggtggagaaggcgcagaagctctgcacgctctacgccaaggagaagggtgagggtgaccacgagatgaaggtcgaggtgaaggtggccgtcggggacgccaggaccgtcatctgccagatggcggacaagctcggggccgacctcctcgtcatggggagccatggctacggcttcttcaagagggctctgctcggaagtgtaagtgattactgcctcaggaacgcgagctgtcccgtcctcatcgtcaagtcttaatccgaacctagtcgagtgtttaagaatggatcagacatgatgctccttgccaagctttgcgcctgcaattccactttccccagtttttgttgtcccgaattttgtgagttagctttgcctacgtcaaatgtattttgccagaggcgcatatgtgtagtggtaactgaagtttacccagcagcaacctgtatgtatatagtactaatacgacctatgtaatggttgaaatgggctcaaggtctatccttcttgggctggaaggccaagatttgacccttttaaagtttaaaaaaaaaaaaaaaaaaaa

SEQ ID NO: 3058 - protein, 168 aa, Panicum virgatum
  misc_feature: Ceres CLONE 1788927
  misc_feature (1)..(148): Pfam Name: Usp Pfam Description: Universal stress protein family
MGGEAAAEQGRRILVAVDEGDESVQALRWCLGTFAAAARGDTVILLYVRPALPTYSVLDASGYLFSEEVTAAIDRYSREVADSVVEKAQKLCTLYAKEKGEGDHEMKVEVKVAVGDARTVICQMADKLGADLLVMGSHGYGFFKRALLGSVSDYCLRNASCPVLIVKS

SEQ ID NO: 3059 - DNA, 983 bp, Panicum virgatum
  misc_feature: Ceres CLONE 1788947
  misc_feature: Encodes the peptide sequence at SEQ ID NO. 3060
agccacagtttggggataaacccaagcggaagcggccacagccagctcagagcagcagccatggcgcctcccgtctccttcctgccccgcatggcgtccagcccaatcccgccgccgcagctccccaagcccagcagaagggcgctcgccgtcgcgccctgcagctccgcctcctcctcgccgcccaccacctcctcccctccgtgccacgccgccgcgcctccggcgggtcggagggggatgctggcgctgggcgcggggttcctggcctcggcctcgctgctggccccgaccggggacgccggggcgacgcgcatcgagtactacgcgactgtcggggacaagctctgcgacatgagcctcgtcaagtcggggctcgcgtactgcgacgtcgaggttggcaccggcgcccagcccccgcgcggcgagctcatcaatgttcactacactgcaagatttcctgatggtacagtgttcgacagcacctacaagcgcggcaggccactgacaatgcgtatcggcgctgggaagatcctccgtgggcttgaacagggaatcagtggaggtggaggagtgccgcccatgcttgttggtggaaagcgcaagcttatgatacctgcaactctggcgtacgggcctgaaccagcaggctgcttctcaggagattgcaacattcctggaaactccacacttctatatgaccttttcctagtcgggatttacaagtgagcatccaatgagatgacaaggaacattcaggaattagaacagacaaggcagaagtctatcatgcagataaagagaacggttcctggaacacatggtcccaataccgcggatgaagagaacgcttctggcaatactcgcgaaagcttgtgaataacatttatattttcttacctagccgatcggcaatgttcctgacctatttccgaagaaaataaagcccacctggattgcatcaaaaaaaaaaaaaaaaaaaa

SEQ ID NO: 3060 - protein, 222 aa, Panicum virgatum
  misc_feature: Ceres CLONE 1788947
  misc_feature (1)..(105): Pfam Name: FKBP_C Pfam Description: FKBP-type peptidyl-prolyl cis-trans isomerase
  misc_feature (97)..(219): SWISSPROT Homolog: EC 5.2.1.8 FKBP-type peptidyl-prolyl cis-trans isomerase 3, chloroplast precursor
MAPPVSFLPRMASSPIPPPQLPKPSRRALAVAPCSSASSSPPTTSSPPCHAAAPPAGRRGMLALGAGFLASASLLAPTGDAGATRIEYYATVGDKLCDMSLVKSGLAYCDVEVGTGAQPPRGELINVHYTARFPDGTVFDSTYKRGRPLTMRIGAGKILRGLEQGISGGGGVPPMLVGGKRKLMIPATLAYGPEPAGCFSGDCNIPGNSTLLYDLFLVGIYK

SEQ ID NO: 3061 - DNA, 825 bp, Panicum virgatum
  misc_feature: Ceres CLONE 1788956
  misc_feature: Encodes the peptide sequence at SEQ ID NO. 3062
aagcaatcccaaacggccaaacagcccctcactcctgccgctctgttataacgcacatcccgtctgcaccccgagatcggcgaattgctctctcttccggtcttctctcgcaagtcatggcgaagccgcaggttcttctctgcctcctagtcgccgccgccgcgctgctactcgtcgccgcggccaagaaatccggcgacgtgactgagctccagatcggcgtcaagtacaagcctgaatcctgcagcattcaagctcacaaaggtgacagagttaaagttcactaccgtggaaaacttactgatggaacagtttttgattcaagctatgaaaggggtgaccctattgaatttgaattgggcactggccaagtgatcaaaggctgggatcagggtctcctgggaatgtgtgttggtgagaagcggaagctgaagatcccatcaaaacttggctatggccctcaaggatcaccgcctactattccaggtggagcaactctcatatttgacaccgagcttgttgctgtcaatggggagccatccagcaaatctgatgagagcagtgagctttagatagcagggagggtagaattggcttccagaatccagatcaaaaagttaccagatcagatagatgaatgcataaaccattttactcagaattcggcgaatgtaatgcacttagagaaatgagcatccgttccctgtgactttgttttgttattccacaagaacaattagtctttctggagcaaactcctgatctcgtgatttctttttgggaatcactacaggcttgtgacttcaaaaaaaaaaaaaaaaaaaa

SEQ ID NO: 3062 - protein, 151 aa, Panicum virgatum
  misc_feature: Ceres CLONE 1788956
  misc_feature (1)..(95): Pfam Name: FKBP_C Pfam Description: FKBP-type peptidyl-prolyl cis-trans isomerase
  misc_feature (17)..(151): SWISSPROT Homolog: EC 5.2.1.8 FK506-binding protein 2-1 precursor
  misc_feature (6)..(151): SWISSPROT Homolog: EC 5.2.1.8 FK506-binding protein 2 precursor
MAKPQVLLCLLVAAAALLLVAAAKKSGDVTELQIGVKYKPESCSIQAHKGDRVKVHYRGKLTDGTVFDSSYERGDPIEFELGTGQVIKGWDQGLLGMCVGEKRKLKIPSKLGYGPQGSPPTIPGGATLIFDTELVAVNGEPSSKSDESSEL

SEQ ID NO: 3063 - DNA, 1063 bp, Panicum virgatum
  misc_feature: Ceres CLONE 1789001
  misc_feature: Encodes the peptide sequence at SEQ ID NO. 3064
gctgaaaagagacagggagagattcagatccacacatccgcgtcctcttctccccccctctcctcggtttcctctccccccaccaccaacccccagatcccggccatcccccgccagccgccctctccggggaggcgcgagcgtagaggggcgccaggaggcggggagggaggcgcggcgggcgccgaggggggcaagatgttcctgtgggactggttctacggggtgctggcctcgctcggcctgtggcagaaggaggccaagatcctcttcctcggcctcgacaacgccggcaagaccacgctgctccacatgctcaaggacgagcggttggtgcagcaccagccgacgcagcaccccacgtcggaggagctcagcatcggcaagatcaagttcaaggccttcgacctcggcggccaccagatcgcgcgccgcgtctggaaggactactacgcgaaggttgatgctgtagtatacctggtagatgcatatgataaggagcggtttgctgaatcaaaaaaggaacttgatgctctcctgtctgatgattcattggccaatgtcccatttctcatccttggcaacaagattgatattccatatgctgcctcagaagaggagctgcggtatcacctaggccttagcaacttcacaaccgggaaggggaaggtcaaccttggtgactctaatgtccgtccacttgaagttttcatgtgcagtgttgtccgcaagatgggctatggagacggattcaagtgggtctcccagtacatcaagtagggtgcttgccaaggcatgctcagcccagcgattttttgccttgtcatttgttctggttggttgttcgtcacgacaatgatcatcatgacggtatcatggagggtatgaagagaaaaacagtgcttaacattgggaaacatgttgaatctttagcctcaaaacagtttgttatgtcaaacttccgaaattcttttgcttttccataggacgtttactaaggacttgagtggcgatggattataagattattggtttcttaagtcaaaaaaaaaaaaaaaaaaaa

SEQ ID NO: 3064 - protein, 193 aa, Panicum virgatum
  misc_feature: Ceres CLONE 1789001
  misc_feature (1)..(188): Pfam Name: Arf Pfam Description: ADP-ribosylation factor family
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASEEELRYHLGLSNFTTGKGKVNLGDSNVRPLEVFMCSVVRKMGYGDGFKWVSQYIK

SEQ ID NO: 3065 - DNA, 886 bp, Panicum virgatum
  misc_feature: Ceres CLONE 1789074
  misc_feature: Encodes the peptide sequence at SEQ ID NO. 3066
aacaaccacccgagcgcctctccttccccgcctccggccggtgcctcccccgtccccggctgcgtcgccggcgatctcaccgcgaatcggatccgccgaaaaggcgagagggaagagatggggctcacgttcaccaagctgttcagtcggctgttcgccaagaaggagatgcggatcctcatggtggggctcgacgccgccggaaagaccaccatcctctacaagctcaagctcggcgagatcgtgaccaccatccccaccatcggattcaatgttgaaactgtggagtacaagaacatcagcttcactgtctgggatgtcgggggtcaggacaagatcaggccgctgtggaggcattacttccagaacacacagggtctcatcttcgttgtggacagcaacgatagggaccgtgttgttgaagccagggatgagctccaccgaatgctgaatgaggatgagttacgcgatgctgttttgcttgtgtttgctaacaagcaagatcttccaaatgctatgaacgctgctgagattactgataagcttggactgcattcacttcgccagcgtcactggtacattcaaagcacctgtgctacaactggtgaaggattgtatgaaggcctggactggctgtccagcaacattgccagcaagtcctaagttgtcaagaggtttggatcatctaggagcttttggatgatatttctggatattaggttgggttgctattcccgtatgtaaggtgtatgccctgagctcaatagttattgagctttggttaagatttaacagttaaattgtttttgtgtaatttgggtcttgagatgtttcgaaccaaacagctaaaagagttccgttgagctaaaaaaaaaaaaaaaaaaaa

SEQ ID NO: 3066 - protein, 181 aa, Panicum virgatum
  misc_feature: Ceres CLONE 1789074
  misc_feature: Great-hit functional homolog of the protein sequence given in SEQ ID NO 9285
  misc_feature (1)..(174): Pfam Name: Arf Pfam Description: ADP-ribosylation factor family
  misc_feature: Useful for making plants with altered Lignin content
  misc_feature: Useful for making plants with altered alkaloid content
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKS

SEQ ID NO: 3067 - DNA, 855 bp, Panicum virgatum
  misc_feature: Ceres CLONE 1789146
  misc_feature: Encodes the peptide sequence at SEQ ID NO. 3068
aaacaaccgccgccacacacggcctccaaatcttttcctctccacaggccggaatgaagctatagctcgtcaagtcgtcgccggccgctataccaaaggaagccaaggaaaaacactcctctttctctccctcccttcccttccgttccattcgatcccatatccaagaaccaaagctgagatccgctcgaggaggatggtggcgccggtggtgatcacgtcggcggggctgggcatgctggcgggcctggcgatggcgaaccggtcgctgggggacgggctcccggcggcgtccaggtgggacgcgcgcccgcgctgcgccacgtgcggcggctccggccgggtcgagtgcctgtgcaaccgctggtccgacggcgactccggctgccggacctgcgccggctcgggcaggatgccctgccgcagctgcggcgggtccggcacgggcaggccgctccccgcgcggctcaccgtccagcaccacaagccgccgccgccggccggctacaactgacgctcgccgatcgattgattagacatgatgatgccggtcggctgacgacatggatgatgagcatgggcgggggcggcagggagcagcaagtatgggctggataggcttggccagagatcttgtggtcgagaggagctcagcatcagatccacaggcttgcaagaaaaagatcccgtagggtagcgtagccacaccaggcactagctttggaccaatgggtagtacggtatggggtccaccaatgtgccatatactacacattatcagagaaaaaagtgacatacacgtgcactaggagcctttggaagcaagttccgtctgaaaaaaaaaaaaaaaaaaaa

SEQ ID NO: 3068 - protein, 105 aa, Panicum virgatum
  misc_feature: Ceres CLONE 1789146
  misc_feature: Great-hit functional homolog of the protein sequence given in SEQ ID NO 9595
  misc_feature: Useful for making plants with modulated nitrogen use efficiency
MVAPVVITSAGLGMLAGLAMANRSLGDGLPAASRWDARPRCATCGGSGRVECLCNRWSDGDSGCRTCAGSGRMPCRSCGGSGTGRPLPARLTVQHHKPPPPAGYN

SEQ ID NO: 3069 - DNA, 1176 bp, Panicum virgatum
  misc_feature: Ceres CLONE 1789192
  misc_feature: Encodes the peptide sequence at SEQ ID NO. 3070
ctgcgggctgcggggaaggaataaggaaaaagggatggccacagcgcacctgctccgacgcgcctctccgccttcctctccagcaccaccacaggccctttgagctcgcgctgccctctcccccgccgcctccggcagccccgcgccgccatggccactgactcctccgccgccccgttccagaagatccagatccagcgcgaggacacgacatttgatgcctatgttgttggcaaagaaaatgctcctggaattgtggttttgcaagagtggtggggagtagattatgagataaagaatcatgcaatccacatctcccaacttggtggaggatacagagcacttattccagatttgtaccgtggcaaagttgctctggatgtcgctgaggcacagcatctgatggaaggtctggattggcaaggcgcagttaaggacattcaggcttcagttaaatggctcaagtcaaatggatcacccagggttggtgttaccggctattgcatgggtggtgctttatcgattgcaagtggagttttagtcccagaggttgatgctgttgttgctttctatgggacaccatcttctgaacttgccgacccttctaaggctaaggctcctatccaggcccattttggagagcatgacagttttgttgggttttcggatgtcactgcggccaagtccctggaggagaagctcaagtcttctggagtaccatttgaagtccacatataccctggatgttcgcacgccttcatgaacacttcccccgaggccctcaagaggaagaagggaatgggtctgactgatgagaaccaggaagccgtcgacctggcctggtctcgcttctctgcttggatgggccgtttccttggatctgcttgagtcattccccagttcatgtgctgtgtgattatgtgtggagtcagggtcccatgaataaaatgtccagatccaggttgctgtatccaaaccatacaaatggactgggttgtactgcgctctggatttggttgtcgttctgcagttgcactgtggtgtcttgtgatttctttggatagatacatattgtgcagtagttggaattcgttgatgccgtttggttggtatcagcgagaaggcaacttttactactgaactcgaagtataaaccaaaaaaaaaaaaaaaaaaaa

SEQ ID NO: 3070 - protein, 245 aa, Panicum virgatum
  misc_feature: Ceres CLONE 1789192
  misc_feature (1)..(221): Pfam Name: DLH Pfam Description: Dienelactone hydrolase family
MATDSSAAPFQKIQIQREDTTFDAYVVGKENAPGIVVLQEWWGVDYEIKNHAIHISQLGGGYRALIPDLYRGKVALDVAEAQHLMEGLDWQGAVKDIQASVKWLKSNGSPRVGVTGYCMGGALSIASGVLVPEVDAVVAFYGTPSSELADPSKAKAPIQAHFGEHDSFVGFSDVTAAKSLEEKLKSSGVPFEVHIYPGCSHAFMNTSPEALKRKKGMGLTDENQEAVDLAWSRFSAWMGRFLGSA

SEQ ID NO: 3071 - DNA, 1586 bp, Panicum virgatum
  misc_feature: Ceres CLONE 1789277
  misc_feature: Encodes the peptide sequence at SEQ ID NO. 3072
atagaccccgcgcgcggaggactctacctctccctcctactccgcccaccctcctcgccgccgcgaagaggctgctcctccctcgcggctcgcctcgcctcgtgctctccgccttcccacctcgcttcctcctccgcgagtccttcgccgaggcgccagcgggagcctataaagcgcccccaccgtcgccaccgccagcccgccacgacacgggacgggaccaatggcggccgctgcgtcctccacgctgcacggcgtcggcgccgtcgcctccgccaagcccagatccgccgccccagcggccgcgaggaggaggagcgtgcgcgtggccgccgcggcggccaagggaggagcgggccccgcgcgaggcaggatggtggctcgcagcgccgttgcagccaaggcggatcaggcggccgcggcggctggatccaagtctggcggccatgaggtgctgatgtttgaggcccttcgtgaagccttgatagaagagatgaatttggacccaacggtgtgtgtaataggtgaagatgttggtcactatggaggttcatacaaggtgaccaagggcttggctgatatgtttggagatctccgggttcttgatactcctattgctgagaactctttcactggcatgggagttggagcagcaatgaaggggctcaggccggttgttgaaggcatgaacatgggtttccttctccttgcctacaatcagatctcgaacaactgtggtatgctccactacacttcaggtggtcagttcaagattccaattgtgatccgaggacctggtggtgttggtcgtcagcttggtgcagagcactcacagcgtctcgagtcgtacttccagtcaatccctggccttcaaatggttgcttgctctactccttacaatgcaaagggcctgatgaaggcagccataagaagcgagaaccctgtggtgctgtttgagcatgtcctcttgtacaacctgaaggagaaaattcctgatgaggaatacatctgctgcctggaggaggccgagatggtgcgcccaggtgagcacgtgaccatcctcacgtactccaggatgaggtaccacgtgatgcaggctgccaagaccctagtgaacaaaggttacgaccctgaggtcatcgacatcaggtctctgaagccgttcgatctgcacacgatcgggaactcgatcaagaagacacatcgcgtgctcatcgtggaggagtgcatgcggaccggcggcatcggcgccagcctgaggtccgccatcatcgacaacttctgggactacctggacgcccccatcatgtgcctgtcgtcgcaggacgtgccgaccccgtatgccgcgactctggaggatgccaccgtggtgcagcctgcacagatcgtggcggcagtggagcagatctgccaatgatcgtaggatcacgacattgctaagttacgttgtttgtggattcataaacaccatgttctgtgtttgttttgccatgttggtaacacttgattgtggcgtagacatgttatatttctcatcggtgcatattctacaagatttgatgccctaaaaaaaaaaaaaaaaaaaa

SEQ ID NO: 3072 - protein, 397 aa, Panicum virgatum
  misc_feature: Ceres CLONE 1789277
  misc_feature (1)..(179): Pfam Name: Transket_pyr Pfam Description: Transketolase, pyrimidine binding domain
  misc_feature (76)..(396): SWISSPROT Homolog: EC 1.2.4.1 Pyruvate dehydrogenase E1 component subunit beta
  misc_feature (76)..(397): SWISSPROT Homolog: EC 1.2.4.1 Pyruvate dehydrogenase E1 component subunit beta
MAAAASSTLHGVGAVASAKPRSAAPAAARRRSVRVAAAAAKGGAGPARGRMVARSAVAAKADQAAAAAGSKSGGHEVLMFEALREALIEEMNLDPTVCVIGEDVGHYGGSYKVTKGLADMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 3073 - DNA, 1592 bp, Panicum virgatum
  misc_feature: Ceres CLONE 1789280
  misc_feature: Encodes the peptide sequence at SEQ ID NO. 3074
atgatcaccctgggccctttgtaaattgcccctccaactgcagatctcctctccatctccctgcagcttatatgcatcatctatccctgatctcttccttctttccccccagcgcttgctacctctctagctagctagatctctctcctctacatgtctaccatctacatgagccaactgtctactctccctctaatggagcgagagcaggatcaggggctctttccggccttccatgtcacgaaggacccacctatcttattcccgttcatgatcaacaaccctgtggatcagctccaagggcaaagtagctatggagatcaacgcttgaggcatcaagttttggctgaatctactcatcaacagttcactgatcgcatgatgatgatgagcggaggatcagacgtcttccctaggccatcaccgttccggccgactattcaaagcatcgatggtgacatgatccagcggtccgcgtatgatccatacgatatcgagaacaagcgtgccgtcgatggatcgatcagtggctgggcagcggcggcggcaccgccggcgaagatgaagatcatgaggaaggcgatggcgagtgagtatcccgagggcggggcagcgagaaagccaaggagaagagcccaagcacaccaggatgagagccagcagctgcagcagcaggctgctatgggtgtcgttagggtgtgctccgactgcaacaccaccaagacccccttgtggaggagtggtccttgtggccccaagtctctttgcaacgcatgcggcataaggcaaaggaaggcgcgtcgggcgatggcggccgccgccggtgccagcaacggaggcgctccacaggtggccagtgtcgccgcacaggcaaagccggcgtccaagaaggagaagagggcggacgtcgaccagtcgctgccgttcaagaaacggtgcaagatggttgccgtggatcacgctgtcacggcggccaaggagacgccgacagtcgctgctccgtccaaccgggatcaggatctggatcacgtctccagtgacaaggttgtgagtctgcagagcaaggtcgtcgccactcctgatccgccggcgatgtcgttccacgccttccccgccgacgagatcaccgacgccgccatgctgctcatgacactgtcctgtgggctcgtccgcagctagctagcgagctatatacagcttctactagcagctgatagcgagatcactggtagacactgatgagttcgacacgttttgcaactaagtaccctaccccggccctatcatattgcttgtttgatcaagtgttgaggaagagcaagtaagatcaccaggagagatagagtgatcacatgcatggccaaggcaaaataataataagccaaaaactctggttagcctaccaggatttgctataagagtgagttttttaatttgttttaccttttttcccagctgtggctaattattcaagccactatatatatatgctatgcaactttgttcatttgtattagttatgttttggatcatcggagctaataatatatatggacaaatgatcgaggataaacactggagattaaacctac

SEQ ID NO: 3074 - protein, 341 aa, Panicum virgatum
  misc_feature: Ceres CLONE 1789280
  misc_feature (1)..(36): Pfam Name: GATA Pfam Description: GATA zinc finger
  misc_feature: The sequence is a functional homolog of  SEQ ID NO 1032 in the  10/666,642 US patent application
  misc_feature: The sequence is a functional homolog of  SEQ ID NO 276 in the  10/666,642 US patent application
  misc_feature: Useful for making plants with modulated growth and phenotype characteristics
MSTIYMSQLSTLPLMEREQDQGLFPAFHVTKDPPILFPFMINNPVDQLQGQSSYGDQRLRHQVLAESTHQQFTDRMMMMSGGSDVFPRPSPFRPTIQSIDGDMIQRSAYDPYDIENKRAVDGSISGWAAAAAPPAKMKIMRKAMASEYPEGGAARKPRRRAQAHQDESQQLQQQAAMGVVRVCSDCNTTKTPLWRSGPCGPKSLCNACGIRQRKARRAMAAAAGASNGGAPQVASVAAQAKPASKKEKRADVDQSLPFKKRCKMVAVDHAVTAAKETPTVAAPSNRDQDLDHVSSDKVVSLQSKVVATPDPPAMSFHAFPADEITDAAMLLMTLSCGLVRS

SEQ ID NO: 3075 - DNA, 1365 bp, Panicum virgatum
  misc_feature: Ceres CLONE 1789287
  misc_feature: Encodes the peptide sequence at SEQ ID NO. 3076
accctatccgtttgacactcttccacgcttgctataactcgtccgtctccggggcgttcgcctcccccaatccccaacccacgcccaccgtccccggccaccgcctcagatcccccgccccgcccagccaggtcccttgcccgcggccatgacgccctcctccgcgctcgccctggccaacctcgccgcggcctccccgctcccggcggcctcctcgccgcggccctcgcccaggcccgcctcgctcagcccgggcccgggccccgccgggctcgggccgcgccggctcgtcgcggcgccgcccccgcgggccttcttctcctcgtcgccctaccagccgccgcagccggagggcttctcgccgcaccgcgagtacggcctcgtccccatggtcatcgagaccacctcccgcggggagcgcgcctacgacatcttctcgcgcctgctcaaggagcgaatcgtctgcatccacggccccatcgccgacgacaccgcctcgctcgtcgtcgcgcagctgctcttcctcgagtccgagaacccgcttaagcccgtccacctctacatcaactccccggggggcgtcgtcaccgccgggctcgccatctacgacaccatgcagtacatccgctgccccgtcaccacgctctgcatcggccaggccgcctccatgggctcgctcctcctcgcggccggggcgcccggggagaggcgcgccctgcccaacgccagggtcatgatccaccagccctccggtggcgcgcaggggcaggccaccgatatcgccatccaggccaaggagatcctcaagatgcgcgaccgcctcaacaagatctaccagaaacacacgcgccagcccatcgataagatcgagcagtgcatggagagggacctcttcatggaccccgaggaggcgcgcgactgggggctcatcgacgaggtcatcgagagccggcccgcctcgctcatgcccgacggactcggtggaaacggcctcgatgtgcccaaccttggcggcggcggcggcggtggacggggaagggatgtcgaggagccctctgcggtgtgaagaacggccacaaaggtgaaatcttatcgcgtccggtggctgtgttgttgttagatctaaagctttaattcttactagacaaggttaaccttgttgttctggttgccgaggcgtccggctccccattccccttcttgcttcaattgcttgaattgagctattggtgataattgttgcagctaaggaaatttcgttcctttgatacggataaatcgacactattgtgtatgttgtactgtattagtatcagttccatgctggagcatattgaaaatcttgaaaaaaaaaaaaaaaaaaaa

SEQ ID NO: 3076 - protein, 305 aa, Panicum virgatum
  misc_feature: Ceres CLONE 1789287
  misc_feature (1)..(182): Pfam Name: CLP_protease Pfam Description: Clp protease
  misc_feature (70)..(276): SWISSPROT Homolog: EC 3.4.21.92 ATP-dependent Clp protease proteolytic subunit
  misc_feature (78)..(275): SWISSPROT Homolog: EC 3.4.21.92 ATP-dependent Clp protease proteolytic subunit 1
MTPSSALALANLAAASPLPAASSPRPSPRPASLSPGPGPAGLGPRRLVAAPPPRAFFSSSPYQPPQPEGFSPHREYGLVPMVIETTSRGERAYDIFSRLLKERIVCIHGPIADDTASLVVAQLLFLESENPLKPVHLYINSPGGVVTAGLAIYDTMQYIRCPVTTLCIGQAASMGSLLLAAGAPGERRALPNARVMIHQPSGGAQGQATDIAIQAKEILKMRDRLNKIYQKHTRQPIDKIEQCMERDLFMDPEEARDWGLIDEVIESRPASLMPDGLGGNGLDVPNLGGGGGGGRGRDVEEPSAV

SEQ ID NO: 3077 - DNA, 1983 bp, Panicum virgatum
  misc_feature: Ceres CLONE 1789302
  misc_feature: Encodes the peptide sequence at SEQ ID NO. 3078
gagtaccaatccatccaaatcctgtatgtgaaaacaaatgccaaccattcttcttccttgcatacccgcgagtagtagtagtgtgctacaagctgcaggcaaagcgagatactatataggaaagcatcgtcggatcacatcctcatctagtcatccatcgtattcatattccggcatccatcgatccttcctccgttttccaccactgttggtggccattactgctcagccatcccagcccaaggttgcttgcttttgctcccttgcatagccgcccggccatggagaaggagatcaataatccgccgccgcacacggccgagccgcaggacaccaccaccacctcatcaccaacagcaaagaaccctgcatcgtcgtccgacgaccagcgaccgctgcggccgcatctctccatcgacatcccggcgtcaagcctgcccggcgaccccctcccgacgccgacggaggccgccgacatcaccctaaccccgacgggttcctcctccaccaccaccagaaggagcggcatccccatcacgcccgtgtcttcctccggtaacagcaggagcggcaagcccctgcgctcgccgtccttcatgctcaggcagacggtcaggagcctcctgcccgtggggagcttcaagtcctccgtcaagggctacgaggcgtccttctccaagctcttcaactccaaggtcatggccaggacgtcctcgcttcctctcgacgaccatcaagccgtcgttgacaaatcttcaacaagttcttgtaccgccaccgaacctgtactccacatgtgccgatcgcagtccctccccatgaacatgaagaaattcaacgccaagagcttcaagaggatggactcgctaggcggcatgtaccgtgtagttccatcgacgccgagagctccagctgcaagcaatgtcgttcctgacatagtcccttcttcagagtcaggggtcgccggcgaagacgacggcgaggacattccggaggaggaagccgtgtgccggatctgcatggtcgagctgtccgaaggcagtgacaccctcaagctggagtgctcctgcaagggtgagcttgctctggcacacaaggactgtgccatgaagtggttcaccatcaagggcaccaggacctgcgaggtgtgcaagcaggatgtgcagaacctcccggtgactctgctacgtgttcagagcctgcagcgcgagccgaatcgcgtggccaatggaggcaacagatccagataccaacgggtgtggcatgggacacctatcctcgtaatcataagcatcctggcctacttctgcttcttggaacagttactggtggcccatgacggcattgctgcgctggcaatatcgctgcccttctcatgtatcctggggctcttctcttcattgacaacgacaagcatggtggcaagaaggtacgtttggatctacgcggcagtacagttcctcttcgtcgtgttcttcacccatctgttttacagatatctccatctgcaggccgtgatatccatcatccttgcgaccttcgctgggttcggcgtggggatgaccgggaactccatcatcgttgagatactgcggtggagggtgcggcggatggcgcctcctgctcctgccatgccccgccgtgatcgcggaacacgcgcagcccagcagcaggcttcggcgtctgatcaaccttcgggccagtcttcagttgccggcggcggacagcacgacaccgttgctgctagcgatgttgagaaccccgccctccctcaggcatagaacatgtatattgtataactgtataagcagttcttttctagatagtatatacagagtatatgtgtagcagttgtagtttacctgctgagaggttgggggcctcatttcactgtataaatggtagaacagaccaagtctgaattttgttttttaagggagaagagatcccaatctcaaaaaacaaaaaaaaaaaaaaaaaaaa

SEQ ID NO: 3078 - protein, 499 aa, Panicum virgatum
  misc_feature: Ceres CLONE 1789302
  misc_feature (1)..(48): Pfam Name: zf-C3HC4 Pfam Description: Zinc finger, C3HC4 type (RING finger)
MEKEINNPPPHTAEPQDTTTTSSPTAKNPASSSDDQRPLRPHLSIDIPASSLPGDPLPTPTEAADITLTPTGSSSTTTRRSGIPITPVSSSGNSRSGKPLRSPSFMLRQTVRSLLPVGSFKSSVKGYEASFSKLFNSKVMARTSSLPLDDHQAVVDKSSTSSCTATEPVLHMCRSQSLPMNMKKFNAKSFKRMDSLGGMYRVVPSTPRAPAASNVVPDIVPSSESGVAGEDDGEDIPEEEAVCRICMVELSEGSDTLKLECSCKGELALAHKDCAMKWFTIKGTRTCEVCKQDVQNLPVTLLRVQSLQREPNRVANGGNRSRYQRVWHGTPILVIISILAYFCFLEQLLVAHDGIAALAISLPFSCILGLFSSLTTTSMVARRYVWIYAAVQFLFVVFFTHLFYRYLHLQAVISIILATFAGFGVGMTGNSIIVEILRWRVRRMAPPAPAMPRRDRGTRAAQQQASASDQPSGQSSVAGGGQHDTVAASDVENPALPQA

SEQ ID NO: 3079 - DNA, 2195 bp, Panicum virgatum
  misc_feature: Ceres CLONE 1789313
  misc_feature: Encodes the peptide sequence at SEQ ID NO. 3080
acagcaggggaggccgaggaaaaggggaggcgtgggaggcccgccctcgagggagccagagccaccgcggctgccgtgcgcggagcaaaagcctgcatctggatcaggcgtccccttcgcgccgctccctgctcccgccgccgccacccggggccgccgccgagcggagatccgccccggggcctgggcgcaggctggtctctggctctctgccttcgctggtacaattcgtttgattacctcctaaattctcgatccccgttttcacatgagtacaagggacaaaaagtgcagcaattgtgactagaggctcgtgcttttgagtaattaaggagggatacatgcgtaacgaaaccctgattctggaatggtgtccagtcgaaggagcagcgggattatcatacgggaagggtctaggaactggtctgagttcaatgatccctcgccgtctccaaaactgctgtattcacagtcctatgttgcaatgagagggttggtggcctcagtgatatccttggactttttcctgttgtcaagcaagctaaaatctgcatgggcaggtatgacgtcccagaggcatattcgatctcaggagagatcaaaatcaagaggattgaactgcaagagggttgtggttcatctgctattgtgtttcatggttggcattttcattggattcatgccattcttctcagttgatgtttataagaaaattgtctctgaaaatgagaggcttccgttccatgagagtgtggttgagacggagatgatggatactaaagttaaggagttggagacagttgtagtagagaaagaggttgaactgattgatgagccagaagttggagagagtcctccagttcctgcaatgttggatgacgaggcagattttgctgaatcaacacgtgcattacctgctattgaagattccgatatcagtgtgaagaagctgctgataatcgtgacaattacttctgttcggccacaacaggcatattacttgaatcggctagcccatgttttgaaagctgtacaagcacctctactgtggttagtggtggaatggcctgaacagtcctatgaaacagcagaaattttgaggtcttctggggttatgtacaggcatcttatatgtagaaagaatactacaagtgtgcgaaagattgctgtctgtcaaaggaataatgcaatctatcatgtcaaaaagcatcacctggatggtataatgcattttgccgatgaagagcggtcatactctgctgacgtatttgaagaaatgcagaaaatcagacgctttggctcatggcctgtagcaatccatgttggaaccaagtatagggcggttttggaaggccctatttgtaaaggtagccgagtcactggatggcacacggtccaggcagttcagaagaagagtatgactcgtcgattcccaataggtttctctgcgtttgctttcaacagcacaatgttatgggaccctcagagatggaaccgcccagctatggattctgttatagtccactcaggtggaagaggtggtttgcaggaatcgaggtttatagaaaagcttgttaaaaatgagcgtcaagtggagggtcttccagacaattgcaacagggttatggtctggaatttcaacctggaacctcctcaactcaactatcccacaggctgggcactgtataagaacctagaagctgacatgcctgtaatatagtttcttgctgctgcactagatctgctcctagaggtggtttttctcagcgagccagaagcaccaaggacgtttccagtgtcacaatggttctagatcttgactccctgttgttaccagatgtcaaaactccagttaggttgctggacgaagccatcctgagcaggttgctccaaagattacatggatatcatgtgcggagatctgccttcagtaatttcagatctattgcggggccaaccaaatcaggatattttcctctttcttttgtgtattccttttatgctctttattttttctctcctttatattcaccagctagatacatcatgtagagtattttttttaggttcttctgttattgcatatgtgttaccttcttacagatgtaaaagctcgcatacattggaactgtttaagagcaaaggcaaataccgtcttgatacatgaagagatcgaaaaaaaaaaaaaaaaaaaa

SEQ ID NO: 3080 - protein, 450 aa, Panicum virgatum
  misc_feature: Ceres CLONE 1789313
  misc_feature (1)..(217): Pfam Name: Glyco_transf_43 Pfam Description: Glycosyltransferase family 43
MVSSRRSSGIIIREGSRNWSEFNDPSPSPKLLYSQSYVAMRGLVASVISLDFFLLSSKLKSAWAGMTSQRHIRSQERSKSRGLNCKRVVVHLLLCFMVGIFIGFMPFFSVDVYKKIVSENERLPFHESVVETEMMDTKVKELETVVVEKEVELIDEPEVGESPPVPAMLDDEADFAESTRALPAIEDSDISVKKLLIIVTITSVRPQQAYYLNRLAHVLKAVQAPLLWLVVEWPEQSYETAEILRSSGVMYRHLICRKNTTSVRKIAVCQRNNAIYHVKKHHLDGIMHFADEERSYSADVFEEMQKIRRFGSWPVAIHVGTKYRAVLEGPICKGSRVTGWHTVQAVQKKSMTRRFPIGFSAFAFNSTMLWDPQRWNRPAMDSVIVHSGGRGGLQESRFIEKLVKNERQVEGLPDNCNRVMVWNFNLEPPQLNYPTGWALYKNLEADMPVI

SEQ ID NO: 3081 - DNA, 1773 bp, Panicum virgatum
  misc_feature: Ceres CLONE 1789317
  misc_feature: Encodes the peptide sequence at SEQ ID NO. 3082
aattcgaccacgcttccgccgcagcttctcccctttccacctccgatggcggcgacggcgacggtgacggcgccggcggcgaacaccaacttcgtagcgacgccagcggctccgcatcctcgccccggcgtggcccccgctccccggcccccctccaccttgggtcccgtcaagtcggaggcccctccgcccccctcgtccactacttccgccgccgcccctgccgccgccgccgcatccggaccggaggatccatcctacatcatcaccatcccgagttattcagcgtggttctccttcgactccatccacgacactgagcgccgcctcctgccggagttcttcgagggggaggcggcggcggcgtccgggtgccggggcccgggcgggtacaagtactaccgcgacagtctgatacggaggttccgggcgcggccgggtcgacggctcacgctaacggaggccaggcggggacttgtcggcgacgtcggctccgtccgccgcgtgttcgacttccttgaggaatgggggctcatcaactacggtgctttgccgtcgggctcaaagcaggcgaaagagaagagggaagaggctgcaccacagtcggcgttgccttctgctggggcaacagcacccaggaagctttgtaccgggtgccgcactgtgtgcgggcttgcttacttcgcctgcgagaaggcagatataagtctctgtgctagatgctttgtacgtaataacttccggccaggtctgactgctgcaaacttcaagaaagttgaaattactgaagatgcaaaatctgattggacagacaaagaaactcttcacttgcttgaggctgtcttgcattatggtgaagactggaagaaggtgtctgaacatgttggtagtcgatcagaaaaagactgcattgcaagattcatccgtctaccttttggagaacagttcatgggacccaaggaggatagaatggggtttgaaaatgatgatgatgttactgatgaatctggagcagatgtctcaaaacggctacgtctcactccactggcagatgcaagcaatccaattttggctcaggttgcattcttatcagccattgtgggttctgatgctgcctcagctgctgctcaagcagctatttctgcacaatcccgtgttgatctaaatgacgaagagattgattcttctataaatagcaccaaggaagaaggcaacgatttgctgaaagaggctgccgctaatgcaagggcacaacttgaaaaagaaaggaacggcatagagcaatctttatccgatatagtggatgtccagatgaaggaaatccaagataaaatatgccgtttcgaacataaggagatgctgatggacaaagagcaacagcagctccgctgccttagggatttgcttttcgcagatcaactggcgatcatgcaacatcaacgcaagccccaagctgtagctgcagagagcaaatatgacgagaagccaaaacccctgattaacataagttgattcaaatagagggtttttttatcgaaacgggaaatggttcctcagcatgactggaacgacagttgtgagaattggacataggtctgcaccatttagctaacttctacccctcccccctttgttggcctgactctagttgtatgttcaatccatgtgcggacgcctcggatggtataggaagcaagggcgatgactattctttacaatctagctgatgagaatggttgacttcctttcctccaaaaaaaaaaaaaaaaaaaa

SEQ ID NO: 3082 - protein, 488 aa, Panicum virgatum
  misc_feature: Ceres CLONE 1789317
  misc_feature (1)..(46): Pfam Name: Myb_DNA-binding Pfam Description: Myb-like DNA-binding domain
MAATATVTAPAANTNFVATPAAPHPRPGVAPAPRPPSTLGPVKSEAPPPPSSTTSAAAPAAAAASGPEDPSYIITIPSYSAWFSFDSIHDTERRLLPEFFEGEAAAASGCRGPGGYKYYRDSLIRRFRARPGRRLTLTEARRGLVGDVGSVRRVFDFLEEWGLINYGALPSGSKQAKEKREEAAPQSALPSAGATAPRKLCTGCRTVCGLAYFACEKADISLCARCFVRNNFRPGLTAANFKKVEITEDAKSDWTDKETLHLLEAVLHYGEDWKKVSEHVGSRSEKDCIARFIRLPFGEQFMGPKEDRMGFENDDDVTDESGADVSKRLRLTPLADASNPILAQVAFLSAIVGSDAASAAAQAAISAQSRVDLNDEEIDSSINSTKEEGNDLLKEAAANARAQLEKERNGIEQSLSDIVDVQMKEIQDKICRFEHKEMLMDKEQQQLRCLRDLLFADQLAIMQHQRKPQAVAAESKYDEKPKPLINIS

SEQ ID NO: 3083 - DNA, 1659 bp, Panicum virgatum
  misc_feature: Ceres CLONE 1789321
  misc_feature: Encodes the peptide sequence at SEQ ID NO. 3084
agccaccagattccttcctccaatcctcctccttgcaaagccgcagcaatcaatctcactgcatccccccgccaatctccgtcccactgcataacccccaagtcgccaacgtcgcaccgccgcgccagcatgggcggcggcctcggcctccggcggcgcggcgcgcaccgcccgctggcgctgctcctggtcctggtcctcgccgccgccgcgggcggtgccgccgagggaaaggcgagggggaggggggcgcacggcagtaccagcaccaggctgcggttccggcgcggcagcgggacgttcaaggtggtgcaggtggcggacatgcactacgccgacggccgggccacgggctgcgaggacgtgctcccgtcccaggtggccgggtgctccgacctcaacaccaccgccttcctctaccgcgtcttccgcgacgaggaccccgacctcgtcgtcttcaccggtgataacatctatggtgctgattcaagtgacgcagccaagtctatggatgcagcgattgccccagccattgacatgaaacttccttgggcagctgtgattgggaaccatgaccaagagggtacgctgtcacgtgagggtgtaatgcgtcaccttgtgagcatgaagaacagcctttcaggactcaaccccgaaggaattgaaattgatggctatggcaattacaatttggaagtttccggggttgaaggaacatcactgggtgaaaaatcagtgctcaacctgtatttcctagacagcggtgactattctactgtaccgtcaatcaaaggttatggttggatcaaggcctcacagcaagtctggttccaacaaacatcttcaagcctacagagaaagtatatgaatgaaaaccctaagcagaagcagccagcacctggccttgtgttcttccatattccactgccggagttcagcagttttacagcagccaatatcactggagtaaaacaggagggaattagctcagcatcaatcaactctgggttctttacctccatggtggaggctggagatgtgaaggcggcctttattggacatgatcacattaatgacttttgcggaaagctcagcggtattcagctatgctatgctggcggatttggttaccatgcctacgggaaggctgggtggtcaaggagagcaagggtggtgtctgtgcaacttgagaagacagacaacggtgaatggcaaggagtgaagtccatcaagacatggaagaggcttgatgatccccatctcagcacaattgactctgaggtcctctggaatagaggcactaatgggaggcgcaagaagaatactgacggtagttaactcatctggacagcaaatggagcaccgtattggactctgtgcatagttgtgtattgttggatggccaatttaacagagtcgcaaaatgcagaaatgtgcaggagggaaaaggaagattatatactacacgtatacaagtttttctgttgtatttttccctagctaggaaataacacgtcgtggagcaattgtaattcagagcggctgtcaactactattcacaagtgtccacagctagaatgcagtggtcaaaggtaaacacaaatgtaattccattgagatcccatctctcatctctcataaaaaaaaaaaaaaaaaaaa

SEQ ID NO: 3084 - protein, 402 aa, Panicum virgatum
  misc_feature: Ceres CLONE 1789321
  misc_feature (1)..(258): Pfam Name: Metallophos Pfam Description: Calcineurin-like phosphoesterase
MGGGLGLRRRGAHRPLALLLVLVLAAAAGGAAEGKARGRGAHGSTSTRLRFRRGSGTFKVVQVADMHYADGRATGCEDVLPSQVAGCSDLNTTAFLYRVFRDEDPDLVVFTGDNIYGADSSDAAKSMDAAIAPAIDMKLPWAAVIGNHDQEGTLSREGVMRHLVSMKNSLSGLNPEGIEIDGYGNYNLEVSGVEGTSLGEKSVLNLYFLDSGDYSTVPSIKGYGWIKASQQVWFQQTSSSLQRKYMNENPKQKQPAPGLVFFHIPLPEFSSFTAANITGVKQEGISSASINSGFFTSMVEAGDVKAAFIGHDHINDFCGKLSGIQLCYAGGFGYHAYGKAGWSRRARVVSVQLEKTDNGEWQGVKSIKTWKRLDDPHLSTIDSEVLWNRGTNGRRKKNTDGS

SEQ ID NO: 3085 - DNA, 2641 bp, Panicum virgatum
  misc_feature: Ceres CLONE 1789344
  misc_feature: Encodes the peptide sequence at SEQ ID NO. 3086
attgctcttcctacctccctccctggttcgcctccccgccccctcttcccccctgctcctccccttcttccccggggggcgggcgttcttggagccggagcttctggagctgctgctgctgctgacgccgccggcggtggtcctgtaggtggcggttcgcaatggggaggagcagccgcgcctgctccgtccttggctcagccctgctcctgctgctgctctcgctcggctccgccgccgcgcagaagggctccacctggaagaccctgagtggcaaggctccagcaattattgccaagggcggcttctcaggcctttttccagattccagtggtaatgcttatcagtttgttggaattgctagctctcctgacacagccatctcgtgcgatgtttggttgaccaaggatgccgttggcatctgccttccaaacataaatatggataactgcaccaccatatctgatcaattcccacaggggaagaagacctacaatgttaatggtgtgtctacagcaggctggttctctgtcgactttacaatcactgatctgcaaaatgtaaccttgaagcaatcaatcttgtcccgtccgtattacttcgatggtttatggccaatagttcctgttgatgctgttttgtcccaatttaaggtccctgctgtttggttaaatgtgccgcttgacagtttctacagccagtttaagctcaacatgagaagctatatcctatctctaacaaaacaatacatcgttgactacatttcatcgcctgaagtgaacttcctcacaagcatatctggaagagttagcaagaagacaaagcttgtgttccgatttcttgatgaacgctctattgagccatctacaaaccagacatatggttcaatgttgaaaaatctaactttcgtcaagacttttgcttctggaatacttgtccctaaaaactatatctggccggtcacacctgataattatctgctgtcctatacttcagtcgttgatgatgctcataaagcagggctagaagtctatgctgctggttttgcaaatgactttgctatcagctacaactacagctatgatccattgacagaatacctttccttcattgataatggtgccttctctgttgatggtgtattgtccgatttccctattaccccttcagaggcagtcggttgctttagtaaccttaacgacagcaagatagatcatgctaaacctctagtaatctctcacaatggtgccagtggtgactacccagactgcactgaccaagcttaccaaaaggcagttgctgatggtgcagatgtcattgactgtcctgttcaagtgaccaaagatggcataccaatatgcatgagttccattgacctgatggatgttactactgttgcaacatcacaatttgccactccagcagttaccataacagatcttaagcctgttcctggagtcttttccttcaacctcacttgggatgatatttcgaagaacctgaagcccatgatatcaaacccattgagcaagttccaactatatagaaatccaagaaacaagaatgccgggagtttcatgagactatcagactttttggcctttgcaaaagataaggatttgtctggaatcatgatcactgtagagcgtgctgcattcatggcagagaagcttggatttggtgtggtagatgcagtgatcaaagcccttgatgactctggttacagcaaacagactgcccagaaagttatgatccagtcaacgaacagctcagttctagtgaagttcaagcaggaaaccaagtatgaccttgtctacatgatcgaggaagatgtcagagatgctgcgccttcctcccttgcagacattaagaagtttgccagtgctgtttctgtcagcaccaaatccattttcccaacaaccaatcaattcttgacaaaccagaccaataatctcgtcacatcccttcaatcttctggcctcccagtttatgtttatctgctcatgaatgagtttgtttctcaaccgtatgactttttctcagacgccacggcacagatcaatggttatgtgcaaggtgctaaagtggatggagtcatcacagatttccctgggactgctcacagatacaaattgaactcttgcatgggaaagaatgcaccggactttatgcggcctgcgcagccagggggtatcctttcagtcatggacccaggtgctcagccaccagcggcagccccaatgccgctcttgacagactctgacgttgcagaaccacccctacctccggtcagcaacaccaccacagcttcgacgccttcccatgctgccctcagaatgaagaccgatgcctccatcctcatcacattgctggtgctatgtgcttctctcctgatttgaagatagtcctgcacattgcggaatggggcgttagatctctaatgaatgcatatcgagctgctaatagctattcttttccaccacttcatgtagcaattcttttttttcttttttctttttgttttgcggaattcgggggatgtggatgttcagcttgataccccaacggtggcacttatgtgtgctgcgcgtatcaacattttggtacatatgtgtggtgataaaaaaaaaaaaaaaaaaaa

SEQ ID NO: 3086 - protein, 745 aa, Panicum virgatum
  misc_feature: Ceres CLONE 1789344
  misc_feature (1)..(295): Pfam Name: GDPD Pfam Description: Glycerophosphoryl diester phosphodiesterase family
MGRSSRACSVLGSALLLLLLSLGSAAAQKGSTWKTLSGKAPAIIAKGGFSGLFPDSSGNAYQFVGIASSPDTAISCDVWLTKDAVGICLPNINMDNCTTISDQFPQGKKTYNVNGVSTAGWFSVDFTITDLQNVTLKQSILSRPYYFDGLWPIVPVDAVLSQFKVPAVWLNVPLDSFYSQFKLNMRSYILSLTKQYIVDYISSPEVNFLTSISGRVSKKTKLVFRFLDERSIEPSTNQTYGSMLKNLTFVKTFASGILVPKNYIWPVTPDNYLLSYTSVVDDAHKAGLEVYAAGFANDFAISYNYSYDPLTEYLSFIDNGAFSVDGVLSDFPITPSEAVGCFSNLNDSKIDHAKPLVISHNGASGDYPDCTDQAYQKAVADGADVIDCPVQVTKDGIPICMSSIDLMDVTTVATSQFATPAVTITDLKPVPGVFSFNLTWDDISKNLKPMISNPLSKFQLYRNPRNKNAGSFMRLSDFLAFAKDKDLSGIMITVERAAFMAEKLGFGVVDAVIKALDDSGYSKQTAQKVMIQSTNSSVLVKFKQETKYDLVYMIEEDVRDAAPSSLADIKKFASAVSVSTKSIFPTTNQFLTNQTNNLVTSLQSSGLPVYVYLLMNEFVSQPYDFFSDATAQINGYVQGAKVDGVITDFPGTAHRYKLNSCMGKNAPDFMRPAQPGGILSVMDPGAQPPAAAPMPLLTDSDVAEPPLPPVSNTTTASTPSHAALRMKTDASILITLLVLCASLLI

SEQ ID NO: 3087 - DNA, 1379 bp, Panicum virgatum
  misc_feature: Ceres CLONE 1789356
  misc_feature: Encodes the peptide sequence at SEQ ID NO. 3088
gctatggctccaaacgacgccgctactgccgctccgtccgagccggagagcgtcggcggccggatgagcagcgaggacatggtcgccacgaggccgctcctctcggcgccctccccctccccctccgcagcctccgcggcgccggtgcaggagagcatagaggagctggaccggaagtacgcgccgtacgcgcggcgggacgcgtacgggccgatgggcctcgggcccgtgggcgcgctggaggcgttccggctggctttcgcggcggtcgtgctcgtcccactccgggtcgtggcaggcatgctcgtcctcgtggtctactacctcgtgtgccgcgtgtgcacgctgtgggtggaggaggagcgggagggcggcgaaggggacgggtacgcgcggctggaggggtggaggcgggagggggttgtgcggtgcggccgcgcgctcgctcgcgccatgctgttcgtcttcgggttctactggatcccggagtacgactgccgcttcgctgatgccgaggatgggcatgcagaccagtctaaagaaatggaaaggcctggggctattgtatctaatcatgtttcttatgtggatattctttatcatatgtcggcctcttttcccagttttgttgctaagagatcagtaaccagattgcccctagttggtctcataagcaaatgtcttggatgcatttttgttcagcgggagtctaaaacatcagatttcaaaggtgtttcaggtgctgtaactgaaagaatccagcgtgctcatcaacagaaaaatgcgccaatgatgctactctttcctgaaggcacaactacaaatggggattatctccttccattcaagacaggtgcttttattgcaaaagcaccagttcagcctgtcattttaagatatccttacaaaagatttaatccagcatgggagtccatgtcaggggcacgccatgtatttctgctcctttgtcaatttgtaaattatctagaggtgatccatttgcccgtctactatccttctgagcaagaaaagaatgatcctaagctctatgcaaataatgtgcggaaattaatggcagtggagggaaacttaattctttcagaccttgggctggcagagaagcgagtataccatgcagcactgaatggtaatagtctacctcgtgttttacatcagaaagatgattgaaataccattctgtcgtgcttccataatactgacagttgagtggtttgcttgtaattgtgtatacatgcttgtgcattgtcatggctgagaggactgttgtgaatatcatattgacataaagctgtaaaacaatttgcaaactgccagttcagtaattatgtcagttataccaaaaaaaaaaaaaaaaaaaa

SEQ ID NO: 3088 - protein, 394 aa, Panicum virgatum
  misc_feature: Ceres CLONE 1789356
  misc_feature (1)..(130): Pfam Name: Acyltransferase Pfam Description: Acyltransferase
MAPNDAATAAPSEPESVGGRMSSEDMVATRPLLSAPSPSPSAASAAPVQESIEELDRKYAPYARRDAYGPMGLGPVGALEAFRLAFAAVVLVPLRVVAGMLVLVVYYLVCRVCTLWVEEEREGGEGDGYARLEGWRREGVVRCGRALARAMLFVFGFYWIPEYDCRFADAEDGHADQSKEMERPGAIVSNHVSYVDILYHMSASFPSFVAKRSVTRLPLVGLISKCLGCIFVQRESKTSDFKGVSGAVTERIQRAHQQKNAPMMLLFPEGTTTNGDYLLPFKTGAFIAKAPVQPVILRYPYKRFNPAWESMSGARHVFLLLCQFVNYLEVIHLPVYYPSEQEKNDPKLYANNVRKLMAVEGNLILSDLGLAEKRVYHAALNGNSLPRVLHQKDD

SEQ ID NO: 3089 - DNA, 1619 bp, Panicum virgatum
  misc_feature: Ceres CLONE 1789361
  misc_feature: Encodes the peptide sequence at SEQ ID NO. 3090
tctcctccgtctccgtccaccgctggcgctgcgagtgcgagctcgccagatatttttacccgcctccctcctcgccgttccgcgctcacgagcccccgggcaagccatgaactgcctccagaacctgctcaaggagcctccaatcgtgggatccaggtccatgaggcgtccctctccgctcaatctggcaatggtccgtggcgggagtcgccgatcaaataccgtcaaaactatgcagccacctggggcgaccacttctggtgcagagaacagtgcactcgaggtcggcacggagaagtccgaagtgtacagcactaacatgacacaggctatgggagcagtgttgacatatagacatgagctcggaatgaactacaatttcatacgcccagacttgattgtgggctcctgcttacagagtccgcttgatgttgataagcttcgaaagattggtgtgaaaactatattctgtttgcagcaggattcagaccttgaatattttggagtcgacatccgtgccattcaagattattctctaaaattcaaagatattgagcactgccgtgctgagattagggattttgatgcttttgatttgcgattgaggcttcctgctgtggttagcaaactgcacaagctcgtcaactgtaatggtggtgtaacatatattcattgtactgctggacttggaagagctcctgctgtggcacttgcttatatgttctggattcttgggtacagtcttaatgaaggacatcagctacttcagagtaaaagggcttgctttccaaagttggaagccattaagttggcaactgctgacattctgacgggattatccaaaaatacaatcactttgaagtgggaagatgatagttgttcttctgttgaaatttctgggctcgacattggctggggtcagaggatccctttgaaatatgataaggagaaaggagcttggtttctggagaaagagctgcctgaagggcggtatgaatacaaatacatagtggatggcaagtgggtgtgcaatgagcatgagaatataaccaaaccgaatgctgacggtcatgtgaacaactacgtccaggtctccagagatggcacgagtgatgaagagaaggaactgagggagcgtttgactggtcccaaccccgatcttacgcatgaggaaaggctgatggtcagagagtacttggaacaatacgtggatgctgagcattaggaggttcagttgaggccattcccattccatgggctagtgtataaacaagttcattggaattggatataagtattgacatgaactgcagaagctagtgaccttgtgagccttggcgagaggaaacaacacatggcgatgaagagacgatggacctttccggtgaagattgttgttgttggcttccccatgtcaatagtagcttaaccgaggaaatgggcacactgtgcatatacagaaggagcaatttgtgttgttgacaccatcgtggctgcatagaaataataataagtattgtaaattcactatcataaaataactagtgtatggtcctgaataaatccaaggtagcttatatgctttaatttccccttgtcaaaaaaaaaaaaaaaaaaaa

SEQ ID NO: 3090 - protein, 372 aa, Panicum virgatum
  misc_feature: Ceres CLONE 1789361
  misc_feature (1)..(92): Pfam Name: DSPc Pfam Description: Dual specificity phosphatase, catalytic domain
MNCLQNLLKEPPIVGSRSMRRPSPLNLAMVRGGSRRSNTVKTMQPPGATTSGAENSALEVGTEKSEVYSTNMTQAMGAVLTYRHELGMNYNFIRPDLIVGSCLQSPLDVDKLRKIGVKTIFCLQQDSDLEYFGVDIRAIQDYSLKFKDIEHCRAEIRDFDAFDLRLRLPAVVSKLHKLVNCNGGVTYIHCTAGLGRAPAVALAYMFWILGYSLNEGHQLLQSKRACFPKLEAIKLATADILTGLSKNTITLKWEDDSCSSVEISGLDIGWGQRIPLKYDKEKGAWFLEKELPEGRYEYKYIVDGKWVCNEHENITKPNADGHVNNYVQVSRDGTSDEEKELRERLTGPNPDLTHEERLMVREYLEQYVDAEH

SEQ ID NO: 3091 - DNA, 2039 bp, Panicum virgatum
  misc_feature: Ceres CLONE 1789384
  misc_feature: Encodes the peptide sequence at SEQ ID NO. 3092
gaagctttcctccgttctcatcttctcggggtggggggcaacaggtggtgcgatcttgttgggttctccgccgccatggcattgcccgttcccttcgtccgcctgacgctgctgctgctcgtcgccctgccattctgcgcggcgcatcccggtccgggcttccatgctcatcgcgagttccagaggcccgcgctccactcagatggatttgtcttggtggcaaggagatcaattgctgaagctcctgctgacataaacatcactacgaatagctcctttgtcttggcggcagataggacgtaccgcagggaccccttgaatggtttcaggaaatatccaggtggctggaatatcagtgaagtgcactattttgcttctgttggatatacagccattcccctgtttgcgattgccctggtgtggtttgtgttcttttttctggttatgcttgggatttgctgccatcattgctgttgtccacatcgcagttacaagtattctagaacagcatatgccttgtcattgatacttctaatattgttcacttgtgctgcaattgctggatgtgttatgttatatgatggccagggcaaattccacagaagcacaacaactactctgaaatttgttgttagccaggcaaattataccgttgacaaccttaggaacctatctgatagtttgtctgctgcaaagaaggttgacattgggcgattcttactgccttctgatgtgcaaaatgaaatcaacgaaattcaagggaagttggattcatcagctaatgatcttgctgttaaaacaacagataatgcttcaaagataaaaaaattgctaaaccaagtgcggatggctttaattgtcattgcggctgtaatgcttcttctggctttcattggcttcttgttatccatctttgggctggaattccttgtctccgttttggtggttattggatggatactagttactggaacatttatcctgtgtggtgtcttccttcttctgcacaatgtcacgtcagatacctgtgttgcaatggaggagtgggttgctcatcctactgaacacactgccctggatgagattatcccttgcgttgaacctgccacagcaaatgagtccctgtatagaagcaggcatgtcactttccagctagtgaatctggtgaaccaggtgatcaccaacgtgtcgaatcagaactttccttctcctcctcccgtagcaacacccttctactacaatcagtcggggccattgatgccgctgctctgcaacccattcgcacctgatctgagcaaccgcacctgcaccagaggagaggttaccttggacaatgcaacacaggtttataggagctttgaatgccagaccaccactgtctcaggagccgagatctgcaccacggtggggcgtgtcacccccaggatctatggccagatggcggccggtgtgaccgtgagccaggggctgtaccagtatggccctttcctcattcagctggaggactgcaccttcgtccgcgacacgttcacgaccatcaaccaggagtactgccctggcctacagcggtacagcaagtgggtgtacgtcggcctggtgatggtctcggcggcggtgatgctgtccctgatcttctgggtgatctacgcgagggagcggcgccaccgcgtgtacaacaagcagtacatcgcccagcaccagccgtacccggtggaagagaagccggccccaaccgccccacacgcttgatgaccgttcccatatgcctgtgcatactcggtgctagtggttttcgtaatgtagatcgccggacccttgattgttggttgcttgctgattttcgtagccgaggtttatgtgcattttcgttctgacggtagctggatttgtggctcgaatttgcagaggtcagacagacttcgtctgtccgtgtttcggtttctgttgggaatggtcattggtggtgtactgtacatacagtcatggtctggaagaactgcatggtcttcagtttgcttcaaaaaaaaaaaaaaaaaaaa

SEQ ID NO: 3092 - protein, 557 aa, Panicum virgatum
  misc_feature: Ceres CLONE 1789384
  misc_feature: Great-hit functional homolog of the protein sequence given in SEQ ID NO 9744
  misc_feature: Useful for making plants with modulated biomass
  misc_feature: The rosette leaves do not appear in the normal fashion, i.e., their phyllotaxy may be abnormal or too many leaves may be emerging in comparison to the control.
MALPVPFVRLTLLLLVALPFCAAHPGPGFHAHREFQRPALHSDGFVLVARRSIAEAPADINITTNSSFVLAADRTYRRDPLNGFRKYPGGWNISEVHYFASVGYTAIPLFAIALVWFVFFFLVMLGICCHHCCCPHRSYKYSRTAYALSLILLILFTCAAIAGCVMLYDGQGKFHRSTTTTLKFVVSQANYTVDNLRNLSDSLSAAKKVDIGRFLLPSDVQNEINEIQGKLDSSANDLAVKTTDNASKIKKLLNQVRMALIVIAAVMLLLAFIGFLLSIFGLEFLVSVLVVIGWILVTGTFILCGVFLLLHNVTSDTCVAMEEWVAHPTEHTALDEIIPCVEPATANESLYRSRHVTFQLVNLVNQVITNVSNQNFPSPPPVATPFYYNQSGPLMPLLCNPFAPDLSNRTCTRGEVTLDNATQVYRSFECQTTTVSGAEICTTVGRVTPRIYGQMAAGVTVSQGLYQYGPFLIQLEDCTFVRDTFTTINQEYCPGLQRYSKWVYVGLVMVSAAVMLSLIFWVIYARERRHRVYNKQYIAQHQPYPVEEKPAPTAPHA

SEQ ID NO: 3093 - DNA, 2011 bp, Panicum virgatum
  misc_feature: Ceres CLONE 1789391
  misc_feature: Encodes the peptide sequence at SEQ ID NO. 3094
aaggcacactcttctactcctctcctgctgcagtcccactcctacactccactcgcagcaagctctagccatggatcccaccaaggtgagcgcaaggcagccatcttttccatcggcatggagtattattgtagctagttagttaatctctgattaattatacactcaggtcgagctagctactaattattactagcaatgaaattataaatctttttgtttttattatgaactactccgcgcgcgtgtgctagtaataatcaagcaagtactaatacgacgcgcatggcatgtgggcggcgcgtggcagttccggccgtcgagctcgcacgacggcggcgtgacgacgaccaacgccggcgctcctgtgtggaacgacaacgaggccctgacggtgggcccccgcgggcccatcctgctggaggactaccacctgatcgagaaggtggcccacttcgcccgcgagcgcatcccggagcgcgtcgtccacgcgcgcggcgcctccgccaagggcttcttcgagtgcacccacgacgtgtcggacctcacctgcgccgacttcctccgcggccccggcgcccgcacgccggtgatcgtgcgcttctccacggtgatccacgagcgcggcagcccggagacgatccgcgacccgcgcgggttcgccgtcaagttctacacccgggagggcaactgggacctgctgggcaacaacttccccgtcttcttcatccgcgacggcatcaagttccccgacgtgatccacgccttcaagcccaaccccaggtcgcacgtgcaggagtactggcgcgtcttcgacttcctctcgcaccacccggagagcctccacaccttcttcttcctcttcgacgacgtcggcgtgcccgccgactaccgccacatggagggcttcggcgtcaacacctacaccttcgtcaacaaagccggcaaggccagctacgtcaagttccactggaagcccacctgcggggtgcgctgcatcctcaccgacgaggaggcggcgctcgtcggggggcgcaaccacagccacgccacgcaggacctctacgactccatcgccgcgggcagcttcccggagtggcagctgctggtgcaggtgatggacccggacacagaggaccagtacgacttcgacccgctggacgacaccaagacgtggcccgaggacctgctgccgctgcggccggtggggcggctggtgctggaccggaacgtggacaacttcttcaacgagaacgagcagctggcgttcggccccgggctggtggtgccggggatctactactcggacgacaagatgctgcagtgccgggtgttcgcgtacgccgacacgcagcgctaccggctggggcccaactacctgatgctgcccgtgaacgcgccgcggtgcgcgcaccacaacaaccactacgacggcgccatgaacttcatgcaccgggacgaggaggtggactactacccgtccaggcacgcgccgctgcggcaggcgccgccggtgccggtgccgccgaggccgctggcggggaggagggagaaggccaccatcaggaagcccaacgacttccagcagcccggggagaggtaccggtcctgggacgccgacaggcaggagcggttcgtcaggaggttcgccgactcgctggggcacccaaaggtcagccaggagctgagatcgatctggatcgacctgctctcgaagtgcgacgcgtcgctggggaagaagatcgccacccgcctcaacgtcaagccaagcatgtgaagatatatggagtccgtcctctcctctccttatccagcgagcaataacttaacacgagccagcggcaggacaccagagagagatagatagatgttgatcatcatcaagctgcatgcgtgtgtcagtcaagtttattcgttacatctgcatgctatatatattcctatgtatgtcacatatatatgtatatacatacgcatgtactactctactcaaaaaaaaaaaaaaaaaaaa

SEQ ID NO: 3094 - protein, 512 aa, Panicum virgatum
  misc_feature: Ceres CLONE 1789391
  misc_feature (64)..(195): Pfam Name: Catalase Pfam Description: Catalase
MACGRRVAVPAVELARRRRDDDQRRRSCVERQRGPDGGPPRAHPAGGLPPDREGGPLRPRAHPGARRPRARRLRQGLLRVHPRRVGPHLRRLPPRPRRPHAGDRALLHGDPRARQPGDDPRPARVRRQVLHPGGQLGPAGQQLPRLLHPRRHQVPRRDPRLQAQPQVARAGVLARLRLPLAPPGEPPHLLLPLRRRRRARRLPPHGGLRRQHLHLRQQSRQGQLRQVPLEAHLRGALHPHRRGGGARRGAQPQPRHAGPLRLHRRGQLPGVAAAGAGDGPGHRGPVRLRPAGRHQDVARGPAAAAAGGAAGAGPERGQLLQRERAAGVRPRAGGAGDLLLGRQDAAVPGVRVRRHAALPAGAQLPDAARERAAVRAPQQPLRRRHELHAPGRGGGLLPVQARAAAAGAAGAGAAEAAGGEEGEGHHQEAQRLPAARGEVPVLGRRQAGAVRQEVRRLAGAPKGQPGAEIDLDRPALEVRRVAGEEDRHPPQRQAKHVKIYGVRPLLSLSSEQ

SEQ ID NO: 3095 - DNA, 1543 bp, Panicum virgatum
  misc_feature: Ceres CLONE 1789399
  misc_feature: Encodes the peptide sequence at SEQ ID NO. 3096
ttcgcagacgcgactagccagcgaaggcacggccatgggttcccacaccggcggcggcggcagccgcgtgctcctcctgccgtacccgagccagggccacgtccacccgatgctccagttcgccaagcgcctggcgctccatggcctgcgccccacgctggcggtcacccgcttcatcctcgcgacctgcgcgcccgacgccgccgcgctgggcggcgtccgcctcgccgccgtctcggacggcttcgaccgcggcggcttcggcgagtgtggcgacgtcaccacctacctcgcccggctcgaggacgcgggctccgagacactggcggagctcctccgggacgaggccgccgccggccgccccgtccgcgcggtggtctacgacgcgttcctgccgtgggcgcgggccgtggcccagcgccacgccgccgccgccgccgccttcttcacgcagccgtgcgccgtcaacgtcacctacgggcacgtgtggcgccgccgggtgggcgtgccggcggataaggggatggtccgcctgcccgggctgccggcgctcgagccggagggcctgccttggttcctcagggtcgggcccggcccgtacccggcctacttcgagctggtgatgcgccagtttcagggcctggaggaagccgacgacgtgctcgtcaattcggtccacgagctggagcccgaggaggcggagtacatggcgtcggcgtggcgcgccaagacgatcgggccgacggtgccggcgtcctacctcggcgacggccgcctcccgtccgacaccaagtacggcctccacctcttcgagctgaccacggcgccgtgcgtcgcctggctggacgcgcaccagccgcgctccgtggtgtacgcctccttcggcagcctgtcggacctcgacccgtcggagatgcgggaggtcgcgcgcggcctcctcgactccgggcggccgttcctctgggtggttcgcgcgtcggaggcccacaagctgcccgccggctacgaggacgacgcccgcggcggcgggctggtggtgtcgtggtgcccgcagctggaggtgctggcgcaccgcgccgtggggtgcttcctgacccactgcgggtggaactcgacggtcgaggcgctggtggccggcgtgccgatggtggccgtgccgcagtggacggaccagcccatgaacgccaggtacgtggaggccgcgtggcgcgtcggcgtgcgggtgcggccggcggctgccgacgggctcgtgcggaggggcgaggtggccgggggcatcgaggaggtgatgggcggggagaggagcggcgagtacagacgcaacgccgccgcgtggatggagaaggccagggcggcgagcagggagggcggcagctccgacaggaacatcgccgagttcgtggccaagtactcctccaactccaagtgatcagtcttgtagcaaattggcatcacatgaactcctgacatgttggcctaatattgtagctacaaatgatttagacatttgcatctcagaacacaaaaaaaaaaaaaaaaaaaa

SEQ ID NO: 3096 - protein, 464 aa, Panicum virgatum
  misc_feature: Ceres CLONE 1789399
  misc_feature (1)..(131): Pfam Name: UDPGT Pfam Description: UDP-glucoronosyl and UDP-glucosyl transferase
MGSHTGGGGSRVLLLPYPSQGHVHPMLQFAKRLALHGLRPTLAVTRFILATCAPDAAALGGVRLAAVSDGFDRGGFGECGDVTTYLARLEDAGSETLAELLRDEAAAGRPVRAVVYDAFLPWARAVAQRHAAAAAAFFTQPCAVNVTYGHVWRRRVGVPADKGMVRLPGLPALEPEGLPWFLRVGPGPYPAYFELVMRQFQGLEEADDVLVNSVHELEPEEAEYMASAWRAKTIGPTVPASYLGDGRLPSDTKYGLHLFELTTAPCVAWLDAHQPRSVVYASFGSLSDLDPSEMREVARGLLDSGRPFLWVVRASEAHKLPAGYEDDARGGGLVVSWCPQLEVLAHRAVGCFLTHCGWNSTVEALVAGVPMVAVPQWTDQPMNARYVEAAWRVGVRVRPAAADGLVRRGEVAGGIEEVMGGERSGEYRRNAAAWMEKARAASREGGSSDRNIAEFVAKYSSNSK

SEQ ID NO: 3097 - DNA, 1818 bp, Panicum virgatum
  misc_feature: Ceres CLONE 1789413
  misc_feature: Encodes the peptide sequence at SEQ ID NO. 3098
aactcgcagtctcgatctccttcctcccccaccccactcttcctctccggggcctgctgctggcgaggtcgagcgctagctagcaagatggtggcgtcccgcaggttcaagcccatcgaggagtgctgcttggaggggcggtcggagcagacggtggcggcggacctggacggcacgctgctcatctcccggagcgcgttcccttactacctcctcgtggcgctcgaggccgacagcgtcctccgcgccgtgctgctcctcctctccgtgcccttcgtctacgccacctacatcttcttctccgagtcgctggccatcagcacgctcgtctacatctccgtcgcggggctcaaggtgcgcagcatcgagatggtggcgcgctccgtgctgcccaggttctacgccggcgacgtccacccggagagctggagggtgttcagctccttcggcaagcgctacatcatcacggccagcccccggatcatggtcgagcccttcgccagggcgttcctcggcgccgacaaggtcgtcgggacggagctggaggtcggcaagaacggcaaggccacgggcttcatggtcaagcccggcgtcctcgtcggggaccacaagaagcaggccgtcgtcagggagctcggcgacgcggtgcccgacgtcggcatgggggacagggagaccgacttcgacttcatgtccatctgcaaggaggcctacctggtcacgtcgaggaagaagtacagcccggtgccccggaaccagctgctgagcccgttgatcctgcacgacggccgcctcgtgcagcgcccgacgccgctcgtcgcgctcgtcaccttcctgtggatgcccttcggcttcgcgctcgcgctcatgcgcgtctacatcaacctgcccctgcccgagcgcatcgtctactacacctacaagctcatgggcatcaggctcatcgtcaagggcaccccgccgccgccgcccaaaaaggggcacccgggggtgctcttcgtctgcaaccaccgcaccgtgctcgaccccatcgaggtcgccgtcgcgctccgccgcaaggtcagctgcgtcacctacagcatctccaagttctccaagctcatctcgcccatcaaggccgtcgccctgtcgcgggagcgcgacaaggacgctgagaacatccgccgcctgctggaggagggcgacctcgtcatctgccccgagggcaccacctgccgcgagcccttcctgctgcgcttcagcgcgctgttcgccgagctcaccgaccgcatcgtgcccgtggcgatcaacaccaaggagagcatgttccacggctccaccgtgcgcggcttcaagctcatggacccctacttcttcttcatgaacccgcggccgacgtacgaggtcaccttcctgaaccagctgcccaagaagctcacctgcagcggtggcaagtcgcccatcgaggtcgccaattacatccagaagacactcagcggccagctcggcttcgagtgcaccaccatcacccgcaaggagaagtacggcatactcgccggcaccgacggccgcgtcccgtccaagaataaggagaaggagaagaactagcggcgaaatagatcaaagcgggggcagcaaacgatcactactccggactcaggcagccgattattactgctgttatttgttccgattaattgttgtttgtcgaaaagttggtcaattactcattgtttcaattgacaatgtcatggggctctgtattagtacaagcttggagatcataagtatctgaaaattctttcccctttctgaatctaaaaaaaaaaaaaaaaaaaa

SEQ ID NO: 3098 - protein, 499 aa, Panicum virgatum
  misc_feature: Ceres CLONE 1789413
  misc_feature (1)..(120): Pfam Name: Acyltransferase Pfam Description: Acyltransferase
  misc_feature (4)..(496): SWISSPROT Homolog: EC 2.3.1.15 Glycerol-3-phosphate acyltransferase 4
  misc_feature (5)..(496): SWISSPROT Homolog: EC 2.3.1.15 Glycerol-3-phosphate acyltransferase 6
MVASRRFKPIEECCLEGRSEQTVAADLDGTLLISRSAFPYYLLVALEADSVLRAVLLLLSVPFVYATYIFFSESLAISTLVYISVAGLKVRSIEMVARSVLPRFYAGDVHPESWRVFSSFGKRYIITASPRIMVEPFARAFLGADKVVGTELEVGKNGKATGFMVKPGVLVGDHKKQAVVRELGDAVPDVGMGDRETDFDFMSICKEAYLVTSRKKYSPVPRNQLLSPLILHDGRLVQRPTPLVALVTFLWMPFGFALALMRVYINLPLPERIVYYTYKLMGIRLIVKGTPPPPPKKGHPGVLFVCNHRTVLDPIEVAVALRRKVSCVTYSISKFSKLISPIKAVALSRERDKDAENIRRLLEEGDLVICPEGTTCREPFLLRFSALFAELTDRIVPVAINTKESMFHGSTVRGFKLMDPYFFFMNPRPTYEVTFLNQLPKKLTCSGGKSPIEVANYIQKTLSGQLGFECTTITRKEKYGILAGTDGRVPSKNKEKEKN

SEQ ID NO: 3099 - DNA, 1531 bp, Panicum virgatum
  misc_feature: Ceres CLONE 1789419
  misc_feature: Encodes the peptide sequence at SEQ ID NO. 3100
gcacacacatggacgcgagccagggcgtcctcctgtccagctccctggtcgccgccgccaatggccccgcgttgtggccggagctgctcggctcccggcactgggacggcctcctcgacccgctcgacctcacgctccgccgcctcatcctgctctgcggcgacctctgccaggtcacctacgactccttcaactccgactcccactccaagtactgcggcagctgccgctactcccgctccacgctcttcgcccgcaccatgttcccggccgccgccgacgtcgccccggcggcctacctctacgcgacctcccaggcgtcgttcccgggcggcatcatggtgttctcgctctcccgcgaggcctggagcaaggagtccaactggatcggctacgtcgccgtgtccacggacgccgccgccgccgccacgggccagcgcgtcatctacgtcgcgtggcgcggcaccatccggacgctcgagtgggtggacgtgctcaagccggacctcgtctcgcccaacggcgtcctgccggagggggacccggcccgcgtcatgaagggctggtacctcatctacacatccagcgacgagcgctcgcccttctcccagcacagcgcgcgggaccagctgctcgccgcggtgcgcgggctggtggccaggtacaagggcgagagcctcagcatcgtgtgcaccggccacagcctcggcgcgtcgctcgccacgctctccgcgttcgacatcgcggtgaacggcgtgtcgagggtcgccggcgccgacatccccgtcacggccatcgtgttcgggagcccccagatcgggaaccccgagttcaagaagcggttcgaggagctgcccaacctgcgcgcgctgcacgtcaggaacgagcccgacctgatcccgttgtacccgagcggcctcctgggctacgccagcgtcggcgacctcctggccgtgaactcgaagaagtcgccgtacgtgaaggagagcaccaccaacgtcggcgactaccacaacctgcagggcatcctgcacacggtggccggctggaacgggaaggacggcgagttcaagctgcaggtgcaccgcagcgtggcgctggtgaacaagtcgtccgcgttcctcaaggacaacaacctcgtgccggagtcatggtgggtggagcggaacaaggggatggtcatcggggaaaccgggctgtggcagctcgagccgcctgccgaggagaacctgcccgtcccgccggtagtgaccgggaaggtcatcggcgacgacgtcgccgccgccgctaccacggctagcaaagagacgaagatgccggcggaggacaagaagaaggggaccggagctaatcttttctcggcatgctttagagtttagaggggtcaatcagtttgttcataggattaatttgaatggttgaatgtttgaacgatctttaatttgctactattggtgtgatgtgatggtgcttaaggctgtgtttacttcaataaaggtttggattttggcaaaaaaaaaaaaaaaaaaaa

SEQ ID NO: 3100 - protein, 456 aa, Panicum virgatum
  misc_feature: Ceres CLONE 1789419
  misc_feature (1)..(164): Pfam Name: Lipase_3 Pfam Description: Lipase (class 3)
MDASQGVLLSSSLVAAANGPALWPELLGSRHWDGLLDPLDLTLRRLILLCGDLCQVTYDSFNSDSHSKYCGSCRYSRSTLFARTMFPAAADVAPAAYLYATSQASFPGGIMVFSLSREAWSKESNWIGYVAVSTDAAAAATGQRVIYVAWRGTIRTLEWVDVLKPDLVSPNGVLPEGDPARVMKGWYLIYTSSDERSPFSQHSARDQLLAAVRGLVARYKGESLSIVCTGHSLGASLATLSAFDIAVNGVSRVAGADIPVTAIVFGSPQIGNPEFKKRFEELPNLRALHVRNEPDLIPLYPSGLLGYASVGDLLAVNSKKSPYVKESTTNVGDYHNLQGILHTVAGWNGKDGEFKLQVHRSVALVNKSSAFLKDNNLVPESWWVERNKGMVIGETGLWQLEPPAEENLPVPPVVTGKVIGDDVAAAATTASKETKMPAEDKKKGTGANLFSACFRV

SEQ ID NO: 3101 - DNA, 1941 bp, Panicum virgatum
  misc_feature: Ceres CLONE 1789439
  misc_feature: Encodes the peptide sequence at SEQ ID NO. 3102
gctaatcccggcaaaacgaatatgctctttgagttttcgatgctccagctcctcctcttgttggattccatccccattcctctggcgcatggccatggcggcggcgtagtgatgcgtcgtgcctacctgtgttggggggtgggcggctcactcaactactagcacttgagccagccaccacctgtcccctcccactcccaggccctgaacaccaagcatggcggccgccgccgtggtgcccaggccgcctccttctcttcctaccagggcctttccctccgcctcctccacctcctgctcttcccggcggtatcccctaagattaagaagaagcatgccccgcccccttgtgtgcgccgctgcatcgtcctccgtctggatgcccgatccggacctggagcctgagcccgcccgcgacgaccagcccgcgcccgagtccaggccccgccgcatcgccctcttcgtcgagccctcgcccttcgcctacgtctccggctacaagaaccgcttccagaacttcatcaagtacctccgggagatgggcgacgaggtgattgtggtcaccacgcacgagggcgtgcctcaagaattccacggagccaagctgattggatcctggagcttcccttgcccctggtatcaaaaggttccgctctcgctggcgctgagccctcgaatcatcggagaagttgctagattcaaacctgacattattcatgcctcttcccctgggattatggtatttggcgcgctaattatcacaaaattgctctgcgtccctctagtaatgtcataccacacccatgttccaatttatataccaagatatacgttcagctggcttgtcaagcccatgtggctaatcattaaattcttgcaccgagctgcagatctcacactggtaccgtcggttgcgatcggcagggatcttcaagctgcccgtgttacagcagccaataagatacgcctttggaacaagggtgttgattcagaaagcttccatcctcgcttccgaaataaggaaatgcgttcaaggctgactaatggtgaaccagagaagccactaatattgtatgttggacgcttaggagtggagaaaagtttggattttcttaagagagtcatggatcgacttccaggatcaagaattgcgtttattggagatggcccattcagggctgagcttgagcagatgttctcaggtatgcctgcagtgttcacgggtacgttgcaaggggaagagctatcgcaggcatatgccagtggggatgtgtttgtgatgccttcggagtcagagacgctcgggtttgtggtgcttgaggccatgtcatcaggagttccggtagttggcgctcgagctggaggaatacctgatattataccagaagatcaggaggggaagaccagctttctgtacacaccaggggatgttgatgactgtgttagcaagatcgagcgtctcttgtcatgcgaggagttgcgagagatgatggggagggctgccaggaaggagatggagaagtttgactggcgagcagcgacgaggaagatccggaatgagcagtacagcgctgccatctggttctggcgcaagaagagggcacagctgctgaggcctgtccaatgggtggtccggaggctgttgaggccgacgatgcctggggctggcaacaccgtcgcgaagcaatcatagatgaagaggaagcattctggagcatattgggtcagtgcatctgcttctgcggtgtggattgattggatgcgtgatgctcaacaacattgaagggaaggaagctcaagtttagggttccagtacactgaagaatggatgatcagtcgttatttggtttaggactagtagattgtaaatcgtacatatgcgtgcactacttattctcttacgacgttgcatttgcatcctaaaaaaaaaaaaaaaaaaaa

SEQ ID NO: 3102 - protein, 491 aa, Panicum virgatum
  misc_feature: Ceres CLONE 1789439
  misc_feature (1)..(164): Pfam Name: Glycos_transf_1 Pfam Description: Glycosyl transferases group 1
MAAAAVVPRPPPSLPTRAFPSASSTSCSSRRYPLRLRRSMPRPLVCAAASSSVWMPDPDLEPEPARDDQPAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIITKLLCVPLVMSYHTHVPIYIPRYTFSWLVKPMWLIIKFLHRAADLTLVPSVAIGRDLQAARVTAANKIRLWNKGVDSESFHPRFRNKEMRSRLTNGEPEKPLILYVGRLGVEKSLDFLKRVMDRLPGSRIAFIGDGPFRAELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELREMMGRAARKEMEKFDWRAATRKIRNEQYSAAIWFWRKKRAQLLRPVQWVVRRLLRPTMPGAGNTVAKQS

SEQ ID NO: 3103 - DNA, 1837 bp, Panicum virgatum
  misc_feature: Ceres CLONE 1789453
  misc_feature: Encodes the peptide sequence at SEQ ID NO. 3104
gcaatgcaagcatcggtcgacccactgttatttggggaagcagcaggcaggccaggtcgatcagcgatgatggctccaccagcggtctggcagctgcttcttcctctcggcctcctgtgcctctgtagctccgccgcctctctctccggtggcgccacggcggagggcgcagccgactacgtcgtcgtggccacgagctggctcaagacgaagccggtgtgccaagggctcagggtggatgcgccggcgaaccttaccgccagcagctgggtgccgctgagccactcctatggcccgtgctcggtggcggcggcgggaagttggtcgacgccggcgccggccgacgtgctgcggcaggaccagcgccgcgcgggctacatccagaggaagctcgccggcagcaccccccaggacgacaacggcagcgacctgccggagtcggactgcaagagcggccagtcggagcacgctcccaccattcaacccaacgttggccaagacagtagccccacgtcagagggctcggaggcggtgtccgtcatcgaaccgacggcgggcggtggcggcggcggcggcgggcagcgggtgcccggcgtgaagcagacgatggtgctggacacggcgagcgacgtggcgtgggtgcagtgcgccccctgccccatgccgcagtgccaccctcagacggacaccatctacgacccctcgcagtcgtcgacgtacgcgcccttcgcctgcggctcccccgtctgccgccagctcggcccctacggcaacggctgcgccgccgggtcccggcagtgccagtaccgcgtcctgtaccccgacgggcgctccaccatgggcacctacatctccgacgtgctccgcctcaaccccacctccgtcatcggcgggttccagttcgggtgcagtcatgctgtgcagggccacttccccaacgacaccgccgggatcatggcgctcggccgcggcgcacagtcgctagcgtcgcagaccaggctcacctacggtggcgtcttctcctactgccttccgcggacggcgagctacagcggcttcttcgtcctcggcgtgccccgggtcgccgccgcccggtacgccctcacgcccatgttcgccatcccgcaggcgccgatgctctacctcgtccgcctccgggccatcgtcgttgccggtcaggtcctcgccgtgccgccggcggtgttcgcgccgggctccgtcgtcgactcgcgctcggtgatcacgcgcctcccgccgacggcgtacgccgcgctgcgcgccgccttccgggccaggatggggatgtaccgggcggcgccacccaagcagcagctcgacacctgctacgacctcagcggggtgcgccgcgtcacgctgcccaccatcacgctggtgttcgaccacagcgccgccgtggagctcgacccgtcggggatcctctacaacgactgcctcgccttcgcccccggcaccgacgaccgggcgtggggggtcatcggcaacgtccagctgcagacctacgaggtgctctacaatgtcgccggcggcgccatgggcttccgccgtgccgcctgctgatcaaacctaccgtcacaaataaatatatatacacactaccaactgtagtatatatatatatttacctaccgtcattttgggccattgtatatggtggtcgcgttagaataagccgagttaactcgtgcacatgtatttgcgtggtctatcttaagcttcttgtagatgtaaaatgaagcttaagaactattttctgggcaagtctgtccaaaaagaaaatacatatatatatttttgacaaaaaaaaaaaaaaaaaaaa

SEQ ID NO: 3104 - protein, 524 aa, Panicum virgatum
  misc_feature: Ceres CLONE 1789453
  misc_feature (7)..(334): Pfam Name: Asp Pfam Description: Eukaryotic aspartyl protease
MQASVDPLLFGEAAGRPGRSAMMAPPAVWQLLLPLGLLCLCSSAASLSGGATAEGAADYVVVATSWLKTKPVCQGLRVDAPANLTASSWVPLSHSYGPCSVAAAGSWSTPAPADVLRQDQRRAGYIQRKLAGSTPQDDNGSDLPESDCKSGQSEHAPTIQPNVGQDSSPTSEGSEAVSVIEPTAGGGGGGGGQRVPGVKQTMVLDTASDVAWVQCAPCPMPQCHPQTDTIYDPSQSSTYAPFACGSPVCRQLGPYGNGCAAGSRQCQYRVLYPDGRSTMGTYISDVLRLNPTSVIGGFQFGCSHAVQGHFPNDTAGIMALGRGAQSLASQTRLTYGGVFSYCLPRTASYSGFFVLGVPRVAAARYALTPMFAIPQAPMLYLVRLRAIVVAGQVLAVPPAVFAPGSVVDSRSVITRLPPTAYAALRAAFRARMGMYRAAPPKQQLDTCYDLSGVRRVTLPTITLVFDHSAAVELDPSGILYNDCLAFAPGTDDRAWGVIGNVQLQTYEVLYNVAGGAMGFRRAAC

SEQ ID NO: 3105 - DNA, 1875 bp, Panicum virgatum
  misc_feature: Ceres CLONE 1789462
  misc_feature: Encodes the peptide sequence at SEQ ID NO. 3106
gctgttccccttcgcttcgcttcccttccttccccttcctcccgccgcgacgcgaagccgccaaacctgcaaggcgagctcgcagattcccacgagccccgcagccaaatcaacgcacagcgatcgcgagaaaccttccgcatagcttgtctcctccacgagtgctccagccggcaattgttcccccacggcgtcaatggcgagctccggcgatgaagggcgcgttgtggtggacctccgttccgcggcggagtcggtgggtcgggctggcgacgaggaggcgcacgatgcgccgatccaggagatcgagtccctatgcatgcgctgcgggaagaacggcacaacgagggtgatgcttacgctggtcccgaacttccgagaggtgattctgatgtccttcgagtgcccgcattgtggtgagagaaacaatgagactcagtttggtggtcagcttcagccgaaaggatgctgctatcgtttgaaggttccttctgggcagagagtgatactgaaccgccacgttgtcaagtctgattcagcgactatcaagataccagaactggactttgagattcctccagaagctcaacgtgggacatgttctactgtggaagggattattatgcgagctgtggatgagctgcaggctcttcaagatgaaagaaagaaagtagatcctcaaacggctgaagccattgatcaattttgcttgaagttgagatcttttgggtctggagaagctgcatttacctttattcttgatgatcctgcaggaaacagttttgttgagaacccgaatgctccatcatcagatcctttgctatctgtgagattctatgagaggacacgagaacagcaagcagcactcggtttcctcgctgaaccagaacaacctggagagggtgtgctgcctgcttcagcagtgggatccaattctggtgggttgcaaagcgagccccatggctcagttggagctgctgcaggtcgtcgtgctatagctcagggcaaccctgatgaagttgcggcagcactatgtagatactcagcaccagaagaggtcgacgtgttgccatcaacatgtggggcctgtggaaaagaatgtgtcacacgtttctttgctacaaaaatcccatatttccgggaggtgattcttatggcgacaacatgtgacttgtgtggttaccgcaattcagagctgaaggctgggggtgaaattccagctaaaggaaagaaaattactctacgtgttcaaaatgcaaaagacctgactcgtgatgtcataaagtcagattcagctggtgtgcaagtacctgaacttgagttggaactcgcaggtggaacattaggtggtattgtcacaacagttgaaggtttaattgtgaaaatatgcgaggctctggagaggatacgtggattccaatttggtgatagcacccttgaatgggaaaagaagaaatgggatgatttcaggaatcgactatccaagcttctgagtttgcaagagccctggactttgattcttgatgatggactggctgcttcatttgtagctccagctacagactcgttagaagatgataagcagctaactattgaggagtatgagaggagttgggagcagaatgaggaacttggcttgaatgacatggatacttcctcggcagacgctgcttacaacacaaccaagacatgattgtagtagcttgtaacattacattttcacttgtttaccttgaaaaaaaccgtgtgtaatgtgttgcatgtgacaataaacatcgagcattaatgtttggccaagggtgttctgaacacttttaagtttttttaatcgaaggacaaaagaagagaagggagtaaaaaaaaaaaaaaaaaaaa

SEQ ID NO: 3106 - protein, 498 aa, Panicum virgatum
  misc_feature: Ceres CLONE 1789462
  misc_feature: The sequence is a functional homolog of  SEQ ID NO 2316 in the  10/374,780 US patent application
  misc_feature: The sequence is a functional homolog of  SEQ ID NO 240 in the  10/412,699 US patent application
  misc_feature: The sequence is a functional homolog of  SEQ ID NO 48 in the  10/225,066 US patent application
  misc_feature: The sequence is a functional homolog of  SEQ ID NO 88 in the  10/666,642 US patent application
  misc_feature: Useful for making plants with modulated growth and phenotype characteristics
MASSGDEGRVVVDLRSAAESVGRAGDEEAHDAPIQEIESLCMRCGKNGTTRVMLTLVPNFREVILMSFECPHCGERNNETQFGGQLQPKGCCYRLKVPSGQRVILNRHVVKSDSATIKIPELDFEIPPEAQRGTCSTVEGIIMRAVDELQALQDERKKVDPQTAEAIDQFCLKLRSFGSGEAAFTFILDDPAGNSFVENPNAPSSDPLLSVRFYERTREQQAALGFLAEPEQPGEGVLPASAVGSNSGGLQSEPHGSVGAAAGRRAIAQGNPDEVAAALCRYSAPEEVDVLPSTCGACGKECVTRFFATKIPYFREVILMATTCDLCGYRNSELKAGGEIPAKGKKITLRVQNAKDLTRDVIKSDSAGVQVPELELELAGGTLGGIVTTVEGLIVKICEALERIRGFQFGDSTLEWEKKKWDDFRNRLSKLLSLQEPWTLILDDGLAASFVAPATDSLEDDKQLTIEEYERSWEQNEELGLNDMDTSSADAAYNTTKT

SEQ ID NO: 3107 - DNA, 1564 bp, Panicum virgatum
  misc_feature: Ceres CLONE 1789489
  misc_feature: Encodes the peptide sequence at SEQ ID NO. 3108
tctcgtctatctccttcctcctccctcccttccccacccacccatccacctcgccgcgccgcctccaccccgaaaccctagcggatcgtcgccatggccgcggccgcgctcctccgccgcctccccgccgcgcgggccccggccacggccttcatggcggcgcgaccgatctccgactccacggccgcgctcaccatcgagacgtccgtccccttcacctcccacctcgtcgacccgccctcccgcgacgtaaccaccacccccgccgagctcatgaccttcttccgcgacatgtccgtcatgcgccgcatggagatcgccgccgactccctctacaaggccaagctcatccgcggtttctgccacctctacgacggccaggaggccgtcgccgtcggcatggaggcggccatcacccgctccgactccatcatcaccgcctaccgcgaccactgcatctacctcgcccgcggaggggatctcgtctccgccttcgccgagctcatgggccgcgaggccggctgctcccgcggcaagggcggatccatgcatttctataagaaggatgccaatttctacggtgggcacggcatcgtcggcgcgcaggtgcccctcggatgcggcctcgccttcgcgcagaagtacaagaaggaggacaccgctactttcgcgctctatggtgacggtgcggctaaccagggacagctctttgaggcgctcaacatttcggccctttggaagctgcctgccatattggtttgcgagaacaaccattatggtatgggaacagcggagtggagggcagcaaagagccctgcctactacaagcgtggtgactatgtgcctggattgaaggttgatggaatggatgttcttgctgtgaagcaagcctgcaaattcgcaaaggagcatgctgttgccaatggtccaattgttcttgagatggatacctacaggtaccatggccactctatgtcagatcctggaagcacttaccgcagcagggatgagatttcaggtgtaagacaggagcgtgacccaattgagagggtaagaaagttgatctatgctcatgatctggcaactcctgctgagctcaaggatatggagaaagaaatcaggaaacaagttgatgatgccattgctaaagcaaaggaaagttctatgcccggcgcttctgagctcttcacaaatgtttataagaagggctttggtgtggagtcatttgggccagacaggaaggagttgagagcttcccttccataggctggcaacaagatggggcattagccgcaatatgatatgctagccaggagaaataaatattgacgaagaagacacctcaggcattgctcgaattttttgttgggaaaggaacctgtatagagatgcgttgtcaggaggatcagcttctttgttttgcttcattttttttccgttttctacaattcagtctaactgctaatgggtggcttcttattgaagctagaaatttggcccgcaaattggtctgttccaatgaaagtgaaactcaggttggggataaaaaaaaaaaaaaaaaaaa

SEQ ID NO: 3108 - protein, 390 aa, Panicum virgatum
  misc_feature: Ceres CLONE 1789489
  misc_feature (1)..(298): Pfam Name: E1_dh Pfam Description: Dehydrogenase E1 component
  misc_feature (1)..(390): SWISSPROT Homolog: EC 1.2.4.1 Pyruvate dehydrogenase E1 component subunit alpha-1, mitochondrial precursor
  misc_feature (17)..(390): SWISSPROT Homolog: EC 1.2.4.1 Pyruvate dehydrogenase E1 component subunit alpha, mitochondrial precursor
MAAAALLRRLPAARAPATAFMAARPISDSTAALTIETSVPFTSHLVDPPSRDVTTTPAELMTFFRDMSVMRRMEIAADSLYKAKLIRGFCHLYDGQEAVAVGMEAAITRSDSIITAYRDHCIYLARGGDLVSAFAELMGREAGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKEHAVANGPIVLEMDTYRYHGHSMSDPGSTYRSRDEISGVRQERDPIERVRKLIYAHDLATPAELKDMEKEIRKQVDDAIAKAKESSMPGASELFTNVYKKGFGVESFGPDRKELRASLP

SEQ ID NO: 3109 - DNA, 1713 bp, Panicum virgatum
  misc_feature: Ceres CLONE 1789490
  misc_feature: Encodes the peptide sequence at SEQ ID NO. 3110
acccgcatctgaatctgaggcacgcacgccccagccgcaccaactcttccgcggctcgacgagccaccccagcccggcttacccgacttggcctgccaccaccactgcggccacatcccccagcacggcagcaacaaaccccccctgccgcgcgcggcggatggcaacggccgcctccgcctcccccggcgcgctcggcggcgtcggcgccaaaaccccagcgcgggggccgagcgcgagcacgcgccacccggccccgaagccgaccccagcattcgcgaggccctccccgcgccgagcccccgcccccggcaggccccgcgccagcctccacctcggcggcgcgggcgcgggcgcgggcgtggccagcagcagcagcgccgccgccaacggcagcgggctccacgtgccccccgcgatcgcgccgctcgccctgcccaagatggccggcgccatggggacccacaagaatgtcctgctcttctactgcgaggagatgcgggagctcgcgcagcaggtggtcgcccggaacgatgatatcgagctgcgctccatctcctggaggacatttgctgatggattcccaaatttgttcatctcgaatgcccacagcattcgtggccggcatgttgcttttttagcatcatttagctcgcccagtgtcatatttgagcaactatctatcatatatgctctgccgaagttgtttatttcatcgttcactcttatactcccattttttccaaccgggacttctgaacgcatggaagacgaaggagacattgcaactgccttcacacttgccagaattttgtcaaatataccaatatcacgaggtggaccttcaagtttagtgatttttgatatccatgctttgcaggagagattctactttggagactcagtcttaccatgttttgagagtggcatcccattgctaaaaagtaggcttcaggagttgcctgattcccataatataaccatagcatttccagatgacggtgcttggaagcgcttctataagcaacttcaacattttcccatggttgtatgtaacaaagttagagaaggggagcagagaattgtacggataaaagagggagatcctagaggccgtcatgttgttatagtcgatgacttggtgcagtccggtggtactttgatcgagtgccagaaagtattggcagctcatggcgcagcaaaggtcagtgcatatgtgacacatggcattttccccaataactcatgggagaaatttcagcctgataatggagagggcccggagcatggcctgagccacttttggcttaccgattcatgccctctaactgtcaaggcggtgaaggacaggcggccgttcgaaattcttagcctggccggatctatttcttctgctcttcagatttagcaaactttggtctgcctcgtccctcaggatagtgttgagtgttcagttcattcttcttccttcacatttttctttttgaggatcttggtgtttttcctttctccaaccagattaccagaaggcattttgttaatgtatttactagaaaaccttgagatggtagacccatccaagcagggcgcattcgtcaaaaaacattcgttggatagtgtccgtctaataatttggctgagcaagtcaagtgtcggtctatgtaacataaataaaactctgaaataaagtgccaaaaaaaaaaaaaaaaaaaa

SEQ ID NO: 3110 - protein, 415 aa, Panicum virgatum
  misc_feature: Ceres CLONE 1789490
  misc_feature (1)..(415): SWISSPROT Homolog: EC 2.7.6.1 Ribose-phosphate pyrophosphokinase 3
  misc_feature (103)..(415): SWISSPROT Homolog: EC 2.7.6.1 Ribose-phosphate pyrophosphokinase 3, mitochondrial precursor
MATAASASPGALGGVGAKTPARGPSASTRHPAPKPTPAFARPSPRRAPAPGRPRASLHLGGAGAGAGVASSSSAAANGSGLHVPPAIAPLALPKMAGAMGTHKNVLLFYCEEMRELAQQVVARNDDIELRSISWRTFADGFPNLFISNAHSIRGRHVAFLASFSSPSVIFEQLSIIYALPKLFISSFTLILPFFPTGTSERMEDEGDIATAFTLARILSNIPISRGGPSSLVIFDIHALQERFYFGDSVLPCFESGIPLLKSRLQELPDSHNITIAFPDDGAWKRFYKQLQHFPMVVCNKVREGEQRIVRIKEGDPRGRHVVIVDDLVQSGGTLIECQKVLAAHGAAKVSAYVTHGIFPNNSWEKFQPDNGEGPEHGLSHFWLTDSCPLTVKAVKDRRPFEILSLAGSISSALQI

SEQ ID NO: 3111 - DNA, 1914 bp, Panicum virgatum
  misc_feature: Ceres CLONE 1789493
  misc_feature: Encodes the peptide sequence at SEQ ID NO. 3112
acaggttcgcattctaggctctagccagttttaagcagaccaaaccttcagttcctccccctcctggtaagctcacaacctcaacaactggagtaggatttctgggagcaactttgcttttcttcaaactgggcgccaagcagccggcaggcgcagatctgcagaactagagtgcgcggcgaccatcgtagcgatcatggaagtggtctcttgcagccactcctgctcggcattacatcaaacacctagaagtgcttggaagcttcggggcaggggtgttggtctggggcatgggcatgccaagtttcctgggcccagaagaagtgcgattctttgcgtcggaaccacaagaggaacttcaattccgggtgattccagcaaggttcatgccacccagggatttgttgatgcaaccctgcagggggttccttccagaaaagtcggagagattgagaaggtgatgattcagggcctcccggaaggccctgatagctctcccatcagtactggattctgggagtggaagccgaagttgacagtgtactatgagaggtcaggtaccaagaacagaaaagcgcctgcggtgctcttcctgccggggttcggagttgggacattccattttgaaaagcaactgagggatcttggtcgtgatcataaggtgtggacgatggattttcttgggcagggaatgtcgttgccgtgtgaagaccctgctcctagtagcatagcaggggaccagaatgaagactcgttttggggctttggagaagattcacagccttgggcagaggagctggtgtattctgtagatttatggcaaaaccaagttcagcatttcattgaagaggttatccgtgagccagtttacattgtggggaactctcttggaggatttgttgctctgtattttgctgcgtcctgtccacatcttgtaaaaggcgtcacgttgcttaatgcaacaccattttggggattctttcctaaccctgctacatctcctcgattgtcaaagattttcccatgggctgggacatttcctcttccatcatttgtgaggaaacttactgaagcagtttggcagaagataagtgacccaagaagcatacatgacatactcaaacaagtatatgctgaccactcgacaaatgtggacaatgtattctctcgtattgtggagataacacaacacccagctgctgctgcatcatttgcctccatcatgtttgccccaaggggtcagatttccttccaagaggcaatctctaggtgccaaagccaaggtgttcccatatctcttatgtatggaagagaggatccttgggttagacctatttggggaatcaaagtcaaacagcaggtgccagaagcaccttattatgaaatcagccctgccggtcattgtcctcatgatgaggtcccagaggttataaactacttactccgtgggtggctaaagaacctcgagtctgacggttcaatcgacctgccgtttctcgaagaacccagctatgctgagcatggtgtgtcgagggagctggagtttatcagagaagggtcaaggaaatcagttagtgtgcggctctatggttccaaaatttctctctggagccagctgagctcattcttgaacactcgtgcctccaattcacgggtagtctctagatgattcatccttaagtagatattagaacttaagcttcgattcaatattgtatttgttacttgactaagtcagtcttggatagttgtagtaaatagatagtgttttttgaatttctagtgaatgtaaatatgtatagaacaatgccagcttcaatcatactactgcccatagcctgtcgaaggtactctacctctgggcagacccacagattggagggcattgcgtcagaaaaaaaaaaaaaaaaaaaa

SEQ ID NO: 3112 - protein, 490 aa, Panicum virgatum
  misc_feature: Ceres CLONE 1789493
  misc_feature (1)..(267): Pfam Name: Abhydrolase_1 Pfam Description: alpha/beta hydrolase fold
MEVVSCSHSCSALHQTPRSAWKLRGRGVGLGHGHAKFPGPRRSAILCVGTTRGTSIPGDSSKVHATQGFVDATLQGVPSRKVGEIEKVMIQGLPEGPDSSPISTGFWEWKPKLTVYYERSGTKNRKAPAVLFLPGFGVGTFHFEKQLRDLGRDHKVWTMDFLGQGMSLPCEDPAPSSIAGDQNEDSFWGFGEDSQPWAEELVYSVDLWQNQVQHFIEEVIREPVYIVGNSLGGFVALYFAASCPHLVKGVTLLNATPFWGFFPNPATSPRLSKIFPWAGTFPLPSFVRKLTEAVWQKISDPRSIHDILKQVYADHSTNVDNVFSRIVEITQHPAAAASFASIMFAPRGQISFQEAISRCQSQGVPISLMYGREDPWVRPIWGIKVKQQVPEAPYYEISPAGHCPHDEVPEVINYLLRGWLKNLESDGSIDLPFLEEPSYAEHGVSRELEFIREGSRKSVSVRLYGSKISLWSQLSSFLNTRASNSRVVSR

SEQ ID NO: 3113 - DNA, 758 bp, Panicum virgatum
  misc_feature: Ceres CLONE 1789498
  misc_feature: Encodes the peptide sequence at SEQ ID NO. 3114
gtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggcggcggcggcggcggctacggaggcggtggtggcggtggtggctacggcggtggtcgccgtgagggcagctacggcggaggcgatggcggcggtcgccgcgagggcggctacggtggtggtggctacggcagccgcggtgactccggtggtaactggaggaactgatgacttggccctcccgtgctggcagccaagttatcctatatatctattagtgttcgtgttaccatttgatccgagttaccccagagtttagtgtccgtgttacctgttggttcccatgttaccgttcccgagttgtttccgcaatgaaatgagaagaaaagagtgagcaaggtttttgttcgcaaaaaaaaaaaaaaaaaaaa

SEQ ID NO: 3114 - protein, 158 aa, Panicum virgatum
  misc_feature: Ceres CLONE 1789498
  misc_feature: Great-hit functional homolog of the protein sequence given in SEQ ID NO 9185
  misc_feature: Great-hit functional homolog of the protein sequence given in SEQ ID NO 9423
  misc_feature: Great-hit functional homolog of the protein sequence given in SEQ ID NO 9703
  misc_feature: Great-hit functional homolog of the protein sequence given in SEQ ID NO 9716
  misc_feature: Useful for making plants with altered Lignin content
  misc_feature: Useful for making plants with altered alkaloid content
  misc_feature: Useful for making plants with modulated flowering time
  misc_feature: Useful for making plants with modulated nitrogen use efficiency
  misc_feature: The plant flowers significantly late compared to wild-type.
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGGYGGGGGGGGYGGGRREGSYGGGDGGGRREGGYGGGGYGSRGDSGGNWRN

SEQ ID NO: 3115 - DNA, 2052 bp, Panicum virgatum
  misc_feature: Ceres CLONE 1789505
  misc_feature: Encodes the peptide sequence at SEQ ID NO. 3116
cggcctactacggcgggaaggcgcctctcctctctcctctcgctcttctaaattgggcagctgggtctgggtctctctctctctctctcctcgccgaggacggaggaggagccatagagggaaggaagccgcccggaaggccccggcgcgacggagaaggttcggatatttctctccctcctccgctcccactccctccaaggttcctcgccgagtggctgccgctggagattgacggacggacgggcggacgcgcgctcttctcttctcttctctttagccgccgatcattctctccccccctcgccttgaatcggcgaagcatctgtgctcgctccggccggggggagggctggtcgatcagatggtgggttccaagggggacgaatgcggacgcccccgtctgtcgtatcccaagtggactcggcgaggcgaccaaatcggcttcggccccgggcgcgcgctctcgccctccctccattagttgattcaacgacgacgggtttcctttgttttcctgcgatcgatcattgatttgtctcggtcggcaggatcggggattgtctggttgcctgttttcacctcgttcctgtcgagcgggcgattccgggagggttggttggtgcacgccgaaacagcggcgaacatttcgatcgatcatcgatcggtctctgttttttttttctttcgctagccgctttatttatttctctcgttggtttcgttttctcccgtcccggccacgtaaattggttctgcccttacatttgcaaccgggagaggagacgacggccgatcctccgcgtttccttggatgcgggaacaacagttgaatatctgatatggatgaagccatgggaagacgaacagccagtggccttcttgtcaccaaaggaggctcaattcttctcttcagggaggaaagcccacgccacaaggccagtgcatgttgtacacggcttggatgcagcagtaagcttttcccaaacaaagacaggaagatgcataagacatctaaagaaacatcaggtcctcagagaccacaggttttgaggaaatccagcaggatgtcccctcaaggaagtatttcttatgacggaagcaccagcaggaatgcagcaagtacttttggtgaggctgttaataaaccaagaagaagagaaaatgccggacgtgatctactggcccggttgaaagaaagggtcaatgcatcaagaaagcgtccgttgagtggagggagtagtccctgcctatcagcatcaaacacatccaactctagctccttaagcagtagccgatctatttcaagatcgatatgtcggccagcttcgagaatgagaaaagatggaggaagagttgcagaagctatcaggatgcatagagccagagacaatagtggaaatattagggaagatgtgcgaagaaattccaaccaagatccatcagggtgtctttctcgaagcttgttcagacataggagtggaattcagagaggtccagtatcttcattggaggacagtttggatgattccaatgaatactggcgctttgatatggacgaaagtgaagaggttgaagattatgtctttaacgatcggcataggggaatgagaatggacattgatgacatgtcttatgaggaattacttgctcttggggagagaatcggtactgtaagcactggcctctcagatggtgcactttctgagtgtttgaagagaagcatctttgtgcccacaacttcgacaagccatgaagatggtgacctcaaatgcatcatatgtcaggaggagtatttttctggtgtggaggtggccaagatggcatgccagcactactaccatgtcacttgtatccaacagtggcttgggcaaaagaactggtgcccgatctgtaaatccgtcgcttctgctgtcagctcatagagttcttacagaaataaagaaacatatatatagattcattatatttacacagaactacactgtatcttttttgtttctagaatgaattattcctttcaattccaagcaaaaaaaaaaaaaaaaaaaa

SEQ ID NO: 3116 - protein, 360 aa, Panicum virgatum
  misc_feature: Ceres CLONE 1789505
  misc_feature (1)..(41): Pfam Name: zf-C3HC4 Pfam Description: Zinc finger, C3HC4 type (RING finger)
MDEAMGRRTASGLLVTKGGSILLFREESPRHKASACCTRLGCSSKLFPNKDRKMHKTSKETSGPQRPQVLRKSSRMSPQGSISYDGSTSRNAASTFGEAVNKPRRRENAGRDLLARLKERVNASRKRPLSGGSSPCLSASNTSNSSSLSSSRSISRSICRPASRMRKDGGRVAEAIRMHRARDNSGNIREDVRRNSNQDPSGCLSRSLFRHRSGIQRGPVSSLEDSLDDSNEYWRFDMDESEEVEDYVFNDRHRGMRMDIDDMSYEELLALGERIGTVSTGLSDGALSECLKRSIFVPTTSTSHEDGDLKCIICQEEYFSGVEVAKMACQHYYHVTCIQQWLGQKNWCPICKSVASAVSS

SEQ ID NO: 3117 - DNA, 2005 bp, Panicum virgatum
  misc_feature: Ceres CLONE 1789506
  misc_feature: Encodes the peptide sequence at SEQ ID NO. 3118
agaggcacggctcagatccctctcctcgacccttccgacgcggcaaagcaaaaaaacacagggaggagagggggagagaaagagggagcaggaggagcccggaatcccaaccccaaccccaaccccaaatcctggtccaatctctcaatcaggggagcatcggggtctgatcgggtcggaggattcggggggcgcagccatgaacgagaaggcgtccgtatccaaggagctcaacgccaagcacaagaagatattagaaggtcttcttcggctgcctgagaacagagaatgcgcagactgcaagtcaaagggtcctcgatgggcaagtgtgaatctagggatctttatatgcatgacatgttctggaattcatagaagccttggggtgcacatatctaaggtaagatctgccaccctggatacatggctgccagagcaagttgcatttattcaatcaatgggaaacgaaaaggcaaacagctattgggaagcagagttgcctcctaactatgatagggttggaatagagaatttcatccgtgcaaaatacgaggacaagagatgggtaccaaggaatggaacgtcacgaccttcctctattgctcgagatgagaaaagccaagagtctccggctagtgctaacagaagtggatatggtcacagatcttcatttgagcaaaaccgtacttcaccagctccgagcaaaattgcacctgcagcttcaaggatgccctctcaggcatcacctgcaaaagtagaaccaccagttcctaaggtggtttcacctcctcagccacagaaatctcctgccaaagttgacgcgacaccccctaaagttgagaagccatcggttgcaccacctcctaaagttgattatgccactgatctctttaacatgttatctatggatggaacaacagagaaagagtcagagtcatcttcaaacgatgataatgcctgggatgggttccaatctgcacaaccaccagtacctagctcagagaaaaaggattctgccaaactagcagaaagtaagccccaatctacgtcaggaatagaagatttatttaaagactcaccagctgtgtcagtatcctcagctccagctgtttcccaagcaaatgcgaagaatgatatcatgagtttgtttgagaagtccaatatggtatcaccattcgctctccatcagcagcagctggcattgatgtcccagcagcaagctcttctaatggctgctcttaaagctggaaatgcaccacaaatggttccggggaatgccaatcagctaaatgctaatggttctaatccccctcttggaaccttgccttttcaaaactggacaaatcttggttatcaaacgcctgggttgactccagcagcagcaccagcagcacagaatggtgccgctaaggttgtgaacagcaaccaggactcttctgggagcttcggttttggtacacctgggctgtacaacattagttcagctgtcccagcaaatggggctgcggttgcaggtgctagcaataatggcactggatccactgcctcatctactcttccctcacaatccggcaaagattacgatttttcctcattaactcaaggatttttctccaaacgatgagcaccttgtgagcttggaaaccgaacagaccagtgtgtaatgttggacgaggcatattgatgtagggagcacaaggggtttgtgcacaattatttgaggcagcttttcttctggtggatacatagttacatgacttcgtagctgtcggacaaataagagggaaaatatgtcgctaaatagctcatgatgtttctacaattgaggagtttgttgtcagttatgcttcctactttcactcgaggattacgccttgccagttatagaagtataatgcagcctttgcattgtcttggtgtgacttagctgcaacgccaatactgattaccgattattttgtattgtacaagacaattggatttttaaaaaaaaaaaaaaaaaaaa

SEQ ID NO: 3118 - protein, 474 aa, Panicum virgatum
  misc_feature: Ceres CLONE 1789506
  misc_feature: Great-hit functional homolog of the protein sequence given in SEQ ID NO 9721
  misc_feature: Useful for making plants with altered terpenoid content
  misc_feature: Useful for making plants with modulated nitrogen use efficiency
MNEKASVSKELNAKHKKILEGLLRLPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSRPSSIARDEKSQESPASANRSGYGHRSSFEQNRTSPAPSKIAPAASRMPSQASPAKVEPPVPKVVSPPQPQKSPAKVDATPPKVEKPSVAPPPKVDYATDLFNMLSMDGTTEKESESSSNDDNAWDGFQSAQPPVPSSEKKDSAKLAESKPQSTSGIEDLFKDSPAVSVSSAPAVSQANAKNDIMSLFEKSNMVSPFALHQQQLALMSQQQALLMAALKAGNAPQMVPGNANQLNANGSNPPLGTLPFQNWTNLGYQTPGLTPAAAPAAQNGAAKVVNSNQDSSGSFGFGTPGLYNISSAVPANGAAVAGASNNGTGSTASSTLPSQSGKDYDFSSLTQGFFSKR

SEQ ID NO: 3119 - DNA, 1468 bp, Panicum virgatum
  misc_feature: Ceres CLONE 1789529
  misc_feature: Encodes the peptide sequence at SEQ ID NO. 3120
acccgtccttccatactcccatccgcttcgcctcgccgcgccgcctcggcaccccagtcacactcgcgccacccgcgatgacgccggcggcgatctccggctccagcggccacctcgtcctctcctccccctgcctccggcagccgctcaccctccctccgctcgccgcgcgcccaatcgccgccgcttcgcccgtggcccgccgcggggtcgcggccgccgccgtgtccactcccgccgcgtccgccgccacggggaaagatgtcaaacaggctcctaaggatttccttcatatcaatgattttgacaaggatacgatcatgaatatccttaatcgggcgcttgaggttaagacagcaataaaatctggagacaggagcttccaaccgttcaaagggaaatcaatggcgatgatttttgccaagccatcaatgaggacccgtgtttcatttgagacaggattcttcttacttggtggacatgctatctatttgggtcctgatgatatccaaatgggcaagcgtgaggagactcgtgatgttgctcgagtactctctggctataatgacatcattatggctagggttttcggtcaccaggatattctggacttggcgaagtatgcatctgtacctgtcataaatggtctcactgactataaccatccatgccagataatggctgatgcacttactatgcttgagcacattgatcgtattgaaaacaccaaggttgtctatgttggagatgggaacaatattgtgcactcatggcttctattggctgctgtgctccctttccactttgtatgcgcttgtcctaagggatttgagccagatgcaaagacagtggagatcgccaggagtgctggaatcagtaagattgaaataacaaatgatcccagggaagcagttaagggagcagatgttgtttacacagatgtctgggccagcatgggccaaaaggaagaagctgattatagaaaacagaagttccaaggattcacggtggatgaagccatgatggagattgctggtccacaggcctacctcatgcattgtttacctgcagagagaggggtggaggtgacaaacggtgctattgaggctcccaactcaatcgtattccctcaggctgaaaaccggatgcacactcagaatgccatcatgcttcatgtccttgatgcttaataccccttcggcacaccactattacacctttcttaaattctagggcattactgagggataaaggctgtttcagctttagcgctgaagctctagagtttctttggaggcatgagggtaaacgtttttgaaacatgtcagtcactgtattacgatgaattggattgtccagcaacgtgatattttgcttgtctaggtggtagcttgttgtactgtaaaagggtgacaatcttgaataaaaacacaaacttctttggtgccaaaaaaaaaaaaaaaaaaaa

SEQ ID NO: 3120 - protein, 370 aa, Panicum virgatum
  misc_feature: Ceres CLONE 1789529
  misc_feature: Great-hit functional homolog of the protein sequence given in SEQ ID NO 9526
  misc_feature (27)..(368): SWISSPROT Homolog: EC 2.1.3.3 Ornithine carbamoyltransferase, chloroplast precursor
  misc_feature (37)..(368): SWISSPROT Homolog: EC 2.1.3.3 Ornithine carbamoyltransferase, chloroplast precursor
  misc_feature: Useful for making plants with modulated nitrogen use efficiency
MTPAAISGSSGHLVLSSPCLRQPLTLPPLAARPIAAASPVARRGVAAAAVSTPAASAATGKDVKQAPKDFLHINDFDKDTIMNILNRALEVKTAIKSGDRSFQPFKGKSMAMIFAKPSMRTRVSFETGFFLLGGHAIYLGPDDIQMGKREETRDVARVLSGYNDIIMARVFGHQDILDLAKYASVPVINGLTDYNHPCQIMADALTMLEHIDRIENTKVVYVGDGNNIVHSWLLLAAVLPFHFVCACPKGFEPDAKTVEIARSAGISKIEITNDPREAVKGADVVYTDVWASMGQKEEADYRKQKFQGFTVDEAMMEIAGPQAYLMHCLPAERGVEVTNGAIEAPNSIVFPQAENRMHTQNAIMLHVLDA

SEQ ID NO: 3121 - DNA, 2392 bp, Panicum virgatum
  misc_feature: Ceres CLONE 1789535
  misc_feature: Encodes the peptide sequence at SEQ ID NO. 3122
aacggcaaccccacttcctccgccttcccttcgcgcgcacgcctccgcgacttcgtcgaccaccccccgcgccatgccgccgcccgccaccgccgcctcccgctccggcgccgaggagcccgagtccccggcggcgcgccgcctgcgccgcctctcgctgcacctcctccgcccctcccccgccccggccgaccaggcggcgggcccggcgctggccctcgcggcgtgcgcggggcgggcgcgccgcgtcgagggcggcgcggacgtggcggcgacgctggcggcctacctgcggggccggcaccgcgcggcgcagctgcggctgttcgacttcctccgcgcgcgcccggacctgcagacgcccgtggagatgaccacggccgcgcaccgggagctctgcttccgccagctgcgcgcgctggtgcgggacgccggggtgcgcccgctcacgctcatggccaccgaccccgccgagtacttcgccgtcatggaggccgccggcggcgccgacatctccctcggcgtcaagctcggcgttcagtacagcctctggggaggttctgtcataaatttaggaaccaaaaagcacagagataagttctttgatggaattgacaatttggattacccaggctgttttgcaatgacagaactgcatcatggatcgaatgtccaagccctacagactactgctacatttgatcctgttactgatgtgttcatcattaacaccccaaatgatggggctattaagtggtggattggcaatgctgcagttcatggaaaatttgctactgtctttgcaaggttaattttgccccttcaaggaaaaggaggagaacctgctgatatgggcattcacgcattcattgtccccatacgggaccttgaaactcatgctgttcttcctggaattgagatcaatgactgtgggcacaagataggcctgaatggtgtagacaatggtgcactgagatttcgctcagttaggatacccagagataatcttctgaaccggtttggtgatgtctcacgagatggaaaatacacaagcagtctccccacaattaacaaaagatttgcagcaacccttggggagcttgttggtggacgagtcggtattgcatactgttctgttggtgtgctcaaagttgcagtaacaattgccgtgaggtatgctcttctacgccaccaatttggtccacctaagcagcccgaaatcagtgtgttggattatcagtctcaccagcacaaactaatgcccatgttagcatcttcatatgcgttccactttgccacagtccaattggtggataagtactcagaaatgaagaaaaccaacgatgaggagcttattgctgacgtgcatgttctttcatccgggttgaaagcttatataacttcatatacagcgaagtctataagcatatgcagagaagcatgtggtggccatggttatgctgctgtaaatcgttttggagctctgcgcaatgaccatgatatattccaaacatttgagggggacaacacagttcttctgcagcaggttgctggagatctcttgaagcaatatcaggagaaatttaagggaggtacactctcagttacctggaattacttgagagactccatgggtacctacctatcccagcctaatcctgtcactgcccgatgggaaggagaagatcatctgcgggatcctaatttccagctggatgccttcagatatcggacatctcggttgctgcatagtgttgctgctcgacttcagaagcacagcaagacacttggaggttttggcgcatggaacagatgtttgaatcatctcctcacacttgcagagtcacacattgagtctgtaatccttgcaaagttcattgaatcagttaaaagttgccctgatgaaaaaacacgggaggtcctaaagctcgtttgtgacctttacgcgctcgataggatctggaaagatattggaacatatcggaatgtagactatgttgccccaaacaaagcaaaggctattcacaagttgacagactaccttagctaccaagtgaggcttgtggcaaaagaactcgttgacgcatttgatcttccagatctcatcattcgtgccccaattagcatgcaatcagaggcctatgcacagtatactcaatatgttggcttctaaatgatataaatattaacatagctgggacaagttcatatatacaccaagttgcaatgaagtgtatagatgggaaaataagtttatccatgctcttatacataactgtaaagccaggccttctgtgaataaactatcagattgctttttcggcacaattgttttcattgacagtattattactcggaagaaaaatcagtccaaaaaaaaaaaaaaaaaaaa

SEQ ID NO: 3122 - protein, 699 aa, Panicum virgatum
  misc_feature: Ceres CLONE 1789535
  misc_feature (1)..(60): Pfam Name: Acyl-CoA_dh_M Pfam Description: Acyl-CoA dehydrogenase, middle domain
  misc_feature (1)..(159): Pfam Name: ACOX Pfam Description: Acyl-CoA oxidase
  misc_feature (1)..(165): Pfam Name: Acyl-CoA_dh_1 Pfam Description: Acyl-CoA dehydrogenase, C-terminal domain
  misc_feature (13)..(699): SWISSPROT Homolog: EC 1.3.3.6 Acyl-coenzyme A oxidase, peroxisomal precursor
  misc_feature (20)..(699): SWISSPROT Homolog: EC 1.3.3.6 Acyl-coenzyme A oxidase 2, peroxisomal precursor
MPPPATAASRSGAEEPESPAARRLRRLSLHLLRPSPAPADQAAGPALALAACAGRARRVEGGADVAATLAAYLRGRHRAAQLRLFDFLRARPDLQTPVEMTTAAHRELCFRQLRALVRDAGVRPLTLMATDPAEYFAVMEAAGGADISLGVKLGVQYSLWGGSVINLGTKKHRDKFFDGIDNLDYPGCFAMTELHHGSNVQALQTTATFDPVTDVFIINTPNDGAIKWWIGNAAVHGKFATVFARLILPLQGKGGEPADMGIHAFIVPIRDLETHAVLPGIEINDCGHKIGLNGVDNGALRFRSVRIPRDNLLNRFGDVSRDGKYTSSLPTINKRFAATLGELVGGRVGIAYCSVGVLKVAVTIAVRYALLRHQFGPPKQPEISVLDYQSHQHKLMPMLASSYAFHFATVQLVDKYSEMKKTNDEELIADVHVLSSGLKAYITSYTAKSISICREACGGHGYAAVNRFGALRNDHDIFQTFEGDNTVLLQQVAGDLLKQYQEKFKGGTLSVTWNYLRDSMGTYLSQPNPVTARWEGEDHLRDPNFQLDAFRYRTSRLLHSVAARLQKHSKTLGGFGAWNRCLNHLLTLAESHIESVILAKFIESVKSCPDEKTREVLKLVCDLYALDRIWKDIGTYRNVDYVAPNKAKAIHKLTDYLSYQVRLVAKELVDAFDLPDLIIRAPISMQSEAYAQYTQYVGF

SEQ ID NO: 3123 - DNA, 1239 bp, Panicum virgatum
  misc_feature: Ceres CLONE 1789542
  misc_feature: Encodes the peptide sequence at SEQ ID NO. 3124
tcgtcctccgctccggcgccactcgctcctgcccccccgcgcgcctctccgctcccaagtcccaactcgcatctcgatccctccgatctatcttctctcgggggatcaggaaggaggaggatggaaggccctccagtcgcgcttttcgacagcctcaaggctgccaaaccattcttcttgctagccgggcccaatgtgattgaatcggaggagcatgtcctcaagatggccaaacacattaaaagcatcacaaccaagcttgggatcccacttgtgttcaaatccagctttgataaagcaaatcgtacatcatcaaaatctttccgtggtcctggtctggaagaaggcctaaagatccttgaaaaggtgaaagcaacatatgaccttccagttgtcactgatgtgcatgaaagccaccagtgtgaagctgttggaaaagttgctgacattatacaaattccagctttcctctgtcgtcagactgatcttctcgtggctgctgctaagactggaaaaattatcaatatcaagaaagggcaattctgtgcaccttctgttatggtcaactctgcagagaaaataagacttgctggaaatcctaatgtgatggtctgtgagcgtggtaccatgtttggctacaatgatctaattgttgacccaaggaattttgagtggctgagggaatctaactgcccagttgtagctgatataacacatgctttacaacaaccagctggaagaaagcttgatggtggaggtgttgcaagcgggggcttccgcgaattaataccttgcatcgcaaggacttctgttgctgttggtgttgatggtattttcatggaggtacatgatgatcccttgaatgctccatgtgatggcccaacccaatggccattgcgcaatttggaggagctattggaggaattgttagcaatcgctgcgtgtgaagcgagttaccaagggaaagaagccgttccagattgatctcacaccattccaggaatgatctggtttggtagatagagagcacaatgccactgtccactggtttcaacagggtgtatttctcttcgctgtacttgtttgttgtttcgggcatagctgccgtagacgacttatatctgaactactgaattgaagcctgtggttgctttatgctgtttcatcagttgtacgatgttataatttcacgcaaaataaatgtgatttattgctgattaaaaaaaaaaaaaaaaaaaa

SEQ ID NO: 3124 - protein, 287 aa, Panicum virgatum
  misc_feature: Ceres CLONE 1789542
  misc_feature (2)..(263): Pfam Name: DAHP_synth_1 Pfam Description: DAHP synthetase I family
  misc_feature (8)..(273): SWISSPROT Homolog: EC 2.5.1.55 2-dehydro-3-deoxyphosphooctonate aldolase
MEGPPVALFDSLKAAKPFFLLAGPNVIESEEHVLKMAKHIKSITTKLGIPLVFKSSFDKANRTSSKSFRGPGLEEGLKILEKVKATYDLPVVTDVHESHQCEAVGKVADIIQIPAFLCRQTDLLVAAAKTGKIINIKKGQFCAPSVMVNSAEKIRLAGNPNVMVCERGTMFGYNDLIVDPRNFEWLRESNCPVVADITHALQQPAGRKLDGGGVASGGFRELIPCIARTSVAVGVDGIFMEVHDDPLNAPCDGPTQWPLRNLEELLEELLAIAACEASYQGKEAVPD

SEQ ID NO: 3125 - DNA, 1096 bp, Panicum virgatum
  misc_feature: Ceres CLONE 1789549
  misc_feature: Encodes the peptide sequence at SEQ ID NO. 3126
attatacccaagcaactgaagcgagcgcccagaattgctgctggccgtaggggtcgaatcaaaatcggctggggcgagagatcggagcgcagcatgtcggaggagcagttcctcgacgtggcggtggaagccgccaagaacgccggcgagatcatccgcaagggattttaccagaccaagaatgtggagcacaagggccaggtggatttggtgacggagacggacaaggcctgcgaggacttcatcttcaaccacctccagaagcactttccggaccacaagttcatcggggaggagacgtccgcggcgctcggcgccaccgccgacctcacagatgaacctacctggatcgtcgatcccctcgacggcaccacaaatttcgtccatggcttcccctttgtgtgcgtctcgattggcctcaccattgggaaaatccccaccgttggagtcgtttataacccaatcatgaatgagcttttcactgcaattcatggaaagggtgcttttctgaatggctctccaatcaaagcatcatctcaagatgagttagtgaaggctcttctggtaacagaggctggaaccaagagagacaagaacactctggatgacacaaccaatagaatcaacaagctactatacaagattcgatccatacggatgtgtggctccttggcgttaaacatgtgcggggttgcctgtggtaggcttgatttgtgttacgagctgggatttggtggaccctgggatgttgctgctggagctgtgatccttcgggaagctgggggccatgtttttgatccaagtgggggagaatttgacctgatgtcgcgaagaatggcgggatctaatggcttgctgaaggataagttcgtcaaggaattgggggataccaattgaaacgaatgctatcattattcctgaagtagaataagtgcaataagattgccttgccgtaccaataataccatattgtttcggcaattttttccatgtaattctacacagggagtgctgtcttatacaactatcttggattgaaaagcattttgttgtttcctgtgattacatgggagttgaaaaaaaaaaaaaaaaaaaa

SEQ ID NO: 3126 - protein, 267 aa, Panicum virgatum
  misc_feature: Ceres CLONE 1789549
  misc_feature (1)..(264): Pfam Name: Inositol_P Pfam Description: Inositol monophosphatase family
  misc_feature (2)..(263): SWISSPROT Homolog: EC 3.1.3.25 Inositol monophosphatase 1
  misc_feature (2)..(265): SWISSPROT Homolog: EC 3.1.3.25 Inositol monophosphatase 3
MSEEQFLDVAVEAAKNAGEIIRKGFYQTKNVEHKGQVDLVTETDKACEDFIFNHLQKHFPDHKFIGEETSAALGATADLTDEPTWIVDPLDGTTNFVHGFPFVCVSIGLTIGKIPTVGVVYNPIMNELFTAIHGKGAFLNGSPIKASSQDELVKALLVTEAGTKRDKNTLDDTTNRINKLLYKIRSIRMCGSLALNMCGVACGRLDLCYELGFGGPWDVAAGAVILREAGGHVFDPSGGEFDLMSRRMAGSNGLLKDKFVKELGDTN

SEQ ID NO: 3127 - DNA, 2460 bp, Panicum virgatum
  misc_feature: Ceres CLONE 1789564
  misc_feature: Encodes the peptide sequence at SEQ ID NO. 3128
ccgtcgccgtgctactactacccctccgccggctcagtagaaaagccccccctcgcccattccttcccatcagccccggccgtttgccactctgcattgctccctcaggatttcgaaagcacaaacacggaggacatggcgacaccgtacaaacctaagaacatcctcatcactggggctgctgggtttattgcctcccatgtcgcgacccgcatcgtgaagaagtaccctgactacaagatcgtcgtccttgacaagcttgactactgctccaacctgaagaacctgctctccgtgagctcgtcgccaaactttaagtttgtcaagggcgacatcgcgagcgccgaccttgtcaacttcatcctcgtcacagagaacattgacactgtgatgcactttgcagcccagacacacgtcgacaattcctttgggaactccttcgagttcaccaagaacaatatttatggtacacatgtccttcttgaggcctgccggcagatcaccggtcagatcaagaggttcatccatgtcagcactgatgaggtttatggagagacagatgaggatgcagttgttggcaaccatgagatgtcacagctgctccccacaaacccctatgcagccaccaaagccggagcagagatgcttgtcatggcctatgggagatcctatggtcttccagtcatcactactcggggaaacaatgtctatggccctaaccaattcccggagaagctcatcccaaagttcattctcttggccatgagagggcaaccccttccaatccatggtgatggatccaatgtccggagctacctctattgtgaggatgtcgccgaggcatttgaggtcattcttcatcgtggagaggttggacatgtttataacattgggacaaagaaagagaggacggtcatgaatgtggcaaaagatatatgcaagcttttcaatctggaagccgacaaagctatcaagtttgttgacaacaggcctttcaatgatcagaggtacttcctcaacaatgagaagctcatgagccttggatggtccgagcacactcactgggaggagggcctgaggaagacaatggaatggtatgtgtctaattccgactactggggtgatgtttctggggcattgttgcctcatccaaaggcaatggtgatgcctggagggtatgagggctctaaggagattaaaggaatacttgctcaatttaataacattcagacaaaggtagctccaacatcagatagtgttctggaaacacatcccttcaaattcttgatatatggtcggactggatggattggtggacttcttggaaaaatatgtgagaagcagggaatccaatatgaatatggaaaaggtcgcttgcaagagcgttcttcactcatcctagacatccaaactattaagccaacacatgtcttcaatgctgctggtgttactggcagacccaatgttgactggtgtgaatctcacaagccagaaaccatccgtaccaatgttgttggtaccttgactctagctgatgtgtgtagggagcatggcttattgatgataaactatgccacagggtgcatattcgaatatgatgcacaacatcctgaaggatcaggtatcggcttcaaagaggaggacacaccaaattttactggttcattttactcgaagaccaaggcaatggtcgaagagctactgaaggaatatgagaatgtctgcaccctgcgtgtccggatgcccatatcttctgaccttagcaacccccggaatttcgtgacaaagatcagccgttacgacaaggtggtgaacatcccaaacagcatgacaatactggatgagctcctgccgatctcaatcgagatggccaagaggaacctgcggggcatctataatttcaccaaccctggcgtcgtcagccacaacgaggtcctggagatgtacaagcagtacattgaccctagcttcaagtggacaaacttcaccctcgaggagcaggccaaggtcatcgtcgcgccccggagcaacaacgagttggacaccaccaagctggagcaggagttccccgagttgctgtcgatcaaagactcgttgatcaagtacgtcttcgagccaaacaggaaggtgccagcaaactgaaggccagcagagccgatacaacagaaaatgcagcagccattattagcttgtagcgcatccattcgtcgtgaacggttcatcagaatttgtacttgttatactcggcagcatatctccgctatagtttgattcagagctgctttgtagtttttggcaacatggcgattccccaatttgctgcagagaccatatgtactacttgctgagttcaaatgttcagtatgtgtatttggtttcaattcactgctgacatatgtatttggcaacctgttctatcatgaataattctctaatattcaaaaaaaaaaaaaaaaaaaa

SEQ ID NO: 3128 - protein, 668 aa, Panicum virgatum
  misc_feature: Ceres CLONE 1789564
  misc_feature: Great-hit functional homolog of the protein sequence encoded by LOCUS At1g53500
  misc_feature: Great-hit functional homolog of the protein sequence encoded by LOCUS At1g63000
  misc_feature: Great-hit functional homolog of the protein sequence encoded by LOCUS At1g78570
  misc_feature: Great-hit functional homolog of the protein sequence encoded by LOCUS At3g14790
  misc_feature (1)..(243): Pfam Name: Epimerase Pfam Description: NAD dependent epimerase/dehydratase family
  misc_feature: Useful for making plants with altered cell wall content and/or composition
MATPYKPKNILITGAAGFIASHVATRIVKKYPDYKIVVLDKLDYCSNLKNLLSVSSSPNFKFVKGDIASADLVNFILVTENIDTVMHFAAQTHVDNSFGNSFEFTKNNIYGTHVLLEACRQITGQIKRFIHVSTDEVYGETDEDAVVGNHEMSQLLPTNPYAATKAGAEMLVMAYGRSYGLPVITTRGNNVYGPNQFPEKLIPKFILLAMRGQPLPIHGDGSNVRSYLYCEDVAEAFEVILHRGEVGHVYNIGTKKERTVMNVAKDICKLFNLEADKAIKFVDNRPFNDQRYFLNNEKLMSLGWSEHTHWEEGLRKTMEWYVSNSDYWGDVSGALLPHPKAMVMPGGYEGSKEIKGILAQFNNIQTKVAPTSDSVLETHPFKFLIYGRTGWIGGLLGKICEKQGIQYEYGKGRLQERSSLILDIQTIKPTHVFNAAGVTGRPNVDWCESHKPETIRTNVVGTLTLADVCREHGLLMINYATGCIFEYDAQHPEGSGIGFKEEDTPNFTGSFYSKTKAMVEELLKEYENVCTLRVRMPISSDLSNPRNFVTKISRYDKVVNIPNSMTILDELLPISIEMAKRNLRGIYNFTNPGVVSHNEVLEMYKQYIDPSFKWTNFTLEEQAKVIVAPRSNNELDTTKLEQEFPELLSIKDSLIKYVFEPNRKVPAN

SEQ ID NO: 3129 - DNA, 2314 bp, Panicum virgatum
  misc_feature: Ceres CLONE 1789568
  misc_feature: Encodes the peptide sequence at SEQ ID NO. 3130
gcacccgtctcgcctctgatcccatccttcttcctcgactccgtcggccaccgccaccgctcgccggcgccggccgtccgagctcggaaaggtccctcctttcctgccaagatcccacctttctttctcgagccagctgaccccgcctgctccgtactagctagctagttgattggtggggcgttcttgattcgtgaagcgaccgtacagtaggatcgtgctcgcgccgcctgagggttgcgtgcaggatggtcgtcaaagattgggagtgaggaggcagctcaacgcagtcgtggaggctaaatgtaccgcaagaacgactcggcactctcctgcttctacctcttcctcctctggttcttcttcttgaaatagaccagcccggcccagcgagagcaactcgactgcgattgagatcgatcgctgtctctcgttgtttggtccgtgtgaggctgaggtgattctttcctggctgtctgctccagcaagaatcgcaaggaagggaggagatggaactggatctgaacgtggccgaggtggcgccggagaagacggcggcgatggccacgagcgactccggctcatcggagtcgtcggtgctgaacgcggaggcgtccggcgggggagccgcgccggcggaggagggctccagctcgatgcccccgccgcccgccgtgctcgagttcagcatcctcaggagcgagagcgacgcggccggcgccgacgacgacgacgacgccacgccgtcgccaccgcaccaccaccaccagcagcagcagccgcagctcatcacccgggagctctttccggccgccgcgggcccgccgcgcccgccgccacagcattgggccgaccttggcttcttccgcgccgagccgccgctcccgcagccggacatcaggatcctgccgcacccacacgccacgccgccggcgccggcgcccgtgcagccacaggcggccaagaagagccgccgcggcccgcgttcccgcagctcgcagtaccgcggcgtcaccttctaccgccgcaccggccgctgggagtcccatatctgggattgcggcaagcaagtgtacttaggtggatttgacactgcccatgctgctgcgagggcgtacgatcgagcggccatcaagttccgcggcgtcgacgcggacataaacttcaatctcagtgactacgaagacgacatgacgcagatgaagagcctgtccaaggaggagttcgtgcacgtcctgcgaaggcagagcacgggattctcgcggggcagctccaagtacagaggcgtcaccctgcacaagtgcggccgctgggaggcgcgcatggggcagttcctcggcaagaagtacatatatcttgggctattcgacagcgaagtagaggctgcaagggcttatgacaaggccgcgataaaatgcaatggtagagaggccgtgacgaacttcgagccaagcacatatgacggggagctgctatccgaagttggaactgaagcgggtgcggatgttgatctgaacttgagcatatctcaaccggcatcccagagtccgaaaagagataagaactccctcggtctgcaactccaccatggatcctttgagggctccgagttgaaaaggacaaaggttgatactccccatgaactggccggtcgccctcatcggttccctgttatgactgagcatccaccgatctggcctgctcaatctcaccccttctttacaaataatgagagtgcatcaagagatcttaacaggaggccagcagagggggggacagggggtgttcccagctgggcatggaaggtgacagcccctcctcccaccctcccattgccgctcttgtcgtcgtcgtcgccgtccgctgcagcatcatcaggattctccaataccgccacgacagctgcccttgccaccccatcagcctccctccggttcgacccgccgtcgtcgtcgagccatcgccgctgaaaatcaagaagccacgctgtaaatttgccgggaagctggcatttttcccccctctgggcgttgcaactttttcggttttgcgcctgggtggtttcttgtagtggattggattcgtaactgcattttcataccgctcaagtgaaatggttctctctttagacactctgcatgctgctctgggagttgctgctgctggagattgactaacttcaacctctgagattgatctactatacattgtgtagagaatcattgctgaactattaacatacagaagtataggtatcataagcccatgtctgcctctacttgtggacagagttcaaaaaaaaaaaaaaaaaaaa

SEQ ID NO: 3130 - protein, 486 aa, Panicum virgatum
  misc_feature: Ceres CLONE 1789568
  misc_feature: Great-hit functional homolog of the protein sequence given in SEQ ID NO 9346
  misc_feature (1)..(65): Pfam Name: AP2 Pfam Description: AP2 domain
  misc_feature: The sequence is a functional homolog of  SEQ ID NO 1785 in the  11/479,226 US patent application
  misc_feature: The sequence is a functional homolog of  SEQ ID NO 467 in the  10/374,780 US patent application
  misc_feature: Useful for making plants with modulated seed size
  misc_feature: Useful for making plants with modulated nitrogen use efficiency
  misc_feature: Useful for making plants with modulated growth and phenotype characteristics
MELDLNVAEVAPEKTAAMATSDSGSSESSVLNAEASGGGAAPAEEGSSSMPPPPAVLEFSILRSESDAAGADDDDDATPSPPHHHHQQQQPQLITRELFPAAAGPPRPPPQHWADLGFFRAEPPLPQPDIRILPHPHATPPAPAPVQPQAAKKSRRGPRSRSSQYRGVTFYRRTGRWESHIWDCGKQVYLGGFDTAHAAARAYDRAAIKFRGVDADINFNLSDYEDDMTQMKSLSKEEFVHVLRRQSTGFSRGSSKYRGVTLHKCGRWEARMGQFLGKKYIYLGLFDSEVEAARAYDKAAIKCNGREAVTNFEPSTYDGELLSEVGTEAGADVDLNLSISQPASQSPKRDKNSLGLQLHHGSFEGSELKRTKVDTPHELAGRPHRFPVMTEHPPIWPAQSHPFFTNNESASRDLNRRPAEGGTGGVPSWAWKVTAPPPTLPLPLLSSSSPSAAASSGFSNTATTAALATPSASLRFDPPSSSSHRR

SEQ ID NO: 3131 - DNA, 2184 bp, Panicum virgatum
  misc_feature: Ceres CLONE 1789588
  misc_feature: Encodes the peptide sequence at SEQ ID NO. 3132
atcaccctcttcttcaccccgtcgagtcgcgtccccccgatccccaaatccactcctcgccccccatggaccaccactaccaccacctcacgccgccaccgtcgccgatggagaacacggcggcggggacgtcctccaagccgccgacgacggcgtccacgcccaactcaaggctcgcctcgggcgcgccctcctcccggcactccgccacgccgtcgcacgcctccgccaccacatccgcgcccacgccggcctcgcggaccgtctacagcgaccgcttcatccccagccgcaccggatccaacctcgcgctcttcgatctagccccctcgccctcgccctcccacgacgccgcgcccagcggcccggcctcctcgtccggatctgcaccagccacgtcgccgtactgcgcgctcctccgcgccgcgctcttcggccccgacacgccggaccgggtcgcgtcctcggccaccgcgtgctcctcatcctcgtccgcgggggcgtcggcggtgggcacccccgccacggggaatatcttcagattcaaggcggaggtgcccaggaacgccaagagggcgctattctccggcgaggacgaggaggacgcgctgtttcccggcattttcaccacgaggggcgccgggccaaggaagatcccaaggtcgccctacaaggtgctagatgctcccgcgttgcaagacgacttctacctcaacctcgtcgactggtcttcacataatgtccttgctgttgggttgggcaattgcgtttacttgtggaatgcgtgcagtagcaaggtcaccaagctatgtgatttaggggtggatgacaatgtttgctctgtggggtgggcgcagcgtggcactcacctagctgttgggacaaatcaaggcaaagttcagatatgggatgcaactcgttgtaaaagaataagaacgatggaaagccatcgcatgcgtgtaggtgctcttgcatggagttcttcattgctttcttctggaagtcgcgacaagagcatcctccaccatgacatccgtgctcaagaagattatgttagcaagcttactgggcataaatctgaggtttgtgggctcaagtggtcatatgacaatcgtcagcttgcatctggtggcaatgacaaccgactttttgtttggaatccacattcagtacaaccagtactgaagtatacggagcacacggcagctgtcaaagctattgcctggtcacctcatctccatggcctgcttgcatctggcggaggaaccgcagatagatgcatacgattttggaatacgaccacaaatacacacttgagctgtgtggacactggcagtcaggtctgcaatcttgtgtggtcaaagaatgtaaatgagcttgttagtacccacggatactctcaaaaccaaataattgtttggagatatccaacaatgtctaagcttgccactttgacaggccatacatacagagtattgtatctagctatttcccctgatggtcagaccatagttactggtgctggtgatgaaacactccgtttttggaacgtgttcccttctccaaaatcccagagttctgacagtttaagttgcatcggaggaacatcatttgttagaagctacatccgatgacagtgaaatgtagttaccttgggctcataagattattgcaggcttgcagcatatgttgatgatcatcaacatcattccatttgcaacacccatgccaccaggtcatcaaccatcaaagctagccgaatttttgagatagcacgatgcattgtggtgaactggcttgcaaatccgggcatggctcttttgttgagtgtacatatttatcagagcagtggtgctgtaggagtgaacattgctggagcttctgagtatcagcactgttcctattgataagaatacgccctcttgtttttgctcccttttgcgagtcaaacctcgacctggagctgtttctgtaatctgctagcagctaacctattcaaaacatttactaactcatgacgcccatttcatccatgttggcatggtgtaaaatgagaatacttctgttccagatgtattgttactgtcttgaagaggagggctgatgtgcccttaattcacttgtttcgtattaagattcatcagaaaatgattgttcattatttaaaaaaaaaaaaaaaaaaaa

SEQ ID NO: 3132 - protein, 522 aa, Panicum virgatum
  misc_feature: Ceres CLONE 1789588
  misc_feature: Great-hit functional homolog of the protein sequence given in SEQ ID NO 9729
  misc_feature: Useful for making plants with modulated biomass
  misc_feature: The plant is abnormally small.
MDHHYHHLTPPPSPMENTAAGTSSKPPTTASTPNSRLASGAPSSRHSATPSHASATTSAPTPASRTVYSDRFIPSRTGSNLALFDLAPSPSPSHDAAPSGPASSSGSAPATSPYCALLRAALFGPDTPDRVASSATACSSSSSAGASAVGTPATGNIFRFKAEVPRNAKRALFSGEDEEDALFPGIFTTRGAGPRKIPRSPYKVLDAPALQDDFYLNLVDWSSHNVLAVGLGNCVYLWNACSSKVTKLCDLGVDDNVCSVGWAQRGTHLAVGTNQGKVQIWDATRCKRIRTMESHRMRVGALAWSSSLLSSGSRDKSILHHDIRAQEDYVSKLTGHKSEVCGLKWSYDNRQLASGGNDNRLFVWNPHSVQPVLKYTEHTAAVKAIAWSPHLHGLLASGGGTADRCIRFWNTTTNTHLSCVDTGSQVCNLVWSKNVNELVSTHGYSQNQIIVWRYPTMSKLATLTGHTYRVLYLAISPDGQTIVTGAGDETLRFWNVFPSPKSQSSDSLSCIGGTSFVRSYIR

SEQ ID NO: 3133 - DNA, 1837 bp, Panicum virgatum
  misc_feature: Ceres CLONE 1789589
  misc_feature: Encodes the peptide sequence at SEQ ID NO. 3134
tttttttagttccagagccctccaaaagaaaaaatattatcgaatattaaaagccttttcctcatcgatagaaacagtggaattattaaaaagggcaaaaaggattttttccattttgctaccccgtcgtcttccaccagcttcctctccggccgccgtagcgtagccgaattgtcctgctccggggctcgctagcttctccggccggcgagaggctgttcctggcgagcgttcattctcctccgcgcggctgaggggatccccttgggcgctcggaattggggcgtgcatgatgggattttggctgattccgatggagacgccggcgaggcttctgtggagcaccagcttcttccgccacaagatcgccgccatgctcgcctcctcctcctgcttcttatagatccgatccctcaccgtcgtcgtcggcagcttggcttctgtgctgtacaaacgccggcgcacgtatagttaaatttcctcgatctcctaagaagtaaataataatcttcaagcttgggtacgtcttggatccatggagtccagccggctcatcttcagcgccacgggctccggcgccgggcagatgttcttcctggactgcggcgcgggcggcgtccccggcggcggcggcttgttccatcgaggtgggagaccggtgctcggcctggaagaagggcgcggcgtaaagcggcccttcttcacctcccccgacgagctcctcgaggaggagtactacgacgagcagctaccggagaagaagcgccgcctcaccccggagcaggtgcatctgctggagaggagcttcgaggaggagaacaagctggagccggagcgcaagacggagctggcccgcaagctggggctgcagcctcgccaggtggccgtctggttccagaaccgccgcgcccgctggaagaccaagcagctcgagcgcgacttcgaccgcctcaaggcctccttcgacgccctccgcgccgaccacgacctcctccttcaggacaaccaccgcctccgctcacaggtggcatcgttgaccgagaagctgcaagagaaggaggggacggagggcggcgctagcgccgacgccgacgccgcggcgctgccggtggatgtcaagctggcttccttggccgacgaagacgttgacgagccgcccgcggaggcgttcgaagcgcatcagcaggtcaagtccgaggataggctgagcacgggcagcggcgggagcgcggtggtggacacggacgcgctcctgtgcggccagctcgccgccgcggtcgacagcagcgtggagtcctacttccccggcggcgaggactaccacgactgcgggatgggcggccccgtcaaccactgcccgggagggatccagtcggatgacgacggcgcgggcagcgacgagggatgcagctactatcccgaagatgaagccgccgccgccgtgttcttcgccggacacggccacccccacgccgaagacgacgaggacgccggccagatcggctggtggatgtggaactagacattcttcccaaagccgaccgaccgtcaaaaatcttatgttgtcgaaatctctcgtgcctcagttttctttcgcaatcgttgctgtaatatggtgaattatggataaggtgtatgcatgcatggtagggtaaaattgggcagttaatattgttaatcccgatcagacttggcgttcgagaagattaagagagttggggcgagaaatgagtgcatagagacaagtactctttttatggcacagtatgcattactagtatgtcaaatgatgagattcagtcatgtcatttctgttcaaaaaaaaaaaaaaaaaaaa

SEQ ID NO: 3134 - protein, 328 aa, Panicum virgatum
  misc_feature: Ceres CLONE 1789589
  misc_feature (1)..(55): Pfam Name: Homeobox Pfam Description: Homeobox domain
  misc_feature: The sequence is a functional homolog of  SEQ ID NO 218 in the  10/225,068 US patent application
  misc_feature: The sequence is a functional homolog of  SEQ ID NO 262 in the  10/412,699 US patent application
  misc_feature: The sequence is a functional homolog of  SEQ ID NO 574 in the  11/479,226 US patent application
  misc_feature: The sequence is a functional homolog of  SEQ ID NO 74 in the  10/374,780 US patent application
  misc_feature: Useful for making plants with modulated growth and phenotype characteristics
MESSRLIFSATGSGAGQMFFLDCGAGGVPGGGGLFHRGGRPVLGLEEGRGVKRPFFTSPDELLEEEYYDEQLPEKKRRLTPEQVHLLERSFEEENKLEPERKTELARKLGLQPRQVAVWFQNRRARWKTKQLERDFDRLKASFDALRADHDLLLQDNHRLRSQVASLTEKLQEKEGTEGGASADADAAALPVDVKLASLADEDVDEPPAEAFEAHQQVKSEDRLSTGSGGSAVVDTDALLCGQLAAAVDSSVESYFPGGEDYHDCGMGGPVNHCPGGIQSDDDGAGSDEGCSYYPEDEAAAAVFFAGHGHPHAEDDEDAGQIGWWMWN

SEQ ID NO: 3135 - DNA, 1878 bp, Panicum virgatum
  misc_feature: Ceres CLONE 1789591
  misc_feature: Encodes the peptide sequence at SEQ ID NO. 3136
gctggcgctcagtaaagaagagactagcctgacctgccttccggctcttcttcctcttcattcatacgcccgccgcctccatctttcgtctctgctgcgaccctctccagctccctccattgctcaaggctctgggccatccagcagccatggggacccaagcgcccgcgagctaccctcctcctgccaaggatgacaccaagaccgcggaggagaagaagctcgaggagtggctccccatcaacgggtccaggaacgccaagtggtggtactccgccttccacaatgtcaccgccatggtcggcgccggcgtcctcggcctcccctacgccatgtccgagctcggctggggccccggcatcgtggtgatgatcctgtcctggatcatcacgctctacacgctatggcagatggtggagatgcacgagatggtgcccgggaagcgcttcgaccgctaccacgagctcggccagcacgtcttcggcgagaagctgggcctctggatcgtcgtgccgcagcagctcgtcgtcgaggtcagcctcaacatcatctacatggtcaccggcggccagtccctcaagaagttccacgacgtcatctgcgacggcgggtgcaaggacatcaagctctcctacttcatcatgatcttcgcctcggtccacttcgtcctctcccagctccccaacttcaactccatctccggcgtctccctcgccgccgccgtcatgtcaatcagttactcgacaatcgcgtggggcgcatccttgcacaaggggagggaggcgaacgtggactacgacctgcgcgcgtccacgacgccggggagggtgttcggcgtcttgggggggctaggcgacgtggcgttcgcgtactcggggcacaacgtggtgctggagatccaggctaccatgccgtccacgccggagaagccatccaagcacgccatgtggaagggcgcgctcgtcgcctacatcatcgtcgcactgtgctacttccccgtcacgttcgttgggtactgggccttcggcaacagcgtcgacgacaacatcctcatcacactttcaaagcctaagtggctcattgccgccgccaacatgatggtcgtcgtccatgtcattggcagttaccaggtttacgcaatgccggtgttcgacatgatggagtcgtttctggtgaaaaagctgcggttcgctccaagcctaaaactccgtctcgcgtcccgtactttctacgtcgcgttcacgatgttcatcggcatcagcttccccttctttggcggattgctcagtttctttgggggattagccttcgcaccaacaacttattttcttccctgcatcatgtggctcgcagtctacaagcccaaaaggttcagcctctcgtggttaaccaactggatctgcattatcattggagtgctgctgctggtgttgtcaccgatcggagggctccggcagatcattttgtcagccaagacatacaaattctaccagtaaatatgattagctggggacgtatgcatggcaagctgcagaacaccagaacactctttttccattcattatctaaaataactaaatacagtcaagcaacttcatcagccatggtatcaaatcaaaacttgatccagagaatgatgaacctagttagtggttcatttagataggcctagaccaggggatcgattcgagttagtcaaagacgtatgtacgcggcatttatctatttttcaagggtggactattggcttttatgtgcacgtgggagagcaagggctcagtggtttgtatttctttcatccacggcttactgtaccctcaagttgggacactgaaagagagacccatgttaatgttataaaaaaaaaaaaaaaaaaaa

SEQ ID NO: 3136 - protein, 448 aa, Panicum virgatum
  misc_feature: Ceres CLONE 1789591
  misc_feature: Great-hit functional homolog of the protein sequence given in SEQ ID NO 9238
  misc_feature: Useful for making plants with altered oil content
MGTQAPASYPPPAKDDTKTAEEKKLEEWLPINGSRNAKWWYSAFHNVTAMVGAGVLGLPYAMSELGWGPGIVVMILSWIITLYTLWQMVEMHEMVPGKRFDRYHELGQHVFGEKLGLWIVVPQQLVVEVSLNIIYMVTGGQSLKKFHDVICDGGCKDIKLSYFIMIFASVHFVLSQLPNFNSISGVSLAAAVMSISYSTIAWGASLHKGREANVDYDLRASTTPGRVFGVLGGLGDVAFAYSGHNVVLEIQATMPSTPEKPSKHAMWKGALVAYIIVALCYFPVTFVGYWAFGNSVDDNILITLSKPKWLIAAANMMVVVHVIGSYQVYAMPVFDMMESFLVKKLRFAPSLKLRLASRTFYVAFTMFIGISFPFFGGLLSFFGGLAFAPTTYFLPCIMWLAVYKPKRFSLSWLTNWICIIIGVLLLVLSPIGGLRQIILSAKTYKFYQ

SEQ ID NO: 3137 - DNA, 1581 bp, Panicum virgatum
  misc_feature: Ceres CLONE 1789593
  misc_feature: Encodes the peptide sequence at SEQ ID NO. 3138
atgcctgcatcttgattgatcttcccacctctctcctcctcattgcccccatctctctacagactactcactccatctccattccccgtacacattcctcctccagtcctgactacagctcggtgatgatccgctgagggcgagttcttggcattaatggccgcttggtagccagcgctctccaatcccccttaactcccccacctcttatctccctgcaccttgagctgagctccggctcccctccacattgaccatcacccttcgtcgggtcggttcttgccgcgtccgatcctgatctgcaagcttcgcgtgctgtgatctgagagcgtccggggccatggggaccggggcggtggcggtggtggcgcctgaccgggccaagcagcgccggggcggccacctatggaagaaggcgctgctccacttctcgctctgcttcgtcatgggcttcttcacggggttcgcgccctcctcctcctcgtcctggaaggctgccacccaacacccgccgcaccgggccggggaccacctcgccgcctcccgcgtcgccgtcgacgcgcgcgtcaacctggtgccgtcgccgcccgacacggctggcgaggtggggctcggcggggccggcggcggggcgacggttgacgtgggcgacgacgacgaggaggccggcctgcagcggcttctgattgtggtcaccaccacgcggtcgggcgccggcgagcggcggcggcgcagggccgagctgctgcgcctggcgcacaccctgcggctcgtgcgcccgcccgtcgtgtgggtggtcgtggagccggtcgccgacgcccccgccacggccgaggtgctgcggggtaccggcgtgatgtacaggcacatcgcgttcaagcccgaggagaacttcaccacggccgccgccgaggcgcacgcgcagcggaacgccgcgctcgcccacgtcgagaagcaccgcctcgccggcgtcctccacttcgccgacgccgccggcgtctacgacaccggcttcttcgaccagatccgccagatcgaagcgtttggcacatggcctgtggcaacaatgtcggcaggcgagaagaaagtggtagtggaaggtccactatgcagtgcctcaaaggtcatcggctggttctcaagggacttcaacgatgggactacccgtgcagcgacatataacacagaaactgacttgaatcctgctggtgctgctggtacacgactccacacgatcgacgtctcagggttcgcgttcaacagttctattttgtgggatcctgagcggtggggacggccaacgtcattaccagatacttcacaggattcgatcaagtttgtgcaagaagtggtgctggaagaccgagctaagctgaaggggatcccctccgattgctcccagatcatggtgtggcagtatggcgcgcccagctcccaatagaaggttagtaagatgggtggcattgccggaagggaaaattggcggggatcggagttgatgtaaatgtggcgataacaaaaaggaaaggaagaaggtcgattactaagttttcttgtttcagaaaaaaaaaaaaaaaaaaa

SEQ ID NO: 3138 - protein, 366 aa, Panicum virgatum
  misc_feature: Ceres CLONE 1789593
  misc_feature (1)..(228): Pfam Name: Glyco_transf_43 Pfam Description: Glycosyltransferase family 43
MGTGAVAVVAPDRAKQRRGGHLWKKALLHFSLCFVMGFFTGFAPSSSSSWKAATQHPPHRAGDHLAASRVAVDARVNLVPSPPDTAGEVGLGGAGGGATVDVGDDDEEAGLQRLLIVVTTTRSGAGERRRRRAELLRLAHTLRLVRPPVVWVVVEPVADAPATAEVLRGTGVMYRHIAFKPEENFTTAAAEAHAQRNAALAHVEKHRLAGVLHFADAAGVYDTGFFDQIRQIEAFGTWPVATMSAGEKKVVVEGPLCSASKVIGWFSRDFNDGTTRAATYNTETDLNPAGAAGTRLHTIDVSGFAFNSSILWDPERWGRPTSLPDTSQDSIKFVQEVVLEDRAKLKGIPSDCSQIMVWQYGAPSSQ

SEQ ID NO: 3139 - DNA, 1505 bp, Panicum virgatum
  misc_feature: Ceres CLONE 1789597
  misc_feature: Encodes the peptide sequence at SEQ ID NO. 3140
actcgggtcgagcagctcgcttttagttctagcagacacagactactgcgccagtaaacgccccgcccctcgccgagcttgagctgcgcagcgcagaggtgggggcgatggatccctacaagtacctcaagatccggttcaaccccgacggctccctgtaccggtacggggaggcgccgctcctcccggcggcgccggcgggggagcccgtggcggtcgcggcggagggcggcggggacggcgagcaggggccgcgccgcattgtggtccactccaacgacgtcccgctcagcgaggccgccggcacgggcctccgcctcttcgtgccgtccggcggccacgcccggctgccgctgatcgtctacttccacggcggcgggtacgtcctcttccgcgcggcctccgagccgttccacaacacctgcacggcgctcgccgccgccgtcccggcggccgtcgcgtccgtcgactaccgcctggcgcccgagcaccgcctcccggccgcgttcgaggacgccgccgacgcggtgctgtgggcgcgcccgcacgcggccgccggccggccggtgttcgtgatgggcagccacaacggggccagcatcgcgttccgcgcggcgctggcggcggcggacgccggcgtggagctgcgcggggtgatcttgaaccagccgcacctcggcggcgcggcgcggtcgcccgcggagacggcctcggtggacgaccgcgtgctgccgctgccggccaacgacctgctctgggagctcgcgctgcccgtgggcgccgaccgggaccacgagtactgcaacccggagccgatgctggcccgcgtcggcgcggcgcggctgcggaggctcccgccctgcctggtgctcggccggcgcaaggacccgccgcgggaccggacgaggacgctggccaacgcgctgcgcaaggccggcgtcgccgtggaggcgaggctcgacggcgccgggtaccacgccatggagctgttcaagcccaactgcgccgccgagttcaccgcgcaggtggccgacttcgtccgccgccactccgccgccggcgccggcgacgtggttggtgtgagcaagctgtgacagacggtcaacccgatcgggcggccgcagtgggggttgctgtacggcgcttttggtgcaagttgcagcgatgtttacggggggcatatctcaatcatatcatcatcgtcatgctacaatgcggagcggcgactggcgcgagctcgccgacgacgtccaacggacaggtagacctggtgccgtgcggataggggcgagggttggccgctttttcttttttctttttttttctaccggcgagtcgacctcgacgtgaattcgtgcagggcagactgaaataaccgaatagagatttcagttactcggatgtgcaaaccaatttctgaaaggtgtggctgagagagattggtttgcactttttgaataactgaaatggcttcatgttgtgtcgaaaaaaaaaaaaaaaaaaaa

SEQ ID NO: 3140 - protein, 328 aa, Panicum virgatum
  misc_feature: Ceres CLONE 1789597
  misc_feature (1)..(223): Pfam Name: Abhydrolase_3 Pfam Description: alpha/beta hydrolase fold
MDPYKYLKIRFNPDGSLYRYGEAPLLPAAPAGEPVAVAAEGGGDGEQGPRRIVVHSNDVPLSEAAGTGLRLFVPSGGHARLPLIVYFHGGGYVLFRAASEPFHNTCTALAAAVPAAVASVDYRLAPEHRLPAAFEDAADAVLWARPHAAAGRPVFVMGSHNGASIAFRAALAAADAGVELRGVILNQPHLGGAARSPAETASVDDRVLPLPANDLLWELALPVGADRDHEYCNPEPMLARVGAARLRRLPPCLVLGRRKDPPRDRTRTLANALRKAGVAVEARLDGAGYHAMELFKPNCAAEFTAQVADFVRRHSAAGAGDVVGVSKL

SEQ ID NO: 3141 - DNA, 1866 bp, Panicum virgatum
  misc_feature: Ceres CLONE 1789600
  misc_feature: Encodes the peptide sequence at SEQ ID NO. 3142
gaaggaccagacgcggcgcaggcaccgcttgccctgaagttgctgccgaatctggatcccgctcgctcgccgccgactcgccccccttctctttcttctcctcgacctcgctcgctcgctcggcagtcgcccctcttctttccaagcagcgacgacaggggagtggcgccgctcttgccttgcgagttctttgtcgggcgcttcgccggccggcaaggtatgttcgccccttacccttccctttctgctctgcgaaatcgaatacccaaaccccctaacgtgtgctatttgtattcggatctgaccgtggattttgcctactaactacgatttttttgcaaaatacatgtgtactgccatgccctatactgggtccgcccctgattgcactgatttactattaacagatttagtgcagtacaggtccacaactacccttctttccctaggcataacgtgtgtccaaagttccagaagatgaagccctggatgtatgctgcgagtagtcatagcacgggatagtggaaaatagtacgattgtggtgcttgaacccctggaatcctaatttatgtataccttttgggcgttgataaagacgtactgtgtgcatttcaagtttgtggcagcaatcagattataaatcttcactggactctctgcacaaccatcacattgcttacttttgtcaaactgtaaatttgtggctatcaatctatcataaagaaaaacacttatgtctgaaattcagaacacactagttttccatagcaacactaacagagttaagagttttcaatgcaaacatctgattcctttagcggaagataaaattcatgaccacatggagtgatgcacaaagtttttttttttttgcttatttgaaatgatatttcttccccctgtttttctttcatttcattccagaccttgcactgttaatgatgtttctctatacctgcacaaatcattcgacttactgtaatcctatgtagttgagcagttcaagcagggtgatggctacatcagagtcagtacaagaaagtttgatgctggactactcacaacctagtaagcctcgggtccttcttgctgcttcaggaagtgtagctgctataaaatttgagagcctttgtcgtagtttctctgagtgggcggatgtccgagccgtggccaccaaatcatccttgcactttgttgatagatcatctctacctagtggcattgccctttacactgatgatgatgaatggtctacctggaagaagataggagatgaagttttacacatcgagttgcggaaatgggctgatattttggtgattgcaccattgtcagcaaataccctggctaagattgccggtggcctatgtgacaacctcttgacatgcattgtgagagcatgggactacagcaaaccactctttgttgccccagctatgaacacattaatgtggaacaactcattcacagagcgtcatcttcagacgatcaaccaactgggcataatcttgatccccccagttaccaaaaggttggcttgcggtgattacggaaatggtgcgatggctgaaacctcacaggtctatacttccgtgaggcttgcatgcaaaacgcaaccccatgattcaagcagatcgtttgtgattcctgtctgtaacaatcagccatctagctgattcagctatcaacctcaccaactgttaagcttagggatttgttttctctgcagtgtgcatctggatgttacaagtgaagagcagtagatatttaatcagcagtgtttgtaccaaccagagttgtggtggtgtacctttgtgtcaaagtactcaatggtaattactcagtaaaaaaaaaaaaaaaaaaaa

SEQ ID NO: 3142 - protein, 220 aa, Panicum virgatum
  misc_feature: Ceres CLONE 1789600
  misc_feature: Great-hit functional homolog of the protein sequence given in SEQ ID NO 9731
  misc_feature (18)..(206): SWISSPROT Homolog: EC 4.1.1.36 Phosphopantothenoylcysteine decarboxylase
  misc_feature: Useful for making plants with modulated flowering time
  misc_feature: The plant flowers significantly late compared to wild-type.
MATSESVQESLMLDYSQPSKPRVLLAASGSVAAIKFESLCRSFSEWADVRAVATKSSLHFVDRSSLPSGIALYTDDDEWSTWKKIGDEVLHIELRKWADILVIAPLSANTLAKIAGGLCDNLLTCIVRAWDYSKPLFVAPAMNTLMWNNSFTERHLQTINQLGIILIPPVTKRLACGDYGNGAMAETSQVYTSVRLACKTQPHDSSRSFVIPVCNNQPSS

SEQ ID NO: 3143 - DNA, 1668 bp, Panicum virgatum
  misc_feature: Ceres CLONE 1789605
  misc_feature: Encodes the peptide sequence at SEQ ID NO. 3144
attccattatcgctcgctgggcgtggatgacacgaaagcacaagggtttggacgcctccaagcgccacaagcaatcgtccgaaaacaggaatcccaagagcggaaaggttagcgccttggcggggggcgtgccgcgtgcggggggcctggccttgttgttagtctctcgcccgttcacgcgcccccattggacggacagggacagcaggagtctccgcccccttcccgcgccgctctgccaatgcgtgcaagacaccagacatgaccgggcagtggtgggtgacttgccatcgcgcgcaactgctgctgctgctgttatatattaggagtcggtggtgcccgcggcccggtcgtggcacctcgtttccagtttgctctcgagtggcagggggcgatggcgaagggcagcgctgccatggccgccgccgccgccgcggtcctcgccctggcggcgctcctgtgcgcgccggccgccgcggagctggcccggctggagcacccggccaagaacgacgggtcgctcagcctgctcgtcgtcggagactggggccgcaagggcacgtacaaccaatccagggtcgccgagcagatggggaaggttggggagcagctcggcatcgacttcgtcgtatccaccggcgacaacttctacgagaacggcctgactggcacagatgaccaggcgttcgagcaatccttcaccgacatctacacggccaagagcttgcagaagccgtggtacctcgttctgggaaatcatgactacaggggtgatgttcttgcacagctgagcccagtcctgcgaaagatcgacagccgattcatttgcatgaggtcgttcatcgttaacgcagaaattgtggatttcttctttgttgacaccactccatttcaactgaagtactggactcaccctaaagatgatcattatgactggagaggagtggcgcctcgagagaagtacttagccaatttgctgaaggatctggacgaggccatgaggaaatcaacagcaacgtggaagattgctgtgggccatcataccatgaggagtgtcagtgatcatggtgacaccaaggagcttctgcagctacttcttccagtcctccaggccaatggcatcgacttctacatcaacggacacgaccactgcctggaacatattagcagcaaaaacagcccaatccaatacttcacaagcggaggcggttcgaaagcatggagaggagtgttccagcccaacgaagacaacgttgagttcttctatgatgggcaagggttcatgtccctccagctcgaccacaaccaagccgagttcaccttttatgacgtcaatgggaatgtgttgtaccaatacacgcagtcaagcctgaggaaaacaagccacctccagccctctggctatgccactgaggaatgaggcggatgcagatcaccaacagagaatagagaccggttcaggtatatcccacatccgtgtgaaatttgaatgtggtattgtagtaagcggcagaagtggtctatagaggaaatgtactagtcttaactagtcctgaagtatggtatgtggttcatctatccagagagaagggatatttaggttgtgcttcaataccgctttcaacatttatcactgctttttgagattaaaaaaaaaaaaaaaaaaaa

SEQ ID NO: 3144 - protein, 341 aa, Panicum virgatum
  misc_feature: Ceres CLONE 1789605
  misc_feature (1)..(212): Pfam Name: Metallophos Pfam Description: Calcineurin-like phosphoesterase
MAKGSAAMAAAAAAVLALAALLCAPAAAELARLEHPAKNDGSLSLLVVGDWGRKGTYNQSRVAEQMGKVGEQLGIDFVVSTGDNFYENGLTGTDDQAFEQSFTDIYTAKSLQKPWYLVLGNHDYRGDVLAQLSPVLRKIDSRFICMRSFIVNAEIVDFFFVDTTPFQLKYWTHPKDDHYDWRGVAPREKYLANLLKDLDEAMRKSTATWKIAVGHHTMRSVSDHGDTKELLQLLLPVLQANGIDFYINGHDHCLEHISSKNSPIQYFTSGGGSKAWRGVFQPNEDNVEFFYDGQGFMSLQLDHNQAEFTFYDVNGNVLYQYTQSSLRKTSHLQPSGYATEE

SEQ ID NO: 3145 - DNA, 1483 bp, Panicum virgatum
  misc_feature: Ceres CLONE 1789607
  misc_feature: Encodes the peptide sequence at SEQ ID NO. 3146
agtaacccaaaaaccctcctctcctctcccacccacgatggccgccgccgccgccacgtccaccgctcactccctcctcctccagcgccccgccgcaccgagggcgcccgccgccaccgcctcctccctgcgcctcccggcgcgcgccgccaagatctcctgcgcggcggtggcggcgccgtccgcgtcctcccccctcaccggcgccggggaccggggcgtctacaacttcgcggcgggccccgcgacgctcccgctcagcgtcctcaagcgggcgcaggcggagctcgtcgactaccacggctccgggatgagcatcatggagatgagccaccgcgggaaggagttcgacgccgccatcaagaaggccgaggccgacctccgcgcgctcctcgcggtgcccgacacccacgccgtgctcttcctccagggcggcgccaccacgcagttcgccgccgtgccgctcaacctctgcgccggcccctccgaccccgccgacttcgtcgtctcgggatcctggagcgacaaggccttcaaggaggccaagaagttctccgccgcctccgtcgcctggtccggcaaggacggcaagtacaccgccctcccgcccttcgacgacatcaagcagaacccggaggccaggttcctccacatctgctccaacgagaccatccacggcgtcgagttcaaggactacccggagccccgcaacaagtccggcatcctcgtcgccgacatgtcctccaacttctgctccaagcccgtcgacgtctcccgcttcggcgtcatctacgccggcgcgcagaagaacgtcggcccctcgggggtcaccatcgccatcgtgcgcaaggacctcatcggcaacgcgcagcccatcacccccgtcatgcttgacttcaagacacacgccgacaacgcctcgctctacaacaccccgccctgcttcgccatctacatctgtggcctcgtcttcgaggacctgctcgcgcagggcggccttgcggaggtcgagaagaagaacgcctacaaggctggcatcctgtacgacaccattgacgccagcggcgggtactacatctgtcccgtggagaagtcagtgcggtcgctgatgaacgtgcccttcactctggccaaggggccggactttgagaagcaattcatcgccgaggcggccaaggagggcatggtgcagctcaaggggcacaggtcggtcggtggcgtgcgcgcatccatctacaacgctatgccgctcgccggcgtggagaagcttgtcgcgttcatgaaggatttccaagctaggaacctttgattggcttggcttatgatcatttggtattgctaatatttagcaggatgttttgttcttcataacataagtgagctctgtgcaagagttgatttgcgcatttgtgatctgtccgtagtattagtgctgtagtaactattttgcaatgtttcttttcaaaaaaaaaaaaaaaaaaaa

SEQ ID NO: 3146 - protein, 423 aa, Panicum virgatum
  misc_feature: Ceres CLONE 1789607
  misc_feature (1)..(350): Pfam Name: Aminotran_5 Pfam Description: Aminotransferase class-V
  misc_feature (1)..(422): SWISSPROT Homolog: EC 2.6.1.52 Phosphoserine aminotransferase, chloroplast precursor
  misc_feature (56)..(422): SWISSPROT Homolog: EC 2.6.1.52 Phosphoserine aminotransferase, chloroplast precursor
MAAAAATSTAHSLLLQRPAAPRAPAATASSLRLPARAAKISCAAVAAPSASSPLTGAGDRGVYNFAAGPATLPLSVLKRAQAELVDYHGSGMSIMEMSHRGKEFDAAIKKAEADLRALLAVPDTHAVLFLQGGATTQFAAVPLNLCAGPSDPADFVVSGSWSDKAFKEAKKFSAASVAWSGKDGKYTALPPFDDIKQNPEARFLHICSNETIHGVEFKDYPEPRNKSGILVADMSSNFCSKPVDVSRFGVIYAGAQKNVGPSGVTIAIVRKDLIGNAQPITPVMLDFKTHADNASLYNTPPCFAIYICGLVFEDLLAQGGLAEVEKKNAYKAGILYDTIDASGGYYICPVEKSVRSLMNVPFTLAKGPDFEKQFIAEAAKEGMVQLKGHRSVGGVRASIYNAMPLAGVEKLVAFMKDFQARNL

SEQ ID NO: 3147 - DNA, 1173 bp, Panicum virgatum
  misc_feature: Ceres CLONE 1789644
  misc_feature: Encodes the peptide sequence at SEQ ID NO. 3148
atagctagctcgctctcaccggctcatcgcccgctctcggcgctagctccagcccgttctctctctagctagtgtttccttcctctttgctgtcctggtgaggcggttcggatgctgtcccacgtcgagatggcccccgcggccggcgggttcaagctcttcggcaaggtcatcacgcagtgcgccgagagcgcgccgccggtgccggcgcagccgcgggagccgccggcgaggggcgcgcgggagagggacgacccggacgagcgggaccagccgatggtcaagcgggaggcggcggaccacgactccgccgacaagcagcagcactccggcggcggcggggagagcaaagggctgcagccgcgcccgcggcagccgccgcaccaggacacagcggaggcgcgcgcggccgcggccgcctcgtcggcaccgccgctgccgtgcccgcgctgccggagccgcaacaccaagttctgctacttcaacaactacaacgtcaaccagccgcgccacttctgcaaggactgccaccgctactggaccgccggcggcgcgctccgcaacgtccccgtcggcgccggccgccgcaagaaccggcccctcggccccgtcgtcgccgccggcgcccacctgcaccaccagcaccgcgtggccgccgcgggcttcgtcctcggcttccccggcggccagcgcccttcctccccgacctccccgtcgccggtctacgccgaccggtggccggtctgccccgaccgccggttctgatgacgtgacgacgatccgccatccgatcagcagcctcgcgggccatccggctgggttcgcggatagggagctactaggctggtttgacccgcgtaacttgctgctgaggtgggggaggctgccctgcctgcctgcgtccttgctgtacgtgcgcccttgcacaatcaccaatggagcaagggatgggaggacatggaaaaatggccttttgtttcttctccccctctctttctccgtgtctagctcgtccgtttcctttccttttgttgtttcctgcagtatgctttggatagagctcgaagctatcctgcagtcttgcagatgtgtgtagtgcaatgtaaacagcaccagcgaggcggcgagttgcgaactccgtggaagcgaagcgaaaaaaaaaaaaaaaaaaaa

SEQ ID NO: 3148 - protein, 217 aa, Panicum virgatum
  misc_feature: Ceres CLONE 1789644
  misc_feature (1)..(63): Pfam Name: zf-Dof Pfam Description: Dof domain, zinc finger
  misc_feature: The sequence is a functional homolog of  SEQ ID NO 1122 in the  10/374,780 US patent application
  misc_feature: The sequence is a functional homolog of  SEQ ID NO 1145 in the  10/666,642 US patent application
  misc_feature: The sequence is a functional homolog of  SEQ ID NO 1322 in the  10/412,699 US patent application
  misc_feature: Useful for making plants with modulated growth and phenotype characteristics
MLSHVEMAPAAGGFKLFGKVITQCAESAPPVPAQPREPPARGARERDDPDERDQPMVKREAADHDSADKQQHSGGGGESKGLQPRPRQPPHQDTAEARAAAAASSAPPLPCPRCRSRNTKFCYFNNYNVNQPRHFCKDCHRYWTAGGALRNVPVGAGRRKNRPLGPVVAAGAHLHHQHRVAAAGFVLGFPGGQRPSSPTSPSPVYADRWPVCPDRRF

SEQ ID NO: 3149 - DNA, 2036 bp, Panicum virgatum
  misc_feature: Ceres CLONE 1789655
  misc_feature: Encodes the peptide sequence at SEQ ID NO. 3150
aatcgcaaaattccccactccactcctcctcccctccctcccattctataaaaactccgtcgccaaatcgcaggccacatctcgctgttgtcgccgctcaccaccaccgctcccccgttccggatcgccaccgcagctccgggaggagagacagagagatccggtcagcgccatggcgaacatcgacatggccgcgatcctggcggacctggaccgcggtgacgccgacacgcgggtgcccaaaaccaagctcgtctgcacgctcggcccggcctcccgctccgtccccatgctcgagaagctgctccgagccggcatgaacgtcgcgcgcttcaacttctcccacggcacgcacgagtaccaccaggagacgctcgacaacctcaggcaggccatgcacaacaccggcatcctctgcgccgtcatgctcgacactaagggtcctgagatccgtactggatttttgaaggacggtaaaccaattaagctaaccaagggtcaagaaatcactgtcaccactgattatgatgtcaagggtgatgagaatatgatcgctatgagttacaagaaactacctgttgatgtgaagcctggaaatgtcatactgtgtgcagatggtactatctctctgactgttctctcttgtgatcctgatgctggaactgtgagatgtaagtgtgaaaacactgcaatgctcggtgagagaaagaactgcaatttgcctggaattgttgttgatcttcctacactaactgagaaagataaagaggacattttgggatggggcgttccaaatgatatcgatatgattgctctatcctttgttcgtaaaggatcggatttggtaactgtcagacaggttcttgggcagcatgccaagcgcatcaagctgatgtcaaaggttgaaaaccaagagggtgttgtgaacttcgatgagatcttgagggagactgatgcctttatggttgctagaggtgatctgggaatggagattccagttgagaagattttccttgcgcagaagatgatgatctacaagtgcaatattgctggcaagcctgttgttgctgctacccagatgcttgagtcaatgatcaaatcttcaaggccaactcgtgctgaggcgactgatgttgcaaatgctgttcttgatggaactgactgcgtcatgctcagtggtgagagcgctgctggggcataccctgagctggctgtgaagatcatggctcgtatatgcatcgaggcagaatcttccctggaccacgaggcagttttcaaggcgatgatcaggtccgcacccctaccaatgagtccattggaatctcttgcatcatctgctgtgcgaactgccaataaggcaaaggctgcactgattgtcgtcttgactcgcggtggcaccacggccaagcttgttgcgaagtaccgtcccagggttccaatcctctctgtggttgtccctgtgctgacaacggattcattcgactggaccatcagctctgagggcccagcgaggcacagcctaatctacagaggcctcgtccccctccttgctgagggctcagccaaggctacagattcagagtcgacagaggtgatcctggaggccgcactgaagtctgcagtacagaagcagctgtgcaagcctggtgatgccgtcgtggctcttcaccgtatcggcgtggcatctgtcatcaagatctgcatcgtgaagtgattatcagagacgatgacttgaatcccagggtgtcgtcgctgggaacaaaacttctctgcctgtttttacaactgcatcttccgctgtaagcctgctgtgcgcaggatggttttgtttacatagtttgtgaaagagctggtaaatggggagggagaggactccattatgtagtggtaataagattggtatctacggagttcagttaaacagcgaattccatggacatgttggaacgtgccatggattcatgttgcatgttcagcatgaacattatgtagctggtaaatgagctgtttgaatttaaaaaaaaaaaaaaaaaaaa

SEQ ID NO: 3150 - protein, 513 aa, Panicum virgatum
  misc_feature: Ceres CLONE 1789655
  misc_feature (2)..(347): Pfam Name: PK Pfam Description: Pyruvate kinase, barrel domain
  misc_feature (1)..(513): SWISSPROT Homolog: EC 2.7.1.40 Pyruvate kinase, cytosolic isozyme
MANIDMAAILADLDRGDADTRVPKTKLVCTLGPASRSVPMLEKLLRAGMNVARFNFSHGTHEYHQETLDNLRQAMHNTGILCAVMLDTKGPEIRTGFLKDGKPIKLTKGQEITVTTDYDVKGDENMIAMSYKKLPVDVKPGNVILCADGTISLTVLSCDPDAGTVRCKCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVAATQMLESMIKSSRPTRAEATDVANAVLDGTDCVMLSGESAAGAYPELAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILEAALKSAVQKQLCKPGDAVVALHRIGVASVIKICIVK

SEQ ID NO: 3151 - DNA, 1020 bp, Panicum virgatum
  misc_feature: Ceres CLONE 1789673
  misc_feature: Encodes the peptide sequence at SEQ ID NO. 3152
gatccaaccagtctccactccctttatgctctgctctatagtcgttgcattgcatgtgctgctctcttcagtctgttacgctagtgccctccccttcctccccctcctcctccttgttgaggcagttggcaggagttgagctcagcaatggaggtggaggcttgctacaactatggcttcctccctgctgacagaggcaggcaccagccaccgccgccgccgccaccatatgggcatggcccctctccaccccatccggcagaagatggagagttgtgggagtatttcccttgccctttctgctacatcgaggttgaggtgcccttcatctgcaaccaccttcaggaggagcattgctttgacaccagaaatgctgtttgcccgatctgtgccaacaatctagggaaagacatggctgcacatttcagagttcagcactcgcatcttctcaagaggaggaaaccttccaagccaagctcatggcctgcagctgctaccaactcatcatctagaacgggaacatcaacgtatgaagtgaattcttactttgaagatccccagcgctacaggatgagcgacaggccataccaagagcctgcgcctgacccactgctctcccagttcatctgcagcgttgcacaaaccgacgatgcgatcccaggtgataccaacactgagaaaggtgctgcaaagatcccagatgatcagaggtggagaaagagagcgagtggtgctgcctcatccaagctgggactggaggagaggttgcagaggatcgactttctcacggagatactcatgtccaccattctttaatgtgttgttatccagggtttcttgagcaattttaggcggttattagaatgtgtttgtgagtgcatatgtgtaccactgtctttgaaaagaaagatgtgcaccactgccatgtatgcaaagcactcccctgcatcacatgtacacttacactataaccttggctatctatacacaacaatgttgcaaaaaaaaaaaaaaaaaaaa

SEQ ID NO: 3152 - protein, 222 aa, Panicum virgatum
  misc_feature: Ceres CLONE 1789673
  misc_feature (1)..(191): Pfam Name: Di19 Pfam Description: Drought induced 19 protein (Di19)
MEVEACYNYGFLPADRGRHQPPPPPPPYGHGPSPPHPAEDGELWEYFPCPFCYIEVEVPFICNHLQEEHCFDTRNAVCPICANNLGKDMAAHFRVQHSHLLKRRKPSKPSSWPAAATNSSSRTGTSTYEVNSYFEDPQRYRMSDRPYQEPAPDPLLSQFICSVAQTDDAIPGDTNTEKGAAKIPDDQRWRKRASGAASSKLGLEERLQRIDFLTEILMSTIL

SEQ ID NO: 3153 - DNA, 1253 bp, Panicum virgatum
  misc_feature: Ceres CLONE 1789675
  misc_feature: Encodes the peptide sequence at SEQ ID NO. 3154
agccagcttcacggacggccggacgggagaggcgccatggcgatgagagcagctacggcggcggcgacaggcttcttttcttcgccctcctccgtctccccgaggcgtttctcgtcctcctcgccgccggcgtcgctctccgccgggcgctgcatccgtcgccatcgtctccgcgccttcccgagttcggaattgcctctggaggaactcaacccatccgttgatctactgagaaaaactgccgaggccgtcggtgatttcaggaaaactccaatctatatcgttggcacggattgcacagccaagcgcaacattggcaagctccttgccaattctataatataccgctacctctgcagcgaggaactgctcgttgatgttcttggtggcaaggacgcccttagagccttcaaggaatcagatgagaagggctatcttgaagttgagaccgaagggttaaagcagctcacatccatgggcagccttgtgctttgctgtggggatggtgctgtcatgaactcaactaatctgggcttactgaggcatggtgtctccatttggattgacgttcctctcgagatggcagcgaacgatatgctgaagagcacaggaacacaagctactacagatccagactctttttcacaggcgatgagcaagctccgtcagcagtatgatgatctgaaagaacgctatggaatttctgatattactgtttcagtacaaaaagtggcttctcagctgggctacagcagtgttgactctgtgacccttgaggacatggttcttgaaattgtgaagcaaattgagagactgatccgaacaaaagcgatgatggaagctgcagggaagcccttctagactataggcgtgacattccgctccggcatttacatattatctccagttgccagagcaggcatttggctcttccatggagctgattacagttaaccaacgaatcaagcacaagcattttcaaatccgaggagcagaatcacactcttgtgctggaatatgcttatttcgtattgtaaaatcgcatgtcatttgatagcacattgtgtagatctgccatggtgcagcaactttcagattgtatctactgtcaatggaaatgacaaatctgcttgtacacggtccaaaggccgaaatctggagaattttgacacgggaaaattttgagaatccctttgctatgaacatgctgccctgttaagcagaggcttttgcaaaaaaaaaaaaaaaaaaaa

SEQ ID NO: 3154 - protein, 274 aa, Panicum virgatum
  misc_feature: Ceres CLONE 1789675
  misc_feature (1)..(166): Pfam Name: SKI Pfam Description: Shikimate kinase
MAMRAATAAATGFFSSPSSVSPRRFSSSSPPASLSAGRCIRRHRLRAFPSSELPLEELNPSVDLLRKTAEAVGDFRKTPIYIVGTDCTAKRNIGKLLANSIIYRYLCSEELLVDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQQYDDLKERYGISDITVSVQKVASQLGYSSVDSVTLEDMVLEIVKQIERLIRTKAMMEAAGKPF

SEQ ID NO: 3155 - DNA, 1537 bp, Panicum virgatum
  misc_feature: Ceres CLONE 1789681
  misc_feature: Encodes the peptide sequence at SEQ ID NO. 3156
gaacccccgcccccgcccccgcagccgcccccgcgcccgctcgtcctccccgcgccgcctcggggacgccccggtcggcgatgtggcgggagcatgctgggaccgctcctcaggctcctctcggggtgcggcggggtctggcccacctcaccggcccccgcctccgcctcgggggaagactctgagggccgcgacggcctcctctggtggcgcgacctcgcgcgctgccacgccggcgaagtctccctcgccgtcgcccaggccaaccaggtgctcgaggaccagtgccgcctcgagtccgccccgcccctcggcaccgtcatcggcgtcttcgacggccacggcggccccgacgccgcccgcttcgcctgcgacaacctcttccccaacctccgagaggcgtcctccggcccgcagggcgtgaccgcgaacgccgtcagggaggcgttcctggctacggaggcaggcttcctcgagctcgtgtcgcgcctgtgggaaacccagccggacatcgccacggtcggcacgtgctgcctcgtcggcgttgtgcacaagaggaccctgttcgtcgccagcctcggcgactctcgagctgttctcgggaagaaagtgggccgcaccgggcagattgccgcggagcagttgtccagtgagcacaatgccaaccaggaggccgtcaggcaggagctcatggcacagcacccggatgatcctcagattgttgccctcaagcatggggtatggagagtgaggggcctcatacaggtgtcgagatcaatcggtgatgtatacctgaaacatgcgaagtataacacagagcggatcaaacccaagttcaggctttctgaatcattcaccaggccaatactgagcgctgatccatctatcatatcccgcaatcttcaaccaagtgacagttttatcatatttgcatcagatggtttgtgggaacacctgagtaatcaggatgccgtcgagattgttcacaaccatcaacgtgctggaagtgcaagaagactcatcaaagctgctctgcaagaagcagctcggaagcgtgagatgcgttactcggaccttacaaagatcgacaagaaggtccggaggcattttcatgatgacattatcgtcatcgtcttgtttttaaattatgacctattagtgaaaggcgctgcgcgaggacaacccctctccatcagatgcgctctagattattgacagtgagctatttcatcatccaatggtgttcagctcctatcagcagcaatatccagagtccgatgacatatggtcaaccggttgtgaaaagcacacaacctccggcagcagttttcttttcattttccattttgcacataaggttgacatgtcgctaaattgccagttttcccctcttaaactatgtcggatgaaatgcggttactcttcagttttgaagatatatgcctagagtttgagggacaaggttataaaggatcctgtaacttctgattgattgattctctagttctttctgtatgtaaaaaaaaaaaaaaaaaaa

SEQ ID NO: 3156 - protein, 373 aa, Panicum virgatum
  misc_feature: Ceres CLONE 1789681
  misc_feature (1)..(284): Pfam Name: PP2C Pfam Description: Protein phosphatase 2C
MLGPLLRLLSGCGGVWPTSPAPASASGEDSEGRDGLLWWRDLARCHAGEVSLAVAQANQVLEDQCRLESAPPLGTVIGVFDGHGGPDAARFACDNLFPNLREASSGPQGVTANAVREAFLATEAGFLELVSRLWETQPDIATVGTCCLVGVVHKRTLFVASLGDSRAVLGKKVGRTGQIAAEQLSSEHNANQEAVRQELMAQHPDDPQIVALKHGVWRVRGLIQVSRSIGDVYLKHAKYNTERIKPKFRLSESFTRPILSADPSIISRNLQPSDSFIIFASDGLWEHLSNQDAVEIVHNHQRAGSARRLIKAALQEAARKREMRYSDLTKIDKKVRRHFHDDIIVIVLFLNYDLLVKGAARGQPLSIRCALDY

SEQ ID NO: 3157 - DNA, 2168 bp, Panicum virgatum
  misc_feature: Ceres CLONE 1789692
  misc_feature: Encodes the peptide sequence at SEQ ID NO. 3158
aaaaaaccatccaaagatccacgtacaccacaacacctctcacgaagccatgaacggcgccatggcgagcgccgcctgcggtagctccacgagccccctcctcccggcggtggctcccgccgcctcggccaagtcctctgcatgcccctccaagaagaccaccgccaccttcccccgccgcaccgtgtggtgccgggccgccggcgggcgcgacgacgacggcctcctctggctcccccgccgggacatgctcagcaccctgggcggcgtcgccgccggtctcgtcgggtacccgggcctcgcgtccggcgccgccgtggaggcgaaccccgtggagagctgccgcaagggcgacaaggtgaacgagaacctggtgaagtgcacggaccccaaccgggagttcccgtgcccgccgccgtcgcccgccaaggccgtcgacttcacgccggagagcacggtgaagcgcgtccggcagccggcgcacctcctgagcccggagaaccaggagaagtacaaggaggccatcgccaagatgaaggcgctgccggcggcgcacccgctgagcttcgcggcgcaggcggcgatccacgagtcctattgcgacggccactaccgctacgacccggcggagaagaaccggcccttcgacgtgcacttctcctggatcttcgcgccgtggcaccgcatgtacatccacttctacgagaaggccctcgggcagctcatcggcgacgacaccttcgcgctgccctactggaactgggacgcgccggccggcatggtggtgccgccgctcttccgggaccccttcggcaacccgctctacaacaaaaaccgcgagcagtcgcgcctcgacaagctcgtcgacctcgacttcctcaacgcccccaccgacgccccgctcatccctttcgacggccccaaagacgacaagtacgaggcacttgttaacaagaacctctgcaccatgtaccagcagcaaattcggggcggcaagggcgcgcgggcgttcctgggcgagaagctgtgcagcgacgcggacgcccggctgaaggagatcaacgcgcgttcgaagaagagaggcgggcagaaggtgaagagggacaagaccaagagccagggctcgctggagcggatggcgcacacggccctgcacgtctgggtcgggcgctccggcccgccggaggggacgacctgctccgccgacaccggcggcgtgctggggcacaacggcgcctacacctgcaacaacgacatgggcttcctgggctcggcaggccgggacccgctcttctactcgcaccactccaacgtcgaccgcatgtggcacatctggtccaccaagctcggcggcgagggcttcaaggacccggagtggctcgacgccagcttcgtcttctacgacggcgtcgagaacccgcggccggtgcggatcaagttccgcgacgtgctcgacacgcgcaacctcgggtacacgtacgacgccgagtcggagaaggagctgccgtgggtggccagcaagatcaacccgctagtgccgcgcggcaagggggcgccgcgggcggcggcgccggcgaaggcgctggcgtacccgctgacgctggccgctggcgaggtcgtggaggtggccggcgtggcggtgccggcgaagcaggcggggcagcagcgggtgctggtgatccaggggatcgagtacgaccccaacgtggagaacaagttcgacgtggccatcggcgtgcccggggaccaggccagcaaggtggggcccgaccacaccgagtacgccggcagcttcgccgtcgtgccgagctccaaggccggcggcggcacgctggaggggaggatcacgctcttcgtcgacgacgtgctggacgacgtcatgggcgaccgcgacaccaccgtcgacgtcgtgctcgtgccgcgcacggacgaggagatcaagctccaccttcccccgacgatcgagaaccagagccagaactagtacgtagtactggtcgctcgtcgtccaataatgcatcgtgcacagtggcgatgcatggtgtctccggatgcgtgcagctaagaataaaaacgtcgtgtcgtgtcgtgtgctcgtatcgtacttgtaataagagaataattcctttgtttttgctctagtctcaaataaagggatgtgccatccg

SEQ ID NO: 3158 - protein, 644 aa, Panicum virgatum
  misc_feature: Ceres CLONE 1789692
  misc_feature (1)..(222): Pfam Name: Tyrosinase Pfam Description: Common central domain of tyrosinase
MNGAMASAACGSSTSPLLPAVAPAASAKSSACPSKKTTATFPRRTVWCRAAGGRDDDGLLWLPRRDMLSTLGGVAAGLVGYPGLASGAAVEANPVESCRKGDKVNENLVKCTDPNREFPCPPPSPAKAVDFTPESTVKRVRQPAHLLSPENQEKYKEAIAKMKALPAAHPLSFAAQAAIHESYCDGHYRYDPAEKNRPFDVHFSWIFAPWHRMYIHFYEKALGQLIGDDTFALPYWNWDAPAGMVVPPLFRDPFGNPLYNKNREQSRLDKLVDLDFLNAPTDAPLIPFDGPKDDKYEALVNKNLCTMYQQQIRGGKGARAFLGEKLCSDADARLKEINARSKKRGGQKVKRDKTKSQGSLERMAHTALHVWVGRSGPPEGTTCSADTGGVLGHNGAYTCNNDMGFLGSAGRDPLFYSHHSNVDRMWHIWSTKLGGEGFKDPEWLDASFVFYDGVENPRPVRIKFRDVLDTRNLGYTYDAESEKELPWVASKINPLVPRGKGAPRAAAPAKALAYPLTLAAGEVVEVAGVAVPAKQAGQQRVLVIQGIEYDPNVENKFDVAIGVPGDQASKVGPDHTEYAGSFAVVPSSKAGGGTLEGRITLFVDDVLDDVMGDRDTTVDVVLVPRTDEEIKLHLPPTIENQSQN

SEQ ID NO: 3159 - DNA, 1574 bp, Panicum virgatum
  misc_feature: Ceres CLONE 1789700
  misc_feature: Encodes the peptide sequence at SEQ ID NO. 3160
gagctttgctctgaggtagtgaggtggagcctgcctcgcccctccccctcaccggtcaccactcccctccgcccatggcgaccatctctgcagccctcgccatctccttcctcccgtcccctaatcgcttccccgtccccactacggcctcctcgtcctcgcgcataaagaggacggcacgcttcagatgctgcgcggatccttcttcccagtcccaggagcaggataccgcggccgctcctcctaccctgccgccggagaagcccacaaaagagttcacttcgtctctgctgggcatttccacgagcacctggtctgcgggtgtcgctgggctggggttcctggagactggctacctcacgtacctcaagctcacgggatccgaggcattctgccccatcagcggcggaggctgcggcgacgtcctcgacagcgactactccgccatctttgttggtctggtggcatatggtttggctacagcactttctctgcaagaaaatggaactgacttactccctggatttgatgacctggatattcagttaacattgcttctaattgctacttctatggcgactgcaagtgcttattttctttacattctaagcactaaatttgttggagtatcctgttcgtactgtttgttgtcagcagctctctcgttcactctacttttcatcagagtaaaggactttggttttgaacgtatcaagaagttcgctggtattcagttagctgtagctgtcattatagctctagctttgacaaactcatacagttcagctactactcagttgaagggcacagatgattttgtattagaaccatatgaaacagagataacaactgaatcatccccattcgctatagcattggctagacatttgcactctataggtgctaagatgtatggagcattctggtgttctcattgcaatgaacaaaaacagatgtttggtcgtgaagctacaaaaattctagactatgtggagtgtttcccaaatggggcaggtaagggaaagaaaatgacttcagaatgtcaagctgctggtcttgaaggttttccaacatggttcatcaatggaaaggttctcagcggtgatcaggagcttgaagttctggcggaagcatcaggcttcgttgctgagggtacagaacaatccaaggaaatagcaccgaattgatattataaatttactataatcttggtggagtcttcagacatcaatcaatatcccggaatatgcactcgagcagttgcatccgaaggtcgcatggtctacttgacaactaaccattgtaatttgtagcaactctgcttgctctgcgagaagaggaaacaaaccacatgtccaaggcagcttgttgtacaaccattttgtagtcctagtttgtactgtaaatgtgtaatcctttgaaaacgcgcgctttctcatttgacgtatatataaagtactatgtaatgccattcccgcttgtatgaagtttaagttgacacaacagttggagcgcctttgatagcctcttcgtgttgattaattatgttaaacgaaaaaaaaaaaaaaaaaaaa

SEQ ID NO: 3160 - protein, 370 aa, Panicum virgatum
  misc_feature: Ceres CLONE 1789700
  misc_feature (1)..(137): Pfam Name: VKOR Pfam Description: Vitamin K epoxide reductase family
MATISAALAISFLPSPNRFPVPTTASSSSRIKRTARFRCCADPSSQSQEQDTAAAPPTLPPEKPTKEFTSSLLGISTSTWSAGVAGLGFLETGYLTYLKLTGSEAFCPISGGGCGDVLDSDYSAIFVGLVAYGLATALSLQENGTDLLPGFDDLDIQLTLLLIATSMATASAYFLYILSTKFVGVSCSYCLLSAALSFTLLFIRVKDFGFERIKKFAGIQLAVAVIIALALTNSYSSATTQLKGTDDFVLEPYETEITTESSPFAIALARHLHSIGAKMYGAFWCSHCNEQKQMFGREATKILDYVECFPNGAGKGKKMTSECQAAGLEGFPTWFINGKVLSGDQELEVLAEASGFVAEGTEQSKEIAPN

SEQ ID NO: 3161 - DNA, 1708 bp, Panicum virgatum
  misc_feature: Ceres CLONE 1789703
  misc_feature: Encodes the peptide sequence at SEQ ID NO. 3162
ctggatctatccctatatcactcacccacctctcactgcctggctgcctgccttcacactaccatactagtgctagctagctcatcagctcgaagctgcaggtaacaagcaagcaagcacagctagcgacaatggcggccgtcgagaatggcagcagcagcagcaaggagcaggtagcagcagtgagcgtgacgggcaggcgcacggtggcgcccggcaagagccggtgcgtcctggccaccttcgacctcccctacatcaccttctactacaaccagaagctgctcctgtaccgcacggtcgacttccccgacgccgcggcgcgcatcacggccgcgctctccgacgcgctccgcgtcttctacccgctcgccggccgcatccgccgggacgccgacggcgcgctcgccgtggagggcgacgagggcgccgaggtcctggaggccgaggccgagggcgtcgccgtggacgaactcgccggatccggaggggactgcggcgagagggtcatgcagcagctggtgccatacaccggcgtcatgaacctcgaggggctccgccgcccgctgctggctgtccagctgacgaagctcaaggacggcctggccgtgggctgcgccttcaaccacgccgtgctggacggcacctcgacctggcacttcatgtcctactgggcccagctctgccgcacgagcagcccatcatccctggtgccgcagcccatccacgagcgctccctggcccggcccgtccgcgtgcgcctggacctccccgagtccgccgaggcccacgagaagacggaccccaacgggcccaagaagcctctggtggcccgcgtcttctccttcccggcggcgaccgtggcgcgcatcaaggcggccgccaacgccgcgctcccgccggccgccaagcccttctccaccttccagtccctgggcgcgcacctctggcgcgccgtctcccgcgcccgcggcctcggccccgccgacatcaccgccttcgccgtcttcgccgactgccgcgcccgcctcgacccgccgctcccgcccgcctacttcggcaacctcatccaggccgtcttcacgggcgtgcccgccgggatgctcctgggcgggccccccgagctggcggccggcctgctgcagaaggccatcgacgaccacgacgccgccgccgtcacgcggaggctcgaggagtacgaggccgcgcccaagctcttccactacagcgacgccgggcccaactgcgtcgccgtggggagctccccgcgcttcaaggtgtacgacgtcgacttcggcttcggcaggcccgagcgcgtgcgcagcggcggcaacaacaagttcgacggcatggtctacctctacccggcccgcgccggcgacggaggcatcgacgtcgagctggcgctgcagccggagccgatgcagaggctccaggaggacgccgacttcctcctccaccagccggcctagctacctgctcatttaattaattgttaactaattggtattggattgacagtactgtactgtactgtagtattcgttccttgttgcattgcttcgtcaccattcaattccgtatgtttcatcagtcggtgttgtactcttgtaccttttttttgtgactttgtactcttgtgtcttgttatatatacttatgtaccactggatttgatcgtcaagaataaaaaaaaaaaaaaaaaaaa

SEQ ID NO: 3162 - protein, 446 aa, Panicum virgatum
  misc_feature: Ceres CLONE 1789703
  misc_feature (3)..(430): Pfam Name: Transferase Pfam Description: Transferase family
MAAVENGSSSSKEQVAAVSVTGRRTVAPGKSRCVLATFDLPYITFYYNQKLLLYRTVDFPDAAARITAALSDALRVFYPLAGRIRRDADGALAVEGDEGAEVLEAEAEGVAVDELAGSGGDCGERVMQQLVPYTGVMNLEGLRRPLLAVQLTKLKDGLAVGCAFNHAVLDGTSTWHFMSYWAQLCRTSSPSSLVPQPIHERSLARPVRVRLDLPESAEAHEKTDPNGPKKPLVARVFSFPAATVARIKAAANAALPPAAKPFSTFQSLGAHLWRAVSRARGLGPADITAFAVFADCRARLDPPLPPAYFGNLIQAVFTGVPAGMLLGGPPELAAGLLQKAIDDHDAAAVTRRLEEYEAAPKLFHYSDAGPNCVAVGSSPRFKVYDVDFGFGRPERVRSGGNNKFDGMVYLYPARAGDGGIDVELALQPEPMQRLQEDADFLLHQPA

SEQ ID NO: 3163 - DNA, 1967 bp, Panicum virgatum
  misc_feature: Ceres CLONE 1789705
  misc_feature: Encodes the peptide sequence at SEQ ID NO. 3164
aaaccgagagtcacctccgctccctcatcctctcctccagcagccccccagcttcgctgccgcggtcatcgtgatcctaatctccttctccctggcatcaccagcttgtcagctgtgtatcctttttaagtctctagaagccattttctaaagaacattctgggaagaggttgcgactagcatttctgttgattaccatggactactcttctggttcctacttctcaccatggcctatcaattctgcctctgagaggtacagtttggctgatggttcagtggaatcatttggagaaggaaccatgccaccttcaagctatttcatgacagctagttcagatcacagtttaaaatttagtgggcatgagcaggactccactatgcttacaaacgagcgattaacctatgctggtgctggacatgctgatctgttacctggtgacattctatctagggataagtttcctgaaaatcttctggagcttcaacgactgcagaacaatggcaatctgcagagtaatttagtgaacccacaggtgcttcagtgcacttcaacaccgagaagatttcatcagcaactacctcatgccttatccagttcaattgatagtaacagctgtgaagtttccgcttttctcgctgatgtcaatgctgtatcttcagcctcaaccttatgtcccacattccaaaatcatccttcattcatggaaccagtgaacatagaagctttcgatttccaaggggcacagagtgatgctattttgaacaaaacaagccatccaaacgggaatatctcagtttttgacaatgctgccttggcatcactacatgatagcaaagagtttatcagtagtaggcttccctcatttcctagtgtccaggaaacaaacctagctgccattggtttcaagacacaaaagcaggagccaaatccaatgtgtaatttgcctatccctgctttcactgctcataaccagatggcagtcacaacaacaaaaggagctcggattcctcaacagatgccttcattggtcaatgaaaataaaagtgactgtcctgttagccgtccttctgatgtgcaaaaccaagcaaattcagctggaaatggcattggcatgaagccacgagcaagggctcgtcgtggacaggcaactgatcctcatagtatcgctgaacggcttcgcagagaaaaaatttcagataggatgaaaaatctgcaagacctcgtccctaactccaataaggcagacaagacatccatgctggatgaaataattgattatgtgaaatttcttcagcttcaggtcaaggtcttgagcatgagtaggctaggatctgccggagcagttcttccccttctcacagaatcccaaactaagggttgccacggtcaacctctgtcagcttcgacaaaagcacaaggactgctggacgcacaagactcagaagatgccttagcctttgaggaagaggtggtcaagctgatggaaacaagcatcaccagcgcaatgcagtatcttcagaataaggggctctgcctgatgccagttgctctcgcttccaccatatccgcccagaaaggcgtgtccgctgctgcgatccctcctgaacggtgaagtgaagacacatgctcctcccatcagaatgaggaaacaactgcaggagacagaacctgactgctgaagacgcagtctaccccgtggagtacaaagataggaagttagtctgaccaaattccagttcatggcctaatctactaatctgcttctcggaacctgttgcacatcagttgatgtgtatttttccccttttctgcttttcttttttttttactggattgcatcaggatcagggactcagggtgcttagggacagggaatagttgcggttttgaaagtttgtatctggatctctattaaggttcagtttaacatctgtgctagacagaaaaaaaaaaaaaaaaaaaa

SEQ ID NO: 3164 - protein, 472 aa, Panicum virgatum
  misc_feature: Ceres CLONE 1789705
  misc_feature (1)..(50): Pfam Name: HLH Pfam Description: Helix-loop-helix DNA-binding domain
MDYSSGSYFSPWPINSASERYSLADGSVESFGEGTMPPSSYFMTASSDHSLKFSGHEQDSTMLTNERLTYAGAGHADLLPGDILSRDKFPENLLELQRLQNNGNLQSNLVNPQVLQCTSTPRRFHQQLPHALSSSIDSNSCEVSAFLADVNAVSSASTLCPTFQNHPSFMEPVNIEAFDFQGAQSDAILNKTSHPNGNISVFDNAALASLHDSKEFISSRLPSFPSVQETNLAAIGFKTQKQEPNPMCNLPIPAFTAHNQMAVTTTKGARIPQQMPSLVNENKSDCPVSRPSDVQNQANSAGNGIGMKPRARARRGQATDPHSIAERLRREKISDRMKNLQDLVPNSNKADKTSMLDEIIDYVKFLQLQVKVLSMSRLGSAGAVLPLLTESQTKGCHGQPLSASTKAQGLLDAQDSEDALAFEEEVVKLMETSITSAMQYLQNKGLCLMPVALASTISAQKGVSAAAIPPER

SEQ ID NO: 3165 - DNA, 2270 bp, Panicum virgatum
  misc_feature: Ceres CLONE 1789711
  misc_feature: Encodes the peptide sequence at SEQ ID NO. 3166
aactgcaaaccaaaccaaagccaccctggtccgcaaagcgtagccgcaaaactccatcccgtaatccacacgcacgccatccagatcagagccaccggccagaggagaacaaaaatatcttctcctctcgtccctccatcggatcggttccccgactcctcctgccgccgatcgatcgagagggcgaccgcggcggcgtgtccggggcacaagattttgccggtttggagccagagaggggtatgagctgttttgcgcaccgccgctgctccgacgccgcccgccgccaggacggcctcctcgtcttcgtcttcttcctctcgattcccatacgtagtattagtaattccaatttaagtagtagtaatagtagtagtaatctcttgtaaactgcgctcgccctcgcggttgcgagtacggggacggagggaccttctgttgcttgttcctctttctcctcttcttcctctgcggcattggcagcggtggttatggatcccaatggcctcaaaactggaggccttttgctcccaaccattgaaaggcggtgcacatcgcctccatcagtcatcgtgatcggcggtggcatctctggcgtggcagctgctcgtgctctctccaattcttcatttaaggtgactgttctggagtccagagatcgtattggtggacgtgttcatactgattactcatttggatgcccaattgatatgggagcctcatggctgcacggtgtatgcagtgagaattcactggcaccattgatcggctatctcgggctcaggttatatcgcaccagcaatgacaactctgttctgtatgatcatgatttagaaagctatgctctctttgataaggatggcaatcaggtcccaaaggatacagttgataaagttggagaaacatttgaaagaatccttgaagagacggtgaaagtgcgtgatgagcaggaacatgacatgccccttctacaggctatttctattgtgtttgagaggcactcccatctaaagctggaagggctagatgatcaggtcctgcaatggtgtgtctgccggctcgaggcatggtttgctgcagatgcagatgaaatatctctcaaaaactgggatcaggagcgtgttcttactggtggtcatgggctgatggtaaatgggtattatcctgttattgaggctcttgctcgaggtcttgacatcaggcttaatcaaagggtcaccaaaattgcccggcaatacaatggagttaaggtcactactgaagacggcacgaattattttgctgacgcttgcataatcacggtgccgctcggtgtgctcaaggcaaacataatcaagttcgagcctgaactgcccccatggaagagctccgccatcgccgacctcggtgttggcatcgagaacaagattgccatgcacttcgacagagtcttctggcccaacgttgaggtgctaggaatggttggcccgacgcctaaagcttgtggatacttcctgaacctccacaaggccactggcaatccggtcctcgtgtacatggctgctggaaggttcgcccaggaagtggagaaactgtcggacaaggaagctgtcgatctggtcgtttctcacctgaagaagatgcttccagatgctactgaacctacgcagtacttggtgtcacgctggggctctgacccgaactctttggggtcctattcgtgcgacctcgtcgggaagccggccgacgtgtgcgcgaggttctccgcccccgtggagaacctgtacttcgccggtgaggcggccagcgccgagcactcggggtccgtgcacggcgcgtactcgtcgggcctcgccgccgccgaagaatgtaggaagcggctcctgacgcagaagggcgtcccggacctcgtccaggtcgcggcttgggaggaggtggccggagttgtggctcccctgcagatttgcaggacctgagcttggagcagctgcgcggccgtttggccttgatcgactcgatcacttcgttgactcagattggggcaaagaagccatgaactctccgagtcgtcgcgagcaaggattgcacaatcttattatcatgtcgtatatgtgtattgtaaacgtgttactgtccttttttttaacaaaacgtgttactgtcttgattgtgaataagtggagatcaactgcagatcttcagctgtcggacactgaactcttataaaataatgttattatgactgttactcttatataaagaatttgaagcaaaaaaaaaaaaaaaaaaaa

SEQ ID NO: 3166 - protein, 487 aa, Panicum virgatum
  misc_feature: Ceres CLONE 1789711
  misc_feature (1)..(422): Pfam Name: Amino_oxidase Pfam Description: Flavin containing amine oxidoreductase
MDPNGLKTGGLLLPTIERRCTSPPSVIVIGGGISGVAAARALSNSSFKVTVLESRDRIGGRVHTDYSFGCPIDMGASWLHGVCSENSLAPLIGYLGLRLYRTSNDNSVLYDHDLESYALFDKDGNQVPKDTVDKVGETFERILEETVKVRDEQEHDMPLLQAISIVFERHSHLKLEGLDDQVLQWCVCRLEAWFAADADEISLKNWDQERVLTGGHGLMVNGYYPVIEALARGLDIRLNQRVTKIARQYNGVKVTTEDGTNYFADACIITVPLGVLKANIIKFEPELPPWKSSAIADLGVGIENKIAMHFDRVFWPNVEVLGMVGPTPKACGYFLNLHKATGNPVLVYMAAGRFAQEVEKLSDKEAVDLVVSHLKKMLPDATEPTQYLVSRWGSDPNSLGSYSCDLVGKPADVCARFSAPVENLYFAGEAASAEHSGSVHGAYSSGLAAAEECRKRLLTQKGVPDLVQVAAWEEVAGVVAPLQICRT

SEQ ID NO: 3167 - DNA, 1323 bp, Panicum virgatum
  misc_feature: Ceres CLONE 1789724
  misc_feature: Encodes the peptide sequence at SEQ ID NO. 3168
atctcatcgcattctcgctctgttgtgtgactgattgccaagaaggaaacgctctctgcttgtgttccagcctctgaatctcgtgtgaggatgtcgtgctgcggaggcaactgcgggtgcggctccggctgcaagtgcggctccggctgcggagggtaagatctctccgacgagcgcctctctcatctcccgtatgcacgcatgggttcgtcagatcgttcggttgttcttgtgttcttgctgtcggtatcccctccgctcctgtcctgatacggtgataccggtctaggagtggatggcggacggcctcttgtgatgccgggttccatgatctacctgcagggccatggctctgttccccttccttgatgttgaggggcttggcagggagtgcatgcagacgcggcagatagcttgcatggaaatgtttttcttttggggggagaacctttgtgggtggatctttgtttgattagaggatggagctggaggatttttgcctcccctttttataggggaaaaaaagagagagaaaggtttccctcatgttcatgcatgtaaattcctgtctgaactctgaaaactctgaaacgatgtgctgcacgcatgctgtagttgtgctcctggagaggagaatttctgatgatcatatcccgacctgctgcctggattacctgcaggtgcaagatgtacccggacatggctgagcagggcaccaccaccaccacccagactgtcatcatgggcgttgcaccaaccaacaaggggtatgtccatccatcccatctgtaccatgtacttttcagcttcctgcgcatagatcattttggcgaggtagtgatctgatccacaccatccttatgtttgccaataatagccagcagttttcatggtgcagaattgttagctctactatttttacggacttgccttgtgtgtgtctgtggtagatcggttgtgtaggaagtagcacaaacttctgttagcatagtgctagactgcttgtacagaactcaagtcaccatcagcaactaagccactaagctacgaaaaaaatcagtttgtgcccatcatgaaacaaaacaatcttctgcttcttttccccgcgctaaggccaaggggaggaaaaagccaacaaaaaatgatgccttctttacttgtccacaactaaaaagttcggtgttcttgcaatgaaacgaggggaacctccctttcttctaaaaaaataaaaaatgaaaagttcggggcggcatacatagctgctggtagcgaactggccaaaattgctctgcaactcgtcttctgaaatctgaatctgaactg

SEQ ID NO: 3168 - protein, 67 aa, Panicum virgatum
  misc_feature: Ceres CLONE 1789724
  misc_feature (23)..(51): Pfam Name: Metallothio_2 Pfam Description: Metallothionein
MIISRPAAWITCRCKMYPDMAEQGTTTTTQTVIMGVAPTNKGYVHPSHLYHVLFSFLRIDHFGEVVI

SEQ ID NO: 3169 - DNA, 1511 bp, Panicum virgatum
  misc_feature: Ceres CLONE 1789725
  misc_feature: Encodes the peptide sequence at SEQ ID NO. 3170
acatcctcctccgctgcgcctctccagtcttcattgctccacccatcgcatctacctcccaaaccccaaacccccacagaaggaagcaatggcttcctccacccagggtcaggtcatcacctgcaaagcggcggtggcgtacgagccgaacaagccgctcgtgatcgaggacgtgcaggtggcgccgccgcaggccggcgaggtccgcatcaagatcctctccaccgcgctctgccacacggaccactacacctggagtggaaaggaccctgagggtctcttcccctgcattcttggccacgaagctgctggagttgttgaaagtgtcggtgaaggagtaactgatgtgcagcctggggatcatgtcattccttgttaccaagctgaatgcaaggaatgcaagttttgtaagagtggaaagaccaacctctgcggtaaggttcgaagtgccacaggggccggtgtcatgatgaatgatctcaagagcaggttctcagtaaatggaaagcccatttaccatttcatgggaacatcaacattcagccagtacactgtcgtgcatgatataagtgttgcaaagatcaacccacaggcacctctagataaagtctgcctgcttggctgtggtgttcctaccggtcttggagcagtgtggaatactgcaaaggttgaagctggctctattgttgctgtttttggccttggcacagttggacttgcagttgctgagggtgcaaaagcagctggtgcttctcggattattggcgttgacattgatagtaaaaaatttgacgttgcaaagaactttggagttacagaattcgtgaacccaaaagaccatgacaaaccgatacaacaggtcttaattgatcttacagatggtggcgtggattacagttttgaatgcattggaaatgtatctgttatgagggctgcactggaatgctgccacaagggctggggaacctctgtcattgttggtgtggctgcttctggccaggagatttccacacggccattccagcttgtgactggccgtgtctggaagggaacagctttcggcggcttcaagagccgaacccaggtcccatggcttgttgagaagtacttgaaaaaggaaatcaaggtggacgagtacattacccacaacatgaacctggctgacatcaatgaggcgttccacctgctgcatgaaggtggttgcctgcgctgcgtgctgaaagtgcaggattgagtttctaagcgaagcagtttgcatcatgtcgggttgtaatctagattgtgtcgttggtactagaactcttttgcctcgtttggcctggaacctggataccctctgaacccactgttacaataataagttctgttggatgccctggtgatggtacatgtgagtcaacaatgtgtgctgcattgtagacttgtatcgcggttgtgctgtttctgaaataatttttgcgtgtcaattttctttacattgataattgattttaaaaaaaaaaaaaaaaaaa

SEQ ID NO: 3170 - protein, 381 aa, Panicum virgatum
  misc_feature: Ceres CLONE 1789725
  misc_feature (1)..(130): Pfam Name: ADH_N Pfam Description: Alcohol dehydrogenase GroES-like domain
  misc_feature (1)..(377): SWISSPROT Homolog: EC 1.1.1.1 Alcohol dehydrogenase class 3
  misc_feature (1)..(380): SWISSPROT Homolog: EC 1.1.1.1 Alcohol dehydrogenase class 3
MASSTQGQVITCKAAVAYEPNKPLVIEDVQVAPPQAGEVRIKILSTALCHTDHYTWSGKDPEGLFPCILGHEAAGVVESVGEGVTDVQPGDHVIPCYQAECKECKFCKSGKTNLCGKVRSATGAGVMMNDLKSRFSVNGKPIYHFMGTSTFSQYTVVHDISVAKINPQAPLDKVCLLGCGVPTGLGAVWNTAKVEAGSIVAVFGLGTVGLAVAEGAKAAGASRIIGVDIDSKKFDVAKNFGVTEFVNPKDHDKPIQQVLIDLTDGGVDYSFECIGNVSVMRAALECCHKGWGTSVIVGVAASGQEISTRPFQLVTGRVWKGTAFGGFKSRTQVPWLVEKYLKKEIKVDEYITHNMNLADINEAFHLLHEGGCLRCVLKVQD

SEQ ID NO: 3171 - DNA, 1723 bp, Panicum virgatum
  misc_feature: Ceres CLONE 1789732
  misc_feature: Encodes the peptide sequence at SEQ ID NO. 3172
gtgagcttagcggagcaaatagctagacgccataacattttcgatccagagctagctctcgacttgtcgagctcgtacgcccgagtaccggcaccaagggggctctgaattctgaccgagccgtacgtcgagagatggtgaagaggagcgtggttctgtacccgggcctcggcgtcggccacctgacgccgatggtcgagctggccaaggcgttcctccaccacggcgccgccgtcaccgtcgcgctcgtcgagccgcccaccaagtcccccgacttctccgcggcggtcgcccgcgccgcggcctccaacccgtccgtcaccttccacgtcctgccgccgccgccgcctgccccggctggcccttccggctccggcggcggcacgtcaccagcgcaccacgtcgtcgtcatgctctaccacctcaaggccatggtcgcgccgctccgcgacttcctccgctcgctgcccgccgtcgacgcgctcgtcctcgacatgttctgcggcgacgccctcgacgtcgccgccgagctcaagctgcccgtcttctacttctacgcctcgggcgccggcgacctggccgtcttcctcaacgtgggtcgcacgtccacgagcacggctttcgcggagctcggcgactccctcgtctcgttccccggcgcgcctccgttcaaagcttcggatttgcccaaagagttctcggagggcagccctggagcgaagcccatcctcggcgcgctccaccggctgccggaggccgacgggatcctcgtcaacaccttcgagtcgctggaggcgcgggcggtgcgcgctctgagggagggtctgtgtgttcccgaccgttccacgccgccggtctactgcattgggccgttggtgtcgggaagcggagagaaggagcacgagtgcctccggtggctggacaagcagccagagagcagcgtcgtgttcctctccttcgggagcttgggcacgttccccaagaagcagctcgaggagatcgccattggattggagaagtcagggcagaggtttctatgggtggtgcggagcccgcgagacctcgaggacatgtcaagccagccactcccggagccggacctcgacgcccttcttccggagggattcttggggaggaccaaggacactgggctcgtgctcaagtcttgggcgccacagggggatgtgctacgtcacagagccaccggtgcgttcgttacacactgcggatggaactcgacactggaaggcatcacagcggggctgcccttgctgtgctggccgttgtatgcagagcaaagaatgaacaaggtgttcatcgtggaggtgatgaagcttggggtggagatgaagggctacgacgaggagttggtgaaggcggaggaggtggagacgaaggtcaggtgggtgatggagtctcaaggtgggcaagcgctcagagatagggtggcagaggtgaaaggtagagcgatcgaagcaatcgaagaagagggctcatctcatgctgcttttgttgaattcttgaaggatctcgataccatgaacttgccttagcattagcacacaacgcacttaattattcaaaggtttcgagtcccacgtacgtaggcatcgttaataattcttgcttttgagtactcaagtggtcaacatgactgtgcattttctactcatgttgatattaaatatattttgagcttctttaaaaaaaaaaaaaaaaaaaa

SEQ ID NO: 3172 - protein, 472 aa, Panicum virgatum
  misc_feature: Ceres CLONE 1789732
  misc_feature (1)..(138): Pfam Name: UDPGT Pfam Description: UDP-glucoronosyl and UDP-glucosyl transferase
MVKRSVVLYPGLGVGHLTPMVELAKAFLHHGAAVTVALVEPPTKSPDFSAAVARAAASNPSVTFHVLPPPPPAPAGPSGSGGGTSPAHHVVVMLYHLKAMVAPLRDFLRSLPAVDALVLDMFCGDALDVAAELKLPVFYFYASGAGDLAVFLNVGRTSTSTAFAELGDSLVSFPGAPPFKASDLPKEFSEGSPGAKPILGALHRLPEADGILVNTFESLEARAVRALREGLCVPDRSTPPVYCIGPLVSGSGEKEHECLRWLDKQPESSVVFLSFGSLGTFPKKQLEEIAIGLEKSGQRFLWVVRSPRDLEDMSSQPLPEPDLDALLPEGFLGRTKDTGLVLKSWAPQGDVLRHRATGAFVTHCGWNSTLEGITAGLPLLCWPLYAEQRMNKVFIVEVMKLGVEMKGYDEELVKAEEVETKVRWVMESQGGQALRDRVAEVKGRAIEAIEEEGSSHAAFVEFLKDLDTMNLP

SEQ ID NO: 3173 - DNA, 1664 bp, Panicum virgatum
  misc_feature: Ceres CLONE 1789736
  misc_feature: Encodes the peptide sequence at SEQ ID NO. 3174
atttccacggcgagatatacaaaggccccggcagcctcggcgcgacgaagtgatgacccgggcccccctcctcccctcgcctcgctgagcgagacccaccaccactcccgtccacactctcccacctcgaccactgcgggggcggggcgtccgagctacgcgcggcggagaaacccagtggaggaggagcgaggaggcgcggggggagcggagatggcgtcgccggggctggtggcagcggcgctggtggtggcggcgctggcggcattctgcggcacggacccgctgcggacgggcagcatggtggacttcccgggcttcgaggcgcacttcgtcgacctcccggagcccgccgagatgccgcagcacgcggacgcccgcgagcggctccgcggcgcggaggtgcggttccgcggcgaggtgcaggggcccgagagcgtcgccttcgacccgcgggggcgcgggccgtacacgggcgtcgccgacgggcgggtcgtcttctgggacggcgagcggtgggcgcccttcgccacggtctccccgcgctggacgcaggagctctgcggcgggcccaaggcgtcgcccatggagtacctccccaacgagcacatctgcggccgcccgctcgggctccggttcgataagaagaccggggacctctacatcgccgacgcctacttcggcttgctcaaggtcgggcccgagggcgggctggccacgccgctggccacggaggccgagggcgtgcgcttcaacttcaccaacgatctcgacctcgacgaggagggcaacgtctacttcaccgactccagcatccactaccagagacggaatttcatgcaattggttttctctggagatccctctgggaggcttttgaaatacaacccgcagacaaaggaaacgacagtactgcatcgcaacctccaatttcccaatggcgtgtccatgagcaaggatggctcattccttgtcttctgtgaaggatcacgtggcaggttgagcagatactggttgaaaggtgagaaggcagggaccgtggatcttttcgccatcttgcctggattcccagacaatgtgcggaccaacgagaagggcgagttctgggtcgcgatccactgccggcgcagcctgtatgcccgactcatgagccgccatgttaagatgaggaagttcttcctcagcctcccgatccccgccaagtaccactacctgatgcagattggcggcaagctccacgcggtgatcatcaagtacagccccgagggcgaggtgctcgacatcttggaggacaccaagggggaggtggtgagagccgtgagcgaggtggaggagaaggatgggaagctctggatagggtctgtcctgatgccattcatcgctgtatttgacctcgccaaggcctcttagcagacccggtttgctggagaacaccgttgcgcgcgtctctgagaggaacagcgatccaaataatttagtcctggagcaacctggagctgtttgacgctccagcatctttagtaatagcaatgtaagttgctgacgttttagattctccctcgaacttttaggaacgaacaagttcgtgtttctgaaccttgatttgtcacgtgtgctcattgagttcgatctgttcctatgttcaaaaaaaaaaaaaaaaaaaa

SEQ ID NO: 3174 - protein, 398 aa, Panicum virgatum
  misc_feature: Ceres CLONE 1789736
  misc_feature (1)..(88): Pfam Name: Str_synth Pfam Description: Strictosidine synthase
MASPGLVAAALVVAALAAFCGTDPLRTGSMVDFPGFEAHFVDLPEPAEMPQHADARERLRGAEVRFRGEVQGPESVAFDPRGRGPYTGVADGRVVFWDGERWAPFATVSPRWTQELCGGPKASPMEYLPNEHICGRPLGLRFDKKTGDLYIADAYFGLLKVGPEGGLATPLATEAEGVRFNFTNDLDLDEEGNVYFTDSSIHYQRRNFMQLVFSGDPSGRLLKYNPQTKETTVLHRNLQFPNGVSMSKDGSFLVFCEGSRGRLSRYWLKGEKAGTVDLFAILPGFPDNVRTNEKGEFWVAIHCRRSLYARLMSRHVKMRKFFLSLPIPAKYHYLMQIGGKLHAVIIKYSPEGEVLDILEDTKGEVVRAVSEVEEKDGKLWIGSVLMPFIAVFDLAKAS

SEQ ID NO: 3175 - DNA, 1527 bp, Panicum virgatum
  misc_feature: Ceres CLONE 1789738
  misc_feature: Encodes the peptide sequence at SEQ ID NO. 3176
gcgaacaaactcatttccccgtccccactggagagcccccttcttcctcctctcgccttcctccggctcctccccccaaatccgcctctcccctacctcgatttcctgcccccacctcgccgtcggctgcatccacgccggcggcgtacgggccccgcaccgagcgaggaggccccggacctgattccctcgtcgagaggagtcgccgtcccctcctggctccgcttgcggtgccgggctgccgcggtctggagggggaggaagaccggagatccgtccgcccgtgcttggattggtgtcgtctttggctgagggtatgagcaatgtactcaccaaaaccggaagctagttttggctcaactcataccaactcagttgcaaaccagcagcaaatggagttagctggaaacaacatgggtcctagtaacggagcaaataataataacaacctagctgcaaggcaacgcctacggtggacaaatgaactgcatgaaagatttgttgaggctgttactcaacttggtggtcctgacagagcaactcctaaaggagttctgagaattatgggtgtaccaggattaacaatataccatgtgaaaagtcacttgcagaaatacaggctagcaaagtacattcctgatgcttcagctgatggtaacaaggctgataacaaggacccaggggatttgcttgcgggacttgagggatcctctggattgccaatatctgaagccctcaagctgcagatggaggtccaaaagcgactgcatgaacagttagaagtacaaaggcagctgcaactgcgtattgaggctcagggaaagtacctccagaagatcattgaagagcagcagcgcttaactggcgtgaaatctgaaactcctgctgcaggtgcttctgtcacagtatcaagtgatcaattccctgactctgagcggactgagccctcgactcctgcgccaacatccgagtctccaactaaagttggcacttccaatagggatactggagaacggactgaagcaaccaagagcacctgtcgtggtgattcactctcccgtcacgagccactgacccctgattccaactgccagaacggctcgcctcctgctagtccaaaccatgagagggcagcaaagaggcaacgaggcagtggtaatgatttcttggatgccgaggctgatttttcccttccgcgcaacatcttcgagtcgagttcaggctccgagttccagccgtattcaatgtcctactcaggcaattagcttctgatgctcccatcattgctagcttgttgagcacaatgcgcatgatctgatccatgtctgtaggtctgggtagaatgatgctatctcaaggattgtattgttggtagacaaagttgtagggggttcagttattgtttacatgatatacatgacatccacaagtgcttaggtttgtaacatctatgtcccatctgtagttcagtggagatgtattggtggaaggctaatgttccgttgcgaaaaaaaaaaaaaaaaaaaa

SEQ ID NO: 3176 - protein, 313 aa, Panicum virgatum
  misc_feature: Ceres CLONE 1789738
  misc_feature: Great-hit functional homolog of the protein sequence given in SEQ ID NO 9222
  misc_feature (1)..(52): Pfam Name: Myb_DNA-binding Pfam Description: Myb-like DNA-binding domain
  misc_feature: Useful for making plants with altered Lignin content
  misc_feature: Useful for making plants with altered terpenoid content
MYSPKPEASFGSTHTNSVANQQQMELAGNNMGPSNGANNNNNLAARQRLRWTNELHERFVEAVTQLGGPDRATPKGVLRIMGVPGLTIYHVKSHLQKYRLAKYIPDASADGNKADNKDPGDLLAGLEGSSGLPISEALKLQMEVQKRLHEQLEVQRQLQLRIEAQGKYLQKIIEEQQRLTGVKSETPAAGASVTVSSDQFPDSERTEPSTPAPTSESPTKVGTSNRDTGERTEATKSTCRGDSLSRHEPLTPDSNCQNGSPPASPNHERAAKRQRGSGNDFLDAEADFSLPRNIFESSSGSEFQPYSMSYSGN

SEQ ID NO: 3177 - DNA, 1754 bp, Panicum virgatum
  misc_feature: Ceres CLONE 1789748
  misc_feature: Encodes the peptide sequence at SEQ ID NO. 3178
ctattgatccaccaccttccgtcctctctccagccccgtgatctcgtggccgtgcacgcctgcagcgctctcgaagcgagcggggccgcgccgcccggtcgcccaatcgctgccggcgacggcgaccgccgcggcaacaggagtgggcacgggcggcagccggcaggacaacgagaggggcactgtagcctgaaaaggactgcggggaaacggccgtgacctggcaactccaagggtccatccaagccgcgcccgcccgccgcaacgcgaagtccccacgcctcgcctctccagcctccgctcgctcgctctcggcttccctcgggccggccgcggcgccaagggatggacgcgctccgcctccggccgtccctcctctccgcgcggcccggcgccgcccgcccgcgagatcattttttaccaccattttgttcaattcagcgaaatggggaaccgcgagtgtgtttttccgcccaaaggacccaaggcccttccttgtatcactgtcagaaatccttcgattggaaatccacctattctaggatatcacgtcagtcaacaagtacttctattaatgcttcgggccaaccgctgcaatctgaacctgaagcacatgattctgcaagcatctggagggcaatatcatcttcattagatgtgttttacagattttcccggccacatactgtcatcggaacagcgttaagcatagtctcagtttcccttctagctgtccagagcttgtctgatatatctcctttgttcctcactggtttgctggaggcagtggtagcagctcttttcatgaacatttatattgttggactgaaccagttattcgacattgagatagacaaggtcaacaagccaactcttccactggcatctggggaatatacccctacaactgggattgcaatagtatcggtctttgctgctatgagctttggccttggatgggctgttggatcacaacctctgttttgggctcttttcataagcttcgttcttggaactgcatactcaatcaatttgccatacttaagatggaagagatctgctgttgttgcagcactctgcatattagcagttcgtgcagtgattgttcagctggccttttttctccacattcagacctttgttttcagaagaccagcagtttttacgaggccattgatgtttgcaactggatttatgacgttcttctcagttgtaatagcacttttcaaggatatacctgatattgaaggggaccgcatatttgggattcgatcattcagtgttcgtttgggccaaaagaaggtcttctggatctgtgttggcctgcttgagatggcttacggcgttgcaatactgatgggagcaacttctacctctctgtggagcaaaaccgcaacaattgccgggcattccatcctcgcggcgatcctatggagctgcgcgcggtcggtcgacctgacgagcaaggccgcgataacatccttctacatgttcatctggaagctgttctacgcggagtacctgctcatccccctggtgcgttgactccccggcgatggcgacggcgacggcgacggcgggacaacaactccacgggaggactttgagcgccggagtagtaaacgcccgtttgaagccggacgccacatgcgcgcgcacgagggggagaggatggattggcatctggcaggctacggccggcgcccaataaaacggaataaaattcccttcccctaaaaaaaaaaaaaaaaaaa

SEQ ID NO: 3178 - protein, 399 aa, Panicum virgatum
  misc_feature: Ceres CLONE 1789748
  misc_feature: Great-hit functional homolog of the protein sequence given in SEQ ID NO 9324
  misc_feature (1)..(279): Pfam Name: UbiA Pfam Description: UbiA prenyltransferase family
  misc_feature: Useful for making plants with altered tocopherol content
MDALRLRPSLLSARPGAARPRDHFLPPFCSIQRNGEPRVCFSAQRTQGPSLYHCQKSFDWKSTYSRISRQSTSTSINASGQPLQSEPEAHDSASIWRAISSSLDVFYRFSRPHTVIGTALSIVSVSLLAVQSLSDISPLFLTGLLEAVVAALFMNIYIVGLNQLFDIEIDKVNKPTLPLASGEYTPTTGIAIVSVFAAMSFGLGWAVGSQPLFWALFISFVLGTAYSINLPYLRWKRSAVVAALCILAVRAVIVQLAFFLHIQTFVFRRPAVFTRPLMFATGFMTFFSVVIALFKDIPDIEGDRIFGIRSFSVRLGQKKVFWICVGLLEMAYGVAILMGATSTSLWSKTATIAGHSILAAILWSCARSVDLTSKAAITSFYMFIWKLFYAEYLLIPLVR

SEQ ID NO: 3179 - DNA, 1712 bp, Panicum virgatum
  misc_feature: Ceres CLONE 1789752
  misc_feature: Encodes the peptide sequence at SEQ ID NO. 3180
gacaatcgccgccacgtgcgccttcccctcgctgccttcttcccgtgcccgtcgtaggtgagaccttctccgagttccgatcccagatcggcctcgaggacgaagcttcttctccgggatgcggctccgccatcgtcgtctctcgtcgccgccgttgacgccgctcctcgccagctgccttctcctcctcctgctgccgctcccccgggcggcggcgacgacggtggtcactcgcctgccggggttccacggccccctgccgttctacttggagacagggtacgtgggcgtggaggaggagacgggggcggagctcttctactacttcgtggagtcggagcggagccccggcaccgaccccgtgctggtgtggctcaccggcgggccccggtgctccgccttcagcggcctcgcctacgagatcgggcccgtcaagttcgtcctcgaaccctacgacggcacgctgccgcggctggtctacagcccggattcctggacgcgggtggcgagcatcatcttcctggactcgcccgtgggttcaggcttctcgtacgcgcgcgacccccgcggctacgacgtcggggacgtctcgtcgtctaggcaggtcgtcacgttcctgaggaagtggtttgatgctcacccatggcttcaatcaaaccctttctacgttgctggcgactcttatgcaggaaagatggtgcccgttattgcgcaatatatctcagaaggaaatgaaggaatgcatcatccactgatcaatctcaagggctatatagtcggcaaccctgtaaccggagaccagatcgacaccaactctcggattccatacgctcattcgcatggaatcatatctgaccagcagtacgaggctgcggtggcaaattgcaatggggattacgtgagtccgacgaacaagctctgcgccgacgtgctacaaactatccacaatctcatgtcagaagtcgactaccatgacatactgggaccgacatgtccccgtgattcactgaatccgaggagagatgctttagcgaggaagtccctagcagaggaacactactatcggattagtgacccacctgcggaaccttctttccgttgttttgaataccgctactacctgtcttacttttgggcaaatgacaatgccactagagctgcccttgggatcaaggaggggacagtgaaggaatgggtcaggtgttgcaagcgtccaggtttcccctacacctacgatattccgagcagcataaagtaccacttcaacctcaccaccaggggttaccgcgctctggtatacagtggagaccatgatctagttataccgttctcgggcacacaagcatggataagatcctacaacttctccattgttgatgactggagggcgtggcaccttgatggccaggctgcaggattcacgatcaaatatgccaacaatctcactttcgcgacagtgaagggtggtcgccatgaagctccagggaatcggcccaaagaatgcttcgctatggctaaaaggtggctggataataagcctctctgatgtagtgatgtgcctgccaactcaggctgcacttctgatccagattcagtctgtaactgtgcattaagtctgtaaaatgacaaccaaagctagcgaagtaagttaatcaatgtaataaaagcacgtcaaatattaagtttgcactcaaaaaaaaaaaaaaaaaaaa

SEQ ID NO: 3180 - protein, 475 aa, Panicum virgatum
  misc_feature: Ceres CLONE 1789752
  misc_feature (1)..(389): Pfam Name: Peptidase_S10 Pfam Description: Serine carboxypeptidase
MRLRHRRLSSPPLTPLLASCLLLLLLPLPRAAATTVVTRLPGFHGPLPFYLETGYVGVEEETGAELFYYFVESERSPGTDPVLVWLTGGPRCSAFSGLAYEIGPVKFVLEPYDGTLPRLVYSPDSWTRVASIIFLDSPVGSGFSYARDPRGYDVGDVSSSRQVVTFLRKWFDAHPWLQSNPFYVAGDSYAGKMVPVIAQYISEGNEGMHHPLINLKGYIVGNPVTGDQIDTNSRIPYAHSHGIISDQQYEAAVANCNGDYVSPTNKLCADVLQTIHNLMSEVDYHDILGPTCPRDSLNPRRDALARKSLAEEHYYRISDPPAEPSFRCFEYRYYLSYFWANDNATRAALGIKEGTVKEWVRCCKRPGFPYTYDIPSSIKYHFNLTTRGYRALVYSGDHDLVIPFSGTQAWIRSYNFSIVDDWRAWHLDGQAAGFTIKYANNLTFATVKGGRHEAPGNRPKECFAMAKRWLDNKPL

SEQ ID NO: 3181 - DNA, 1777 bp, Panicum virgatum
  misc_feature: Ceres CLONE 1789756
  misc_feature: Encodes the peptide sequence at SEQ ID NO. 3182
ccgacgccgttgccgtacgccggataaacacccgtcgcttgcttgcctgccgctacgtgccggcgccgcgccataagagcaaacacccaattcaattctcctccgcaacctcccacctcccctccgcctccctccccttcgcttcgataaccccaacgcgcgcgcgcgcgggcggcaccgagccagccagccatggagaaggcgatcgaccggcagcgggtcctcctcgcccacctcctcccctcctcgccgtcctcgcagccgcagctggaggcgtcggcgtgcgcggccggggacagcgccgcgtaccagaggacctcctccttcggagacgatgtcgtcgtcgtcgctgcataccgcacgccgatatgcaaggccaagcgaggaggtttcaaggacacgtacccagaggacctccttactgttgttctcaaggctgttctggacaacactaaaatcaatccaagtgacattggtgacattgtggttgggacggtgctaggtccaggttcgcagcgtgcaaatgagtgcagaatggctgctttctatgctggattccctgaaactgttcctgtgagaactgtcaaccgacaatgctcatctgggttacaggcagtagctgatgttgccgccgctataaaggctggtttctatgacatagggattggtgctggtttggaatccatgtcgataaattccattgcttgggaaggacaagtaaacccaaaaataagtgcattccagaaagcacaggattgtcttctgcccatgggagttacttctgaaaatgttgctcatcgatatggtgtcaccaggcaagagcaagatcaggctgctgccgagtctcatagaagagctgctgcagccacagcttctggaaaattcaaggatgagattgtccctgtcccaacaaagatcattgatcctaaaactggagaggagatgaaagttgtgatatctgttgatgatgaaattaggcctggcaccacagcatctggattagcaaagcttaaaccagttttcaaaaaggatgggactactactgcaggcaattctagtcaagtaagtgatggtgctggagctgttctcctcatgaagagatctgtagctctgaagaaaggacttcctattcttggtgttttcaggagctttgctgctgttggagtggacccagctgttatgggtgttggtcctgctgtagccattcctgctgcagtgaagtctgctggccttcagatagaagacattgatctctttgaactgaatgaggcatttgcctctcaatttgtctattgctgcaacaagctgggactagaccgatccaaagtaaatgtgaatggaggcgcgattgcccttggacaccctctgggtgcaacaggtgcgcggtgtgtggctactcttctgaacgaaatgaagcgccgaggaagagactgcagatttggtgttataaccatgtgcatcggatctgggatgggtgcagcagctgtgtttgagcggggagacacggtggatgaactctccaacgtgcggggcgcccagtcacacaattttctatctagggatgcaaagtagaattgcagaaacattcttatctatctcaaggcatcgatcacagtaccatcctaaagcataatacggaaacccatatgtttattttcacagaaactatgtatacaaggaataaagggcatcatatggtatcttgttgtagccacccttatagatgaaaaagagaaagaaaagggtgttgtaaccagaaaaaaaaaaaaaaaaaaaa

SEQ ID NO: 3182 - protein, 459 aa, Panicum virgatum
  misc_feature: Ceres CLONE 1789756
  misc_feature (1)..(446): SWISSPROT Homolog: EC 2.3.1.16 3-ketoacyl-CoA thiolase 1, peroxisomal precursor
  misc_feature (1)..(459): SWISSPROT Homolog: EC 2.3.1.16 3-ketoacyl-CoA thiolase 2, peroxisomal precursor
MEKAIDRQRVLLAHLLPSSPSSQPQLEASACAAGDSAAYQRTSSFGDDVVVVAAYRTPICKAKRGGFKDTYPEDLLTVVLKAVLDNTKINPSDIGDIVVGTVLGPGSQRANECRMAAFYAGFPETVPVRTVNRQCSSGLQAVADVAAAIKAGFYDIGIGAGLESMSINSIAWEGQVNPKISAFQKAQDCLLPMGVTSENVAHRYGVTRQEQDQAAAESHRRAAAATASGKFKDEIVPVPTKIIDPKTGEEMKVVISVDDEIRPGTTASGLAKLKPVFKKDGTTTAGNSSQVSDGAGAVLLMKRSVALKKGLPILGVFRSFAAVGVDPAVMGVGPAVAIPAAVKSAGLQIEDIDLFELNEAFASQFVYCCNKLGLDRSKVNVNGGAIALGHPLGATGARCVATLLNEMKRRGRDCRFGVITMCIGSGMGAAAVFERGDTVDELSNVRGAQSHNFLSRDAK

SEQ ID NO: 3183 - DNA, 2364 bp, Panicum virgatum
  misc_feature: Ceres CLONE 1789760
  misc_feature: Encodes the peptide sequence at SEQ ID NO. 3184
attttctctctctctctctctctctctctctcggcggcagcagcagcagcagcaggggccgaaatcccctcgcgcaccagagaaattctccagccaccgccaccaccgccgcgcccagcacctcccgttcccccaatctggtacaatggtcatgaagatggagatggaggacgacggcgctgtcggaggaactggcgggacatggatggaggaggaccgagctctcggcgctgctgtcctcgggacagatgcatttgcatatctaacaaaaggcggtggtgccatatccgagggtcttgttgctgcatctctgccagatgacttgcaaaacaaactccaggagcttgttgagtcagagggccctggtactggttggaattatgccatcttttggcagctctcacgcaccaagtccggtgaccttgtccttggatggggggatggctcctgccgcgagccccgagatggagaggtgggagctgctgcttctgcaggcagcgatgataccaagcagcggatgcgcaagcgtgtgctgcagaggttgcacatagcattcggggttgcggatgaggaggattatgcccctggtattgatcaggtgacagatactgagatgttcttcctagcatctatgtactttgcattccctcgtcgtgctggtggccctggccaggtatttgcagcaggcatccccctctggattcccaataatgagcgcaaggtattcccggccaactactgctaccgcgggttccttgcaaacacggcaggatttaggactattgtgttggtgccgtttgacagtggtgttcttgaactgggctcaatgcagcacatagctgagagttctgatactatccagaccatacggtctgtgttcacaggggcaggcggtaataaggctgcagttcagagacacgagggaaatggccccactcctcctgaaaggtctcctggtttggcgaagatttttgggaaggatttgaaccttggccggccttcagcagtgccagcggttggtgtatctaaggtagatgaaaggtcatgggagcagagggctgctgctgctggtgggacctcattgcttcccaatgtccagaaaggattgcagaatttcacttggagtcaggcacggggcctgaattctcatcagcagaagtttggcaatggtgttctgattgtgagcaatgaagctgcacaccgtagcaatggagctgcggacagccctagtgcaacgcagtttcagcttcaaaaggtgcctcagcttccgaaactgcagctccagaaattgccgcatattcagaaaacaccacagctggtgaaccagcagcctctgcagccgcaggtacctagacaaattgattttagtgccgggagcagctccaagtctggagtgctggttacaagagcagctgttctggatggggagagtgcagaggtggatggcctgtgtaaagaggaaggcccaccacctgttatagaggaccggcggcctaggaagaggggaagaaagcctgcaaacgggagggaagaaccacttaaccatgttgaggctgagcgccagaggagggagaagctgaaccagcggttctatgcgctcagagctgttgtcccaaacatatcaaaaatggacaaggcgtccctgctgggtgatgcgataacgtacattaccgacctccagaagaagctgaaagatatggagacggagagagagaggcttttggagtcaggtatggtggatccgagggagcgaggagcgcctaggccggaggtggacatccaggtgttgcaggacgaggttcttgttcgagtgatgtctcccatggagagccatccagtcaagaaagtcttccaagcgtttgaggaggcagaagtccgcgttggtgagtcgaaggtgactggcaacaacaacgggaccgtggtgcattccttcatcatcaagtgccctggcactgagcagcagacgagggagaaagtgattgcggcgatgtctcgtgtgatgagcagttgagcagagcttaggaccagattggcgtggtaggggggtgtcggtgtaccatgttgcttgcaaacaagcagcggcagcagccgcccttgacatgtcccgttgtcgataggaggagagttgtaggtggagaaaggaaagctcagattctgacttttagctatgcaggaagaggggaaaaaagaaaggctctgccgctgtttggtagatttcttgtggtggtccgtgtagttttttctttttaatgtttttttgggggatggggatggatggatactgtgtgtcctagtgtaagtttgatgatgcagcagaacaataaacagcagtacatgttttttcaaaaaaaaaaaaaaaaaaaa

SEQ ID NO: 3184 - protein, 621 aa, Panicum virgatum
  misc_feature: Ceres CLONE 1789760
  misc_feature (1)..(50): Pfam Name: HLH Pfam Description: Helix-loop-helix DNA-binding domain
  misc_feature: The sequence is a functional homolog of  SEQ ID NO 1177 in the  11/479,226 US patent application
  misc_feature: The sequence is a functional homolog of  SEQ ID NO 528 in the  10/412,699 US patent application
  misc_feature: Useful for making plants with modulated growth and phenotype characteristics
MVMKMEMEDDGAVGGTGGTWMEEDRALGAAVLGTDAFAYLTKGGGAISEGLVAASLPDDLQNKLQELVESEGPGTGWNYAIFWQLSRTKSGDLVLGWGDGSCREPRDGEVGAAASAGSDDTKQRMRKRVLQRLHIAFGVADEEDYAPGIDQVTDTEMFFLASMYFAFPRRAGGPGQVFAAGIPLWIPNNERKVFPANYCYRGFLANTAGFRTIVLVPFDSGVLELGSMQHIAESSDTIQTIRSVFTGAGGNKAAVQRHEGNGPTPPERSPGLAKIFGKDLNLGRPSAVPAVGVSKVDERSWEQRAAAAGGTSLLPNVQKGLQNFTWSQARGLNSHQQKFGNGVLIVSNEAAHRSNGAADSPSATQFQLQKVPQLPKLQLQKLPHIQKTPQLVNQQPLQPQVPRQIDFSAGSSSKSGVLVTRAAVLDGESAEVDGLCKEEGPPPVIEDRRPRKRGRKPANGREEPLNHVEAERQRREKLNQRFYALRAVVPNISKMDKASLLGDAITYITDLQKKLKDMETERERLLESGMVDPRERGAPRPEVDIQVLQDEVLVRVMSPMESHPVKKVFQAFEEAEVRVGESKVTGNNNGTVVHSFIIKCPGTEQQTREKVIAAMSRVMSS

SEQ ID NO: 3185 - DNA, 2594 bp, Panicum virgatum
  misc_feature: Ceres CLONE 1789765
  misc_feature: Encodes the peptide sequence at SEQ ID NO. 3186
acttcactccccctcccctgccctgccccctcaacttcaaatcgattcggcgctagggagcagtaaggccaaggcagcatccatccagcaatagcagcagcgacctccccttgtcttcctcctccggtcctcgcctcatgaggacccaaacaagccaccttggcctcctcttcctcttctcctctgcgttgctcgccgtctccttcgcgcaggagcgcaacaactatgtggttcatctcgagccgagagaggacggcagcaccgattcggtggaggagtggcaccggtccttcttgccggaggccacgctggactcggcgagcgacgacggccccaaaatcatacactcgtacagccacgtgctcaacgggttcgccgcccgtctcaccgacgcggaggcggagagtctcaggaacaaggaggggtgcctgcgcctctaccccgaggaattcttgccgctcgcgaccacccactcgccgggcttcctcggcctccacctcggcaaggacggcttctggagccgctccgggttcggccggggcgtggtgattgggctcctggacaccggcatcctgcccagccacccgtccttcggcgacgccggcctgccgccgccgcccaagaagtggaaaggcacctgcgagttcaggtcgatcgccggcggcggctgcaacaacaaggtcatcggcgcgcgcgcgttcgggagcgccgccatcaacaacaccgcgccgcccgtcgacgacgcgggccacggcacgcacacggcgagcacggcggcgggcaacttcgtccagaacgccgacgtgcgcgggaacgcgcacggcacggcgtccgggatggcgccgcacgcgcacctcgccatatacaaggtctgcgcccggagccgctgctccatcatggacatcatcgccgggctggacgccgccgtcaaggacggcgtggacatgctctccttctccatcagcgccaccgacggcgcgcagttcaactacgacctcatcgccgtcgccactttcaaggccatggagcacggcgtcttcgtcagcgccgcggccggcaatgacggccccgtcgccggcaccatcagcaacggcgcgccctggatgctgacggtggcggccggcaccacggatcgcgcgatccgcaccagcgtgaggctcggcaacgggcaggtgttggacggcgagtccctgttccagccccggaacaacaccgccgggcggcagctcccgctcgtgttcccgggccgcaacggcgacccggacgcccgcgactgcagcacgctggtcgaggcgaaggtgcgcggcaaggtggtcctctgcgagagccggtcgatcggcgagcacgtcgagcagggtcagatggtgtccgcgtacagcggcgccggcatgatcctgatgaacaaggcggcggaggggtacaccactttcgccgacgcccacgtgctgcccgcgtcgcacgtgagctacgccgccgggtcgaagatcgcggcgtacatcaggtcgacgcccaggcccacggcgagcatcaccttcaggggcacggtgatggggtcgtccccggcgccgtcggtcgccttcttctcgtcgcgcgggccgaacaaggcgagcccgggcatcctgaagccggacatcacggggcccggcatgaacatcctggcggcgtggacgcccagcgagatgcatcccgagttcgcggacgacgtgagcctgaccttcttcatggagtcgggcacctcgatgtcgacgccgcacctgagcggcatcgccgccatcgtcaagagcctgcacccgagctggtcccccgcggcgatcaagtcggcgatcatgacgtcctcggacgtcgcggaccacgccggcgtggccatcaaggacgagcagtaccgacgggcgagcttctactccatgggcgccgggtacgtgaacccgtcccgcgccgtcgaccccgggctggtgtacgacctgggcaccaacgagtacatcgcctacctctgcgggctggggctcggggacgacggcgtgaaggagatagtcgggcggcgcgtcgcctgcggcaagctcagggccgtcaccgaggcggagctcaactacccgtcgctggtggtgaagctgctgtcccagccgatcacggtccggcgcacggtgacgaacgtggggaaggcggactcggtatacacggcggcggtggacatgcccaaggacgtgtccgtggtggtgcggcccccgatgctgcgcttcacccgggcgaacgagaagcagagcttcagcgtgacggtgcggtggaacgggcagccggccgtgggcggcgccgaggggaacctcaagtgggtgtccaaggagcatgtggtgaggagcccgatcgtgatcccgccggccaaggccgtcgcttgatcacaagtagtggtaggttatcatgagactgagtgtgcccggtggtgtacgtatggcgaaggaagtagtaggtgatttgttgttgttgtatagccagcaaggtaccgggcgagatcatctgcgacgcagcaagctcagctgcaatggcgttctgtaaaaaaaatggctgaaaaataattgcttcaaaaaaaaaaaaaaaaaaaa

SEQ ID NO: 3186 - protein, 750 aa, Panicum virgatum
  misc_feature: Ceres CLONE 1789765
  misc_feature (9)..(465): Pfam Name: Peptidase_S8 Pfam Description: Subtilase family
MRTQTSHLGLLFLFSSALLAVSFAQERNNYVVHLEPREDGSTDSVEEWHRSFLPEATLDSASDDGPKIIHSYSHVLNGFAARLTDAEAESLRNKEGCLRLYPEEFLPLATTHSPGFLGLHLGKDGFWSRSGFGRGVVIGLLDTGILPSHPSFGDAGLPPPPKKWKGTCEFRSIAGGGCNNKVIGARAFGSAAINNTAPPVDDAGHGTHTASTAAGNFVQNADVRGNAHGTASGMAPHAHLAIYKVCARSRCSIMDIIAGLDAAVKDGVDMLSFSISATDGAQFNYDLIAVATFKAMEHGVFVSAAAGNDGPVAGTISNGAPWMLTVAAGTTDRAIRTSVRLGNGQVLDGESLFQPRNNTAGRQLPLVFPGRNGDPDARDCSTLVEAKVRGKVVLCESRSIGEHVEQGQMVSAYSGAGMILMNKAAEGYTTFADAHVLPASHVSYAAGSKIAAYIRSTPRPTASITFRGTVMGSSPAPSVAFFSSRGPNKASPGILKPDITGPGMNILAAWTPSEMHPEFADDVSLTFFMESGTSMSTPHLSGIAAIVKSLHPSWSPAAIKSAIMTSSDVADHAGVAIKDEQYRRASFYSMGAGYVNPSRAVDPGLVYDLGTNEYIAYLCGLGLGDDGVKEIVGRRVACGKLRAVTEAELNYPSLVVKLLSQPITVRRTVTNVGKADSVYTAAVDMPKDVSVVVRPPMLRFTRANEKQSFSVTVRWNGQPAVGGAEGNLKWVSKEHVVRSPIVIPPAKAVA

SEQ ID NO: 3187 - DNA, 1619 bp, Panicum virgatum
  misc_feature: Ceres CLONE 1789793
  misc_feature: Encodes the peptide sequence at SEQ ID NO. 3188
atccatcgccaccaccatggccatggccatggctccgccgccgctcctcctcccgttgctcctcctccctcttctctccaccgccgcgcccaccacgacgctccctctataccgccacctcccgcacgtcgccgagaccgcgcaccaccacccgctctcccgcctggccgccgcatcgctcgcccgcgcctcgcacctcaggcgctcccaccacaaacaggggcaacctggtaccgcctccgccaccgcgctctacccgcactcgtacggcggctacgccttcaccgcctccctcggcacgccgccgcagccgctgcccgtcctcctcgacaccggcagccacctcacctgggtgccctgcacctccaactaccagtgccgcaactgccccaccgccgccgtccccaccttccaccccaggaactcgtcctcctcccgcctcatcggctgccgcaacccctcctgcctctgggtccactccgccgcgcgcctcgccgccgccggcaccaactgcaccgccgccgccgtctgcccgccctacgccgtcgtctacggctcgggctccaccgccggcctcctcatcgccgacacgctccgcgcgcctggccgcgccgtcaggaacttcgtcgtcggatgcagccttgtgtccgtgcaccagccgccgtcgggcctcgcgggcttcggccgcggcgcgccgtccgtgcccgcgcagctcaggctcaacaagttctcctactgcctcctctcccgccgcttcgacgacgacgccgcagtcagcggctcgctggtcctcggcggcgccagagccggcgggatgcaatacgtcccgctggtcaagagcccggccggcgacaagcagccgtacgccgtgtactactacctggccctgaccggcgtgacggtgggcgggaaggccgtgcggctgccggagcgggccttctccgccaacgccgcaggagcgggaggcgccatcgtggactccggcaccacgttcacgtacctggacccgaccgtgttccaaccggtggcggaggccgtgatcgcggcggtgggcgggaggtacaagcggtccaaggaggcggaggacgggctgggcctgcgcccctgcttcgcgctgccgcagggcgccaagtccatggcgctgccggagctgtcgctccacttcaagggcggcgccgagatgcagctcccgctggagaactacttcgtggttgccgggcgcgctcccgtgcccgctggtccgggcgccgcagacgccgaggccatctgcctcgccgtggtctccgacttgggtggcgcgggagacgacgtgggcggcggcggcccggccattattctggggagcttccagcagcagaactactacgtggagtacgacctggagaaggagaggctggggttccggcggcagccgtgcgccgcgtcgtcgtcgtgagccagcgagctcgcgtcgtcgtccatgaattgattgcttaccccacctccacgtactgtttgttgctaatgacaaaggtgtttgctttctttttttgtgtgctcgatcgggttgtccttcttactgctaataaaattgctgcacttatcgtgcgcgtgcttgctaaaaaaaaaaaaaaaaaaaa

SEQ ID NO: 3188 - protein, 472 aa, Panicum virgatum
  misc_feature: Ceres CLONE 1789793
  misc_feature (42)..(397): Pfam Name: Asp Pfam Description: Eukaryotic aspartyl protease
MAMAMAPPPLLLPLLLLPLLSTAAPTTTLPLYRHLPHVAETAHHHPLSRLAAASLARASHLRRSHHKQGQPGTASATALYPHSYGGYAFTASLGTPPQPLPVLLDTGSHLTWVPCTSNYQCRNCPTAAVPTFHPRNSSSSRLIGCRNPSCLWVHSAARLAAAGTNCTAAAVCPPYAVVYGSGSTAGLLIADTLRAPGRAVRNFVVGCSLVSVHQPPSGLAGFGRGAPSVPAQLRLNKFSYCLLSRRFDDDAAVSGSLVLGGARAGGMQYVPLVKSPAGDKQPYAVYYYLALTGVTVGGKAVRLPERAFSANAAGAGGAIVDSGTTFTYLDPTVFQPVAEAVIAAVGGRYKRSKEAEDGLGLRPCFALPQGAKSMALPELSLHFKGGAEMQLPLENYFVVAGRAPVPAGPGAADAEAICLAVVSDLGGAGDDVGGGGPAIILGSFQQQNYYVEYDLEKERLGFRRQPCAASSS

SEQ ID NO: 3189 - DNA, 1433 bp, Panicum virgatum
  misc_feature: Ceres CLONE 1789801
  misc_feature: Encodes the peptide sequence at SEQ ID NO. 3190
aaggcctcgtccacgatggctctcctccctgccgccatgcggtcgatcctcagagctcggagtaaccgtgttcttcgcgctgctcgcgacttgcaggccggaggaggaggcggcggctcgagcctcctgcgccggtggcaatcgtcgctgccgcagccggatcacgtcgataggtccgacgaggagagcggcggcgagatcgactgggacaacctcggcttcggcctcaccccgaccgactacatgtacgtcatgcggtcctcgccggaggacctcggcgccttcccccgcggcgagctctgccgctacggcaacatcgagctcagcccctcctccggcgtcctcaactacgcccaggggctgttcgaggggatgaaggcgtaccggcggccgggccgcggcggctacacgctgttccggccggaggagaacgcgcggcggatgcagttcggcgccgagcgcatgtgcatgccggcgccgtccgtggaccagttcgtcagcgccgtcaaggagaccgtcctcgccaacaggcgctgggtgccgccgcagggaaagggggccctgtacctccggcccctgctcatggggagcggcccgattctcgggctggcgccggctcccgagtacacgttcctcatctacgccgcgcccgtcggaaactacttcaaggagggcctggcgccgatcaacctcatcgtcgacgacgagttccaccgcgccatgccgggcggcaccggcggcgtcaagacgatcgccaactacgcgccggtgctcaaggcgcagatggacgccaagagcaaggggttcacggacgtgttgtacctcgactcggtgcacaagcggtacctggaggaggtctcgtcgtgcaacgtgttcgtcgtcaagggcggcgtcgtcgccacgccggccaccaggggcaccatcctgccggggatcacgcgcaagagcatcgtcgagctcgccagggaccgcggatacaaggtggaggagcgcctcgtctccatcgacgacctgatcgacgccgacgaggtgttctgcaccgggacggcggtggtggtggcgccggtgtcgacggtgacgtaccaggggaggaggcacgagttcaggaccggcccggacacgctgtcgcaggagctgtacacgactctgacgtccatccagatgggcctggccgaggacaacaaaggatggacggtagcagtagattaaggcgacggcatgggggccatggaagcgccgcaacattcatatagtatttcttactgcttattattagattggccattatgactttgtgagcagctattggtattgtcatcacccatagtaggtagaaaaagcatgcattttgccattgatcagcgtgtagtatcagggcagctggaaaaataaaccttgtgtcgagacagttccaaaaaaaaaaaaaaaaaaaa

SEQ ID NO: 3190 - protein, 397 aa, Panicum virgatum
  misc_feature: Ceres CLONE 1789801
  misc_feature (1)..(289): Pfam Name: Aminotran_4 Pfam Description: Aminotransferase class IV
  misc_feature (61)..(394): SWISSPROT Homolog: EC 2.6.1.42 Branched-chain-amino-acid aminotransferase 3, chloroplast precursor
  misc_feature (61)..(394): SWISSPROT Homolog: EC 2.6.1.42 Branched-chain-amino-acid aminotransferase 5, chloroplast precursor
MALLPAAMRSILRARSNRVLRAARDLQAGGGGGGSSLLRRWQSSLPQPDHVDRSDEESGGEIDWDNLGFGLTPTDYMYVMRSSPEDLGAFPRGELCRYGNIELSPSSGVLNYAQGLFEGMKAYRRPGRGGYTLFRPEENARRMQFGAERMCMPAPSVDQFVSAVKETVLANRRWVPPQGKGALYLRPLLMGSGPILGLAPAPEYTFLIYAAPVGNYFKEGLAPINLIVDDEFHRAMPGGTGGVKTIANYAPVLKAQMDAKSKGFTDVLYLDSVHKRYLEEVSSCNVFVVKGGVVATPATRGTILPGITRKSIVELARDRGYKVEERLVSIDDLIDADEVFCTGTAVVVAPVSTVTYQGRRHEFRTGPDTLSQELYTTLTSIQMGLAEDNKGWTVAVD

SEQ ID NO: 3191 - DNA, 1904 bp, Panicum virgatum
  misc_feature: Ceres CLONE 1789808
  misc_feature: Encodes the peptide sequence at SEQ ID NO. 3192
caggtgatctcaagttctgaaccgtgaccagcaagcatcacagcacggggcagtcgtgtgccgcaccgaacccgtactgctccattgacgagctaggtataccctgctgaaacagcgcagaccggaagcgcacgccacgccaggcaagcaaagccgatctcactcaggcagaagccatttgccaacaaccaccggggagaagagaacgagcccgacgacgcccccccgaccgtgctcctgctccgccggtacgatcgggcgcgtgctcactcccctgccctgccgccttcgccctcgcgctcgcgggcgggcgggccccacggtctcccctgcccctggcatgctcccccagctatataaagcgcgagcgccacgcgttcgcagcgcccaccacctccagttcgcttcgcagtcctcgatcgtcctctgctccgatcggttggttcgtcgccaggagctgtctgcgccttggaagccgccgccatgcaggaagctctcctctccccgggcaatgccggcagcctccgctcggccttggagctcaagccgttcgccttcggggaccagcgcctcgcctcgccgcgctacctcaacctcgcctgcggcggcggcggcgacgatgccgtcgacgcgctgttccgctgctcctcccccttcagccccagcttcggcttctcctcgccgtcgccgctcgcagcctcctcgtccgtctcgctctcgccgtcctcgtcggcctccctcgtcgacgactgcgacgacgccgcggccgacgccgccacgggccaccgcctccagctcgcgcgcctcgcgctgcagtaccaggaggcggccgaccgctacgagctctgcctcgcccgcctcgccgaggccgccgacgaggccgcggcgctccgccgcgagaacgccgagctccgcgccgccaacggcgacctcacgcgccgcctcgcgctgctcagggacatcggcaagcaggccgccgccgccgccatcgccgacgaggtccgccggctccgctttgtcgaccagaaggccgccaaggagcggccgcccgagaagctcgccgtgctgcccaagagcatctccgtgcgctccaacgagtacctcaagatgaaactgcccaaccaggcccccgccacgccggccgccaacaacagcaagcctcgcgcggcgaacgctaccaaacccagctcgcacgcgtacatgggcgacggcggcggcaggaaaggcgaggaggccaccaaggaggctggcggcacggagctggaggtgtgcaaccagggcatgttcaagacggagctgtgcaacaagtgggaggagacgggggcgtgcccctacggcgagcagtgccagttcgcgcacggcgtcgccgagctccgccccgtcatccgccacccgcgctacaagacccaggtctgccgcatggtgctcgccggcgaggtctgcccgtacggccaccgatgccacttccgccactcgctcacccaggccgagcgcctcctcctcccgcgcccttagcaagcagaggcacggaaccgttcggttttgcttcatctcaagtcaacaagtggagtatataattcacacgaaaatgcacaaaaaaatgcaaacatcgtaaataagatatatacacgtatacaggtaatatacttataaaagagcataaaaggaaacctgatcgtagaattagttttaaggaaatgtgaatattcatacacaaaattagcttcatcgtaagtcagcgtgggttctcggggacttcaactgtgtcttctgttcatgtaatctatttttttggtgtatttgttaggtgatagctgcccattttcttcgatgcaatgggccagggcttgatacaataaactcagtagaactcattcatcgtccaaaaaaaaaaaaaaaaaaaa

SEQ ID NO: 3192 - protein, 343 aa, Panicum virgatum
  misc_feature: Ceres CLONE 1789808
  misc_feature: Great-hit functional homolog of the protein sequence given in SEQ ID NO 9357
  misc_feature (1)..(27): Pfam Name: zf-CCCH Pfam Description: Zinc finger C-x8-C-x5-C-x3-H type (and similar)
  misc_feature: Useful for making plants with altered Lignin content
  misc_feature: Useful for making plants with altered terpenoid content
MQEALLSPGNAGSLRSALELKPFAFGDQRLASPRYLNLACGGGGDDAVDALFRCSSPFSPSFGFSSPSPLAASSSVSLSPSSSASLVDDCDDAAADAATGHRLQLARLALQYQEAADRYELCLARLAEAADEAAALRRENAELRAANGDLTRRLALLRDIGKQAAAAAIADEVRRLRFVDQKAAKERPPEKLAVLPKSISVRSNEYLKMKLPNQAPATPAANNSKPRAANATKPSSHAYMGDGGGRKGEEATKEAGGTELEVCNQGMFKTELCNKWEETGACPYGEQCQFAHGVAELRPVIRHPRYKTQVCRMVLAGEVCPYGHRCHFRHSLTQAERLLLPRP

SEQ ID NO: 3193 - DNA, 1543 bp, Panicum virgatum
  misc_feature: Ceres CLONE 1789813
  misc_feature: Encodes the peptide sequence at SEQ ID NO. 3194
accacctcgccaaacccggtgagaaacctcgtgctctccgccgccgccgcgtccgcctcgatccctccgcccgcctcccgaggctcaggcttcccggatcttcggcggggagccgcggcgaccctccccaggacgatgcagagcgcggcggccatcgggctagtccggccatgcgccgcgcggccgctcgccgcttgccctagccaccgccgctatggagccggcgccggacacaatccggtcctcccggcgcgcgccctccgcctctccgcccgcgccgggctcgtgccggcctcgccgcttgaggaggaggagaagcggagatgcagggacgtggcggcgtcggcgtcggcggcggccgcggcgcaggggggcggggaggaagccggaggagggctgatgaagacgttgcagctgggggcgctcttcggcctctggtacctcttcaacatctacttcaacatctacaacaagcaggttctgaaggttttgccgtaccctataaacatcacaactgtgcagtttactgttggaactgccattgctttgttcatgtggatcactggtatccttaaaagaccaaagatttctggtgcccagcttctcgctatccttcctctggctattgtccacaccatgggcaatcttttcacaaacatgagccttggaaaggttgcagtgtcatttacacatactatcaaggccatggagcctttcttctcagtcctcctttcagcaatcttccttggtgagttgcctactccttgggttgtattgtctcttgttcccatcgttggtggtgtggctttggcatctcttactgaggcttcctttaactgggctggcttttggagtgcaatggcttcaaatgtaaccttccagtcaaggaatgtgctaagcaagaagcttatggtgaagaaagaggaatctctggacaacattaatcttttctcaatcattacagtcatgtcattcttcctcttggccccagtaaccttactaacagagggtgtcaaagtcagtcctgcagtcttgcagtctgctggcttgaacttaaaacaggtctacacgaggtcgctgattgctgcattctgcttccatgcataccaacaggtgtcatacatgatcctcgctagggtgtccccagtcacccattcagtgggcaactgcgtcaagcgtgtggtggtcattgtgacttccgttctgttcttcaggacccctgtttctcctgtcaactctctaggtaccggggttgccctcgcaggagtcttcctgtactcgcaactgaagaggcttaagcccaagcccaaggctgcttaatgacatactatcaggtccatcggtccattagaactgtggaagaccttccgcatgagtgactagcgagtgctgtagtttagaatgatattgaaaggagcccctctggtttgctaccacttcatgtgattgtatgtgatttaattactagcatttttgaacggatttatggtttattggtgtattaataattttgatgtggtgccaaaaaaaaaaaaaaaaaaaa

SEQ ID NO: 3194 - protein, 394 aa, Panicum virgatum
  misc_feature: Ceres CLONE 1789813
  misc_feature (1)..(147): Pfam Name: TPT Pfam Description: Triose-phosphate Transporter family
MQSAAAIGLVRPCAARPLAACPSHRRYGAGAGHNPVLPARALRLSARAGLVPASPLEEEEKRRCRDVAASASAAAAAQGGGEEAGGGLMKTLQLGALFGLWYLFNIYFNIYNKQVLKVLPYPINITTVQFTVGTAIALFMWITGILKRPKISGAQLLAILPLAIVHTMGNLFTNMSLGKVAVSFTHTIKAMEPFFSVLLSAIFLGELPTPWVVLSLVPIVGGVALASLTEASFNWAGFWSAMASNVTFQSRNVLSKKLMVKKEESLDNINLFSIITVMSFFLLAPVTLLTEGVKVSPAVLQSAGLNLKQVYTRSLIAAFCFHAYQQVSYMILARVSPVTHSVGNCVKRVVVIVTSVLFFRTPVSPVNSLGTGVALAGVFLYSQLKRLKPKPKAA

SEQ ID NO: 3195 - DNA, 1759 bp, Panicum virgatum
  misc_feature: Ceres CLONE 1789827
  misc_feature: Encodes the peptide sequence at SEQ ID NO. 3196
aaatgaactccctcaaaggcaaaacaggccagcgcgaattctacgcttgcaagtcataacgatcttttattggttggagatttgcggcgatgaaattaaatatccttttctccgtttagagccgggcggcgacgatgtggcctgtaccctgtagggactggtagtgagtaaagaatccagcatgccagccacctgccccgtaacttcttctggttcctcttcgtcatcatcctcctcctactcccgacgaagcaaccaaggacgagaggcgggagcggaggaccgccgccgcagcccaatccgctaaggggtagagggaacagcccgcggaaagaatcttgttcttcaaatagaaagtatggaactgggacccgattcttgaactaagaatctcgactcctcatctctgccttccccgtctccaagatctgccagtgcgcccttgtctccaagatgtccatgcctgccattgccgatcgaagtttattcgcaaatgggcactgtagtcatcatcttgtttcatctcttcttgataaaattgttgtttaggtgaaggatttggaggatgacagaagctgcaattacaaggtattggtgccatgaatgtgagcacgccgttgactttgagggggccatggtcgaggccatggctgaggagatcaagtgcccagcctgcgatggtggattcattgaggagatgattggcgaggaatttgagagattgaccagccaacactcagagcaggatttatcacaatggggaacgtctgaccatccttttgagcatccaggagcgacagcggacagcgaggatgatgaagaagaagatgatgacgatgatgatatgggccgtgagtttgagggtttcatcaggaggcatcgacgggcatcagctcttcgtcgtgtacttgacagcatccaagatgacctcagagctgacagggaaagggacaactccattctgatcaatgccttcaaccaggcccttgctctgcatggctcagtgctcgatcctgatgaggtccgggatgaccaaggcagctctagcaatgatgatggtttgctggaggagtatgtgctgggggctgggctgagcttgctgcttcaacatttggctgagagtgacccataccgatatggtacccctcctgctaggaaagaggcggttgaagctttgcccactgttaaaattgaagaggtcgtcagctgttcagtctgccttgatgatcttgggctgggctcccaggcaaagcagatgccttgtgagcataagttccactctccatgtatcatgccatggcttgaactccatagttcatgccctgtgtgccggtttgagctaccatctgaagagacgaaagacttgaacgagcctagcaatgtcgttagaacagagagcatccatgacgaaatcagagctgatggccctgggaatgacaatgagagcagtaacagagcttgggccctagctccttggttcaatgggctattctcggcacctgaaccgcaaactgccagaggcgctttgactgatcaacaaccaccttcagctactggaaccaacccgaatgctggggaaagctgatttcatcttcctttgtgaataatgcttatacatctgaggatagcaatgaaccatgttggtagaacacttctttttctctagtgataatccttctaggatgaatcacaaggtacaaagtttgtggctgctctgttttgccatatgtttagcgatcaaaaaaaaaaaaaaaaaaaa

SEQ ID NO: 3196 - protein, 339 aa, Panicum virgatum
  misc_feature: Ceres CLONE 1789827
  misc_feature (1)..(41): Pfam Name: zf-C3HC4 Pfam Description: Zinc finger, C3HC4 type (RING finger)
MTEAAITRYWCHECEHAVDFEGAMVEAMAEEIKCPACDGGFIEEMIGEEFERLTSQHSEQDLSQWGTSDHPFEHPGATADSEDDEEEDDDDDDMGREFEGFIRRHRRASALRRVLDSIQDDLRADRERDNSILINAFNQALALHGSVLDPDEVRDDQGSSSNDDGLLEEYVLGAGLSLLLQHLAESDPYRYGTPPARKEAVEALPTVKIEEVVSCSVCLDDLGLGSQAKQMPCEHKFHSPCIMPWLELHSSCPVCRFELPSEETKDLNEPSNVVRTESIHDEIRADGPGNDNESSNRAWALAPWFNGLFSAPEPQTARGALTDQQPPSATGTNPNAGES

SEQ ID NO: 3197 - DNA, 1732 bp, Panicum virgatum
  misc_feature: Ceres CLONE 1789833
  misc_feature: Encodes the peptide sequence at SEQ ID NO. 3198
acgcgccgcgcatcgccatctcccgttgctcatagaagaaaggaagagggggcggcgagcgagcagcgagcagggcaggtcggtccatggcgacgtgcgccgcgagcctcgcgccgctgctgggcccggcggcggcgaacgcgacggactacctgtgcaaccggttcgcggacaccacgtcggcggtggactcgacgtacctgctcttctcggcgtacctcgtgttcgccatgcagctggggttcgccatgctctgcgcgggctccgtccgcgccaagaacaccatgaacatcatgctcaccaacgtgctcgacgccgccgccggcgctctcttctactacctcttcggcttcgccttcgcgtacgggacgccgtccaacggcttcatcggcaagcagttcttcggcctcaagcggctgccccaggtcggcttcgactacgacttcttcctcttccagtgggccttcgccatcgccgccgccgggatcacgtcgggctccatcgccgagcggacccagttcgtggcgtacctcatctactccgccttcctcaccggcttcgtgtacccggtggtctcccactgggtctggtccgccgacgggtgggcctcggcgtcccggacgtcggggaagctgctcttcggctccggcatcatcgacttcgccgggtccagcgtcgtccacatggtcggcggcattgccggcctctggggcgcgctcatcgagggcccccgcatcggccggttcgaccacgccggccgctcggtggcgctgcgcgggcacagcgcgtcgctcgtcgtgctcggcaccttcctgctgtggttcgggtggttcggcttcaacccggggtcgttcctcaccatcctcaagagctacggccccgccggcagcatccgcgggcagtggtccgccgtgggccgcaccgccgtgaccaccaccctcgccggcagcacggcggcgctcacgacgctcttcgggaagcggctccagacggggcactggaacgtgctcgacgtctgcaacggcctcctgggcggcttcgccgcgatcaccgccggctgctcggtcgtggacccctgggcggccatcatctgcgggttcgtgtcggcgtgggtgctcatcgggctcaacgcgctggcggcgaggctccggttcgacgacccgctggaggcggcgcagctccacggcgggtgcggcgcgtggggggtcatcttcacggggctgttcgcgcgccgggagtacgtggagcagatctacggcggcgcgccggggcggccgtacgggctcttcatgggcggcggcgggcggctgctggcggcgaacgtggtgatagtcctggtgatcgcggcgtgggtgagcgccaccatggccccgctgttcctggcgctcaacaagatgggcctgctccgcgtctccgccgaggacgagatggccggcatggaccagacgcggcacggcggcttcgcgtacgcgtaccacgacgacgaggaccccagcggcaggcccaaggggttgcagacctcgcagatcgccaacgcgcccagcggcgagttctagcgacgccgtgccagccgctaccgctatagtaggggtacacatacacacgccctgcagattgcaagcagaccacccttctgtcgagctggatctcaccgtatgatgctacacaagattgtataataacaacgaggcatactattactcttcttgtctaaaaaaaaaaaaaaaaaaaa

SEQ ID NO: 3198 - protein, 489 aa, Panicum virgatum
  misc_feature: Ceres CLONE 1789833
  misc_feature (1)..(425): Pfam Name: Ammonium_transp Pfam Description: Ammonium Transporter Family
MATCAASLAPLLGPAAANATDYLCNRFADTTSAVDSTYLLFSAYLVFAMQLGFAMLCAGSVRAKNTMNIMLTNVLDAAAGALFYYLFGFAFAYGTPSNGFIGKQFFGLKRLPQVGFDYDFFLFQWAFAIAAAGITSGSIAERTQFVAYLIYSAFLTGFVYPVVSHWVWSADGWASASRTSGKLLFGSGIIDFAGSSVVHMVGGIAGLWGALIEGPRIGRFDHAGRSVALRGHSASLVVLGTFLLWFGWFGFNPGSFLTILKSYGPAGSIRGQWSAVGRTAVTTTLAGSTAALTTLFGKRLQTGHWNVLDVCNGLLGGFAAITAGCSVVDPWAAIICGFVSAWVLIGLNALAARLRFDDPLEAAQLHGGCGAWGVIFTGLFARREYVEQIYGGAPGRPYGLFMGGGGRLLAANVVIVLVIAAWVSATMAPLFLALNKMGLLRVSAEDEMAGMDQTRHGGFAYAYHDDEDPSGRPKGLQTSQIANAPSGEF

SEQ ID NO: 3199 - DNA, 1660 bp, Panicum virgatum
  misc_feature: Ceres CLONE 1789834
  misc_feature: Encodes the peptide sequence at SEQ ID NO. 3200
agtccaccaaagcaagaacttgggcttgggctactcccaactcccaattttaagacaggaaaggtgcatcctctgctgcaactagccacagaattgcagcaaagctaggccatgaagaagaccgtggttctgtaccccgggctctccgtcagccacttcgtccccatgctgcagctcgccgacgccctcctgaacgaaggctacgccgtcaaggtggcccacatcgaccccgccctgaaaggggacatcgccatggccgccgtcatcggccgcgccgccgcctccaggccgtccgtcaccttctacgagctcccacggatccaggaccctcccaccgtcctccacgacgccaagttcctcgccacgtactccgacctcctaggccgccacaacgagcgcttccacgacttcctccgctcgctgcctcccggcagcgtccacgcgctggtcctggacgtcctggccgccgaggcgttgggcgtcgcccaggagcttgggatcccggcctactccttcgtccccaccaacgcctccgccttcgccattttctcccagctcccttcgatccgcacggagggccagccgaccatgaaggagctcggagacacgcctctcgatttccatggcgtcccacccatgacggcctctcacatccacaccgaaagcctcgaggacccggagagtgagaaggtgctgctggacatgctggtcgcgacacagcaacgagccaacggcatactcgtgaacacgttcctgcccctggaagctcgggcggtgggcgcgctcagggaccggcggtgtttccccacgatgcctccggtctactgcgtcggcccattcatcgcggaggccggtctggcaggggaaaagcatgagtgcctcgcgtggctggacaagcagccggagcgcagcgtggtgtacctctgcttcggcagcgtcggtgccggcaaccactcggaggagcagctcaaggagatcgccgccggcctggagaagtcgggccaccggttcctgtgggtggtgcgggcgcctccccacgacgatccgaagaggccgttcgacccgcgcgccgacccggacctcgacgcgatcctgccggcggggttcctggagaggacccgcggccgcggcctcgtcgtcaagctgtgggcgccgcaggtggcggtgctccagcacagggcgacgggcgcgttcgtgacgcactgcggctggaactcggtgctcgaggggatcacggcgggtgtgccgatgctttgctggccgctgtacgcggagcagaagatgaacaaggtgttcatggtggaggagtacggggtcggcgtggaggtgctcgggtggcagcagggggtggtgaaggccggagagctggaggccaaggtcaggctggtgatggagggcgaggaaggcgagctgctcagggcacgggtcgccgagcacagggaagccgcggccatggccatgaaggatggtggctcgtcgcgggcggcgtttcgccagttcctgtcagacgtaggcaaactcaggctgaggtcaacacgctgatgaatcgttggcgacgtgattattattacatgaattatgtgccacgctctttgaacggtggaaataagctatcgagtgcatacttggaattttcttcgaaaaaaaaaaaaaaaaaaaa

SEQ ID NO: 3200 - protein, 476 aa, Panicum virgatum
  misc_feature: Ceres CLONE 1789834
  misc_feature (1)..(138): Pfam Name: UDPGT Pfam Description: UDP-glucoronosyl and UDP-glucosyl transferase
MKKTVVLYPGLSVSHFVPMLQLADALLNEGYAVKVAHIDPALKGDIAMAAVIGRAAASRPSVTFYELPRIQDPPTVLHDAKFLATYSDLLGRHNERFHDFLRSLPPGSVHALVLDVLAAEALGVAQELGIPAYSFVPTNASAFAIFSQLPSIRTEGQPTMKELGDTPLDFHGVPPMTASHIHTESLEDPESEKVLLDMLVATQQRANGILVNTFLPLEARAVGALRDRRCFPTMPPVYCVGPFIAEAGLAGEKHECLAWLDKQPERSVVYLCFGSVGAGNHSEEQLKEIAAGLEKSGHRFLWVVRAPPHDDPKRPFDPRADPDLDAILPAGFLERTRGRGLVVKLWAPQVAVLQHRATGAFVTHCGWNSVLEGITAGVPMLCWPLYAEQKMNKVFMVEEYGVGVEVLGWQQGVVKAGELEAKVRLVMEGEEGELLRARVAEHREAAAMAMKDGGSSRAAFRQFLSDVGKLRLRSTR

SEQ ID NO: 3201 - DNA, 1714 bp, Panicum virgatum
  misc_feature: Ceres CLONE 1789839
  misc_feature: Encodes the peptide sequence at SEQ ID NO. 3202
ccacacgcgtcggtggtcgccactcgtcacccccaccgaatcctcctcctcctcccctgttcctagaaagtcccaggcgaagaggagaatctcacctcaccctacctcacctcaccctctccccgcggacgcagtcaacgcgggaggcgcagcacggcaccgcagcttctcctcccgctcctgctcctgctcctccccctcccgtcgccgagggcgccgccacggccacggcgccggcgcgtaccaggtccgcgggcctctccaagggacccgataagcctccccctcccccgtcccgtccaccacctataacaaacgagcaaacaaggcaagcgacagcaggaatcgcgaggaacagcgcccgcccaatccaccccgacacgctgggatctttctttccttagccgatcggtcaacgccgcggattttattcttccccttccttccttccttcccccggggctccggaggtttccgtaaacccgtcgtccgtcgccgcggcgccccctccccttctttcttgcaggtattgacgagcagtcgttccattccgacacccctcggcactgactggcttctgatttttgagggcatttggattgcacatcagtttgctgcctttaagcatttggtacctgattagttgggacttgaggagttctgctcaaggaactcctcagtgaggtttccttggattatgggagctttctgttcgtgcctgcaacctgattattctgaccaccatgggaaccacacttcctcggcgtttaggaactgcatgtgcctcagatgttttacccagcagctcatcaatgcgtacactgttttgttccgagctggagcagtgcactctgtttctcagtctatagaagccaccccagtggattcaactgaaagttcctttgatacatatcgttcgcccccaagaccgctgccctatgacgatccacgattttcccctcctgctcgtgactggttaaggcatgagagcccaagccattccccagaggaatcagaaccgcttagagcaaatggtgatgatgaggaaatgaaaacaccaagcagaattgacaaggcaagtaaaacaaactatgacacaaaaatgaagatatgcagctctgcttatggagataaggtaccaccaaagggccatggaaattacttcagctacttctccccatctgctgaagatgaagatgtctgcccaacatgtcttgaagattatacgtctgagaaccccaggatactgatgcattgctcacaccatttccaccttggctgtatctatgagtggatggaaagaagtgaggcatgccctgtctgtggaaataaaatggaatttgacgagacaacttaatcatctgtctggactttacatcttggattaacaacctcaaatggcactctgaaagacaggaggtctagccccaggaagttctctgtaaatacaccctgtaaatattgaatcggtagtgcgctcttcgccataccagtgttcttgaaatgctggatcagtgcacataaacattcttttttcaatttcttccaaatagtcggctggtgaaggtttccccttttcctgtctgcgcccctgcctggacagggtttagaggtgctgtgattgttggtgatagtatcatcagaaagctgtaaattagcaacatgttttcatataatcatatgaagtcccacgcaaaaaaaaaaaaaaaaaaaa

SEQ ID NO: 3202 - protein, 219 aa, Panicum virgatum
  misc_feature: Ceres CLONE 1789839
  misc_feature (1)..(41): Pfam Name: zf-C3HC4 Pfam Description: Zinc finger, C3HC4 type (RING finger)
MGAFCSCLQPDYSDHHGNHTSSAFRNCMCLRCFTQQLINAYTVLFRAGAVHSVSQSIEATPVDSTESSFDTYRSPPRPLPYDDPRFSPPARDWLRHESPSHSPEESEPLRANGDDEEMKTPSRIDKASKTNYDTKMKICSSAYGDKVPPKGHGNYFSYFSPSAEDEDVCPTCLEDYTSENPRILMHCSHHFHLGCIYEWMERSEACPVCGNKMEFDETT

SEQ ID NO: 3203 - DNA, 2091 bp, Panicum virgatum
  misc_feature: Ceres CLONE 1789860
  misc_feature: Encodes the peptide sequence at SEQ ID NO. 3204
actccacagggggagtgaacaaatccatcgccaggagggagctagctagtactacaaggcaacaagagaagaagacggccggggatcggagctagcgaatcgagatctccaactaaccaagaggccggcaacaataatggaggaggaggaggggcagtcgtcggcgccgttgctggaggagaagcagcagaccgcctgggtggaagggtgccccgggtgcgccgtggacaggaggaaggcggccaacccgggcatcccctacggcagcttcatatacgtctggatcgtcaccctctgcacagctttgccaatatcatcattgttccccttcttgtattttatgataagagacttgaatgttgctaaaagaacagaagatatcggcttctatgccggttttgtaggtgcttcatttatgtttggtagatgcttgacttcaacagcttggggaatagcggcggaccgtattgggaggaaaccagttgtcatgtttggcattttctccgtggttgtgttcaatactttgtttgggcttagtgtcagctattggatggcaattgttacacgatttttgctgggtgctttaaatggtctacttggaccaattaaggcttatgccattgaagtttgccgatcagaacatgaagccctagcattgtcacttgtcagcacggcatggggaataggtctcatcattggtcctgctttaggaggctaccttgcactgcctgcagaaaattttccaaatatcttttcacctgactcattctttggaaggtttccatatttcttaccatgcttatgcacatcagtctttgctgctgttgttctcataagctgcatatggatgccggagactttgcataagcataaagttagtgaaaatgaaaaccagagcattgaagctttggaggctcatctgattgatccaaaagaaaaggttgaagaaagtggaagtttggataccaagaagagcttattcaagaattggccattgatgtcatcaataattatctattgcatcttctccttccatgatatggcttacacagaggtgttctctctatgggctgaaagtgacaagaagtatggtggactcagtttatcgtccgaggatgtcggtcaagtcctcgcagttacaggtgccagtcttcttgtatatcaactgttactgtaccctcgtatcaataaagttcttgggcctatcaattcttctcgaattgcagcaatcctgtgtatacctatcctctttgcctacccctatatgacatacctttctcaacctggattatcaatcattctcaatattgcatcggtgataaaaaataatatttctgtaaccatcattacaggcacattcatccttcaaaacaatgccgtgcctcaggatcaaagaggagctgcaaatggattgtctatgacaggaatgtcgtttttcaaggcagttgctccagcaggagcaggcatggtgttctcgtgggcacagaaacgacagcatagttttttctttccaggtgatcagatggtgttctttcttctgaatgtgattgagttgctcggacttgtcctcacattcaaaccctttctggctgtgccagagcaatataataatagaaattagaattcaaattttagaagcttagggatattcaaacagagtcttgcaccggtgaggtaaagggcataatgaccttccacaaagaggaacctgaaagagggagatggatcgagttgtttgcgtgtaactgtaagtgttgtatgcttcgagaaaactgcaagtgttgtatgtagttgcagcaattcagtagaggaaatgtatacttggtaaatggcagccaatcgattgcttgcttttaattaggcaggcattttgtgccgagttgctgcactgtaaagcagcaataattgtttgatcaacatgtctggttctaatttattctgctgattgactcatccttctgcgtcgagtcaaaaacatggcatcctgatgaaaatgttgaagcgaaacagcagagaacattttttttgtcagcaaaaatgaatgcccagcatagcagcctttttattccacaaaaaaaaaaaaaaaaaaaa

SEQ ID NO: 3204 - protein, 494 aa, Panicum virgatum
  misc_feature: Ceres CLONE 1789860
  misc_feature: Great-hit functional homolog of the protein sequence given in SEQ ID NO 9326
  misc_feature: Useful for making plants with modulated flowering time
  misc_feature: The plant flowers significantly late compared to wild-type.
MEEEEGQSSAPLLEEKQQTAWVEGCPGCAVDRRKAANPGIPYGSFIYVWIVTLCTALPISSLFPFLYFMIRDLNVAKRTEDIGFYAGFVGASFMFGRCLTSTAWGIAADRIGRKPVVMFGIFSVVVFNTLFGLSVSYWMAIVTRFLLGALNGLLGPIKAYAIEVCRSEHEALALSLVSTAWGIGLIIGPALGGYLALPAENFPNIFSPDSFFGRFPYFLPCLCTSVFAAVVLISCIWMPETLHKHKVSENENQSIEALEAHLIDPKEKVEESGSLDTKKSLFKNWPLMSSIIIYCIFSFHDMAYTEVFSLWAESDKKYGGLSLSSEDVGQVLAVTGASLLVYQLLLYPRINKVLGPINSSRIAAILCIPILFAYPYMTYLSQPGLSIILNIASVIKNNISVTIITGTFILQNNAVPQDQRGAANGLSMTGMSFFKAVAPAGAGMVFSWAQKRQHSFFFPGDQMVFFLLNVIELLGLVLTFKPFLAVPEQYNNRN

SEQ ID NO: 3205 - DNA, 946 bp, Panicum virgatum
  misc_feature: Ceres CLONE 1789877
  misc_feature: Encodes the peptide sequence at SEQ ID NO. 3206
atctacaagggactcgtcagctcaagcaggcctgcctcctcgatcttccccttattagttaataatactagcagtaataagcatatactaccaagcctcgccatggcccccaccgtgatggcctcgtcggccacctcagtggctccattccagggcctcaagtccaccgctggcctccccatcacccgccgctcccgaagctccgccggcttcggcaacgtcaccgccggcggaaggatcaggtgcatgcaggtgtggccgacggagaacaacaagaagttcgagacgctgtcgtacctgccgccgctctccacggaggacctcctgaagcaggtcgactacctgatccgcaacaactgggtcccctgcctcgagttcagcaaggtcggcttcgtcttccgcgagaacgccacttcccccgggtactacgacgggcgctactggaccatgtggaagctgcccatgttcggctgcacggacgcgacccaggtgtacgccgagctcgaggagtgcaagaaggcctacccggacaactacatccgcatcctcgggttcgacaacgtcaggcaggtgcagtgcgtcatgttcatcgcctacaagccctcgggcgccgcctaataagcgcagccgccgaccgagactagctcatcagctcctgcatgagcagccatggagtgtgtctgttttgtttctgcttgcttcgatcgggtcaccttgattttctttcttttgattttcatggttgctttctgatgctgtatccatggcatgcatgtcatctatctctctccccccaaccggagagttatgttgggtgaggggcatggtgtcaatgcaagctccggctatatatgatctgtaatatggatactatctagagcaaattatctgccaaaatccgccgacaatatatactagaccgtgtcaaaaaaaaaaaaaaaaaaaa

SEQ ID NO: 3206 - protein, 171 aa, Panicum virgatum
  misc_feature: Ceres CLONE 1789877
  misc_feature (1)..(109): Pfam Name: RuBisCO_small Pfam Description: Ribulose bisphosphate carboxylase, small chain
  misc_feature (1)..(169): SWISSPROT Homolog: EC 4.1.1.39 Ribulose bisphosphate carboxylase small chain A, chloroplast precursor
  misc_feature (1)..(169): SWISSPROT Homolog: EC 4.1.1.39 Ribulose bisphosphate carboxylase small chain, chloroplast precursor
MAPTVMASSATSVAPFQGLKSTAGLPITRRSRSSAGFGNVTAGGRIRCMQVWPTENNKKFETLSYLPPLSTEDLLKQVDYLIRNNWVPCLEFSKVGFVFRENATSPGYYDGRYWTMWKLPMFGCTDATQVYAELEECKKAYPDNYIRILGFDNVRQVQCVMFIAYKPSGAA

SEQ ID NO: 3207 - DNA, 2148 bp, Panicum virgatum
  misc_feature: Ceres CLONE 1789936
  misc_feature: Encodes the peptide sequence at SEQ ID NO. 3208
ttagcggaattgctagctagcttatggtgtactcggatagatcgatgcgtgtgtcttgcacccacagagagagagaggatgatcttggtctgagtgagcgttccccttagcacacagatcctcccattcttgtccgcctttgcaacttcttgatcgcttcattgcatctctagctacttcctgctacaccttctaccttcgtcttcggccaatctatagcttcatgaaaaatctgcagatctgcacagatcaataacactgagctagaatcgggttgtaatcttggtgcggctaattaaggtccttaattcgcagcatagaccttacagtatcaggaaatactgcggcgatggcactgtcagcttctctggttcggcaagaagtgccgccggggaggcagttgaggaaccagcttgctgcagccgcgaggagcatcaactggagttatgctctcttctggtccatctcaagcactcagccaggaatcctgacgtggacggacgggttctacaacggcgaggtgaagacgaggaagatcgccaactcggcggagctgacagccgagcagctcgtcatgcagagaagcgagcagctgcgggagctctacgaggccctcctctccggcgactgcgaccgccgcgcggcgcggccggtggcgtcgctgtcgctggaggacctcggcgacaccgagtggtactacgtcgtctgcatgacctacgccttccgtcctggccaagggttgccgggcaggagcttcgccagcaacgaacacgtctggctgtgcaacgctcaacacgccgacagcaaagccttcccccgcgcgctcctggcgaagggagcgtccattcagacaattgtctgcatcccgcttatgagtggcgttcttgagctgggcacaactgatccggtggtggaggacccagacttggtaagccgagccactgcatctttctgggagatgcagttcccggcatgctcggaggagccgagctccagcccggcagcaaacgaaaccggcaaggccgccgacattattgtgttggaggacctcgaccacaatgccatggaagcgatgatcgccggtgggcaggagctggacgaatcggagagcctgtcaaatgcaactctcgagcacatcaccaaggaaatcgacgaattctacagcctctgcgaggaaatggacgtgcagccactcgaggatagctggatcatggacgggtctttccaagtcccctcttcgccggcttcttcgccgcagccggcggcgggggcttctactaccgatgccgccatctcaagcacgcccgtgggtggctctcgcgtgacgagttttacggcttggacgagatcggcgtcggactccggtgaggtggctgtgctggtcatcgaagagccgcagaagttgctgaagaaagtggtgaccggtggagcttgggcgaacaacggtggcggaggcacgacgacgacgacccaagaaggtggcatcatcaagaaccacgtcatatcggagagaaagcggcgagagaagctcaacgagatgttcctcgttctcaagtcattggttccctccattaacaaggtgaacaaagcatccatccttgccgaaacgatagcctacctgaaggagcttcagcgaagggtacacgagctagaatccagcagggaacccatctcgcgcccatctgaaacaagaaggcttacaaagaggcatgacgatggcatcgccaggaagaaagtctctgcaggatccaagaggaagggttcggagctcggcggtgacatggagagggagcaaccatggggcccctccaaggacggcacgagcaatgtcaccgtcaccgtctcggacaaggacgtgctcctggaggtgcagtgccggtgggaggagctgctcatgacgcgagtgttcgacgccgtcaagagcctccatttggacgttctctcggttcaggcatcggcaccagatggattcatggggctgaagatacgagctcagtttgccagctcagctgccgttgtgccctggatgatcagcgaggccctgcgtaaagctatagggaagtgatgaaggaacatctgaatgtggggtatcaatctacatagaagttctatgaatatgttcgttgcgaaaaaaaaaaaaaaaaaaaa

SEQ ID NO: 3208 - protein, 571 aa, Panicum virgatum
  misc_feature: Ceres CLONE 1789936
  misc_feature (2)..(50): Pfam Name: HLH Pfam Description: Helix-loop-helix DNA-binding domain
  misc_feature: The sequence is a functional homolog of  SEQ ID NO 2036 in the  10/374,780 US patent application
  misc_feature: The sequence is a functional homolog of  SEQ ID NO 898 in the  11/479,226 US patent application
  misc_feature: The sequence is a functional homolog of  SEQ ID NO 953 in the  10/374,780 US patent application
  misc_feature: The sequence is a functional homolog of  SEQ ID NO 955 in the  10/374,780 US patent application
  misc_feature: The sequence is a functional homolog of  SEQ ID NO 957 in the  10/374,780 US patent application
  misc_feature: The sequence is a functional homolog of  SEQ ID NO 960 in the  10/374,780 US patent application
  misc_feature: Useful for making plants with modulated growth and phenotype characteristics
MALSASLVRQEVPPGRQLRNQLAAAARSINWSYALFWSISSTQPGILTWTDGFYNGEVKTRKIANSAELTAEQLVMQRSEQLRELYEALLSGDCDRRAARPVASLSLEDLGDTEWYYVVCMTYAFRPGQGLPGRSFASNEHVWLCNAQHADSKAFPRALLAKGASIQTIVCIPLMSGVLELGTTDPVVEDPDLVSRATASFWEMQFPACSEEPSSSPAANETGKAADIIVLEDLDHNAMEAMIAGGQELDESESLSNATLEHITKEIDEFYSLCEEMDVQPLEDSWIMDGSFQVPSSPASSPQPAAGASTTDAAISSTPVGGSRVTSFTAWTRSASDSGEVAVLVIEEPQKLLKKVVTGGAWANNGGGGTTTTTQEGGIIKNHVISERKRREKLNEMFLVLKSLVPSINKVNKASILAETIAYLKELQRRVHELESSREPISRPSETRRLTKRHDDGIARKKVSAGSKRKGSELGGDMEREQPWGPSKDGTSNVTVTVSDKDVLLEVQCRWEELLMTRVFDAVKSLHLDVLSVQASAPDGFMGLKIRAQFASSAAVVPWMISEALRKAIGK

SEQ ID NO: 3209 - DNA, 2075 bp, Panicum virgatum
  misc_feature: Ceres CLONE 1789943
  misc_feature: Encodes the peptide sequence at SEQ ID NO. 3210
atcatctctctctcctcctccatggccctcatgctccgcccttgggcctttcttctcttccttgcactgctctcctacgatgaatctggtcttcagagcacgaggaatggagttgcacaggccacgcagagggtcttcctgtatccgcagtctcccaaggtctcctctattgtgagcaccaagtacaggactgcctaccacttccagcctcccaagaactggatcaacgatccaaatgggccaatgtactacaatggtatctatcaccaattctaccagtacaatccaaacggttcactctggggtaacatagtttggggccactcggtctcaacagatctcatcaactggatccggcttgagccagcaatagaacaaacaactccgagcgacataaacggttgttggactggttcagccacaatcctcaagggcggtcggcctgttatcatatacactggtgctgacacagagaagcgtcaagtccaaaacattgtgtttccaaagaacgtgtctgatccatacctgaaggaatggatcaaaccagacaacaaccccttgatccaaccggttggtcaaggattgaactcagaccaatttagagatccgacaaccagttggattggaccagatgggctgtggagaatagcaattggggctgagctgaacggctacagtgcagcacttttgtacaagagtgaggattttgtgaactggactagagttgatcacccactgtactcttccaatgcctccaccatgtgggagtgcccagatttctttgcagtattacccggaaagaacagtggattggacttgtctgcagctatcccgaatggtgctaagcatgtcctcaaaatgagcttggataattgtgacaagtacatggttggtgtttatgatctcaaaagcgatacattcgtcccagataccgtacttgatgaccgaagattgtggtcaaggattgactacggcaattactatgcttctaagtcgttcttcgattcgaagaggggcaggaggattatatggggttggaccaatgagacagatagttcgtcagatgatgttgccaaaggttgggcaggaatccatgcgatccccaggactatatggttagatagcaacagtaagcaattgctgcaatggccagttgaagagatcgagtcgcttcgaagagaagaagtcagccaccaaggcttggagctgaatcagggggatctgtttgagattaagggaattgatactttacaggcagatgtggagatagattttgagcttacatccatagatagtgctggtccttttgatccttcctggcttttggacatcgagaagcattgtcgggaagcaggtgcatcggttcatggtgatgtgggcccatttggacttgtggttcttgcgtctgataacatggaagagcacacttctgtatacttcagagtttacaaatcacaagagaagtacatgattcttatgtgctcggatctgagaaaatcatccttgagaccagagctgtacacacctgcctatggaggcttctttgaatttgacctcgagaaggaaaagacaatatctttgagaactttgattgatcgctctgcggtggagagctttggtggcggtggcaagctctgcatcatggccagggtttaccccgtgacggttatcaatggcggcactcggatgtatgcgttcaacaatggaaccagcaccgtcaaagtgcctcagctgaaggcatggagcatgaggagagcacaagtgaatgtgaagatgggataagcatgttactatacatcatttagcaataacaaacccttttgaccatattgggggagtgcatgagttacttcaaggcgtcatgctatcctacttgcaagcttatcctttagctcctggaaagaaaagaagggggacacaatactaaacaccagatgactgacatcagattatgtaattcatttgctagaaggaaaggaaacagagattattgtttagtactagtgattagaagaacaaacaattccatcgttcaagtggaagtattttatagacaaaaaaaaaaaaaaaaaaaa

SEQ ID NO: 3210 - protein, 586 aa, Panicum virgatum
  misc_feature: Ceres CLONE 1789943
  misc_feature (1)..(322): Pfam Name: Glyco_hydro_32N Pfam Description: Glycosyl hydrolases family 32 N terminal
  misc_feature (43)..(586): SWISSPROT Homolog: EC 3.2.1.26 Beta-fructofuranosidase, insoluble isoenzyme 7 precursor
  misc_feature (8)..(586): SWISSPROT Homolog: EC 3.2.1.26 Beta-fructofuranosidase, insoluble isoenzyme 4 precursor
MALMLRPWAFLLFLALLSYDESGLQSTRNGVAQATQRVFLYPQSPKVSSIVSTKYRTAYHFQPPKNWINDPNGPMYYNGIYHQFYQYNPNGSLWGNIVWGHSVSTDLINWIRLEPAIEQTTPSDINGCWTGSATILKGGRPVIIYTGADTEKRQVQNIVFPKNVSDPYLKEWIKPDNNPLIQPVGQGLNSDQFRDPTTSWIGPDGLWRIAIGAELNGYSAALLYKSEDFVNWTRVDHPLYSSNASTMWECPDFFAVLPGKNSGLDLSAAIPNGAKHVLKMSLDNCDKYMVGVYDLKSDTFVPDTVLDDRRLWSRIDYGNYYASKSFFDSKRGRRIIWGWTNETDSSSDDVAKGWAGIHAIPRTIWLDSNSKQLLQWPVEEIESLRREEVSHQGLELNQGDLFEIKGIDTLQADVEIDFELTSIDSAGPFDPSWLLDIEKHCREAGASVHGDVGPFGLVVLASDNMEEHTSVYFRVYKSQEKYMILMCSDLRKSSLRPELYTPAYGGFFEFDLEKEKTISLRTLIDRSAVESFGGGGKLCIMARVYPVTVINGGTRMYAFNNGTSTVKVPQLKAWSMRRAQVNVKMG

SEQ ID NO: 3211 - DNA, 1480 bp, Panicum virgatum
  misc_feature: Ceres CLONE 1789957
  misc_feature: Encodes the peptide sequence at SEQ ID NO. 3212
gtcgaggcgcgtcaaggcaagcagccatgccaccgccgccagagccggagaagccgctgccgcggccgaagccgcccaagcccaaggcggggccggagccgaggccgaagccgccgcggccgctgcctcagcgggacgagacccccggcggcgtcccgcctttcctgccggaccccttcgcctgcgccaataactgctccgattcatgcgccttctaccgcctctgcccgccgccggcccctgccgccaccgtgcacctcaggtcgagccggctgccgacgccgctcatcgcgctctcggcgtccctgctcgccgtctccgcggtgctcctcctcgcgctgctcgtccaccgcctggtgcggcggcggcgggcgcgggaggcggcgctggcccagggcgacgaggagggcggccaggtgctggctggcgcggtggcggagggggcgggcgacggggaggaggaggaggccggcggcgacgaggtgcaccatgtgtggtacatacggaccaaggggctcgacgagcgcgccatcgcggcgatcgccgcggtggtctacgacgccaagaagcgcggcgccggtgcggtcgacggcgacggcagctgcgcggtgtgcctcgccgagttcctggacggcgagacgctgcgcctgctgccgcggtgcgaccacgcgttccaccgcgggtgcatcgacacctggctccgcgcccacgtcaactgcccgctctgccgcgcgcccgtccaggtcgccgccgccgccgccgccgcgcagggcacggccacgccaggcggtgagccggagccagatcttgtagccaccggtgccccacggctggcagaggacgccgaacgcggcggcgtgccggaccgcgccgtcaggcgggccgcgtccatggtggcgctgccgaggcgggcgtggccgccggacgtctcgttccgggcgccggcgtcgaacagcgggcgggagaaggacttcacggggctcggcaagatcatgcggctgctgaagttcgcagactcgctggagatggtccgcctcggggtagggaggtcggcgtcgttcggcgccgggagctgccagcacttgccgacaaggtccgggcactcggccgccggcgtcagctccggtgagatgccacagtgaaccggttggcaccgacgagaagtgatcggattgaagttgcagctttggagctcggaggggtgatgatggtgttggtttgcgaagttttgggtgccacaggggaaggtaaaaatgtcaccttttcctagttcccggtatgatcactagatcagtatgcagtaacaagtaaataaacagagtttgtgcatacactgcggatcgtcggaaattgtacataagaattcctgacaaaaagaggttttgtatgtacgagatcacttgtgtttgttgttgttgaatgtctgaatgatgtgaatgagatgaagacacattctgctcaaaaaaaaaaaaaaaaaaaa

SEQ ID NO: 3212 - protein, 371 aa, Panicum virgatum
  misc_feature: Ceres CLONE 1789957
  misc_feature (1)..(42): Pfam Name: zf-C3HC4 Pfam Description: Zinc finger, C3HC4 type (RING finger)
  misc_feature: The sequence is a functional homolog of  SEQ ID NO 954 in the  10/412,699 US patent application
  misc_feature: Useful for making plants with modulated growth and phenotype characteristics
MPPPPEPEKPLPRPKPPKPKAGPEPRPKPPRPLPQRDETPGGVPPFLPDPFACANNCSDSCAFYRLCPPPAPAATVHLRSSRLPTPLIALSASLLAVSAVLLLALLVHRLVRRRRAREAALAQGDEEGGQVLAGAVAEGAGDGEEEEAGGDEVHHVWYIRTKGLDERAIAAIAAVVYDAKKRGAGAVDGDGSCAVCLAEFLDGETLRLLPRCDHAFHRGCIDTWLRAHVNCPLCRAPVQVAAAAAAAQGTATPGGEPEPDLVATGAPRLAEDAERGGVPDRAVRRAASMVALPRRAWPPDVSFRAPASNSGREKDFTGLGKIMRLLKFADSLEMVRLGVGRSASFGAGSCQHLPTRSGHSAAGVSSGEMPQ

SEQ ID NO: 3213 - DNA, 1676 bp, Panicum virgatum
  misc_feature: Ceres CLONE 1789969
  misc_feature: Encodes the peptide sequence at SEQ ID NO. 3214
acgcagcaattcacttgcaggtttcaatacctgcggcagccggcactagtaagtagcatatgggttcagttacgccggagaaggggcagccgcatgccgtatgcctgccgttcccggcgcagggccatgtcacgccgatgctgcagctggccaagctcctcttcgcaagggggttccacatcaccttcgtcaatacggagttcaaccaccgccgcctgctccgctcgcgcggtcccgacgcgctcgacggcgtgcccgggttctacttcgccaccatcccagacggcctcccgccgtcggacgccgacgcgacgcaggaccccccatcgctctgctactctaccatgaccacatgcctcccacacctcctggccctcctcgccgacctcaacgatccgagctccgggacgccccccgtcacctgccttgtggtcgacggcgtcatgtcgttcggatacgacgccgccagggagatcggcgtgccggtcgcagcgctctggaccgcgagcgcctgcggcttcatgggctaccgcaactatcgctggctcgtcgaccggggtctcgtgccgttccgggacgaggcggacctcgcggacgtcgccggcgggcacctcgccaccgtggtggccggcgcgcgcggcatgtgcgacggcgtgcagctgcgcgacttccccagcttcatccgcaccacggaccgcggcgacatcatgctcaacttcatcatccacgaggccgggcggctgtccctaccggacgtcgtcatggtcaacacctttaacgacctcgaggccacgacgctcgacgccatgcgcgccatcctcccgccggtgcacgccgtcggcccgctgctcctccacgagcgccacgtcatcccggcagacagccccctggccggcctcggctctaacctttggaaggagcaggccggcctcatggagtggctcgccggccgcgcgccgcggtccgtggtgtacgtgaactacggaagcatcaccgtgatgacgagcacgcagctgctggagttcgcgtgggggctggccaaaagcggatactcgttcgtgtggaacatccggccagacctggtgatcggcgactccaccgtgctgccgccggagtttgcggccgccgtcgagggccgcgcgatgttgacgtcgtggtgcccgcaggaggcggtgctgcagcacgaggcggtaggggttttcctgacgcactccgggtggaactccacgctggagagcctctgcgcgggggtgcccatgctgagctggccgttcttcgcggagcagcagaccaactgccggtacaagcgcaccgagtggggcgtcgggatggagatcggcggcgaggtgcggcgcgacgagctggcggacatcttacgggaggccatggacggggagaaggggctggagatgcgccggcgcgcggtggagtggaagcagaaggccgtgaaggcgacgctgccaggtgggtccgcagaggccaacctgaacaaggttatcaatgaggtgctgctcgccaagaaggctgaagcagtcagtgcttgattctcatgatcagatctttgtcgaggagtataacattatgtgctatttgcacaattaattggttatctaatatgtgagcaactatatccattttcaaggaataatttcatataaaaaaaaaaaaaaaaaaaa

SEQ ID NO: 3214 - protein, 494 aa, Panicum virgatum
  misc_feature: Ceres CLONE 1789969
  misc_feature (1)..(121): Pfam Name: UDPGT Pfam Description: UDP-glucoronosyl and UDP-glucosyl transferase
MGSVTPEKGQPHAVCLPFPAQGHVTPMLQLAKLLFARGFHITFVNTEFNHRRLLRSRGPDALDGVPGFYFATIPDGLPPSDADATQDPPSLCYSTMTTCLPHLLALLADLNDPSSGTPPVTCLVVDGVMSFGYDAAREIGVPVAALWTASACGFMGYRNYRWLVDRGLVPFRDEADLADVAGGHLATVVAGARGMCDGVQLRDFPSFIRTTDRGDIMLNFIIHEAGRLSLPDVVMVNTFNDLEATTLDAMRAILPPVHAVGPLLLHERHVIPADSPLAGLGSNLWKEQAGLMEWLAGRAPRSVVYVNYGSITVMTSTQLLEFAWGLAKSGYSFVWNIRPDLVIGDSTVLPPEFAAAVEGRAMLTSWCPQEAVLQHEAVGVFLTHSGWNSTLESLCAGVPMLSWPFFAEQQTNCRYKRTEWGVGMEIGGEVRRDELADILREAMDGEKGLEMRRRAVEWKQKAVKATLPGGSAEANLNKVINEVLLAKKAEAVSA

SEQ ID NO: 3215 - DNA, 2359 bp, Panicum virgatum
  misc_feature: Ceres CLONE 1789981
  misc_feature: Encodes the peptide sequence at SEQ ID NO. 3216
aaagctatagtttgcatagttgaagtggatgggttccatggaagggctttctcgtacggtcatccacttcttgctccttttctgcatagtctgtaaatgtctggcatcagatttggaggcaacccagaaggcaaccctcaagattgatgcctcaccaaagcttgctcgaaaaatccctgatacactactcggagtattttttaaggagatgggccgtggtggagctggtggactatgggctgaacttgttagtaacagaggtttcgaagcaggaggccccaatactccgtcaaacattgacccatggctcattattggaaatgaatcttccatttttgtggagactgatcgtacatcatgtttcagtcgaaacattgttgctttaaggatggaggtcatctgcaataactgtccagctggtggtgttggcatttacaacccaggtttctggggcatgaacatagaagatggaaagacatacaatctagttatgtatgtgaagtcagctgaaaccgcacccttgacagtttcactaacaagctctgatgggtcgcaaaatctggcttcagtcgcgataatggttgctggcaaatcgaaatggataaaggtagagcaaaagatggttgctaaaggaaccaatagaacctcaaggcttcaaataacgtctaagaagaaaggagttgtgtggtttgaccaagtatcactcatgcctgcagacacatacaagggacatggtttccgcgacgaacttgtatccatgcttttggatttaaaaccacagttcttaagatttcctggaggttgctttgtacaaggtggctggctaagaaacgcattcaggtggagagagtctattggtccttgggaagagaggcccggacacttcggagattgttggaattattggactgatgatggccttggatattttgaatttctacagctttctgaggacctgggtgctgccccaatctgggtattcaacagcggattgagctacaatgatgaagttgatacagctgctattgccccttttgtaaaggatgtactggacagcctagaatttgcaagggggagtgcaaattcatcatggggctctgttagagctgcaatgggacaccctgaaccgttccctgtcaagtatgctgcaattggaaatgaagactgtgggaagaagttttacaatggtaattacctcaagttttacaatgctataagagaggcatatccagacattcaactgatttcaaattgtgatggctcatctggaccacttgatcatccggctgatttatatgatttccatgtctatgctgatgcaaagactctgttttccatgaagaacacatttgacaagacatcgcgttccggacccaaggcttttgtcagcgagtatgcagtttggaaaactgatgcaggtcgaggaactcttcttgcttcactggcagaagctgccttccttactgggctggagaagaatagtgatgttgttgagatggcttgccatgctccactattcgtaaatgacgatattgagaaaaagtggaacccagacgttattgtcttcaatacttggcaacattatgggactcctagttactggatgcaggtgcttttccgtgagtctagcggtgctattgttcatccaacaacgatcagttccagcagctctggtaatagttctctagcagcatctgcaattacatggcaggattcagacaatagctcattcctaagagtaaagatcataaactttgaatctgttgctgttcaaatcacaatctccacgactggacttcaggctagcattgacgtgttgcgatcgactgccactgttctcacatctagcaatgtgatggatgaaaattcttttagtaaccaagacaaggtctcgccagtcaagagccagctttttgatgcaggagcgcatatgcaagtcacactagctcctcactcattcacatcctttgatcttgcgctggctccgtctaaacttgtcacgttggcaggaagagtcaacaaatacttgatatctgaactgtgagacacccaagtgccagtaattaaggacttgccagtacggtgtaaggcaatgtgttatgcaacaccgaggagaaattaaataaaaatgtcactggaatttatatttttttatttccttgaggatgccattcaaaagtttctttagttagtgtctgatttagcacgaatattcacatctatagtcaattattgtttaaattggtaggtgatacgtccttggacattgaggcatctgtggtaatttatgttttgcgaccaaaaaaaagaatttatagttttgtggtgattttttggcgaaaaaaaaaaaaaaaaaaaa

SEQ ID NO: 3216 - protein, 671 aa, Panicum virgatum
  misc_feature: Ceres CLONE 1789981
  misc_feature (1)..(186): Pfam Name: Alpha-L-AF_C Pfam Description: Alpha-L-arabinofuranosidase C-terminus
MGSMEGLSRTVIHFLLLFCIVCKCLASDLEATQKATLKIDASPKLARKIPDTLLGVFFKEMGRGGAGGLWAELVSNRGFEAGGPNTPSNIDPWLIIGNESSIFVETDRTSCFSRNIVALRMEVICNNCPAGGVGIYNPGFWGMNIEDGKTYNLVMYVKSAETAPLTVSLTSSDGSQNLASVAIMVAGKSKWIKVEQKMVAKGTNRTSRLQITSKKKGVVWFDQVSLMPADTYKGHGFRDELVSMLLDLKPQFLRFPGGCFVQGGWLRNAFRWRESIGPWEERPGHFGDCWNYWTDDGLGYFEFLQLSEDLGAAPIWVFNSGLSYNDEVDTAAIAPFVKDVLDSLEFARGSANSSWGSVRAAMGHPEPFPVKYAAIGNEDCGKKFYNGNYLKFYNAIREAYPDIQLISNCDGSSGPLDHPADLYDFHVYADAKTLFSMKNTFDKTSRSGPKAFVSEYAVWKTDAGRGTLLASLAEAAFLTGLEKNSDVVEMACHAPLFVNDDIEKKWNPDVIVFNTWQHYGTPSYWMQVLFRESSGAIVHPTTISSSSSGNSSLAASAITWQDSDNSSFLRVKIINFESVAVQITISTTGLQASIDVLRSTATVLTSSNVMDENSFSNQDKVSPVKSQLFDAGAHMQVTLAPHSFTSFDLALAPSKLVTLAGRVNKYLISEL

SEQ ID NO: 3217 - DNA, 1621 bp, Panicum virgatum
  misc_feature: Ceres CLONE 1789995
  misc_feature: Encodes the peptide sequence at SEQ ID NO. 3218
ccccgaagtgccatcctatcaggagatgttgtgatagacactaaaagcaagccactcctggttcctcttggagactggttgctgaagaacaaggagaggactcatggagtctatacctcttcttagtccttgtgaaactggaaggttcaggtttttgcacagaattgtgctggcacctttaacaagaaacagatcatatggcaatcttccacaatcacatgccatactgtactactcacagagggctacaaggggaggtcttctgattgctgaagccacaggggtgtcatctgatgctcaagggatgagtttatgtccgcacaccccagggatatggaccaaggaacaagttgaggcctggaagcctgttgtgaatgcggtgcatgctaagggtagaatattcttctgccagatttggcatgtaggaagagcatctgatatagagaaagagcccatctcaagcacagataagccagtggaaaagaatgaagatgaccacatggacttccccattccaagatgcttagctgtagaggagatccctgatgttatcaatcacttcagagttgctgcaagaaatgctatggatgctggttttgatggagttgaaatccatggtgcccatggcttcctccttgagcaatttatgaaagatagtgttaatggtcgtactgacaagtatggaggaagcctgcagaaccgctgtcgatttgcccttgaggtagttgaggccgtggtggctgaggtcgggtctgaccgtgtagggatccgcatctctccttatgccaactaccttggctgccatgactcgaacccagatgcattgggtgtctacatggctcaggaactgaacaagcacagcatcctgtactgcagtgcagtggaacctgagatggtcatggtggatggcaagatgcaaattccacataggctgcacgaaatgaggaaggccttcaatggaatgtttatggttggtggagggtacgacagggaggaggggaacaaagttgtggctgatggatatgctgacatggttgtatatggtcgcttgttcttggcaaatcctgacctgccgaggcgattcaatctggatgctcctctgaataagtacgaccgatcaacattctataccaatgatcctgttgtcggctacacagattacccgtttcttgaggactgtgagccagtgagctccacatgtggggagaatgacattaagcagaagagaggcaactaacaaaaagctgaattgcctttatgtaacttttgcccctggaatcagagcaggcttgatacatcaatggaaagcaacagttggatgattctcatttcgtgaggttgtttcacatttgtggcttgaatgaagaacttttacagatttgaacaaattaaggtatttcaacatatgaattgctgatttggtcacatctgtattgaatggtaatatattgcagaaggtgcacacggttctgtgtattattgcactttgtcgggtcctgaaacttgaaaaatctcatattacatcaaaccaaaagaacacattgagttggcgtacttttggattttaagtgatgcgaaattaaactctgtacatcacacttaaaaaaaaaaaaaaaaaaaa

SEQ ID NO: 3218 - protein, 377 aa, Panicum virgatum
  misc_feature: Ceres CLONE 1789995
  misc_feature (1)..(336): Pfam Name: Oxidored_FMN Pfam Description: NADH:flavin oxidoreductase / NADH oxidase family
  misc_feature (2)..(357): SWISSPROT Homolog: EC 1.3.1.42 12-oxophytodienoate reductase 1
  misc_feature (2)..(357): SWISSPROT Homolog: EC 1.3.1.42 12-oxophytodienoate reductase 2
MESIPLLSPCETGRFRFLHRIVLAPLTRNRSYGNLPQSHAILYYSQRATRGGLLIAEATGVSSDAQGMSLCPHTPGIWTKEQVEAWKPVVNAVHAKGRIFFCQIWHVGRASDIEKEPISSTDKPVEKNEDDHMDFPIPRCLAVEEIPDVINHFRVAARNAMDAGFDGVEIHGAHGFLLEQFMKDSVNGRTDKYGGSLQNRCRFALEVVEAVVAEVGSDRVGIRISPYANYLGCHDSNPDALGVYMAQELNKHSILYCSAVEPEMVMVDGKMQIPHRLHEMRKAFNGMFMVGGGYDREEGNKVVADGYADMVVYGRLFLANPDLPRRFNLDAPLNKYDRSTFYTNDPVVGYTDYPFLEDCEPVSSTCGENDIKQKRGN

SEQ ID NO: 3219 - DNA, 1616 bp, Panicum virgatum
  misc_feature: Ceres CLONE 1789998
  misc_feature: Encodes the peptide sequence at SEQ ID NO. 3220
gctttccttcctcctccctcgcggccaacaaaccaatccctcctcccctcccttcctcccttcttcctccctgccattctcccgttccgttgcggcgtctcttccctccccaccccccgcctccaccgccgcctccgtgcctagcacccgctcgaatttccgcatccgctgccgcgcccgatcgccgaggacgaggatgctgggcgccgcgaggaggcagcttggatccggtcccatgctggtgcaggtcctgcggcggctccgcccggcggcggcgaccgaggcggcgagggggtactccgccgcggcgaaggagatgactgtccgtgatgcattgaactctgcactggatgaagagatgtctgctgatccttctgtcttcctgatgggagaagaggttggagagtatcaaggtgcatacaagatttctaaaggcttgcttgacaagtatggtcctgatagggttcttgacacgcctatcacagaggctggctttactggcattggtgttggtgcagcttatcaaggtcttcggcctattgtagaatttatgacatttaatttcgcgatgcaggctattgatcatatcatcaattcagctgccaagtcaaactacatgtcagctggtcaaatctctgttcctattgtttttagaggacctaatggagctgctgctggagttggggcacaacactcacagtgttatgcagcttggtatgctcatgttccaggacttaaggttctgacaccatactctgcagaagatgctagaggcttgctaaaagccgctattagggatcctgaccctgttattttcctggaaaatgaattgctttatggagaatcattccctgtttctgctgaagtgcttgattctagtttctgcctgccaataggcaaagctaaggtagaacgtgagggtaaagatgttaccattaccacatactccaagatggttggttatgctctccaggctgcagagatactgtccaaggaaggaatcagtgctgaggtgatcaaccttcgatcaatcagaccacttgacagagctgctatcaatgcatctgtcaggaagaccaacagattggtgactgttgaagaagggttcccccagcatgggattggtgctgagatatgcatgtctgtcgtagaagaaagctttgagtaccttgatgcaccagttgagaggatcgctggagctgatgtacctatgccctatgctgctaaccttgagagaatggctgttccacaggtagatgacattgtgcgggcagcaaagcgggcctgctacagggcagtgccaatggcagcaacggcctgaacctgatcagtggacaagcctttttgtttcccttggctttcaccttctagccagaaacatgtagtattcatagtatttcataaggtggtggcaaattgcccagaccccagagactccaagcgagctaattttgtagatctgccatggcgtgctttattccgttagtcgcagatggatggatgattgcattctttctggttccaaacccccttttctatgatttgtatacaacctaatcatgttggcatgcaaacggatcactttgttgtgacgctcaaaaaaaaaaaaaaaaaaa

SEQ ID NO: 3220 - protein, 374 aa, Panicum virgatum
  misc_feature: Ceres CLONE 1789998
  misc_feature (1)..(179): Pfam Name: Transket_pyr Pfam Description: Transketolase, pyrimidine binding domain
  misc_feature (1)..(367): SWISSPROT Homolog: EC 1.2.4.1 Pyruvate dehydrogenase E1 component subunit beta, mitochondrial precursor
  misc_feature (20)..(374): SWISSPROT Homolog: EC 1.2.4.1 Pyruvate dehydrogenase E1 component subunit beta, mitochondrial precursor
MLGAARRQLGSGPMLVQVLRRLRPAAATEAARGYSAAAKEMTVRDALNSALDEEMSADPSVFLMGEEVGEYQGAYKISKGLLDKYGPDRVLDTPITEAGFTGIGVGAAYQGLRPIVEFMTFNFAMQAIDHIINSAAKSNYMSAGQISVPIVFRGPNGAAAGVGAQHSQCYAAWYAHVPGLKVLTPYSAEDARGLLKAAIRDPDPVIFLENELLYGESFPVSAEVLDSSFCLPIGKAKVEREGKDVTITTYSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAATA

SEQ ID NO: 3221 - DNA, 2244 bp, Panicum virgatum
  misc_feature: Ceres CLONE 1790002
  misc_feature: Encodes the peptide sequence at SEQ ID NO. 3222
cttgttggccaccaccaccacctcccccaccgcgctcgcgtcgcctcgaaggaatccgcggctccagccctagctcctctcccccctccctttcgctccctcccggcggccgccatggcggagatcgaggtggtgtccgacggcgcgaggcgggatggggggcaggaggagaagggacggcggaggcagggcggggctgcggcggcggcggagcccgaccccgtggtggacgtgtactcggcggccgcgtacggggacctcgagcggctgcggggcttcgtagagcgcgggggcgccgccgccgcgctccgggagcccgacgccaacggctaccacgcgctccagtgggccgcgctcaacaactacccccacgtcgcgctctacctcatcgagcacggggccgacgtgaacgcgacggaccacgcgcagcagacggcgttgcactgggcggcggtgcgcgggtccacgtccgtggccgacgtgctcgtggagcacggcgcgagggtcgaggccgccgacgtcaacggctaccgggcagtccatgttgcagctcagtatggccagacggcattcttgtatcacattatctcaaagtatggtgcagattttgatgcttcggacaatgatgggaggagcgcattgcactgggctgcctacaaggggaatgcagatacaatcagattacttctgtttatggatgctaatcaagtaaggcaagacaaaaacggttgtacccctttacactgggctgctataagaggaaatttggaggtttgcacggttcttgtacatgctggtacaaaggaagaactcacactaaaggatattggtgggctaactcctgttcaactcgcagcagaaaaaggtcatcggcatctttccaatatcctttctaatgctacaaaagtaagctttgaagacaagtacttccctgggagatcgaggaaaattggatatgcccctttcttgtttgcttatcttgtcatctgcctcatccttttcctgaactcgattgtatttgcacctcatttttctaggatcactgctactgctggtctttggtcttgggctgctgtgtcacttttctttgtttcacaagtacagttctacagagttagcagaaaaaatcctggctatatcaaggtaaataccaagcgacttgatccgaaggaaccacttatggggattgatcttctcaattcctctacttggacaggcaattggtctcagctatgccctacttgtaagataattcgccctatgaggtccaaacattgtccaacatgtaagcattgtgtcgagcagtttgatcatcactgcccgtggatatcaaactgtgttggaaagcgaaataagtgggacttttttgtgttcctttgtatggggatagctacatcctttctgggtgctgccgttggattccacagactttggacagagcccattatactctcatcttcagaatcgtggacacacttcatgctgacaaatcatcctggtgctgtattattcatgtttctggatgtctttttattaacaggagctcttattctgaccggagcacaagtagtacagatagcatggaacatcacaactaatgagcaagcaaacaagtcccgctactcatatcttcgagggcctgatgggcgcttcagaaatccatacagtcggggttgccagaggaactgcactgattttcttgtccatggatacaccaacgatgaggagattgcatggccaacccttcaacaaacagtacagataatctagagctactgatcttggaaactaagttcaagttatacaccacatgttatatgccaaagaacagcctgaaaaaaaaagcttatgctttcatcttagtgcacagaatattccagattgttcagacatggattgacaataggtgtgaatagggatcaacttgggtcgcaccccttcatacaggtttttagacaatgctgtcgatcatagaattgtttgattctgtagattatttgcaagcgggcgtgtgcagtatgttttctttttggtggtcaccacttgctagcaggggccatttgtcttcggaggaatgactcagtgagtgcctatagatgtccatgcggcttttctgaatctttgtagtgatttgacatggtagatgtctcatacgtaccatattgttgtcgcgaagtacagtggacagtaagtaacatgcagttgttccatattattttattttaaaaaaaaaaaaaaaaaaaa

SEQ ID NO: 3222 - protein, 551 aa, Panicum virgatum
  misc_feature: Ceres CLONE 1790002
  misc_feature (1)..(66): Pfam Name: zf-DHHC Pfam Description: DHHC zinc finger domain
MAEIEVVSDGARRDGGQEEKGRRRQGGAAAAAEPDPVVDVYSAAAYGDLERLRGFVERGGAAAALREPDANGYHALQWAALNNYPHVALYLIEHGADVNATDHAQQTALHWAAVRGSTSVADVLVEHGARVEAADVNGYRAVHVAAQYGQTAFLYHIISKYGADFDASDNDGRSALHWAAYKGNADTIRLLLFMDANQVRQDKNGCTPLHWAAIRGNLEVCTVLVHAGTKEELTLKDIGGLTPVQLAAEKGHRHLSNILSNATKVSFEDKYFPGRSRKIGYAPFLFAYLVICLILFLNSIVFAPHFSRITATAGLWSWAAVSLFFVSQVQFYRVSRKNPGYIKVNTKRLDPKEPLMGIDLLNSSTWTGNWSQLCPTCKIIRPMRSKHCPTCKHCVEQFDHHCPWISNCVGKRNKWDFFVFLCMGIATSFLGAAVGFHRLWTEPIILSSSESWTHFMLTNHPGAVLFMFLDVFLLTGALILTGAQVVQIAWNITTNEQANKSRYSYLRGPDGRFRNPYSRGCQRNCTDFLVHGYTNDEEIAWPTLQQTVQII

SEQ ID NO: 3223 - DNA, 1665 bp, Panicum virgatum
  misc_feature: Ceres CLONE 1790009
  misc_feature: Encodes the peptide sequence at SEQ ID NO. 3224
ccccttctcctcaacccggacctcccctcaacccagcagcagccgccccgcaacgcgcggcgccatggccgccgccccccaccaccaccgcggccacctcgtcctcgccgtcctctcccttgccgcggcattcgccgccgccgtcgactcctcctcccacaacatcacggcggtcctcgacggccggtcggagtacacgctgtacaacagctacctctccgagaccaaggtgtgcgacgagatcaacagcgagcacacggtcaccgtcctcgtcctcaccaacggcgccatgtcctcgctcgtcgccaacctctccctcgccgaaatcaagaacgcgctccgcatgctcaccctcctcgactacttcgacgagaagaagctgcactccctcgactccggctccgagctcaccacctcgctctaccagaagaccggccaggccgccggcaacatgggccacgtcaacatcaccgacctccgcggtggcaaggtcggcttcgcctccgccgcgcccggcgccaagttccagtccacctacaccaagcgcgtcgacacggagccgtccaccctctccgtcctcgaggtctccgaccccatcaccttcccgggcctcttcggctccccgtcagcctcctccgtcaacctcacggacatcctcgacaaggccggctgcaagcagttcgcgcgcctcatcgtgtcgtccggggtcgtcaagatgtaccaggccgccatggacaaggcgctcacgctgctcgcgcccaacgacgacgccttcaaggccaagggcctgcccgatctgagcaagctctccagcgccgacctcgtcacgctgctgcagtaccacgcgctgccgcagtacgcgcccaaggcgtcgctcaaggtcgccaagggcgacatcccgaccctggcctctaccggcgcggggaaatacggcctctccgtcgtctccagcggcgacgacgtgtcgctggacaccggcttgggcaagtcccgcgtcgcgtctaccgtgctggacgacaccccgacggtcatcctcacggtggacaaattgctgctcccgtccgagctattcggcggcgcaccgtcccccgcgccggcgcccggaccggccgccgacgtgcccgcttcggccccggctcccgaaacatctgcgcccgcgccctctcccaaggccgccgccaagaagaagaaggccaagtccccttcgcattccccgcccgcgcccccggcggactcgcccgacctggcccccgccgacgcgccggagggtgacgccgaggataaggccgactcgaagaagaacggcgccgccgcagcggccgtgagcttggcggctacggtggcctgcatcgccctggccgtcgcggccttcttgtgagcgggcgagcggcaggtgttcgacgccgagcccggcgtagttgatctctctctgagcgcgtgctctgacgcaatgcaatctgttgttgctcgtgagttctcgtgggctccattgataatttgatatgctcatcaggtgtttctccttgttcctggtttgctggttggtaggtagttgaagtaagaattattaggatttgggtcgtccacttctcaggtggagacgaagagctcggaactgtcatttgagggtgatttgttcttcctgaaaaaaaaaaaaaaaaaaaa

SEQ ID NO: 3224 - protein, 437 aa, Panicum virgatum
  misc_feature: Ceres CLONE 1790009
  misc_feature: Great-hit functional homolog of the protein sequence encoded by LOCUS At2g45470
  misc_feature: Great-hit functional homolog of the protein sequence encoded by LOCUS At3g60900
  misc_feature: Useful for making plants with altered cell wall content and/or composition
MAAAPHHHRGHLVLAVLSLAAAFAAAVDSSSHNITAVLDGRSEYTLYNSYLSETKVCDEINSEHTVTVLVLTNGAMSSLVANLSLAEIKNALRMLTLLDYFDEKKLHSLDSGSELTTSLYQKTGQAAGNMGHVNITDLRGGKVGFASAAPGAKFQSTYTKRVDTEPSTLSVLEVSDPITFPGLFGSPSASSVNLTDILDKAGCKQFARLIVSSGVVKMYQAAMDKALTLLAPNDDAFKAKGLPDLSKLSSADLVTLLQYHALPQYAPKASLKVAKGDIPTLASTGAGKYGLSVVSSGDDVSLDTGLGKSRVASTVLDDTPTVILTVDKLLLPSELFGGAPSPAPAPGPAADVPASAPAPETSAPAPSPKAAAKKKKAKSPSHSPPAPPADSPDLAPADAPEGDAEDKADSKKNGAAAAAVSLAATVACIALAVAAFL

SEQ ID NO: 3225 - DNA, 1472 bp, Panicum virgatum
  misc_feature: Ceres CLONE 1790019
  misc_feature: Encodes the peptide sequence at SEQ ID NO. 3226
atcatccgctccatcgcgtggccgttcgattcgttgagttcccttcccgagcacaaacaagctcctccgcccgcaccccgccgccgccgtctctccaaaacccaagcaaaccctagatccgccgcctccgtttcccgacccaagctccggcgagacccacacccctccgccagcgaagatgccgaacctcgagtgccggatgtacgagccgcggttccccgaggtggacgcggccgtgatgattcaggtgaagcacatcgccgacatgggcgcgtacgtctccctgctcgagtacaacaacatcgagggcatgatcctcttctccgagctctcccgtcgccgcatccgctccatctcctccctcatcaaggtcggccgacaggagcccgccatcgtgctccgtgtcgaccgcgacaaggggtacatcgacctctccaagcgccgtgtctcagaggaggaggcgcaggcctgcgaggacaggtacaacaagtccaagctcgtgcactccatcatgcgccacgttgcagagacgctcgagatcgacctcgagccgctctaccagcgcataggctggccgctctaccgcaagtacggccacgccatcgaggccttcaagctcatcgtcactgaccccgactccatcctcgacgctctgacctacgaggagaaggagaccggcccagatggccaggaggtgactaaggtggtgcctgctgtcactcctgaggttaaggattctctggtgaagaacataaagaggaggatgacaccacagccactcaagatccgtgctgatgtggagatgaaatgcttccagtttgatggagtgcttcacattaagcaagccatgaagaaagctgaagcctctggtaacgatacctgtcctgtgaagattaagctagttgctcctccactttatgttctgaccacacagactcttgataaggagcaaggcatttcagttctcactgatgcaatcaaggcttgtacagcggagattgaaaaatacaagggaaagttggtggtgaaggaaccaccaagagctgtgagcgagcgggaagaaaagcaactcctcgaccagtttaattccttggtggcgcaaaatgaagaggttgatggtgatgatgacagtgaagaggaggaagacacaggaatgggtgacgtcgaccttacaaataccggagtcacagcttattaaggcccctctggaccctggttggtttggatgagatttgctgtatagcaccagctaagacctgaaacgtcctgtttggaagcagtttctttttgtttaggtttttggtggctgaaccccagtgaattcacttaaacttgttacctgccgtgttcatgtttttttgggttcagctggtgtcgggaaaacttttacttggctcgagcagcacataattaccattgggagtgaaacaaggttcgttagttgccgcacccaaaaaaaaaaaaaaaaaaaa

SEQ ID NO: 3226 - protein, 339 aa, Panicum virgatum
  misc_feature: Ceres CLONE 1790019
  misc_feature (1)..(76): Pfam Name: S1 Pfam Description: S1 RNA binding domain
MPNLECRMYEPRFPEVDAAVMIQVKHIADMGAYVSLLEYNNIEGMILFSELSRRRIRSISSLIKVGRQEPAIVLRVDRDKGYIDLSKRRVSEEEAQACEDRYNKSKLVHSIMRHVAETLEIDLEPLYQRIGWPLYRKYGHAIEAFKLIVTDPDSILDALTYEEKETGPDGQEVTKVVPAVTPEVKDSLVKNIKRRMTPQPLKIRADVEMKCFQFDGVLHIKQAMKKAEASGNDTCPVKIKLVAPPLYVLTTQTLDKEQGISVLTDAIKACTAEIEKYKGKLVVKEPPRAVSEREEKQLLDQFNSLVAQNEEVDGDDDSEEEEDTGMGDVDLTNTGVTAY

SEQ ID NO: 3227 - DNA, 1618 bp, Panicum virgatum
  misc_feature: Ceres CLONE 1790033
  misc_feature: Encodes the peptide sequence at SEQ ID NO. 3228
agcgcgacggccatacgaatgtacaacgatttccctttccagtccccacagtgcgcacacaaactgagtgaccactgacgagccgcatctagcagaaagacttgctcagctcggcctagctagtcccatggctccggcgagtcctctgctcgtcctcgtcttcctcgccgccgtaactgccccgctctcggctggtgcgggggcagcactggtgttccccgatgaagcgctcccgacgaagtcgggctacctccccatcccgcccgccaacgcctcgctcttcttcgccttctacgaggccacccacccgctcacgccgccggcctccacgcctctcctcctctggctgcagggcgggcccggctgctccggcctcatcggcaacttcttcgagctcggcccctacttcgtcaaccccgacagcgtctccctctcgcccaaccccttcgcgtggaaccgccgcttcggactcctcttcatcgacagcccgctcggcaccggcttcagcgccgcgccgtcccccgccgacatccccaccaaccagtccgtcgtcgccgcgcacatcctcgccgcgctgcagtcattcctcgccctgtaccccggcttccgcgcgcggccgttcttcctcaccggcaagagctacgccggcaagtacgtccccgcggcgggggcgcacatcctggacgtgaaccccacgctgccggaggcgctgcgcgtcaacctccgcggcgtggccatcggcaacgggctcacgcaccccgtcgcgcaggtggccacgcacgcggacacggcctacttctcgggcctcatcaacgcgcggcagaagcgggagctggaggcgctgcaggcggaggcggtggcgctgacgcgcgcggagcggtggcgcgaggcggcggacgcgcggggccgggtgctgctgcggctgcagaacatgaccggcctggccacgctgtacgacgcggcgaagcagcggccgtaccggacggaccccgtgggcgcgttcctgaaccgggcggaggccaaggctgcgctgggcgcgcgcgggggcgcggcgtgggaggagtgcagcgacgcggtgggcgcggcgatgcacgcggacgtgatgaggagcgtggtgccgcaggtggagtcgctgctgcggcgcacgcgcgtgctgctgtaccagggcgtccgcgacctcagggacggcgtcgtgtccacggaggcgtggctcggcgaggtgcgctgggacgggctggccgccttcctcgacgccgaccgcgccgtgtggcggacgcggggcgacggtgagctcgcggggacggcagggtatgtgcaacgctccggcgcgctctcgcacgtggtggtgtatggggcagggcaccttgtgccggcggacaacgggcgcgcggcgcaggagatgatcgaggactgggtgctgggcacggggctgttcgggcgccgcggaggcaacggcaggaggcgcgcagcctgatgctgcccggcgcgcgctggtgatgcacgtacgaacgtggagtatggacgattgcgtggggcgcaaaatggagtagtgtagtacaataagaagaattttgatgggttctatcctgaccgaccattctaatcacgagcagtatgt

SEQ ID NO: 3228 - protein, 448 aa, Panicum virgatum
  misc_feature: Ceres CLONE 1790033
  misc_feature (1)..(406): Pfam Name: Peptidase_S10 Pfam Description: Serine carboxypeptidase
MAPASPLLVLVFLAAVTAPLSAGAGAALVFPDEALPTKSGYLPIPPANASLFFAFYEATHPLTPPASTPLLLWLQGGPGCSGLIGNFFELGPYFVNPDSVSLSPNPFAWNRRFGLLFIDSPLGTGFSAAPSPADIPTNQSVVAAHILAALQSFLALYPGFRARPFFLTGKSYAGKYVPAAGAHILDVNPTLPEALRVNLRGVAIGNGLTHPVAQVATHADTAYFSGLINARQKRELEALQAEAVALTRAERWREAADARGRVLLRLQNMTGLATLYDAAKQRPYRTDPVGAFLNRAEAKAALGARGGAAWEECSDAVGAAMHADVMRSVVPQVESLLRRTRVLLYQGVRDLRDGVVSTEAWLGEVRWDGLAAFLDADRAVWRTRGDGELAGTAGYVQRSGALSHVVVYGAGHLVPADNGRAAQEMIEDWVLGTGLFGRRGGNGRRRAA

SEQ ID NO: 3229 - DNA, 1948 bp, Panicum virgatum
  misc_feature: Ceres CLONE 1790044
  misc_feature: Encodes the peptide sequence at SEQ ID NO. 3230
ctttttcccgttccgtcacggcttggccttgctcgtcgccaaaccgattgccaacgcagcggcagcgccgccggtgacgagaccgccggggacgttccctccacccgccgctccggagtgcgctgtcgccgccgccgctctccgtcgtacggtgcggagatccatccgcccgcccattcattcatccggctctaattggtctcctcaggctgagtcatcaacgttatcctaaatcaatgaagggctggggtttgctgttgttatctctacatgttatatcatgcctagttagtggtgtcgcctctggtcgcacaagctcttacgtgcgtacagagttcccgtctacggatataccactagaaagtgaatggtttgcaattccaaagggatacaatgctccgcagcaggttcatataactcaaggtgactatgatggaaaggcagttatcgtatcttgggttactccagaagaacctgggccaagtgaagtgttttatggcaagaaggagaagcaatacgaccagaaatcagaaggcacaacaacaaattatacgttttacgactacaaatctggatacatacaccactgtcttgttgatggccttgagtataacactaaatattattataagattggaagcggagattcagctcgagaattttggtttgaaacacctccagcaattgatccagatgcatcatacacatttggcatcataggtgatctggggcaaacgtttaattctctctcaactcttcaacattatgagaaaacaggagggcaaactgttctatttgttggggacttgtcatatgctgatagatataaacatgatgatggcattcgttgggattcttggggtcgacttgttgaacgcagtactgcataccagccatggatttggaatgctggaaaccatgaaatagaatacaggcctgatctgggagaaacttctacattcaagccatatctgcatagatatatgactccatatttggcatcaaagagcagttctcctatgtggtatgctgtcaggcgtgcatctgctcatatcatcgtgttgtctagctactcaccatttgtaaaatacactcctcaatggtggtggctgaaaaatgaattcaagcgtgtggacagggagaagacaccttggcttatagttctcatgcattctcccatgtacaacagcaatgaggcacattatatggagggtgagagtatgagggctgcttttgagaaatggtttgtgaagtacaaggtcgacttggtatttgcaggtcatgttcatgcttatgagagatcataccgcatttcgaatgtcaactacaacataacatcggggaatcgatatccagtgccagacaaatctgctcctgtttacataactgttggtgatggaggcaaccaggaaggacttgcttcaaggtttaatgacccccagccggactactctgcattcagggaggccagttacggccattcaattttacaactgaaaaacaggactcatgctgtctaccggtggaatagaaatgacgatgggaataacgttccagcagacaccgttgtgtttcataaccaatactggacaagcagcacgcgtcgcaggaggctgaagaagaaccatttccatctcgagaacctcgaggatctgatctccctattctaggagagctggtctggcagcacgacctttgtggagcaatggcagaatagcaccgctgctagcgtccattgctcttcggagcagcagggccggtgatcggactggccattgcaagtccagctacccgatttcatgccgaaggagtcatgctggatctgtatgctggactgaatgctgggctgtataaacatagcgaaaaataatacgaggtttgtcgtcggtacagatgtgatcattttacatacaatgaacattatttccaaaaaaaaaaaaaaaaaaaa

SEQ ID NO: 3230 - protein, 477 aa, Panicum virgatum
  misc_feature: Ceres CLONE 1790044
  misc_feature (1)..(198): Pfam Name: Metallophos Pfam Description: Calcineurin-like phosphoesterase
  misc_feature (5)..(451): SWISSPROT Homolog: EC 3.1.3.2 Purple acid phosphatase precursor
  misc_feature (9)..(456): SWISSPROT Homolog: EC 3.1.3.2 Iron(III)-zinc(II) purple acid phosphatase precursor
MKGWGLLLLSLHVISCLVSGVASGRTSSYVRTEFPSTDIPLESEWFAIPKGYNAPQQVHITQGDYDGKAVIVSWVTPEEPGPSEVFYGKKEKQYDQKSEGTTTNYTFYDYKSGYIHHCLVDGLEYNTKYYYKIGSGDSAREFWFETPPAIDPDASYTFGIIGDLGQTFNSLSTLQHYEKTGGQTVLFVGDLSYADRYKHDDGIRWDSWGRLVERSTAYQPWIWNAGNHEIEYRPDLGETSTFKPYLHRYMTPYLASKSSSPMWYAVRRASAHIIVLSSYSPFVKYTPQWWWLKNEFKRVDREKTPWLIVLMHSPMYNSNEAHYMEGESMRAAFEKWFVKYKVDLVFAGHVHAYERSYRISNVNYNITSGNRYPVPDKSAPVYITVGDGGNQEGLASRFNDPQPDYSAFREASYGHSILQLKNRTHAVYRWNRNDDGNNVPADTVVFHNQYWTSSTRRRRLKKNHFHLENLEDLISLF

SEQ ID NO: 3231 - DNA, 2183 bp, Panicum virgatum
  misc_feature: Ceres CLONE 1790071
  misc_feature: Encodes the peptide sequence at SEQ ID NO. 3232
agtccaggtcgagcgtcgacagccgacaactcccttcccttccctttcccctctccccggtctgcgttgctccctcggtccctcctcccgcccgcccgcccgcccccgcctctgctccgcccatccaccgcacctaggcagcccctcgtcacatggaagccgatgtccccattgccacggctacccccaggtaccgagcgggcattagccgttagctagctgcacccggagacactgatttggagctctccaagtattgagctacctctctgttttatcgccttgtgcttgtaattcataagaagagctgtcttttcccctagggctttggagattgccaagatgaggagtagatttatcattctttgtgtgatggcctgtctaatggctcagctaggagctgccaatgtcgtgctaatgggaaataatctgaccttgtcgtttgatgacatcgaggcaagctttgctccaggggtgaaagcatcaggagttaatggcatagtttatactgctgaacctttaaatgcctgcagcccattgacaatcaaagcagttgagggacccccatctcccttcgccttgattataagaggtggatgcacatttgatgagaaagtaaaaaatgcacaggatgctggattcaaagctgcaatcgtatatgacaatgaaaatagtggggttctggtttcaatggctggaagctcaagtggtattcatatatatgctgtattcatatcgaaggcctctggagaggtgttgaagaagttttcaggccatgctgatgtagaagtgtggatactacctacattcgagaactcagcctggtcgatcatggcaatctcattcatatcgctacttgccatgtctgccgtattggctacatgtttctttgtgagaaggcatcgaataaggagggaacaccctagaaatccggaagctcgaaaattccatggaatgagcagtcagttagttaaggcaatgccaagtcttattttcacaaaagtgcaagaagataactgcacatcatcaatgtgtgccatttgcttggaagactacaatgttggagagaagcttagagtactgccttgccgtcacaagttccatgcatcttgtgtggacttgtggttgacttcgtggagaacattctgtcctgtatgcaagcgagatgcaagtagtggagtatcagaacttcctgccacagaggctaccccattactttcttctgctgttcggttaccttcccagccatcttcatcctggttgagtgtggcagcatcccctccgagaccaataagccggcgtccttcgtctcattcggtttctcgtgcttactctgtttcttgtaccccccagtctcccaacccctttagatcttacacacactctcctggtattagtacaagcagaagcaacgcagaccttgcgaatatgtcatctccccaccctcgaatctcacatttatcgtcgacacactcccttgttggcagccacttgtctccaccaatcagtataaggtattcatcaccccatgtatccctgtttggccacggatcacccagcgtacattttggttcatcttatatgtccaattctggatatggatcttcgagctactactatcttggagcctccagccagcatggatcatacctaagacgatgcggagaatcagggccaagcctgtctactatggttcctcaatcaccacagcagtcccagttggggcattgtgagtcctcggaggcaaatgtggtgacaggcgcattgtcagctcagtctttgcggcaatcctacctgagaaactgtggtgattcagatgccagtttgtctgacatgacgtcagctcagtcgttgccgggatgctaagggacccagatgtgtacaaaattatggcgctatttgtgccattgaggcatgtaagtaacataggtgagagaaacatgcatagaatatttgttgttgttgtttgttttggagtagccagttttcttgtgcttgtgtgcatattacaggtgacaggaagaatatttatttgtatgtaacctggtagggcgaaacaatttgtttgtttgaatgtgtatgtcacttgtattgactggaggctttggcgggctggcacgttttttttatatatatataaggacaggcgtgcagttgatgaccaaaaaaaaaaaaaaaaaaaa

SEQ ID NO: 3232 - protein, 507 aa, Panicum virgatum
  misc_feature: Ceres CLONE 1790071
  misc_feature (1)..(42): Pfam Name: zf-C3HC4 Pfam Description: Zinc finger, C3HC4 type (RING finger)
MRSRFIILCVMACLMAQLGAANVVLMGNNLTLSFDDIEASFAPGVKASGVNGIVYTAEPLNACSPLTIKAVEGPPSPFALIIRGGCTFDEKVKNAQDAGFKAAIVYDNENSGVLVSMAGSSSGIHIYAVFISKASGEVLKKFSGHADVEVWILPTFENSAWSIMAISFISLLAMSAVLATCFFVRRHRIRREHPRNPEARKFHGMSSQLVKAMPSLIFTKVQEDNCTSSMCAICLEDYNVGEKLRVLPCRHKFHASCVDLWLTSWRTFCPVCKRDASSGVSELPATEATPLLSSAVRLPSQPSSSWLSVAASPPRPISRRPSSHSVSRAYSVSCTPQSPNPFRSYTHSPGISTSRSNADLANMSSPHPRISHLSSTHSLVGSHLSPPISIRYSSPHVSLFGHGSPSVHFGSSYMSNSGYGSSSYYYLGASSQHGSYLRRCGESGPSLSTMVPQSPQQSQLGHCESSEANVVTGALSAQSLRQSYLRNCGDSDASLSDMTSAQSLPGC

SEQ ID NO: 3233 - DNA, 1634 bp, Panicum virgatum
  misc_feature: Ceres CLONE 1790078
  misc_feature: Encodes the peptide sequence at SEQ ID NO. 3234
atccccgcggcgacctcgcagccgcgccgcgcgtctcgctcccgccacacacagccatgccgctcctccacctctcgctcccgccgcaccgcctcctcgtcgccggccgcggcgggctgtacttcccgccggttccccgtcacacccgcctatccgtcagggcggcggctggggatgcagccgtgtctgtcgccgcgggggcttacgatctccccttccctccggagcgcgcctcccaccaccgcgagctcgccgcggccgccgccgccgtggagcgcgcctgccgcctatgcgttgacgtgaagaggtcgctattttcaggtgagaagagtattcttgaaaagaatgaccaaactcctgtcacaattgcggatttcggggtgcaggcccttgttagtttggaactccagagattgttcccatcaatacctctggtggcagaagaggactcggcatctctaaggtcatccaacactgatgataatagtagtgatgtacttgttgagtcaatttttagtggagttgcagacaaagtgagcaacagtagttcacttttaactcaagatgatgtgctgagagcaattgatagaaggggcaaggatgctgtctcatttgattcaaaccctgctacttattgggtacttgatccaattgatggcaccaaaggtttcttgagaggcgatgatgctctatatgtggtgggcctggctcttgtggtgaatgggaaggtaacaattggagtgatgggatgtccgaattggaccaatgacaccatacacaacgagaaagatggcagtgctgctgcatgtaatgactgggggattcttatggtatctcatctaggctgtggtacatggtctaggcgcctgtcttctgagattggccagtccactacagcacaggatatttggaaaagatgctttgttgacacatgttcagttgttcacatggcacgctattgcattccggatagccaaacatgggatatgataccgttatctgttctcttcaattcaacgacgggtgaatctgatcctagaaatgagactgaaattcttctcctatcagttttctgtggcagcttgtgcaagtatctaactgtagcttctgggagagcctccgtttttgtcctccgagcacggccgacaactcagatcaagtcttgggatcatgctgttggggtaatttgcgtgcaggaagctggcggccagatcagtgactggagtggaaaaccgttggatcttgcagctgacctaacttctcgcagaatcatctacccttcgggcggcgttcttgtgacaaatggtgctctgcatgacaagcttgtggaaatgatctcagctaattacaagtagctgcatagatagcttcacacatcaacacatttcttttctggaatcaactatattgacactcatcaaattgtattcggtctcacattcagtagagaaaccacaaagcatgttcacatgacttccgttgccattaccactacatgaatggaatggaaacgcacaatttcctcgaagcaatgtgctgaacagatccttaagcaacttcattcagacgcaattcatgcgagctgtgatgctcgcctttgtcgtctttgtgcccaaaaaaaaaaaaaaaaaaaa

SEQ ID NO: 3234 - protein, 432 aa, Panicum virgatum
  misc_feature: Ceres CLONE 1790078
  misc_feature (1)..(371): Pfam Name: Inositol_P Pfam Description: Inositol monophosphatase family
MPLLHLSLPPHRLLVAGRGGLYFPPVPRHTRLSVRAAAGDAAVSVAAGAYDLPFPPERASHHRELAAAAAAVERACRLCVDVKRSLFSGEKSILEKNDQTPVTIADFGVQALVSLELQRLFPSIPLVAEEDSASLRSSNTDDNSSDVLVESIFSGVADKVSNSSSLLTQDDVLRAIDRRGKDAVSFDSNPATYWVLDPIDGTKGFLRGDDALYVVGLALVVNGKVTIGVMGCPNWTNDTIHNEKDGSAAACNDWGILMVSHLGCGTWSRRLSSEIGQSTTAQDIWKRCFVDTCSVVHMARYCIPDSQTWDMIPLSVLFNSTTGESDPRNETEILLLSVFCGSLCKYLTVASGRASVFVLRARPTTQIKSWDHAVGVICVQEAGGQISDWSGKPLDLAADLTSRRIIYPSGGVLVTNGALHDKLVEMISANYK

SEQ ID NO: 3235 - DNA, 1765 bp, Panicum virgatum
  misc_feature: Ceres CLONE 1790079
  misc_feature: Encodes the peptide sequence at SEQ ID NO. 3236
aaagtgaagccagcatccattcacttcgtaacagtacccttgcgttatggtgccggccggccggtcggcgctggccgatccctcccttttaagcccgccggatccgggcgtttcttccccggctgtgggagacgagcgcgagagtctccaatggcggcgttccgctgcgttctcgcttcggttctcgtcgcggcggcggcgatggcggcagacgcgctcggggtgaactggggcacgatgtcgacgcgacggctgccgcccaaggtggtggcgcggctgctcgcggacaacgggttccggaaggtgaagatcttcgacgccgacgagcggaccatggcggggctcgccgggacgggcatcgagacgatggtcgccgtgcccaacgacctgctcgccgccgtcgccgactacgaccgcgccagggagtgggtgaaggagaacgtcaccaggtacgccttcgacggcggcgtcgacatcaggttcgtggccgtgggcaacgagccgttcctccgggcgtacaacggctcgttcgaccgcgtcaccgtgccggcgctgcgaaacatccagcgcgcgctcgacgaggccggccacggcggcagggtcaaggcgacggtccccgtgaacgcggacgtgtacgattcgccgccgggcgacccggtgccgtcggcggggaggttccgcgccgacgtggccggggtcatggccgagatggtgcgcttcctcagccgcagcggcgcgccgctgacggtcaacatctacccgttcctcagcctgtacgggaacgacgacttcccgctcgactacgccttcttcgacggcgccggcaaggcgaagccggtggtcgacggccgggtcacctacaccaacgtcttcgacgccaacttcgacaccctggtgtcggcgctgaagagggtcgggttcggccacctgccggtcatgatcggcgaggtcggctggccgacggacggcgaccggcacgccacgccggcgctggcggagcggttctacgcggggctgctccggcgcctcgcggcgaggaagggcacgccgctccggcccggcgcgcgcatcgaggcgtacctgttcgggctcatcgacgaggacgccaagagcgtggcaccgggcaacttcgagcgccactggggcctcttcaccttcgacggccggcccaagttctccctctccctccgcggcggcggcgggcgccccgcgatgcccgtcccggccaggggcgtcgagtacctgccccggcggtggtgcgtgctgaacccggacgccggcgacggcgccgcggcccgagtcgcggacaacgtcggctacgcgtgcggccgcgccgactgcacggcgctggggtacgggtgcagctgcggcggcgctctggacgcgcgcgggaacgcctcgtacgcgttcaacgcgtactaccaggcgcaggggcaggccgagtcggcgtgtgatttccaggggctcgccgtcgtcgtagacgaggacgcgtcgcggggcaagtgcaacttcagcgtgcaggtcgtcgggtcgggcgcgccggcggccgcagcggtggctgcggggacggcggccgtgctggcggctctgcttctcgtgttgctttgagcttacgcgaggtgtcaatgcgacggttgtagattgtaggacgtgacggcattaagatgttgtactaagtactttcgatcacatgagatgttttgggctcatatttgagagattatcagttcatatgtaagcccttcaaaaaaaaaaaaaaaaaaaa

SEQ ID NO: 3236 - protein, 485 aa, Panicum virgatum
  misc_feature: Ceres CLONE 1790079
  misc_feature (1)..(324): Pfam Name: Glyco_hydro_17 Pfam Description: Glycosyl hydrolases family 17
MAAFRCVLASVLVAAAAMAADALGVNWGTMSTRRLPPKVVARLLADNGFRKVKIFDADERTMAGLAGTGIETMVAVPNDLLAAVADYDRAREWVKENVTRYAFDGGVDIRFVAVGNEPFLRAYNGSFDRVTVPALRNIQRALDEAGHGGRVKATVPVNADVYDSPPGDPVPSAGRFRADVAGVMAEMVRFLSRSGAPLTVNIYPFLSLYGNDDFPLDYAFFDGAGKAKPVVDGRVTYTNVFDANFDTLVSALKRVGFGHLPVMIGEVGWPTDGDRHATPALAERFYAGLLRRLAARKGTPLRPGARIEAYLFGLIDEDAKSVAPGNFERHWGLFTFDGRPKFSLSLRGGGGRPAMPVPARGVEYLPRRWCVLNPDAGDGAAARVADNVGYACGRADCTALGYGCSCGGALDARGNASYAFNAYYQAQGQAESACDFQGLAVVVDEDASRGKCNFSVQVVGSGAPAAAAVAAGTAAVLAALLLVLL

SEQ ID NO: 3237 - DNA, 1753 bp, Panicum virgatum
  misc_feature: Ceres CLONE 1790092
  misc_feature: Encodes the peptide sequence at SEQ ID NO. 3238
gacctaacccggagactcgcctccccacccacctttcccctcctccctcccgcggctcgcgtccggcccgacgccgccgcacgcctccacgccagcgccccgccgcacgcctccacgccagcgccccgccgcctcctcgccagggggacgtcgcgccgcgccgtgccggggaggcctcgctcggggggagggctggtcgcccgtcggccgcgcggccgtagaggcggaggacggacggtggggagcttgatctagggctcctgcctgcccccgtgcggcggcgggatgtacgtgccgccgctgcccggcggcgccggcggccgcgacgatgcgcccgccggcgagcagcctagggtttaccaggtctggcggggaagcaacgaattcttcttgcagggaagattcatatttgggcctgatgtgagatctgtgtttctcactatgttcctcatcattgcaccagtggttaccttctgtgtgtttgttgcaaggcatctcatgaatgatttccccgatagctggggcatctcagtgatggtagtagtggttgtcttcaccgtttatgatttgacgctgcttgtttgtacctctggtagagatcctggtataatacctcgcaacactcatcctcctgaacctgaatccattgatggggtcaatgattcgggaggtcagactccgcaacaatttcgtttgcctcgcacaaaggaagtaattgtaaatggaatcagtgtaagagtcaaatactgtgatacctgcatgctgtaccgaccacctcgatgctcacactgttctatttgcaataactgtgtggaaagatttgatcatcactgcccatgggttggccagtgcataggactgcgcaattaccggttcttctatatgtttgtattctcgaccacgttactctgcctgtatgtatttgccttctgttgggtgtatgtgatcaagattagaaatgctgaacaattgtcaatttggaaggccttgacaaagacaccagcttcaattgttctaattatctactgctttctttgtgtatggtttgtcggtggtctgtctgtcttccatttatatctaatgagcaccaaccagacaacatatgagaatttcaggtatcgctatgatcggcgtgataatccatataatagaggtattctgaacaacttcctagagatattctgcactgctatccctccttcaaagaacaatttccgggcgagggtcacagtagagcaagggttgcaacaaacacgctcacagtgtagaagtttcatgagcccaaacatgggcaagcctattggagatcttgaaatgggcaggaagccagtggcttgggatgagccaaggacagcagctgatatcagggacttggaggcaggccttgagggcatgtttgacgagaaagagggcagaatagcccatgcatctccagatctgagcagagatgaactttcagcggagtttgtggaaggccgagctggcatgcattcgaggcagtcaagttgggctcagagagccacagatgaaatggaagccatggctgtgcaaatggctaccgctcgcggaagctaatgggggcccggaatggcacacattagccataaaaaaaaacttgtgtgtgtttcaattgcgcatggagtgggtgtcgtgatcatgtctcaaagcgaactgccatgtgttttccacgtgtgccaggcaacggcctggatcggtgtaactgtcaacgagcttgctgttgtgtgtgtccctg

SEQ ID NO: 3238 - protein, 429 aa, Panicum virgatum
  misc_feature: Ceres CLONE 1790092
  misc_feature (1)..(65): Pfam Name: zf-DHHC Pfam Description: DHHC zinc finger domain
MYVPPLPGGAGGRDDAPAGEQPRVYQVWRGSNEFFLQGRFIFGPDVRSVFLTMFLIIAPVVTFCVFVARHLMNDFPDSWGISVMVVVVVFTVYDLTLLVCTSGRDPGIIPRNTHPPEPESIDGVNDSGGQTPQQFRLPRTKEVIVNGISVRVKYCDTCMLYRPPRCSHCSICNNCVERFDHHCPWVGQCIGLRNYRFFYMFVFSTTLLCLYVFAFCWVYVIKIRNAEQLSIWKALTKTPASIVLIIYCFLCVWFVGGLSVFHLYLMSTNQTTYENFRYRYDRRDNPYNRGILNNFLEIFCTAIPPSKNNFRARVTVEQGLQQTRSQCRSFMSPNMGKPIGDLEMGRKPVAWDEPRTAADIRDLEAGLEGMFDEKEGRIAHASPDLSRDELSAEFVEGRAGMHSRQSSWAQRATDEMEAMAVQMATARGS

SEQ ID NO: 3239 - DNA, 1830 bp, Panicum virgatum
  misc_feature: Ceres CLONE 1790114
  misc_feature: Encodes the peptide sequence at SEQ ID NO. 3240
actacacaagagcccctttccatttggtctcatctctcctctctgtctctctctcctgtctcccccttggcttccgatatcagcggcggcgcagcgccgggggggcggcattgcgtgctgacatcacccgcggcgcggcgatcccggggggcggagggaggtggccgcgccgccggctatgtagtgatctgggccgtgatctcgacggcgactctcggctgagcgggcggcggcgatgaacggagcgagcgccagcgccgggcccggcgccggcgctggcactggcgctggcgcggaggggccgctggtgtacgaggcctggaagggcagcaatgtgtttttccttcaggggaggtttatatttggtcctgatgcaagatccttgtttgtcaccatgttcctcattgttgcgcctgtatcgatcttctgtgcattcgttgcaagggaattgatggataaattctcttatggcatgggattgtcggtaatgattgcagtagttctgttcacagcatatgatctgagtcttctgcttctaacttctgggagagatcctggtatcatacctcgcaatgcacatcctccagaacctgaaggttttgatggcaatgcagaggttggggctaaccagactccacctttgcgtttgccccgagtgaaggatgttgtcgtcaatggagtcactgtgaagacaaaatactgtgacacttgcatgttgtacaggcctcctcgttgctcccattgctctatctgcaacaactgcgtggaacgttttgaccatcactgcccatgggttggacagtgcataggactgaggaattacaggttcttttatatgtttgtgttctcaacaactctgctctgcctttatgttttcgggttctgttgggtgtacattgttaagatcagaaatgcagagcagataacaatttggaaggcaatgtcaaagacccctgcatctattgctctaatcatctacacattcatcgcggtttggtttgttggtggcctctctgtgttccacttgtacctcatgagcacaaatcagacaacatatgagaacttcaaatatcgctatgatcaacgagccaacccatacaacaggggggtcgttgaaaacatcaaggagatcttctttacacccatccctccttccaagaacaacttccgtggcagggttccacaggagcatggtctaaggcctcgtgcgaccaatggtttcacgagtccaaacatggggagagctgtcggtgacattgagatgggtagaaaaccagtagcttgggatgagccaaggatggccgctgagattggtgatttaggagcaggtctgagcaacttgttggaagacaaggatggtaggtttcgtagtgcatctccagatctcagccgtgatgctctcgctgttggaggaggctttgaagagcaaggctcctcggcgatgaaccctgggcggacaagctggggagttgaagccggtcgatgatggtaatgaccatgtaagcagctgtagtgagaggctcagggctgttagtgtcagtttgctgctaatttgttgtttggtttgagatttgaggtccctaatgttatagactcatgacctgtatggcggttgtttcctgatttaagtttctcatttctcttagtttgagatgtctttcctgtatgttgtttgaagcagttggtttgtgacgtctcaagtttggcagtgtctgattttttctgtatatattggctctgtagacctgaaacagtttgaactgcttggctttggatgttagttgtgaacaaatatttgaccttcgcagttaaaaaaaaaaaaaaaaaaaa

SEQ ID NO: 3240 - protein, 416 aa, Panicum virgatum
  misc_feature: Ceres CLONE 1790114
  misc_feature (1)..(65): Pfam Name: zf-DHHC Pfam Description: DHHC zinc finger domain
MNGASASAGPGAGAGTGAGAEGPLVYEAWKGSNVFFLQGRFIFGPDARSLFVTMFLIVAPVSIFCAFVARELMDKFSYGMGLSVMIAVVLFTAYDLSLLLLTSGRDPGIIPRNAHPPEPEGFDGNAEVGANQTPPLRLPRVKDVVVNGVTVKTKYCDTCMLYRPPRCSHCSICNNCVERFDHHCPWVGQCIGLRNYRFFYMFVFSTTLLCLYVFGFCWVYIVKIRNAEQITIWKAMSKTPASIALIIYTFIAVWFVGGLSVFHLYLMSTNQTTYENFKYRYDQRANPYNRGVVENIKEIFFTPIPPSKNNFRGRVPQEHGLRPRATNGFTSPNMGRAVGDIEMGRKPVAWDEPRMAAEIGDLGAGLSNLLEDKDGRFRSASPDLSRDALAVGGGFEEQGSSAMNPGRTSWGVEAGR

SEQ ID NO: 3241 - DNA, 1640 bp, Panicum virgatum
  misc_feature: Ceres CLONE 1790126
  misc_feature: Encodes the peptide sequence at SEQ ID NO. 3242
gatgaagcttcgactcactgcctatctcggcattggtcgggggagtgggaagcgaggagcagcgccatggcctctgctccgaagcttcttcttctcctcctcttttggaggtatcactcttgcgttgctcacgcaggagatgatcgcagctacaaggttctgtcccttgactctctgaagcctgacgctgcatgctccgagcgcaaagttccgttgcccggcgcggccacggtgccgttgcaccaccggcacggcccgtgctcaccggcgcccaccaagaagatgccagacttggaggagatgctccagcgtgaccggctccgagctgcctacatccaacggaagttctccgccgccaacggcggcgccggcgatgtccagcagtcggaggccaccgtgtcgaccaggctgggcacggccctgagcacgctggagtacgtgatcaccgtaggcatcggctcgccggccgtgacccagaccatgctcatcgacaccggcagcgacgtgtcgtgggtgcagtgcaaaccgtgctcgcagtgccactcccaggcggacccgctcttcgaccccagctcgtcgagcacctactccccgttctcctgcagctctgccacctgcgcgcagctctgccaggaggggaacggctgctcgcgctcccagtgccagtacattgtcacctacggcgacggctcgagcaccaccggcacctacagctccgacacgctcgcgctgggctccaacaccgtcaggaacttccaattcggatgcagccaggtggagtcgggcttcaacgaccaaaccgacgggctcatggggctcggcggcggcgcgcaatcactcgtgtcgcagacggcggggacattcggcagggccttctcctactgcctcccgccgacttcgagctcctccgggttcctcacgctcggcgctggaacgtccggcttcgtcaagacgccgatgctcaggagcagccaggtccccacgttctacggcgtccgccttcgggccatcagggtgggagggaggcagctcagcatacccacctcggtcttctccgccgggacgatcatggactccggcacggtcatcacgcgcttgccgcggacggcctactcggcgctgtcgtcggcgttcaaggccgggatgaggcagtacccgccggcgccgcccagcggcatcctcgacacgtgcttcgacttcagcggccagagcagtgtcacgatacctaccgtcgcgctggtgttctccggcggcgcggtcgtcaacctcgacgcgaacgggatcattctatacaactgccttgccttcgcgggcaacagtgacgacggatccctcggcatcatcggcaacgtgcagcagcggacgttcgaggtgctctatgacgtcggcgggggagctgtgggcttcatggctggggcgtgctgatggtcgccgggcacaaggacaacgacagtacggggtgtacctgttttcttgtgttgcgagccaacagacatgaagtgggcaaccatcaaaactatatagcagtaataacgtgaagcaagtttgcaaactacgaaccaaatgacaactgtaattttcacctacaaacaaagattaataatatattatagtattgctaaaaaaaaaaaaaaaaaaaa

SEQ ID NO: 3242 - protein, 452 aa, Panicum virgatum
  misc_feature: Ceres CLONE 1790126
  misc_feature (1)..(336): Pfam Name: Asp Pfam Description: Eukaryotic aspartyl protease
MASAPKLLLLLLFWRYHSCVAHAGDDRSYKVLSLDSLKPDAACSERKVPLPGAATVPLHHRHGPCSPAPTKKMPDLEEMLQRDRLRAAYIQRKFSAANGGAGDVQQSEATVSTRLGTALSTLEYVITVGIGSPAVTQTMLIDTGSDVSWVQCKPCSQCHSQADPLFDPSSSSTYSPFSCSSATCAQLCQEGNGCSRSQCQYIVTYGDGSSTTGTYSSDTLALGSNTVRNFQFGCSQVESGFNDQTDGLMGLGGGAQSLVSQTAGTFGRAFSYCLPPTSSSSGFLTLGAGTSGFVKTPMLRSSQVPTFYGVRLRAIRVGGRQLSIPTSVFSAGTIMDSGTVITRLPRTAYSALSSAFKAGMRQYPPAPPSGILDTCFDFSGQSSVTIPTVALVFSGGAVVNLDANGIILYNCLAFAGNSDDGSLGIIGNVQQRTFEVLYDVGGGAVGFMAGAC

SEQ ID NO: 3243 - DNA, 2578 bp, Panicum virgatum
  misc_feature: Ceres CLONE 1790136
  misc_feature: Encodes the peptide sequence at SEQ ID NO. 3244
ccgcgaagccgccaggccacgagcccacggctccccctcgacctcccaccccccgcctcgctccctccgccgcctagggttttccaccgggcgccgccgcagcggcggcccgggatgcgggtgggcccgcgcaggtagagtcctcggacccaccaccgcccgcgccatgtcgctcctgcggcggcggaaacagccgcagcgggagcagccgccgccgccctcggacggcaacgggtccgaccacgacgacgacgacaaggggaagaggccgtcctcctccgcgccggcgtccaaggaggcgaccaggcggaccaaggccaggtggtcgtgcgtggacagctgctgctggctggtcgggtgcgtgtgctccgcctggtggctcctgctcttcctctacaacgccatgccggcgtcgttcccgcagtacgtcacggaggccatcacaggcccgctcccggacccgcccggggtcaagctgcacaaggaggggctccgcgtcaagcaccccgtcgtcttcgtccccggcatcgtcaccggcgggctcgagctctgggagggccaccactgcgccgaggggctcttccgcaagcggctatggggaggcacatttggcgacgtgtacaagagacctttatgctgggttgaacatatgtcattggacaatgaaactggattagacaagccaggaataagggttaggccggtcacaggtcttgttgcagcagactattttgtacctggatattttgtttgggctgtgttaattgccaatttagctcgtattggatatgaagaaaagaccatgtatatggctgcatatgattggaggttatctttccagaacaccgaggttcgtgatcaaactttgaacagaataaagagtaacattgaactcatggtagcgacaaatggtggaaatagagttgtggtgatcccacactctatgggggtcctctattttctgcattttatgaagtgggtcgaggcacctcctcccatgggaggtggcggtggtccaaactggtgtgaaaagcatattaaagctgtagtgaatattggtggacctttcttgggagttcccaaggctgttgctgggcttttctcatctgaagccaaagatgttgccgttgctagagctattgcacctgatgttctggactctgactttcttggacttcagactttacgccatttaatgcgaatgacccgtacatgggattcaacaatgtcaatgattcctaaaggtggtgatacaatttggggaggtttggattggtctccagaagatgggtttgaatgcaaagctaagaaccaaaaaggcaatgacactgaggtttctgatggcattaatggggaaagtgttgaagttccacctgagcctattaactatggaagattggtatcttttggtaaagatgtagcagaagctccttcttctaagatcgagcggattgagtttcgtgatgctgttaaaggcaataatattgcccattcaaatacatcatgccgggatatctggacagagtatcacgaactagggtggggaggaataaaggcagttgcagattacaaagcttacactgctaattccattatagaccttcttcactttgttgctccaaggatgaagcagcgtggaaatgttcatgtttcatatggaatagctgataacttggatgacccaaagtatcaacattataaatattggtcgaatccgttggaaacaaagttgccgaatgcgcctgacatggaaatattttcaatgtatggagtaggcattcctactgaaagagcttatgtctataagttggccccacaagctgagtgttatataccttttcggattgacaccacggctgagggtggggatgagaatagctgcttgaaagggggtgtttacttagctgatggtgatgaaaccgtcccagttcttagtgctggctatatgtgtgcaaaaggatggcgcggaaaaactcggttcaatcctgctggcagcaagacctatgtaagagaatacaatcattctccgccctcaaatctcctggaaggcaggggcactcagagcggtgcccatgtcgatatcatggggaacttcgctttgatcgaggacatcatcaggattgctgctggggccaccggtgaggaaatcggtggcgatcaggtttattctgatatattcaagtggtcagagaaaatcaaattgaaattgtaatgcttgggaagatgaagtgcctattagtggattgcgtgccaaagtgattgccagagtgcaattctgtggattttgctttgctattgtaattttccactcattcgtcccttttgcaaattcattgacaggaagctgatgcgatgttgtaccactattttgggaatcatacagcattgtatattaaaatgtacaggtgtaagttacattcgctagcagaaatacggtagcttttatcaatcgattgtcttttgagtatttgctaggtaattttctttctttttagaaaaaaatacaaactatgtgtgcgataaattgtttatttaacgatcatgtttgtctatgttcgaaaaaaaaaaaaaaaaaaaa

SEQ ID NO: 3244 - protein, 681 aa, Panicum virgatum
  misc_feature: Ceres CLONE 1790136
  misc_feature (1)..(518): Pfam Name: LACT Pfam Description: Lecithin:cholesterol acyltransferase
MSLLRRRKQPQREQPPPPSDGNGSDHDDDDKGKRPSSSAPASKEATRRTKARWSCVDSCCWLVGCVCSAWWLLLFLYNAMPASFPQYVTEAITGPLPDPPGVKLHKEGLRVKHPVVFVPGIVTGGLELWEGHHCAEGLFRKRLWGGTFGDVYKRPLCWVEHMSLDNETGLDKPGIRVRPVTGLVAADYFVPGYFVWAVLIANLARIGYEEKTMYMAAYDWRLSFQNTEVRDQTLNRIKSNIELMVATNGGNRVVVIPHSMGVLYFLHFMKWVEAPPPMGGGGGPNWCEKHIKAVVNIGGPFLGVPKAVAGLFSSEAKDVAVARAIAPDVLDSDFLGLQTLRHLMRMTRTWDSTMSMIPKGGDTIWGGLDWSPEDGFECKAKNQKGNDTEVSDGINGESVEVPPEPINYGRLVSFGKDVAEAPSSKIERIEFRDAVKGNNIAHSNTSCRDIWTEYHELGWGGIKAVADYKAYTANSIIDLLHFVAPRMKQRGNVHVSYGIADNLDDPKYQHYKYWSNPLETKLPNAPDMEIFSMYGVGIPTERAYVYKLAPQAECYIPFRIDTTAEGGDENSCLKGGVYLADGDETVPVLSAGYMCAKGWRGKTRFNPAGSKTYVREYNHSPPSNLLEGRGTQSGAHVDIMGNFALIEDIIRIAAGATGEEIGGDQVYSDIFKWSEKIKLKL

SEQ ID NO: 3245 - DNA, 1834 bp, Panicum virgatum
  misc_feature: Ceres CLONE 1790142
  misc_feature: Encodes the peptide sequence at SEQ ID NO. 3246
agagtcagctccctgcatctgccacctccactctctccctcctcctcccactgaatcattcgtcttttgaacattttttttgtgctctcaaggcaaaagagcacacttgactcttgccagctccagtcactctctcgctctctctagctctctctcttactccattggaggttggagccatggcgatgccagcagctccggtgagctgctccagcagggcactggccatggtgctcgcgctcgtcgctacggcgctgtgctgccgcctgggttcttgcgacggagctgccgccgacaggatcaggcggctccccgggcagccggaggtgagcttcggccagtactccggctacgtcggcgtggacgacgccggcaagagggcgctcttctactacttcgtcgaggccgaggtcgaccctgcctccaagcctctcgtcctctggctcaatggaggccccgggtgttcttcactgggtgtaggggccttctcggagaacggccccttcaggcctagtgggcaggtgctggtgaagaatgaatacagctggaacaaagaggccaatgtgatttacctggagacgccggctggtgtaggctactcctactctgctgatgctgcctactaccagggcgtggatgacaagatgacggccacggacaacatggtgttcctgcaaaggtggctccaaaagttcccacagtacaagggcagagacctctacatcgccggagaaagctacgcagggcactacatcccacagctcgccgaggccatggtcgagcacaacaccaaggacaagatcttcaacctcaaaggcatcgctctgggcaaccctgtgctggagttcgcgacggacttcaactcccgcgccgagtacttctggtcgcacggcctcatctccgacggcacctaccgcgtcttcaccgccgtctgcaactactcccgctacgtctccgagtactacggcggctcgctgtcgccgctgtgcgcccgggtgatgaaccaggtcacccgcgagaccagccgcttcgtcgacaagtacgacgtcaccctcgacgtctgcctctcctcggtgctctcgcagtccaaggccctgtcgccgcgccagcaggccggccagcggatcgacgtctgcgtcgaggacgagaccgtccggtacctcaaccgccgcgacgtgcaggcggcgatgcacgccaggctcgtcggcgtcgacaagtgggccgtctgcagcagtgttcttgagtacgagctgctcaacctgcagatccccaccatcaacattgtcgggtcgctcgtcaagtccggcattagggtgctggtttacagcggcgatcaggactcggtgatccctctaactggaagccgaacactggtgcagaatttggctcatgacatgggcctcaagacgaccacaccataccgggtttggttcgagggccagcaggttggaggatggactcagatttacggtggcggcacgctgtccttcgccaccatcaggggggcctcccacgaggcgccgttctcgcagcccggtcggtcgctggtgctcttcagagccttcctgcagggccagcctctgcctgaaaccttctcatgatccatgaatgaggtgcttcgtttgcaatgcaatgccggttcctgcttctgcaaggggttttgtactgtaactgtaagaatgtgtttgctgcatttgcctcctgctggtagcggtttgaagctgcgataatcgcggtgttcttcaggttttttgctccttgtttcctctgtatcctcggctcggcaattgtctaaagaagtcgaaagaattgtcaaaaaaaaaaaaaaaaaaaa

SEQ ID NO: 3246 - protein, 473 aa, Panicum virgatum
  misc_feature: Ceres CLONE 1790142
  misc_feature (1)..(414): Pfam Name: Peptidase_S10 Pfam Description: Serine carboxypeptidase
MAMPAAPVSCSSRALAMVLALVATALCCRLGSCDGAAADRIRRLPGQPEVSFGQYSGYVGVDDAGKRALFYYFVEAEVDPASKPLVLWLNGGPGCSSLGVGAFSENGPFRPSGQVLVKNEYSWNKEANVIYLETPAGVGYSYSADAAYYQGVDDKMTATDNMVFLQRWLQKFPQYKGRDLYIAGESYAGHYIPQLAEAMVEHNTKDKIFNLKGIALGNPVLEFATDFNSRAEYFWSHGLISDGTYRVFTAVCNYSRYVSEYYGGSLSPLCARVMNQVTRETSRFVDKYDVTLDVCLSSVLSQSKALSPRQQAGQRIDVCVEDETVRYLNRRDVQAAMHARLVGVDKWAVCSSVLEYELLNLQIPTINIVGSLVKSGIRVLVYSGDQDSVIPLTGSRTLVQNLAHDMGLKTTTPYRVWFEGQQVGGWTQIYGGGTLSFATIRGASHEAPFSQPGRSLVLFRAFLQGQPLPETFS

SEQ ID NO: 3247 - DNA, 1602 bp, Panicum virgatum
  misc_feature: Ceres CLONE 1790144
  misc_feature: Encodes the peptide sequence at SEQ ID NO. 3248
aaaaacttgtctcgtcatccacatcgaccgcaaactcccttcccgcaccaaaccgatcgagcagagaagggagagagatggaggaataaagcggagagggagaaccgagccggagatcaaaagagcttgtgtgtgtgtagagagagagagaggtgtgcgcagcagcatcctcaaccatggcctctgctcctgctgctatataagagccgggggggctcctctgcttcccaatcccctccatcctggtcccatgcttcggtccacgcacacgcccagccccaccagcggcagcggcagctcggcggcgccggcgtccggctcgggcgccaggatggtcggcggcgccggcgcggcgggcagcggcgcgccgagcggggccagcaagctgctgcagatcctcaacgtgcgggtggtgggcagcggcgagcgcgtggtggtgctgtcccacggcttcgggacggaccagtcggcgtggagccgcgtgctcccctacctcacccgcgaccaccgcgtggtgctctacgacctcgtctgcgccggcagcgtcaacccggagcacttcgacttccggcgctacgacacgctcgactcgtacgtcgacgacctgctcgccatcctcgacgcgctccgcatcccgcgctgcgccttcgtcggccactccgtctccgccatgatcggcatcctcgcctccatccggcgccccgagctcttcgccaagctcatcctcatcggggcctcgcccaggttcctgaacgacaacgactaccacggcgggttcgagctgccggagatccagcaggtgttcgacgcgatggcggccaactactcggcgtgggcgacggggtacgcgccgctggcggtgggggcggacgtgccggcggcggtgcaggagttcagccgcaccctcttcaacatgcgcccggacatctccctccatgtctgccgcacggtgttcaacacggacctccgcggcgtgctgggcatggtgcgcgcgccctgcgtggtggtgcagaccacccgcgacgtctccgtcccggcctccgtcgccgcctacctcaaggcccacctcggcggccgcaccaccgtcgaattcctccagaccgagggccacctcccgcacctcagcgcccccggcctcctcgcccaggtgctccgccgcgcgctcgcccgcttctagcgaagcgacctcaaggcggcgatcactatttttaccgcccgcccccatttttaccctcgctctgccgagaatcaaaaatggcgcgacccgcgcgcgccgttgctgctgctgctgtgtgtgccatgactgtagtactagaacttgttctggtgcccgaattgttttttttttactttttactggagcagtcgtactggtactccgcatcttgccttcttctcctgcactgccactgcgccgaaggacagaaaagcgggcctcctagcgccacggggcgtgtactcgcgacggtgcaggagtttgttccagcttccgaagcctcgtcccatctgcaagcgtaggctgtaatttttctctctttttattaatgctcctaatttactgctatgatatgagattgggatcaaaaaaaaaaaaaaaaaaaa

SEQ ID NO: 3248 - protein, 308 aa, Panicum virgatum
  misc_feature: Ceres CLONE 1790144
  misc_feature (1)..(218): Pfam Name: Abhydrolase_1 Pfam Description: alpha/beta hydrolase fold
MLRSTHTPSPTSGSGSSAAPASGSGARMVGGAGAAGSGAPSGASKLLQILNVRVVGSGERVVVLSHGFGTDQSAWSRVLPYLTRDHRVVLYDLVCAGSVNPEHFDFRRYDTLDSYVDDLLAILDALRIPRCAFVGHSVSAMIGILASIRRPELFAKLILIGASPRFLNDNDYHGGFELPEIQQVFDAMAANYSAWATGYAPLAVGADVPAAVQEFSRTLFNMRPDISLHVCRTVFNTDLRGVLGMVRAPCVVVQTTRDVSVPASVAAYLKAHLGGRTTVEFLQTEGHLPHLSAPGLLAQVLRRALARF

SEQ ID NO: 3249 - DNA, 1686 bp, Panicum virgatum
  misc_feature: Ceres CLONE 1790170
  misc_feature: Encodes the peptide sequence at SEQ ID NO. 3250
gtatctaaagccctaaacccatctgccatctcccccaccttctctccactctcctctgctcctcgcaccgccgccgccgccgcgacgcgacgcaatggcttccgccgcggtgctccggaacgccggctcccgccgcctcttctcctacccgaccctacgcgccgccacgatctcggcgcccgccgctctccccgatgcgcccgccacggcggcggcgccgacccagccgccgccgatggccgggaccctctgggccaggtccatggccaccttcacgcgcacgaagccccatgtaaacgtcggtaccattgggcacgtcgatcacggcaaaaccactctcactgctgccattaccaaggttctagccgaggcggggaaagccaaagccatcgcttttgacgagatcgacaaggctccggaggagaaagcgagaggaatcaccatatcaacggctcatgtggagtatgagacggctaaaagacattatgctcatgtggattgccccggacacgctgattatgtcaagaacatgatcactggagctgctcaaatggatggcggcattcttgtcgtttcagcacctgatggcccgatgccacaaacaaaggagcatattctacttgctagacaggttggtgtaccttcacttgtgtgcttcttaaacaaagttgatgctgttgatgatccagagttactcgaacttgtagagatggagctccgtgagctcctcagtttctacaagtttccaggtgatgaaattccgatcatccgaggatcagccttgtcagcattgcagggaaccaatgatgagatcggaaagaatgccataatgaaactaatggatgctgttgatgagtacatccctgatcctgtgaggcagcttgataagcctttcttgatgccgatagaagatgttttctctatccagggtcgtggaactgttgtgactgggcgtgttgaacagggaacaattaaaaccggtgaagatgttgagattttaggtttgacacagagtggtcctttgaagactacggttactggtgttgagatgttcaagaagatattggatcatggagaggctggtgacaatgttggtcttctccttcgtggtcttaagcgtggtgatgttgagcgtggtcaggtggtgtgcaagcctggtactcttaagacatacacaaagtttgaggcagaaatatacgtccttacaaaggatgaaggtggtcggcacacagctttcatgtcgaattacagtccacagttctacttcaggactgctgatgtcactggaaaaattgagttgcttggtgacatgaagatggttttgcccggtgacaatgtgactgcaaatttcgagttgatatcgcctgttcctcttgaacaagggcaaagatttgcgctgagggaaggagggagaactgttggtgctggagttgtctccaaagttattagctaatcaatttccactttgtttccagtagcaatttagcaaaaatgaatgttgatacatgtcggaccgggttagaaacgagagcaaaggaacctgttttgcatttttcttggaatgcatgagcaaaaggccaggttggctggcccggccaccattctggacagtcgcttttgtttccttgttgaggtggtgctctataacaccgcagttaatttggtcaaaaaaaaaaaaaaaaaaaa

SEQ ID NO: 3250 - protein, 452 aa, Panicum virgatum
  misc_feature: Ceres CLONE 1790170
  misc_feature: Great-hit functional homolog of the protein sequence given in SEQ ID NO 9480
  misc_feature: Useful for making plants with modulated oxidative stress sensitivity
MASAAVLRNAGSRRLFSYPTLRAATISAPAALPDAPATAAAPTQPPPMAGTLWARSMATFTRTKPHVNVGTIGHVDHGKTTLTAAITKVLAEAGKAKAIAFDEIDKAPEEKARGITISTAHVEYETAKRHYAHVDCPGHADYVKNMITGAAQMDGGILVVSAPDGPMPQTKEHILLARQVGVPSLVCFLNKVDAVDDPELLELVEMELRELLSFYKFPGDEIPIIRGSALSALQGTNDEIGKNAIMKLMDAVDEYIPDPVRQLDKPFLMPIEDVFSIQGRGTVVTGRVEQGTIKTGEDVEILGLTQSGPLKTTVTGVEMFKKILDHGEAGDNVGLLLRGLKRGDVERGQVVCKPGTLKTYTKFEAEIYVLTKDEGGRHTAFMSNYSPQFYFRTADVTGKIELLGDMKMVLPGDNVTANFELISPVPLEQGQRFALREGGRTVGAGVVSKVIS

SEQ ID NO: 3251 - DNA, 2264 bp, Panicum virgatum
  misc_feature: Ceres CLONE 1790182
  misc_feature: Encodes the peptide sequence at SEQ ID NO. 3252
gcttcaacccgcctgcctggcccccaacgttcaaaacccaggagccctcttttcttttctcctctttcttcctcatctttgataaaagccctgtaggctgtagctggaggcctcaattaccttccctcacgttctgcacccataatttaatcgccacagcctccattattttttcctctccgagctcaccctgtcgcctgccctggcctgtataatatatacttactctctcccaatcttgttctcgatctcccactgtcctcatctctgctagcttctctctcttagaggcggaggaagaagaagccgagggcagggcacaggaggagagagagaagaagcacagcgccaggaattgaattccaccgacccacgcacctctcagtcatccccttcccatttacctccacctatatagctctccataattccccgggcctcctctctctcttgttaggagtacagttctccttataattggacttgtccaaggcacccagcacctttcttcttcatcttcctccctctctctctctctctctatctgtccatccatcgacacacagccagccaccaagagccatgcaggaggagtagagtacaaccagagaaagagagttagctcgcagctccttgattccacccaccactgtcccttatttacaggcgttcgtgatcagcaacagctagtcgtcagctagagtgcagcaggcagagatagctagcagctagaaaaaaagggacctgtgtgcaccaagcaacccaacccagggaggagaagagagctagcgagctttcatttggccgatcgtttccgaggaacagagcaagcaggaattcacaaaggcgattgatcggagacagatggcgagcgccggattcgtggaggagatgatgagggagcagagcctcctggaggcgacctgcggcgacctgttcgaccacatcgacgacctgctcgacttccccaaggaggagtcctccgccgacgtgctcctcctggacgcgccggcgccgggaagcccgctctccgcgcgcatcatcgacgtcggcggcaatgcgccgcccgcgcccgctctggagccgctgatggcgctgcccccgcccgcggcgcaggaggacgacgccgccgcgggggcgcctgtgttcgacgccaaggacgttggcggccacattggctcgtgcgaggacctggacatggacatggcgcagctggagtggctgtcggggctcttcgacgacgcctccatcccgcacgagccggcgttcccgggggccacctgcgccgccccgatcaagagctccgcgctggcggccaacgccggcgtcgcgctgctgccgccggacaagatggaggacgcgctcttccgcagctccagccccatctcggtgctcgagcacaacagcttcaacgccaacaacaacgtgggctccgcgtcctcctcgtcctcctcggcgtcctcctcgtcagagtccttctccgggagcggcgggcacgcgtggtcggcgcccgtgtcgccgcgcccggagccgccggtgctcgtcataccggcgcgcgcgcggagcaagcgctcccgcccgtccgccttcacccccaccgcggaggcgcccaccatcctcgtgccgacgcccatgtactcgtccacctcctcgcactcggaccccgagagcatcgccgagtccaacccacaccaggcgccgcccaagaagaagaagaaggccaagaagccggcgcccccagcgccgaccgcctccgacgcggacggtgacaacgacggcgacgccgactacgaggaaggcggcgagcgctcgctgcctcagggcgccgttaggaggtgcacgcattgccagatcgagaagacaccgcagtggcgcgcgggtcccctgggccccaagacgctctgcaacgcctgcggcgtgcgctacaagtccgggcgcctcttcccggagtaccgccccgcggcgagccccaccttcgtgccgtccatccactccaactcccacaagaaggtggtggagatgcgccagaaggccgtccggagcggcgatccgtcctgcgacctcctgcagttcatccgccgccgggattaaatcgtcggtcggtctcgtcccccttagctatatatgtatacatgctagtatgtatgcatgcatggttgcttcatcagtagtcagtcgttgtcgtcgtcttcatcgtggttgtcatcatcatcatcaccgccatggatccacccatcttcacccaaaaaaaaaaaaaaaaaaaa

SEQ ID NO: 3252 - protein, 408 aa, Panicum virgatum
  misc_feature: Ceres CLONE 1790182
  misc_feature (1)..(36): Pfam Name: GATA Pfam Description: GATA zinc finger
MASAGFVEEMMREQSLLEATCGDLFDHIDDLLDFPKEESSADVLLLDAPAPGSPLSARIIDVGGNAPPAPALEPLMALPPPAAQEDDAAAGAPVFDAKDVGGHIGSCEDLDMDMAQLEWLSGLFDDASIPHEPAFPGATCAAPIKSSALAANAGVALLPPDKMEDALFRSSSPISVLEHNSFNANNNVGSASSSSSSASSSSESFSGSGGHAWSAPVSPRPEPPVLVIPARARSKRSRPSAFTPTAEAPTILVPTPMYSSTSSHSDPESIAESNPHQAPPKKKKKAKKPAPPAPTASDADGDNDGDADYEEGGERSLPQGAVRRCTHCQIEKTPQWRAGPLGPKTLCNACGVRYKSGRLFPEYRPAASPTFVPSIHSNSHKKVVEMRQKAVRSGDPSCDLLQFIRRRD

SEQ ID NO: 3253 - DNA, 1386 bp, Panicum virgatum
  misc_feature: Ceres CLONE 1790219
  misc_feature: Encodes the peptide sequence at SEQ ID NO. 3254
actcacctcaccagctaagtgcagtgctagctataagctgccgttgttcttgaggcaagcaaggtgcgatcgagagcgcgagatggaggcggccattcctctgctgacgccgtacaagatgggcgacttcgagctctcgcaccgggtggtgatggcgccgctgacgaggcagcgctcctacggcaacgtgccgcagccgcacgccgccgtctactactcgcagcgcgccaccaagggcggcttcatgatcaccgaggccacgggcgtctccgacacggcgcagggctacgccgacacccccggcatctggacggccgagcaggtgggcgcctggcgccccatcgtcgacgccgtccacgccaagggcgccgtcttcttctgccagctctggcacgtcggccgcgtctccaccaccgcgttccagcccggcggcgcggcgcccgtctccagcaccgaccgcgcggtgccgccgcagaggagcttcgacggccgcatggaggagttctccgcgccgcggcggctcgaggcgcgcgagatccccgccgtcgtggacgacttccgccgcgccgcgcggaacgccctcgacgccgggttcgaaggcgtcgagatccacggcgccaacggctacatcatcgagcagttcctcaaggacagcgccaacgaccgcgccgacgagtacggcggcagcctcgagcggcgctgccgcttcgcgctcgaggtcgtccaggccgtcgccggcgaggtcggcgcgcgccgcgtcggggtccgcctctcgcccttcacggactacatggactgccacgactccgacccggaggccctggcgagctacctcgtcggcaagctcagcgccgtcggcgtgctctactgccacatgatcgagccccggatggcgctggtggacgggcggcggcagatcccgcaccggctgctgccgtaccggaaggcgttccggggcaccttcatcgccgccggcgggtacgacagggcggaggggaacaagatggtgggcgaggggtacacggacctggtgtcctttggccggctgttcctggcgaacccgaacctccccaggaggttcgagctccccgacgcgccgctcaacaagtacgaccgcaccaccttctacacctccgaccccgtcgtcggctacaccgactacccgttcctcgacgacgtcgtccacgccgcctgatcgtcgtccatcgacatgcattataccagtcgtgttacatacacgtcctctgctcttccagcgtccttcaaattatcgaccccgcgcgtcgtcggcaaccttgtagtctgctgcttgattggttctgtgccatgttacgagtgacagacaggaggtgcaaaaaataaatcaagtttgatccgtaattttac

SEQ ID NO: 3254 - protein, 370 aa, Panicum virgatum
  misc_feature: Ceres CLONE 1790219
  misc_feature (1)..(332): Pfam Name: Oxidored_FMN Pfam Description: NADH:flavin oxidoreductase / NADH oxidase family
  misc_feature (4)..(364): SWISSPROT Homolog: EC 1.3.1.42 12-oxophytodienoate reductase 1
  misc_feature (4)..(364): SWISSPROT Homolog: EC 1.3.1.42 12-oxophytodienoate reductase 2
MEAAIPLLTPYKMGDFELSHRVVMAPLTRQRSYGNVPQPHAAVYYSQRATKGGFMITEATGVSDTAQGYADTPGIWTAEQVGAWRPIVDAVHAKGAVFFCQLWHVGRVSTTAFQPGGAAPVSSTDRAVPPQRSFDGRMEEFSAPRRLEAREIPAVVDDFRRAARNALDAGFEGVEIHGANGYIIEQFLKDSANDRADEYGGSLERRCRFALEVVQAVAGEVGARRVGVRLSPFTDYMDCHDSDPEALASYLVGKLSAVGVLYCHMIEPRMALVDGRRQIPHRLLPYRKAFRGTFIAAGGYDRAEGNKMVGEGYTDLVSFGRLFLANPNLPRRFELPDAPLNKYDRTTFYTSDPVVGYTDYPFLDDVVHAA

SEQ ID NO: 3255 - DNA, 2041 bp, Panicum virgatum
  misc_feature: Ceres CLONE 1790228
  misc_feature: Encodes the peptide sequence at SEQ ID NO. 3256
gtcggtccaaaccaaatccagcaccgctcgggctctcctccgcatcgcgcaccctatccacccccacaccccccttccaggctcaagtccccacccttccctctctcccgctccagacttcgaccaccgcaccggcgaactcggcgccgcacgccaggctggggatggccgccgcgctcgcgagctctccgctcgttcacctaaccgcctcccgcccccgcctccccagtccccgggcctccgtcgccagctccgccccaggctgctcgagaggcgtgtgcctgggatggaggctggcggcggggtggagggccgggaggcggtgcgaacggctccggtgctactcctccgacgggggcggcagggaggagggagagaagcggggcgaagaagaggcctcggcagccgcggccccaggggaggagctggggtccgagcggagccggtcggggagcttctcttcgtcgtcctcgtcggccgggactcctggtgtatcaagcgagccatcactgttgagttttagtgttgataatattgatacagttaaactgttggaacttctgggcccggaaaaggttgacccagctgatgtcaaggcaatcaaggaaaatctctttggctacacaacattctggttgacaaaagaagaaccttttggtgatcttggtgaaggagttcttttcattgggaatctccgtgggaaaagggaggaaatctttgcaaaacttcaacgacaactacgtgaacttactggtgacaaatacaatctttttatggtggaggaacccaattcagaaggggatgacccacgtgggggaccgcgtgttagttttggtttgcttaggaaggaagtttctgagcctggaccaactaccctatggcaatacgtcatttcattattactcttccttctcactatgttctcctgtgttgagctaggaatcgcatcaaagattagcagtcttccaccagaaatagtttcatattttactgatccaaatgctaccggaccccctcccgatatgcagcttttactcccatttgtggaatcggctttgccagtggcttatggcgtcttggctatccaaatatttcatgaaattgggcactttttagcagcatttccaaaaaatgtgaaactgagcattcctttcttcattccaaacttcacgctcggaacttttggtgcaattactcagttcaaatccattctgccagataagaagacaatgttcgacatatcaatggctggtcctgtggctggagctgcactttccttttcaatgttctttgtaggcttgctactctcttcaaatcctgttggggcaaatgatttagttgaagtacctagccagttattccagggttccttgctgcttgggcttattagcagagcaacacttggatacagagctatgcatgctgccacggtttcgatccatcctcttgtgattgcaggctggtgtggtttaactactactgcctttaatatgcttcctgttggatgtcttgatggtggaagagcattacagggggctttcggcaaggaggctttgtttggatttggcctcacaacatactcattgcttggactaggagtgcttggaggaccattatctcttacttggggcctatacgtgctaatatgtcagagaactcctgagaaaccatgcttgaacgatgttagcgatgtcggaacctggaggagggcagccttgatagcttcggtgtttcttgttgtattgactctcatcccattgtgggatgaacttgcggaggaactaggtgtagggcttgttacatcgttctgagatacagagtgctcactgatagaattaggccatgatgtagctcaattttgtatcaaaatcagtattagaagtgttgtaaaggaacatgccatccccatccgtgaatatgcgatgcgtctcgtgcaagttggttttgcacgaactgtaagccataatttgaaggcatcctgtgaatatgctgcagctactatatgcgattttgaatacgatgtgtgaacaaattttgtgac

SEQ ID NO: 3256 - protein, 548 aa, Panicum virgatum
  misc_feature: Ceres CLONE 1790228
  misc_feature (1)..(183): Pfam Name: Peptidase_M50 Pfam Description: Peptidase family M50
MAAALASSPLVHLTASRPRLPSPRASVASSAPGCSRGVCLGWRLAAGWRAGRRCERLRCYSSDGGGREEGEKRGEEEASAAAAPGEELGSERSRSGSFSSSSSSAGTPGVSSEPSLLSFSVDNIDTVKLLELLGPEKVDPADVKAIKENLFGYTTFWLTKEEPFGDLGEGVLFIGNLRGKREEIFAKLQRQLRELTGDKYNLFMVEEPNSEGDDPRGGPRVSFGLLRKEVSEPGPTTLWQYVISLLLFLLTMFSCVELGIASKISSLPPEIVSYFTDPNATGPPPDMQLLLPFVESALPVAYGVLAIQIFHEIGHFLAAFPKNVKLSIPFFIPNFTLGTFGAITQFKSILPDKKTMFDISMAGPVAGAALSFSMFFVGLLLSSNPVGANDLVEVPSQLFQGSLLLGLISRATLGYRAMHAATVSIHPLVIAGWCGLTTTAFNMLPVGCLDGGRALQGAFGKEALFGFGLTTYSLLGLGVLGGPLSLTWGLYVLICQRTPEKPCLNDVSDVGTWRRAALIASVFLVVLTLIPLWDELAEELGVGLVTSF

SEQ ID NO: 3257 - DNA, 2078 bp, Panicum virgatum
  misc_feature: Ceres CLONE 1790230
  misc_feature: Encodes the peptide sequence at SEQ ID NO. 3258
ggattttggctctggcagttcgtgctcacagcctgctcgcgcggctcgggccagggctctccgtcggtgatcgcccgatcagtgggtgcgccatccctgtcagccgcttgttctccgtccaatccatccatctccttgtcacgttcgaacgttcccttccaatccagctgcgtctcgtttttatatgtaacaacatagtatcatccgactggcgagtggattttgcagcggcgcggcgcgaaccgacactgtgctctctctgtactgtccgctcgtgctccctctgcctccagagcttgggcggagatggcgccggctgcgaggctgctgctggcgctgctcgcagcggcggcggcggcggtcgggccgtgcgccggcgccggggccggggccggccgcgtcgacctgtggccaatgccggcgtcggtggcccgcggggcgcagacgctcctcgtcagccgggacctcaagctgtccacgcccgggagcaactactccgacgggaggggcatcctcagggaggcgttccagcggatgctcgccgtcgtggagctcgaccacgtcgtcaacgggagctacggcggccggggctcgcccgtgctcgccggcgtccgcgtcgtcgtccgctcgcccaacgacgagctcaacttcggggtggacgaatcgtacaagctgtccgtgcctgcgaccgggaacccgctgtacgcgcagatcgaggctcaaacagttttcggagcacttcacgccttggagacgtttagccaattatgcaaatttgatttcaatgcaaggctgattgaacttcattcagctccttggactatcatggacgtgccgaggtttcattaccgggggcttcttattgatacttcaaggcactatcttcctgtcccagtgataaaaagtgtaattgattcaatgaccttcagtaaactgaacgttcttcattggcatatcgtggatgagcaatcatttccccttcaaataccttcatacccaaaattatggaatggtgcatactcttattcagagagatatacatttaatgatgctatcgacattgtacagtatgctgaaaaacgaggtgtgaatgtcttggctgagattgatgtacctggccatgctctctcatggggtgtcggatatccatcattgtggccatcagctacatgtaaagaaccgcttgatgtcagcaatgacttcacattccaagtgattaacggaattctatcagatttcggcaagatttttaagttcaagtttgtccatttaggaggagatgaagtaaacacaagttgctggactaccacaccacgcattaaatcatggttgattcagcatggcatgaatgaatctgatgcctacagatattttgtactgagagctcaaaagatagccatatcacatggttatgacattattaactgggaagagacatttaacaactttggagacaagttggatcgtaaaaccgtggtgcataactggcttggaagtggagttgcacagaaagtggttactgctggtctgagatgcattgtaagcaaccaggataagtggtacctagatcacctggatgctacatgggaaggattttacatgaatgaaccattgacaaatatctacaacccggaacagcagagattggttcttggtggtgaggtatgcatgtggggtgaacacatagatgcatcagacattcagcaaaccatttggccacgtgctgcagcagctgcagagcggctgtggactcccattgagaagcttgcaaaggacccgggatcagtcgctgcaagattggcacgcttcaggtgcttgctcaatcaaagaggggttgctgctgcaccgctagctggttatggtcgttcagcgccgtcggaaccaggctcctgtctaaggcagtagatattcatattaggtacatattattcatagaggaggaaaataaacatcatttcaggcatccaatttaccaccccgagcgattaagaggagctcggatcaatgtaaggctgaccaacagggttttctaatggcattccgtatctgatgttgtgcaaaaaaaaaaaaaaaaaaaa

SEQ ID NO: 3258 - protein, 532 aa, Panicum virgatum
  misc_feature: Ceres CLONE 1790230
  misc_feature (1)..(306): Pfam Name: Glyco_hydro_20 Pfam Description: Glycosyl hydrolase family 20, catalytic domain
MAPAARLLLALLAAAAAAVGPCAGAGAGAGRVDLWPMPASVARGAQTLLVSRDLKLSTPGSNYSDGRGILREAFQRMLAVVELDHVVNGSYGGRGSPVLAGVRVVVRSPNDELNFGVDESYKLSVPATGNPLYAQIEAQTVFGALHALETFSQLCKFDFNARLIELHSAPWTIMDVPRFHYRGLLIDTSRHYLPVPVIKSVIDSMTFSKLNVLHWHIVDEQSFPLQIPSYPKLWNGAYSYSERYTFNDAIDIVQYAEKRGVNVLAEIDVPGHALSWGVGYPSLWPSATCKEPLDVSNDFTFQVINGILSDFGKIFKFKFVHLGGDEVNTSCWTTTPRIKSWLIQHGMNESDAYRYFVLRAQKIAISHGYDIINWEETFNNFGDKLDRKTVVHNWLGSGVAQKVVTAGLRCIVSNQDKWYLDHLDATWEGFYMNEPLTNIYNPEQQRLVLGGEVCMWGEHIDASDIQQTIWPRAAAAAERLWTPIEKLAKDPGSVAARLARFRCLLNQRGVAAAPLAGYGRSAPSEPGSCLRQ

SEQ ID NO: 3259 - DNA, 1365 bp, Panicum virgatum
  misc_feature: Ceres CLONE 1790231
  misc_feature: Encodes the peptide sequence at SEQ ID NO. 3260
ccccgagattccatctcctccctttgctaccccagtccccagccgccgccctcgacgctgtcggcccgtgcggcgccctgcagtcctccacgctcccctacccagctgcagctcgagtccagctggtgcggcagcaccctcccttcccacgacttctctgttctttctctcggcctcggtcttcctttcctagcggcgatgacagggcgagttgcgctgcccgttgttcatcgatcgatgggggcttcgccggcgacgaacatccgacaaggggctagcagagggaagttttcattggcagccatcactctagatgattatcttccaatgagaagcactgaagtgaagaaccggacatcaacaggtgacatcaaaagtctcagactaattaccgctgtcaaaaccccctatttgccagatggaaggttcgatcttgaagcatatgattctctcataaacatgcagatagagggtggtgctgaaggtgtaattgttggaggaacaacaggagagggtcaccttatgagctgggatgaacatatcatgctcattgggcatacggtaaactgctttggcactagaattaaagtgattggcaacacaggaagtaactcaaccagagaggctgttcatgcaacagagcagggatttgctgttggcatgcatgcagctctccacatcaatccttactacggaaagacctcaattgatggaatgatatctcattttgaggccttcctcccaatgggcccgacaatcatctacaatgtgccatccaggactgcccaggatattccccctgaagttatcatggcaatttcggtctatccaaacatggcaggtgtcaaggaatgtgttgggcatgagagggttaagcactacacagacaaaggtatagcaatatggagtggtaatgatgatgaatgccatgattctaggtggcaatatggtgctactggagtcatttctgtggcaagtaaccttgttcctgggctcatgcacagcctcatgtacgaaggcgagaacacaaccctaaacgagaagcttttgcctctgatgaagtggttgttctgccagccaaatccaattgcgcttaacactgctctggctcagcttggggtggcacggcccgtcttcagattgccatatgtgccccttcctcttgaaaagagaattgagttcgtccggattgttgaggctattggaagggagaactttgtgggacagaaagaggcccggattctcgatgatgatgatttcgtgttgatcagtaggtactaggaagtgggtttgtccttctctctgtattttgatgaataaagccgagagtgtgcacgttgcgtttaaaaaaaaaaaaaaaaaaaa

SEQ ID NO: 3260 - protein, 360 aa, Panicum virgatum
  misc_feature: Ceres CLONE 1790231
  misc_feature (2)..(278): Pfam Name: DHDPS Pfam Description: Dihydrodipicolinate synthetase family
  misc_feature (13)..(360): SWISSPROT Homolog: EC 4.2.1.52 Dihydrodipicolinate synthase, chloroplast precursor
MTGRVALPVVHRSMGASPATNIRQGASRGKFSLAAITLDDYLPMRSTEVKNRTSTGDIKSLRLITAVKTPYLPDGRFDLEAYDSLINMQIEGGAEGVIVGGTTGEGHLMSWDEHIMLIGHTVNCFGTRIKVIGNTGSNSTREAVHATEQGFAVGMHAALHINPYYGKTSIDGMISHFEAFLPMGPTIIYNVPSRTAQDIPPEVIMAISVYPNMAGVKECVGHERVKHYTDKGIAIWSGNDDECHDSRWQYGATGVISVASNLVPGLMHSLMYEGENTTLNEKLLPLMKWLFCQPNPIALNTALAQLGVARPVFRLPYVPLPLEKRIEFVRIVEAIGRENFVGQKEARILDDDDFVLISRY

SEQ ID NO: 3261 - DNA, 2166 bp, Panicum virgatum
  misc_feature: Ceres CLONE 1790266
  misc_feature: Encodes the peptide sequence at SEQ ID NO. 3262
cccaattcctccgcttctcgatttcaccgcagcctttgcagccgagctcaatcgtctggttcaaatctcccttctctctctctctctctctctctctctctctctctctctccaagcgcaagcatctctctcttcctctctctcgcagcctcccttgttggttggttggttttcgcctccgatccaaaggcaagagagccatggcgctgatgacgctgcgttccaccacgtcgttcctgtcgcccgtcgaccccagctccaagctcctccacaagcccggcgccgacgacgcgccgccgagctgcgccgccgtgcccgccccgccccacgccgccgcgccgagccgcaggctgcgcctcgtcagggcgggcgccgccgcggcgcccgcgccggcggcggaccgcgcgccggccggggccgccgccgagctgctgcacgccggcggctcgggccaggaccacgggcacgcgcgcggcggggtccccgtctacgtgatgctgccgctggacacggtggggcccggcggccagctgtcgcggcagcgcgcggtggcggcgagtctgatggcgctgcggggcgccggggtggagggcgtcatggtggacgtctggtggggcgtcgtggagcgggagggccccggccgctacgactgggaggcctacgccgagctcgtgcgcatggtggagcgcgccggcctgcggctccaggccgtcatgtccttccaccagtgcggcggcaacgtcggcgacacctgcaacatccccttgccaccatgggtgctggaggagatgagcagcaacccggacatcgtgtacacggacaggtccggccggcgcaaccctgagtacatctccctcggctgcgacactctgccggtgctcaagggccggacccccatccaggtgtacaccgactacatgcgcagcttccgcgagaggttcagcgactacctcggcaacgtcatcgcggagatccaagtgggcatgggaccctgtggagagctgaggtatccttcctacccagaagccaacggaacctggcgtttccctggcatcggcgagttccagtgctacgataagtacatgcgagcgtcgctggaggcagcagcggtggccgcggggcgcgaggactggggcaggggcgggccgcacgacgccggcgagtacaagcagatgcccgaggagacgggctttttccggcacgacggcacttggagcaccgagtacggccggttctttttggaatggtactccggcatgctcctggagcacggcgaccgcgtcctggccgcggccgaggccgtgttcggcggcacgggcgccacgctctcggccaaggtcgccggcatccactggcactacgggacccggtcccacgcggcggagctcacggccgggtactacaacacgcggcaccgcaacgggtacgcgcccatcgcgcgcatgctagccaagcgcggcgccgtgctcaacttcacgtgcatggagatgaaggacgagcagcagccgcagcacgccaactgctcgcccgagcagctggtgcggcaggtcaaggccgccgcgggcgccgccggggtggagctcgccggcgagaacgcgctggagcggtacgacgaggcggccttctcgcaggtggtgtcgacggcgcgcggcgcggggctggccgcgttcacgtacctgcgcatgaataagacgctcttcgacggcgacaactggcggcagttcgtgtccttcgtcaggtccatggccgacggcggcacgaggccggcgctgccgcggtgcgacaccgggcactcggacctgtacgtcggcttcctcgacgcctccaaggagaggaaagcgccggaggccgagggcgccgccaccgccgtggcattgtaggccgtggtgccccaagccccatgcctgtgcgtgcggatcacacacatgcactgttgcaccgtgctgtggaatgtgtgttagggtacgcacaccggagaaggggaagtgtatagattcagggggcttgcaggttgcagagttttataggctgtaatcgagcaggtaggtaaaagcaggcaggcagtgtccagaaccagaccataggctgtcttgcgtttctttgtccatccgaaactgtattataaggagcagcttcgtgattgtacaaaaaaaaaaaaaaaaaaaa

SEQ ID NO: 3262 - protein, 559 aa, Panicum virgatum
  misc_feature: Ceres CLONE 1790266
  misc_feature (1)..(418): Pfam Name: Glyco_hydro_14 Pfam Description: Glycosyl hydrolase family 14
  misc_feature (94)..(517): SWISSPROT Homolog: EC 3.2.1.2 Beta-amylase
MALMTLRSTTSFLSPVDPSSKLLHKPGADDAPPSCAAVPAPPHAAAPSRRLRLVRAGAAAAPAPAADRAPAGAAAELLHAGGSGQDHGHARGGVPVYVMLPLDTVGPGGQLSRQRAVAASLMALRGAGVEGVMVDVWWGVVEREGPGRYDWEAYAELVRMVERAGLRLQAVMSFHQCGGNVGDTCNIPLPPWVLEEMSSNPDIVYTDRSGRRNPEYISLGCDTLPVLKGRTPIQVYTDYMRSFRERFSDYLGNVIAEIQVGMGPCGELRYPSYPEANGTWRFPGIGEFQCYDKYMRASLEAAAVAAGREDWGRGGPHDAGEYKQMPEETGFFRHDGTWSTEYGRFFLEWYSGMLLEHGDRVLAAAEAVFGGTGATLSAKVAGIHWHYGTRSHAAELTAGYYNTRHRNGYAPIARMLAKRGAVLNFTCMEMKDEQQPQHANCSPEQLVRQVKAAAGAAGVELAGENALERYDEAAFSQVVSTARGAGLAAFTYLRMNKTLFDGDNWRQFVSFVRSMADGGTRPALPRCDTGHSDLYVGFLDASKERKAPEAEGAATAVAL

SEQ ID NO: 3263 - DNA, 1568 bp, Panicum virgatum
  misc_feature: Ceres CLONE 1790278
  misc_feature: Encodes the peptide sequence at SEQ ID NO. 3264
cttgctggctcctctgtcgctgggacctccaccgccgtcgcagcccactgctccttggcccctgcagcggcggtgcggcggcttcttggctcctccgccgccgcttccccaatctcctgcgcgactgcgaccgtgacctccgccgccgtcgcggcagctgccgtcttcacattctctccagcgttgaatcccctttccttttctcccccatcccctccattgttcctcctccgtgccccttatttttctagccccttccgtttgctgcggtctccggcggcggcggcggcatcccagccatcccctctccaccccttccaccgacgcctctggcgtctggtcaggcggtcaccaccaccaccaccacaccaccgaccagctgccgcgttcccgggtcctcacacggccagcccacccggacccggaaacccgcgcgcgcgcgtattaataacggccacggccacctctctctctgttccgccctgtagtccacgcacagattcgttccacgcccccctctcccctcgcccgcgctcccagatctcgcacgcctcccgcaagggtatctttgagctatgggcacagttgtggatgctccagccgttgtgactgaggaggtcgctgagaacactttgggcggcaagaaagttacagtcgtatttgttctaggtggccctggaagtggaaaaggcacacagtgtgccaacattgtggagcactttggattcacccatcttagtgctggcgatcttttgcgcgcagagatcaaatctggctccgagaatggaaccatgattgagaacatgataaaggaaggaaagattgttccatcagaggtaactataaaactgttgcaggaggcaatgataaaaaatgaaaatgacaaatttctgatcgatggatttccaaggaacgaggagaatcgtgcggcatttgagaacgttactaaaatttctcctgcattcgtgctattctttgactgttccgaggaagagatggaaagacgtcttttggggcgcaaccaggggagagttgatgataacattgagactattaagaaaaggttcaaaacttttgtggaatcaagtctacctgtcatagagtattataactcaaaggacaaggttaaaaagattgatgctgcaaaaccaattcctgaagtgtttgaagatgtcaaaaccatttttgccccatatgcacccaaggctgaatagagcaatacaagggcaccataaaggtgatacgtggtgccataggcaccgctcaaacatatttgtgattatgaaccctttaatatagaagaaaagttttggttcatatgagctaccagcatatcagtaggcaattcgatttgttaccagcaataagtagatctgattcccaactgtcctgctagagtaactttttattgttgtcagtgtacccttcgatgttgtaccagtaccaatgtgtaatttactgcatggacgatgaaaaccttctgcctacccacacccaccagctatctggtggcattatggaaagtaaaactgttgccatattcttttacaaaaaaaaaaaaaaaaaaa

SEQ ID NO: 3264 - protein, 212 aa, Panicum virgatum
  misc_feature: Ceres CLONE 1790278
  misc_feature (1)..(154): Pfam Name: ADK Pfam Description: Adenylate kinase
  misc_feature (24)..(204): SWISSPROT Homolog: EC 2.7.4.14 Cytidylate kinase
  misc_feature (27)..(206): SWISSPROT Homolog: EC 2.7.4.3 Adenylate kinase
MGTVVDAPAVVTEEVAENTLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEEEMERRLLGRNQGRVDDNIETIKKRFKTFVESSLPVIEYYNSKDKVKKIDAAKPIPEVFEDVKTIFAPYAPKAE

SEQ ID NO: 3265 - DNA, 1954 bp, Panicum virgatum
  misc_feature: Ceres CLONE 1790299
  misc_feature: Encodes the peptide sequence at SEQ ID NO. 3266
gctgatcccctcccccgtcttttcccttgcaggtctcctcatcttcctccgtcttcgttttcttctcctcccttcccctatccgccgcttccccttcccccttttctctcaccgcccccagccccgtctcccagcgaattcgccgcgaggaccaggaatttcgtttggagaaaggagccattttttgtatccgtttctccggatccgcgacccgctgttgatttgttcgcccgttccattcggctcgatttagattcgttcatattcgttcttgctcgttcgattggggctagccgccgcccggatttctcgctgcgctgtgtggatctggtctctctgagcccccgccgccctgaatcccgatccgattcggctccgcccgcctcggcgcgttcggatctcgtcggactagaggggaatagaggctttctcgattcgtctcgggacgagatggatcatgtggtcgggggcaagttcaagctgggcaagaagatcgggagtggatcgttcggggagctcttcctcgctgtgaatgtgcagactggagaggaggtcgctgtcaagctggaaaatgtgaagacaaagcacccacagcttcattatgagtcgaagctctacatgcttctccaaggaggaactggcattccacacttgaagtggtttggtgttgagggggagtataatgtcatagtgatcgatcttcttgggcctagccttgaggacttattcaactactgtagcagaaagttctcgctgaagactgtgctcatgcttgcagatcaaatgattaatcgtgttgagtacatgcatcagaagggttttcttcaccgtgatataaagcctgataatttccttatggggcttggtaggaaagccaatcaggtgtatataatagactatgggcttgcaaagaaatatagggatcttcagactcacaagcacatcccctacagagagaacaagaacctcactggaactgcacgatatgcaagtgtcaatacgcaccttggcgttgagcaaagcaggagagatgatttagaatctctcggttatgtccttatttacttccttaggggcagcctaccatggcaggggctgaaagcaggaaccaagaaacagaaatatgacaaaatcagtgagaaaaagatgcttactcctgtggaggtactctgcaaatcatacccaacagagtttatttcctactttcactactgtcgttcattgcggtttgaagacaagcctgattattcttacctgaaaagactattccgcgatctcttcattcgggaaggataccagtttgattatgtgtttgactggaccattttgaaatatccccagataggttccaacccacggatgagggcaagtgaaagaactagtggagccgctggaccttctatggataagattgagaagaccccaggcgaagcgtccggtaggaggaatccaactggctctataaatcagagtgacaattatgcgcagcgaccacgtgagaccgtatctatgtcattaaaggaaatcatgcatagcacagaccggtctggggaaaggactgtggagagacctcgtacatcctctcgtacaggcagcgcatcaaggagagctatcgcgtcaagcagcaggccaggctcatctgtggaaccaagcgagcagcagtataaccggacaagcaggttgttctctagcaacagtggcagtcgtccatcaagcacccagagagtgaacccatcgccaggcgagtcaagggccacctccctttcacgggcagcagttgcgagaggctcccgtgatgagccgctccaccgcagcctggagcttctgtccctgggtggcggtaaaaggaaatgatggggagaagaaaacagaaaactctgtaaatgacaggatttcacctcctatttggcaacagttcccctggggcatcccataaaaaaaaaaaaaaaaaaaa

SEQ ID NO: 3266 - protein, 467 aa, Panicum virgatum
  misc_feature: Ceres CLONE 1790299
  misc_feature (1)..(409): SWISSPROT Homolog: EC 2.7.11.1 Casein kinase I isoform epsilon
  misc_feature (1)..(446): SWISSPROT Homolog: EC 2.7.11.1 Casein kinase I isoform delta-like
MDHVVGGKFKLGKKIGSGSFGELFLAVNVQTGEEVAVKLENVKTKHPQLHYESKLYMLLQGGTGIPHLKWFGVEGEYNVIVIDLLGPSLEDLFNYCSRKFSLKTVLMLADQMINRVEYMHQKGFLHRDIKPDNFLMGLGRKANQVYIIDYGLAKKYRDLQTHKHIPYRENKNLTGTARYASVNTHLGVEQSRRDDLESLGYVLIYFLRGSLPWQGLKAGTKKQKYDKISEKKMLTPVEVLCKSYPTEFISYFHYCRSLRFEDKPDYSYLKRLFRDLFIREGYQFDYVFDWTILKYPQIGSNPRMRASERTSGAAGPSMDKIEKTPGEASGRRNPTGSINQSDNYAQRPRETVSMSLKEIMHSTDRSGERTVERPRTSSRTGSASRRAIASSSRPGSSVEPSEQQYNRTSRLFSSNSGSRPSSTQRVNPSPGESRATSLSRAAVARGSRDEPLHRSLELLSLGGGKRK

SEQ ID NO: 3267 - DNA, 1878 bp, Panicum virgatum
  misc_feature: Ceres CLONE 1790311
  misc_feature: Encodes the peptide sequence at SEQ ID NO. 3268
ctcactaatcactacacagctgcggacttgtggtcaccgcagcgcaccactagctagaaaggatgggagccatggaggacgccgtcgtcgcagcagcggcttcctcgccggcgtcgccgtggagcctgctgctccagggcctcctcgccctgctcgccgtctgggcggcctaccgggccgcggagaggtgctggctgcggccgcggcggctggaccgggcactccgggcgcaggggctcggcggcacggagtaccgcttcccggcgggggacctcaaggagaccgtccggctcaacaaggaggcgcggtccaggcccatgccgctgtgccatgacatcgtcccccgcatcttgccgcacctcctaaacactgttaaggagcatggcagtatatgcatcacctggtttggcccaatccccagggtgatcatcacggaggcagagcaagtcagagacatcctatcaaacaagttcggtcacttccagaagttcagtaacaagcgtctggggaagttgctcgcctatgggcttgcgagtcacgagggagagaaatgggcaaagcacagaaggattctgaacccagcattccacgtggaaaagctcaagcgcatgatgccggcattctcgacgtgctgcaccgagctgatagatcgctgggagagcaaggtctctgatgcttctgacggatcgtacgaagtggatatctggccggagtttcagaacctcaccggagacgtgatctcccgcacggcgttcggcagcagcttcatagaagggcggcggatcttccagcttcagggagagcaagccgagcgagtcatcaaggccttccagtacatctacatcccaggcttcctgttcttgccgacacagaacaaccggaggatgaagcagatcaacggggagatcgaagggatcctgaggggtatgatcgagaagagggagcacgccatcgagaagggcgaggccagcggcaacgacctgctcggcctgctgctgcagtccaacatggacagcgggacaggcagcctgcggatgagcaccgaggacgtgatcgaggagtgcaagctcttctacttcgccgggatggagaccacgtcggtgctgctcacctggacgctcgtcgtcctcagcatgcaccccgagtggcagcaccgcgccagggaggaggtcctcggcgtgttcggcagggacggcaggcccagtttcgacagcctcagtcgactcaaaacggtgacgatgatactgtacgaggtgctcaggctgtacccgccggcggtgtcgctgaaccggaggacattcaaagacatgcggatcggtggcgtcacgtaccccgcaggggtgatcctggagctccccatcatcaccgttcaccacaaccccgacgtgtgggggaaggacgcgcttgagttcaggccggagaggttcgcggaggggatctccaaggcgaccaaggacgagttgccggcgttcttcccgttcgggtgggggccgaggatctgcatcggccagaacttcgcgctgctcgaggccaagatggccctgagcatgatccttcagcggtttgagttccaactgtcgccttcctacacgcatgcgccatacaccgtcatcacgctgcatcctcagcacggcgctccgattatagtcaagaagatctgatgatcgttgcttgagtgtgccacaaacccaaagtgcaaaaacttgtatgagtagtacatactgatactgcagtagctagggagttttgtgtatctgaactttgaggtggagataaacggcacgagatatatgcttgctgtaaaccaacctggtcggtgtatggtcctagccaataatgaattaccgcgttctttgccaaaaaaaaaaaaaaaaaaaa

SEQ ID NO: 3268 - protein, 532 aa, Panicum virgatum
  misc_feature: Ceres CLONE 1790311
  misc_feature: Great-hit functional homolog of the protein sequence encoded by LOCUS At3g14660
  misc_feature: Useful for making plants with modulated nitrogen use efficiency
MGAMEDAVVAAAASSPASPWSLLLQGLLALLAVWAAYRAAERCWLRPRRLDRALRAQGLGGTEYRFPAGDLKETVRLNKEARSRPMPLCHDIVPRILPHLLNTVKEHGSICITWFGPIPRVIITEAEQVRDILSNKFGHFQKFSNKRLGKLLAYGLASHEGEKWAKHRRILNPAFHVEKLKRMMPAFSTCCTELIDRWESKVSDASDGSYEVDIWPEFQNLTGDVISRTAFGSSFIEGRRIFQLQGEQAERVIKAFQYIYIPGFLFLPTQNNRRMKQINGEIEGILRGMIEKREHAIEKGEASGNDLLGLLLQSNMDSGTGSLRMSTEDVIEECKLFYFAGMETTSVLLTWTLVVLSMHPEWQHRAREEVLGVFGRDGRPSFDSLSRLKTVTMILYEVLRLYPPAVSLNRRTFKDMRIGGVTYPAGVILELPIITVHHNPDVWGKDALEFRPERFAEGISKATKDELPAFFPFGWGPRICIGQNFALLEAKMALSMILQRFEFQLSPSYTHAPYTVITLHPQHGAPIIVKKI

SEQ ID NO: 3269 - DNA, 1627 bp, Panicum virgatum
  misc_feature: Ceres CLONE 1790314
  misc_feature: Encodes the peptide sequence at SEQ ID NO. 3270
gccaccatctgcacgaaggaaaatggcacggtgggacgcgcttgtcgatgccgcgctagcgagtctggccgctaggaggctcctgttcaacacgcgcctcatctccctcacaccaccgctggcgccctccgaaaccttcgccggcccggagccctgggaccgcgacaccgtcgaggtccagatcgaccgcaactccctccagcaatggctcgccgcaaatggcgtggtgagcagccaagaagacgaggtgaacgggaaactggtccttttctccgggaacgactacatgtgcctcagctcgcatccggcagtccgtgaggctgcagtcaaggcagctcaggagtacggcatggggccgagaggctcctcgttgatctgtggctacacaacttaccacaaattggtggaggagtcactgacagaactgcagaaaaaagaagattgtctcctttgtcccaccggattttctgcaaacacggccgtcatgactgccctgggcagtatcagctctcttttatctgctgggagaaaacctgcaaaggatgagaggatagccattttctcagatgcgttgaaccatgcatcaactatcgatgggatccgccttgtggagagacagcaagaagccgtagcatttgtctacaggcaccgtgacatgtcgcatcttgattccctgctgtccagttgctcattggaaaggaaagtcgtcgtcaccgatagtatcttcagcatggatggtgatttcgctctgctgcctgaacttgtcaaattacgaagaaaatatggatttttgttgatcgtggatgatgcacatggaacacttgtttgcggtgagaacggtggtggtgtacctgagctgtttggatgtgaaaataacattgatatttgtctcggctcgttgagcaagggagttggttgccagggtggttttatagcatgcagtactccatggaagaggctaattttatcacgaggtcgctcattcatattttcgacttccttgccggtgcccgtagttgcttctgtgaatgcggcgatctatgtctcaaagaaagagatatggcgaagatcaactatttgggagcatgtgcggtattttgcttctttgaccaaacttgagataactagtcccatcattgtcattgtagttggaagtgaagaagcagctgtcagtgctcacaggcatcttctaagatctggatttcttgtccaaccaatacgaccacccgttgtgccacccaattcttctaggttgcgaattacccttagtgcagctcattcttcggatgacatcaaaaggcttgttgatgcgctcactccctggctccctattaatcatgctgatcagcaaagttacgctacatcttcaagactataaggattggaccatctactgttggtgtttgctcaagagccatatcttggggataattgtatcacttctgcatttgatataattttgagcaatgtgtttatttttttggcgaggagatggaacagtgcgtttattctctgtttgttggataattatcttttttacatcaatcaacaactgtgtgtgacttgtttgtaacgctctttatttaatttgtttgttatattattccaaaaaaaaaaaaaaaaaaaa

SEQ ID NO: 3270 - protein, 451 aa, Panicum virgatum
  misc_feature: Ceres CLONE 1790314
  misc_feature (2)..(354): Pfam Name: Aminotran_1_2 Pfam Description: Aminotransferase class I and II
MARWDALVDAALASLAARRLLFNTRLISLTPPLAPSETFAGPEPWDRDTVEVQIDRNSLQQWLAANGVVSSQEDEVNGKLVLFSGNDYMCLSSHPAVREAAVKAAQEYGMGPRGSSLICGYTTYHKLVEESLTELQKKEDCLLCPTGFSANTAVMTALGSISSLLSAGRKPAKDERIAIFSDALNHASTIDGIRLVERQQEAVAFVYRHRDMSHLDSLLSSCSLERKVVVTDSIFSMDGDFALLPELVKLRRKYGFLLIVDDAHGTLVCGENGGGVPELFGCENNIDICLGSLSKGVGCQGGFIACSTPWKRLILSRGRSFIFSTSLPVPVVASVNAAIYVSKKEIWRRSTIWEHVRYFASLTKLEITSPIIVIVVGSEEAAVSAHRHLLRSGFLVQPIRPPVVPPNSSRLRITLSAAHSSDDIKRLVDALTPWLPINHADQQSYATSSRL

SEQ ID NO: 3271 - DNA, 1662 bp, Panicum virgatum
  misc_feature: Ceres CLONE 1790335
  misc_feature: Encodes the peptide sequence at SEQ ID NO. 3272
agatcaactagaggtaagcaaagctcaaatctcaggcaaacgagaccagagcccttccctctccaatcctccccatcattcctctcgcttatgctcggcttcgtgttctgggaacccagcgcgtagatcttattcgtgcacgggaatctcctcgagctctccaacaattcaaccccaaaattcctttgcggcgcaatctttgaccccccgaatcttgggttgtagccaataagatgaacaaagacaaggctccgatgccggggaacggcggctccggggacggcttgccgccgcaggccacgcgccgtgccggagcgccgccctcgtcgtcgaccccgccgccggagttcgacatcagccgcatgccggacttccctacgcggaacgccggccaccggcgcgcgcactccgagatcctgagcctgcccgacgacctcgacctcagcgcccccggaggcggcgacgggccttcgctgtcggatgagaacgacgaggagttgttctccatgttccttgacgtggacaagctgaacgcgtcgtgcggagcatcgtcggaggccgaggctgagtcgtcgtccgcggcaggtggcggaggtgagggggctgagctgggccacgcgcctaggccaaggcatcagcacagccagtccatggacgggtccatgtcgatcaaggcggagcagctggcggcagcacagggaatggaggggatgtcgtctgcagaggcgaagaaagcagtgtctgcggcgaagctggctgagcttgctcttgttgacccaaagagggcaaaaaggatttgggctaatagacaatctgctgcaagatccaaggaaaggaagatgcgctatattgctgaactcgagcgcaaggttcaaactgtgcaaacagaagccacaacattgtcagctcagttggcattgctgcagagagataccactgggctaacaactgagaatagtgagttgaagatacggctgcagactatggaacaacaagtccacttgcaagatgccttgaacgacactctgaaagcggaggtccagcggctgaaggtggcaacaggacaggtggccaatggtggtggaagtatgatgatgaactttggcgccatgccacgcccatttgggggcaaccagcagatgttccagaacaaccaagggatgcaatccatgctggccactcagcagctgcagcagcttcagctccactctcagcctcagcagcaggcactgcgccctcagcaccagcagcagccactacacccgctgcaggtacaacagctgcagcaggcggcgagggacctcaagatgaaagggcatctgggctcccagggccagtggggagactggaagtctgggagcagtggtagttaagcagctggttctgaaagatttggtgtaagtggtggttagaagtgaagatggctgttttggggatggtgttgtgcaactgtagggatcattaactcagtcatctatctataggctcagttcagcttcagtttgtcgttaacctgattatctgtaagcacagttctgctgcaactacagacagtcggatgatcacatatgttttttttttttgcgaccgtgcctgagcatgtttttcattaagagagaaatgatcacagatgttcaactgcaaaaaaaaaaaaaaaaaaaa

SEQ ID NO: 3272 - protein, 379 aa, Panicum virgatum
  misc_feature: Ceres CLONE 1790335
  misc_feature (1)..(61): Pfam Name: bZIP_1 Pfam Description: bZIP transcription factor
  misc_feature (1)..(55): Pfam Name: bZIP_2 Pfam Description: Basic region leucine zipper
  misc_feature: The sequence is a functional homolog of  SEQ ID NO 1046 in the  10/225,066 US patent application
  misc_feature: The sequence is a functional homolog of  SEQ ID NO 2388 in the  10/374,780 US patent application
  misc_feature: The sequence is a functional homolog of  SEQ ID NO 412 in the  10/412,699 US patent application
  misc_feature: Useful for making plants with modulated growth and phenotype characteristics
MNKDKAPMPGNGGSGDGLPPQATRRAGAPPSSSTPPPEFDISRMPDFPTRNAGHRRAHSEILSLPDDLDLSAPGGGDGPSLSDENDEELFSMFLDVDKLNASCGASSEAEAESSSAAGGGGEGAELGHAPRPRHQHSQSMDGSMSIKAEQLAAAQGMEGMSSAEAKKAVSAAKLAELALVDPKRAKRIWANRQSAARSKERKMRYIAELERKVQTVQTEATTLSAQLALLQRDTTGLTTENSELKIRLQTMEQQVHLQDALNDTLKAEVQRLKVATGQVANGGGSMMMNFGAMPRPFGGNQQMFQNNQGMQSMLATQQLQQLQLHSQPQQQALRPQHQQQPLHPLQVQQLQQAARDLKMKGHLGSQGQWGDWKSGSSGS

SEQ ID NO: 3273 - DNA, 2232 bp, Panicum virgatum
  misc_feature: Ceres CLONE 1790340
  misc_feature: Encodes the peptide sequence at SEQ ID NO. 3274
gtttatcgcttctgcttgttttggagccatctttggcagtgttctttattgctatctagcagcctctttgctgtccttctcagccaatttactctcacctggggcctgggggcttgcatgccatcaatgctcccctgaggtgtttatcatgtgaacatctgcattttgctatcacgggaaatcccctctcatggtccactgtattctgtaggtggagtttggctggacttcatttattcccaaagattcgagcttttggagctttaataggtcacaactcacaactcacaaattctcctggcgcttgaggaaactttggccgccccctcgggaggagctcttgcaattctagaggcttcgagaatttcaacttttttttaggcttcgagagctcaagagttggatttctgaaaccattctagaggtttgctctcgccgatttccaagatttcttctttatctcttcgtttccaagatctgagcttgaggattctttctgcaaagcagagcaatccacctaaaccgtcctaagatttggagctggaataatccaccgatgggttccgggttcggccatggagcggcggcggtggccgtggcgctggtttcttggctgtgcttcgcttcagcgggcgtcggcgcgataggggcgaactggggcacgcagacgagccacccgctcccgccggacacggtggtgcggatgctcaaggacaacgggttccagaaggtgaagctgttcgacgccgaggagggcaccatgaacgccctcaagaagagcgggctggaggtgatggtcggcatccccaacgacatgctgctgacgatggcctccaacataaagtccgccgagaagtgggtgtacacgaacgtctccagctacctcaacgacggcgtcaacatccggtacgttgcagttgggaatgagccatttttggagacatacaatggaagctttctgcaaaccacttatcccgccatcagaaacattcaaagtgcacttataaaggctggtttgggcaatcaagttagagtcacatgccctctgaatgccgatgtctatgcatcaccaaccaccaagccttctgacggggacttccgcacagatattcatgatctgatgatcgctattgtaaaattgctcagcgacaatggtggagctttcactgtcaacatataccctttcataagcctctacattgatccaaatttccctgtggactatgccttctttgaaggggcctcgtcacccattgttgatggttccattacttacacaaacatgttcgatgcgaaccatgacacacttatatgggctctgaaaaagaatggctttggaaacctcccagtcattgttggggagatcggatggcctactgatggggacaggaacgctaatgctcagatggctcagcgcttcaaccaaggcttcatgactcatattgcctctggtcgaggaacgccgatgcggcctggacctgttgatgcttacttgttcagtctaattgacgaggacgagaagagcatccaaccaggaaattttgagcggcactggggtatctttacttatgacggatggccaaaataccaactgaatctcgggacagcaaattcaggcggccttgtgagagcaaagggcgtgaagtaccttgaaaagaagtggtgtgtactgaagccttcagtgcccctcaacgatccgaagatcgcagacaatgtgggttatgcatgttccatggcagactgtaccagccttggttataagacttcatgcgggatgctggacgaaagtggtaacatctcatatgcgttcaacaactactaccagaagaacgaccaagatgatgttgcctgtgggtttcaaaacctcgcgaccaccaccggccaagaccccagcactgggacatgcagatttggtatcatgatagaggtcgactctgccttctcattggggctgcagcggcttggaagcaacttcttcttgatgctcctgcttgtgcttctccagctatgcctgtcgttctcataaatgcttgttttctggagatgagcataaaagtataaacaatctgacagcttgaggatatttgatgtctgttgtcagtatcattcatgtaggaaccttttttgtttaaccttttttcttctcttctgaaggaaattgcggacagcggttccatccatgcttggattattgttaggttagatttgatccaaaaaaaaaaaaaaaaaaaa

SEQ ID NO: 3274 - protein, 489 aa, Panicum virgatum
  misc_feature: Ceres CLONE 1790340
  misc_feature: Great-hit functional homolog of the protein sequence encoded by LOCUS At5g58090
  misc_feature (1)..(320): Pfam Name: Glyco_hydro_17 Pfam Description: Glycosyl hydrolases family 17
  misc_feature: Useful for making plants with altered cell wall content and/or composition
MGSGFGHGAAAVAVALVSWLCFASAGVGAIGANWGTQTSHPLPPDTVVRMLKDNGFQKVKLFDAEEGTMNALKKSGLEVMVGIPNDMLLTMASNIKSAEKWVYTNVSSYLNDGVNIRYVAVGNEPFLETYNGSFLQTTYPAIRNIQSALIKAGLGNQVRVTCPLNADVYASPTTKPSDGDFRTDIHDLMIAIVKLLSDNGGAFTVNIYPFISLYIDPNFPVDYAFFEGASSPIVDGSITYTNMFDANHDTLIWALKKNGFGNLPVIVGEIGWPTDGDRNANAQMAQRFNQGFMTHIASGRGTPMRPGPVDAYLFSLIDEDEKSIQPGNFERHWGIFTYDGWPKYQLNLGTANSGGLVRAKGVKYLEKKWCVLKPSVPLNDPKIADNVGYACSMADCTSLGYKTSCGMLDESGNISYAFNNYYQKNDQDDVACGFQNLATTTGQDPSTGTCRFGIMIEVDSAFSLGLQRLGSNFFLMLLLVLLQLCLSFS

SEQ ID NO: 3275 - DNA, 2939 bp, Panicum virgatum
  misc_feature: Ceres CLONE 1790374
  misc_feature: Encodes the peptide sequence at SEQ ID NO. 3276
aacccatccattccacctccgttcaccccgtccatttgatttgcgtttagtgcgttgcgtttcttgggtctgcctctctttgggaggagcgcgcctccttccattggcactcctgttctccgctcggagaaaggcttgaggacccaagaagaggatagcaatgggggaagctgccggcgaccgcgtcctgagccgcctccacagcgtcagggagcgcatcggtgactccctatctgctcaccccaatgagctcatcgctgtcttcaccaggctgaaaaaccttgaaaagggcatgctgcagccccaccagatcattgctgagtacaacagcgctatccctgaggctgagcgcgagaagctgaaggatggtgcctttgagaacgtcctgagagcagctcaggaagctattgttatccccccatgggttgcactggccatccgccctaggcctggtgtctgggagtatgtgagggtcaatgtcagcgagctcgctgttgaggagctgagagtccctgagtacctgcagttcaaggaacagcttgtggaagaaggccccaataacaactttgttcttgagctggactttgagccattcaatgcgtccttccctcgtccttctctgtccaagtccattggcaatggtgtgcagttcctcaacaggcacctgtcgtcaaagctcttccatgacaaggagagcatgtaccccctgctcaacttccttcgcgcccacaactacaaggggatgaccatgatgttgaatgacagaatccgcagcctcagtgctctgcaaggcgctctgaggaaggctgaggagcatctgtccagccttccagctgataccccatactctgacttccaccacaggttccaggagcttggtctggagaagggttggggtgactgcgctaagcgtgcgcaggagactattcacctcctcttggaccttcttgaggccccagatccgtccaccctggagaagttccttgggactatccccatggtgttcaatgttgttatcctctccccccatggttacttcgctcaagctaatgtcttgggttaccctgacactggaggccaggttgtctacattttggatcaagtccgcgctatggagaatgaaatgcttctgaggatcaagcagtgcggtcttgacatcacaccaaagatccttattgtcaccaggttgctccctgatgcaactggcaccacctgtggccagcgtctcgagaaggtccttggcactgagcactgccatatccttcgtgtgccattcagaactgagaatggaattgttcgcaagtggatctcacgttttgaagtctggccatacctggagacttacaccgatgacgtggcacacgagattgctggagagcttcaggccaatcctgacctgatcatcggtaactacagtgatggaaaccttgttgcatgtttgcttgcgcacaagatgggtgttactcactgtaccattgcccacgctcttgagaaaactcagtaccccaactctgacctctactggaagaagtttgaggaccactaccacttctcgtgccagttcaccactgacttgatcgctatgaaccacgctgacttcatcatcaccagtaccttccaagagattgctggaaacaaggacaccgtcggtcagtacgagtcacacatggcattcacaatgcctggcctctaccgtgtcgtccatggtatcgatgtgtttgaccctaagttcaacattgtctcccctggtgcggacatgtccatctacttcccttacactgagtcacacaagaggctgacctccctccaccctgagatcgaggagctcctctacagccaaaccgagaacaacgagcacaagttcgtgctgaacgacaggaacaagcccatcatcttctccatggctcgtcttgaccgtgtcaagaacttgactggtctggtcgagctctacggccggaacaagcgtctgcaggagctggtcaaccttgtggtggtctgcggtgaccacggcaacccgtccaaggacaaggaggagcaggccgagttcaagaagatgttcgacctcatcgagcagtacaacctgaacgggcacatccgctggatctctgcccagatgaaccgtgtccgcaacggtgagctctaccgctacatctgcgacacccagggcgccttcgtgcagcctgctttctacgaggccttcggtctgacggtggtcgaggccatgacctgcggcctgcccacgttcgccactgcctacggtggcccggctgagatcatcgtgcacggcgtctccggctaccacatcgacccgtaccagggcgacaaggcctcggcgctgctggtggacttcttcgagaagtgcaaggaggactcgagccactggagcatgatctcgcagggcggcctccagcgcatcgaggagaagtacacatggaagctctactcggagaggctgatgaccctgacgggcgtgtacgggttctggaagtacgtgtccaacctggagaggcgcgagacccggcggtacctggagatgctgtacgcgctcaagtaccgcaccatggccagcacggtgccgctggccgtggagggagagccctccagcaagtgaggcgccggggcctgaatgaaaggagcagggagcacttggagtcgtgtctttttcctgggtttccttcctcattcggaggcgaaaaaagaagagtttgcatttcgtaggcgggctttcttcaagaatttaaggtcgaccttcttccattgatgtgggtgctgctgctagtttgagttgattcagtagttgggggatggatggggtgtgtcagtgtgcagttggtcatgggtgctcccttgtttcctgggtggatggatggatgttgctccttcaataaaacgcagcggcctcacttggcgccgtttccgaaaaaaaaaaaaaaaaaaaa

SEQ ID NO: 3276 - protein, 816 aa, Panicum virgatum
  misc_feature: Ceres CLONE 1790374
  misc_feature: Great-hit functional homolog of the protein sequence encoded by LOCUS At3g43190
  misc_feature: Great-hit functional homolog of the protein sequence encoded by LOCUS At5g20830
  misc_feature (1)..(549): Pfam Name: Sucrose_synth Pfam Description: Sucrose synthase
  misc_feature (1)..(816): SWISSPROT Homolog: EC 2.4.1.13 Sucrose synthase 2
  misc_feature: Useful for making plants with altered cell wall content and/or composition
MGEAAGDRVLSRLHSVRERIGDSLSAHPNELIAVFTRLKNLEKGMLQPHQIIAEYNSAIPEAEREKLKDGAFENVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSSLPADTPYSDFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTQYPNSDLYWKKFEDHYHFSCQFTTDLIAMNHADFIITSTFQEIAGNKDTVGQYESHMAFTMPGLYRVVHGIDVFDPKFNIVSPGADMSIYFPYTESHKRLTSLHPEIEELLYSQTENNEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTQGAFVQPAFYEAFGLTVVEAMTCGLPTFATAYGGPAEIIVHGVSGYHIDPYQGDKASALLVDFFEKCKEDSSHWSMISQGGLQRIEEKYTWKLYSERLMTLTGVYGFWKYVSNLERRETRRYLEMLYALKYRTMASTVPLAVEGEPSSK

SEQ ID NO: 3277 - DNA, 1769 bp, Panicum virgatum
  misc_feature: Ceres CLONE 1790392
  misc_feature: Encodes the peptide sequence at SEQ ID NO. 3278
atcctgtactctccgctacaaatctcacttgccttcctcctctaaaaccgccatgagagcgcgcacggcgctcccaggttccgtcctcccgccttgtcgcttccgctcgtgccgagcacccgcgctctcggcgcggtctcgcgactgaaaagccatgtccgtcgcgggcgccgccgacaaggtgatgccaccgccggcgtgcgacttctgcgccggcctgccggcggtggtgtactgccggggcgactccgccaggctctgcctgccgtgcgaccgccacgtccacggcgccaacacggtgtccagccgccacgcccgggcgccgctctgcgccgcgtgccgcgccgccgcggccgcgttccgccgcggcggcgccgtcttcctctgcgcaaactgcgacttcgaggaggagcgccagcgggacgacgacccgcggccgctccacgatcgtggcgcggtggaaagctacgccggctgcccctccatcgcggagctcgccgcgatcctcggcgtcggcgggtgcgagaaggcggaggccgcggccgggcacgggcacggggacgggtggtggcccgcctgggaggagccacaggttctccgcctggaggacgtgatcgtgcccaccacctcctgccatggcctccagccgctcctcacgccatcctccccaaagaacccgagctccggcgggaagctgaccgaagaggtaatccggcagctgggggagctcgccaagtccgaggcggcggcgatggctttctcggaggcggagccagccgacggtgagcagctgccttcgtgggcttcgtcagagtacggcgatttcggggctttcgacaacgatgcttgccatgaggcagcaagcatggccgtgccttcttgtgagcaggaagcgtgggtcgcgaccgacggcgacggcggcgcgtgcagggaggcgcgcgagcaagcgccggcgccggcgagctcgttggccgagccgtgcctgctgtcctcgttcgtggagatgtcagagatctgccccagcatgaccctccgcagcagcagcgtcggcgtcgacagcggcagcaggaagcgagacgccgccgaagcggccccgcagcaggcctcgccggcgccggcgaagaagggcggctacgacgtggcctaccccgaccgcggcacggtgatctcgcgctacaaggagaagcggaagaacaggaggttcgacaagcagatccggtacgagtcgcgcaaggcccgcgccgacggccggcttcggatcaagggccggttcgccaagtccggcgaggcctgatggcatcgagggatgcttggcggcgaatggggcgatcgaccgatggtgacctcggcagctagggtgggccgggcacggcggagaagggggaccgtggggccggcacgtgcgtgcgtggcagagctcggcccgtgttgttggtgccattgaagacgatgatgctctgttgtgcgacttgcgctcagaaataatcagccaccactatgttgttttcctggttttgtttcctggtgacgcaccactatttgtctaagcagcgagcctgcatgttcccatcccaacgacaattccacgcagggactaggagcaactccaacagattgattttttttttccttttctcatcttacagaggaatccctcgtcacaattttagtttattggtgagatgtgctctagtaaattgatttttccctttcctctttaattcataagtgaactggatcttttcatgcaaaaaaaaaaaaaaaaaaaa

SEQ ID NO: 3278 - protein, 379 aa, Panicum virgatum
  misc_feature: Ceres CLONE 1790392
  misc_feature (6)..(48): Pfam Name: zf-B_box Pfam Description: B-box zinc finger
MSVAGAADKVMPPPACDFCAGLPAVVYCRGDSARLCLPCDRHVHGANTVSSRHARAPLCAACRAAAAAFRRGGAVFLCANCDFEEERQRDDDPRPLHDRGAVESYAGCPSIAELAAILGVGGCEKAEAAAGHGHGDGWWPAWEEPQVLRLEDVIVPTTSCHGLQPLLTPSSPKNPSSGGKLTEEVIRQLGELAKSEAAAMAFSEAEPADGEQLPSWASSEYGDFGAFDNDACHEAASMAVPSCEQEAWVATDGDGGACREAREQAPAPASSLAEPCLLSSFVEMSEICPSMTLRSSSVGVDSGSRKRDAAEAAPQQASPAPAKKGGYDVAYPDRGTVISRYKEKRKNRRFDKQIRYESRKARADGRLRIKGRFAKSGEA

SEQ ID NO: 3279 - DNA, 1895 bp, Panicum virgatum
  misc_feature: Ceres CLONE 1790408
  misc_feature: Encodes the peptide sequence at SEQ ID NO. 3280
agcgacgtcaccgcttctccgtcgccaccgtcgccctcccatccaatccagcagccgccccttccctataacagctagctcctcgccagtcgggcgccctccgcctgccgcccgtgcatcgaggagagcttggggaccggccggcgcggaagggatcgagatcgaccccccggagttgagttcccatggcttctgaatcaggggacggcaactgcgatgcttgggcagcgagagatccttctggagttctctcaccgtacaaatttaaccgcagggcagtgcaaagtgacgatgtttcattgaagatcacacactgtggagtctgttatgctgacgttatttggacacaaaataggctcaatgattcgaaatatccgttggttcctgggcatgagatagcaggagttgtaaccgaggtcggttcagacgtcaaaggctttaaagtgggtgaccatgtaggtgttggaacctatgtgaactcatgccgagattgtgagaattgcaatagctctctagagaaccactgcccaagatcagtttatactttcaatggcattgatacagatggcactgtcacaaaagggggttactccactcacattgtagtccatgaaaggtactgcttcaaaataccagatggctaccctttggcaaaggcagcacctcttttatgtgctggaatcactgtgtatactccaatgatgcgacacaacatgaaccaacctggaaaatcactaggggtcattggactaggtgggctgggtcacatggcagtgaaatttggtaaagcctttggtcttaaggtcacagttttcagtacaagtgaatccaagagagatgaagccatcaacctccttggagcagataattttgttatatcatcaaacacacagcagatggagtccctgaaaaactctctgcacttcatagttgacactgcttctggtgaccatgcatttgatccgtatctctcactccttaaggttggtggtgtgatggcaatagtgtgctttccaagtgagatcaaagtgcatcctgcaagccttaatattggtgcacgtaccttgtctggcagtattactggaggtacaaaagacatccaagaaatggttaacttctgtgcagcaaacaaaatctatccagaggttgagatcatcaagatagattatatcaatgaggctctcacaaggctcgtcaatcgagatgtgaaataccgcttcgtaatcgacatagagaactctttcaagtagcatgcctcattttcatgatctaatctttctgtcgatgtatgagcaagcgtgggaatcatgttggaaaaacttgatgtaattccgcattggatttgtattattcttatttgcaccacaccccaaccgtcctccaaggatgcgtgttcaattgaacgttgctatgcccaccatgtccgcaaggtctttccttcgcgcggccatgttgctgctggtccagctggctggcatctacctcgcacacgcaacgcatccccggagctgtagtacctcagaccccaatgcaccctgccgccctccaggccctccaaattagcagtgttctcggccaccgtgttagaattcttggttgtcaggactcaggatctgagtagggttgcaatccacgttttcaagccggtgagaaaggctgacttcagtgggaatgagttcacaggtttatttccttatctctctgcgcatgcatgattgtgagataaaaatatatctttcctggtccaccttccatgggtccaggcttgtgtcatgtacagtgggtacagtttcgtaaaaatttgtgagtggttaaatcttcaatgtaaagtgaataaaatatattattttgatacttcatgtgtgtatctagaatattttttcctttttttcttg

SEQ ID NO: 3280 - protein, 354 aa, Panicum virgatum
  misc_feature: Ceres CLONE 1790408
  misc_feature: Great-hit functional homolog of the protein sequence encoded by LOCUS At1g72680
  misc_feature (1)..(116): Pfam Name: ADH_N Pfam Description: Alcohol dehydrogenase GroES-like domain
  misc_feature: Useful for making plants with altered cell wall content and/or composition
MASESGDGNCDAWAARDPSGVLSPYKFNRRAVQSDDVSLKITHCGVCYADVIWTQNRLNDSKYPLVPGHEIAGVVTEVGSDVKGFKVGDHVGVGTYVNSCRDCENCNSSLENHCPRSVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFSTSESKRDEAINLLGADNFVISSNTQQMESLKNSLHFIVDTASGDHAFDPYLSLLKVGGVMAIVCFPSEIKVHPASLNIGARTLSGSITGGTKDIQEMVNFCAANKIYPEVEIIKIDYINEALTRLVNRDVKYRFVIDIENSFK

SEQ ID NO: 3281 - DNA, 1583 bp, Panicum virgatum
  misc_feature: Ceres CLONE 1790409
  misc_feature: Encodes the peptide sequence at SEQ ID NO. 3282
agcaccagcctcgccggcgcgcgctaaaaccctaacccctccgcgcctccgcctcctctccgccgcgcgaccgccccccacccgcgaggagaacgaaggccggggtcgagatggagcgagacaagacccggcgtctctccggcagccgccacctccggcagcggctggtgctggcgacgctcacctccaccggcgtcaccatcgatgacatccgctccggggacgccgcgccggggctccgcccgtacgaggtctccctcctacgcctcctggacaaaatctccgaccgccacaccatcgacctcaacgagacaggaacgaagctgaagtacatgcccggggtgattcaaggcgggaagggccttgagcacgactgcggggtgcaccgggggatcggctacttcctcgagccgctcatactgctcggcttgttcgcgaaggcgcccatatcgattcggctgaaaggaatcactaatgatacaaaggacccttctgtggatactttccggatgacaaccttgcatatgctcaagcattttggtgttcctttggagggtttggagctaaagattgatagccgaggatctcctccccttggcggtggtgaagtgttcctccgagttcccaatataaatagcacactaacggcagcaaactgggttgatgaaggtatggtgaagaggataaggggtgtttcattctctactagagtatctccacagattgaaagccggattatatatgctgcacgtggaatcttcaatcgcttcattcctgatgttcatatattcactgatcatagatctggtgcttctggtggaaggtcaccaggctatggtgtatcgttagttgctgagaccacaacaggctgcctgctctctgtagatgccactgtgagttatcctagtgttgatgaaataaatgaagaatcagagaagccagagctgatgtctccagaggatcttggtgttcaagctgcatcaatgctactagaagaggtggctcaaggaggggttgttgactctacacatcagggcctcctatttatcctgtgtgctttatgcccagccgacgtatcaaaggttcgtgttggacagctgactccgcatggtatagaaacacttcgaaacatcagggattttcttaacgtcatgtttgttatcaagcctgatcctaattcaaacactgtcacattaaaatgtgtcggtgcgggagtgaagaatattgctcggaagagttcataagcaacaggattatgaatctcgtcatggattgagggcacagcaagagactaccgtgagatcctgtttgtagctgcgaaacagaaaggagtttcctttgtctactcctactgaattttttgttctgaggtgcatgacatatcctactctctgatgccattttgatatctcagtcggtggtagtagaatgtatttttcttatgtgtgcgcaacattttctgtatcccatagctttatccagcaactatttttcagtttctacttgccgagacctgctggcacatatgaatgaaaaatatgcaaacatctaggctgttttagcaaaaaaaaaaaaaaaaaaaa

SEQ ID NO: 3282 - protein, 377 aa, Panicum virgatum
  misc_feature: Ceres CLONE 1790409
  misc_feature (1)..(345): Pfam Name: RTC Pfam Description: RNA 3'-terminal phosphate cyclase
MERDKTRRLSGSRHLRQRLVLATLTSTGVTIDDIRSGDAAPGLRPYEVSLLRLLDKISDRHTIDLNETGTKLKYMPGVIQGGKGLEHDCGVHRGIGYFLEPLILLGLFAKAPISIRLKGITNDTKDPSVDTFRMTTLHMLKHFGVPLEGLELKIDSRGSPPLGGGEVFLRVPNINSTLTAANWVDEGMVKRIRGVSFSTRVSPQIESRIIYAARGIFNRFIPDVHIFTDHRSGASGGRSPGYGVSLVAETTTGCLLSVDATVSYPSVDEINEESEKPELMSPEDLGVQAASMLLEEVAQGGVVDSTHQGLLFILCALCPADVSKVRVGQLTPHGIETLRNIRDFLNVMFVIKPDPNSNTVTLKCVGAGVKNIARKSS

SEQ ID NO: 3283 - DNA, 1270 bp, Panicum virgatum
  misc_feature: Ceres CLONE 1790413
  misc_feature: Encodes the peptide sequence at SEQ ID NO. 3284
aacccaaaggtgaaaggccccccaatcgaacccctccagtcctctccccatggcggccacgctcttctccgcctccctctcgccccagttcctctccctctccgccaagcgcaaccccgcaaccccgtcagccaccgcgaccttcccctcgggggcgccgcagctccgcgcgctctccgtggcggcggcatggaggccgctcgcgcccgtgcgcgcggccgcagccgtggcggaggagctcgatgcggaggggctggccggcggggaggaggaggaggaggagttctccgcggatctcaggatcttcgtcggcaacctgcccttcagcgtcgacagcgcccagctcgcgggactcttcgagcaggctggctccgtcgagatggtcgaggtcatctatgacaaattaaccggaaaaagccgaggattcgggtttgtgataatgtcttctgtccaagaagttgaggctgctgttgagcaattcaatggctatgtgcttgatggaagaagtttgagggtgaattcaggcccagcaccacccagggagcagtcctcaccaagagggcccagaggcgaagccaatagggtctatgtgggcaacctttcatggggtgtggacaactcagctctcgctaacctgttcaacgagcaaggtgaggtcctggaagccagggtcatctacgacagggagagtgggaggtcaagagggtttggttttgtcacgtatggctcctccgaagaggtggagaatgcaatttcgaaccttgatggcactgaactcgatggcagacggatccgtgtgacggtagccgagtcgagaccgcctaggcaacagtactgaaattccacttcagaaactgctcagaatgaattgtagtatggactgtagtatcgccggtcttattcttcaggattgttagctgtagtatctccaccaaccaaccattcatggtctggtcttgaccatcactgagcatataaagttctcatggttcaatacacttatgcgcacttgtaaaacagaggattcccaggctcagtagccctttatactgcaattggctttttattaaaaaaaaaactgcaattggctgcattatatggtgtctgatctctgatgtcgtatgtcttcttcgccaactcgaactctgtacgactgtacctgtacgttatgagcagctggacggccaccagcaacagccagcagagtgagaatgtctggtggctggtccgtggtgggggctgattcctccaaaaaaaaaaaaaaaaaaaa

SEQ ID NO: 3284 - protein, 262 aa, Panicum virgatum
  misc_feature: Ceres CLONE 1790413
  misc_feature: Great-hit functional homolog of the protein sequence given in SEQ ID NO 9213
  misc_feature: Useful for making plants with modulated biomass
  misc_feature: Useful for making plants with modulated nitrogen use efficiency
  misc_feature: The plant is abnormally small.
MAATLFSASLSPQFLSLSAKRNPATPSATATFPSGAPQLRALSVAAAWRPLAPVRAAAAVAEELDAEGLAGGEEEEEEFSADLRIFVGNLPFSVDSAQLAGLFEQAGSVEMVEVIYDKLTGKSRGFGFVIMSSVQEVEAAVEQFNGYVLDGRSLRVNSGPAPPREQSSPRGPRGEANRVYVGNLSWGVDNSALANLFNEQGEVLEARVIYDRESGRSRGFGFVTYGSSEEVENAISNLDGTELDGRRIRVTVAESRPPRQQY

SEQ ID NO: 3285 - DNA, 1812 bp, Panicum virgatum
  misc_feature: Ceres CLONE 1790416
  misc_feature: Encodes the peptide sequence at SEQ ID NO. 3286
gcgcggctcctcccttcttcttctcttcccccctcggcttcgaggggtttttttctctttgtttctttccttttttttttctttttttttattttttttcttttcgttttttttggttcctcctccccgtcggggttttcggccccgacgaaaccctaataaccggcggggggcaatcgccggcggcatgcaccagcagcggatgaagcaggccgcagcggcggcggcggcgcagcagcagcagctgatgcagcaggcgctgctcctgcagcagcagcagcagcagcagcagcaggcgcagccgcccttgttccccgggcaccacccgcaccccggcctcctcgccgcgccgcagatagagcccatagttagcggaaaccttcctcctgggtttgattcaagtacatgccgcagcgtgtatgttggcaatatccatcttcaagtgacggacacgttactgcatgaagtcttccaaagtattggtccagtagaaggttgcaagctcatcagaaaagaaaagtcgtcttttggtttcattgactactatgaccgccgatctgctgcactagcaattttatctctcaacggcaaaccactgtatggtcagccaataaaagttaattgggcatatacaagtactcagagggaggatacatcaggtcattttaatatttttgttggggatctttgcccagaaatcactgatgctgctctatttgcctttttttctggatactctacctgctcagatgctagggttatgtgggaccagaaaacaggacgatccagagggttcggttttgtttctttcaggaatcagcaggatgctcaaaatgcgataaatgacttgaatgggaagtggcttggcaaccgtcaaattcgttgcaattgggcgacgaaaggcgctaatgcttgtgatgaaaaacaaagtgtggacaccaaggtggaccagacaaatggttcatcagaagctggaaaggagaattcaaatgaagatggtcctgaaaataacccactttttaccactgtttatgttggtggtcttcctcatgaggccaccaacaatgatgtgcacctgtttttccattcacttggggctggctcaatcgaggaggtccgtgtgacacgtgacaagggctttggctctgtgaggtacagcacccatgaggaagctgcactagcaattcagatgggcaatggccaactgattggcgggaggccgataaggtgctcctggggaaacaagccaactccaccggggacagcatcttcgccgctcccccctccggcaccatctccattccccaccggcgcgtccgcaactgacctcctggcttaccagcgcctggccctgagcaagattgccgcgaacccatccctaatgggccagcacgccctgaagcaggctgcactggggatggacgccggggccagccaggctatctatgatggcggctaccctggcatcaacgctgcggccggcacacagcagcagcagcaacagcagctcatgtacttctagagtgacagctatcttatgaggcggcagctacctgtctctgcaggaggaaggcgaagatgatgccccagttacagccccccatatatacatatactagtagtatcatagtaatcaagccttaccaggaccttcttttatttacctttaatctttcgttacaccatctaagtaacttgtcctgtatgccggctctctatatatatatactcaccaccgtagaacacatatatgtatttctagagacatggaaaccaagtctgggtgggtgtcaaaaaaaaaaaaaaaaaaaa

SEQ ID NO: 3286 - protein, 444 aa, Panicum virgatum
  misc_feature: Ceres CLONE 1790416
  misc_feature: Great-hit functional homolog of the protein sequence given in SEQ ID NO 9221
  misc_feature: Useful for making plants with altered Lignin content
MHQQRMKQAAAAAAAQQQQLMQQALLLQQQQQQQQQAQPPLFPGHHPHPGLLAAPQIEPIVSGNLPPGFDSSTCRSVYVGNIHLQVTDTLLHEVFQSIGPVEGCKLIRKEKSSFGFIDYYDRRSAALAILSLNGKPLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANACDEKQSVDTKVDQTNGSSEAGKENSNEDGPENNPLFTTVYVGGLPHEATNNDVHLFFHSLGAGSIEEVRVTRDKGFGSVRYSTHEEAALAIQMGNGQLIGGRPIRCSWGNKPTPPGTASSPLPPPAPSPFPTGASATDLLAYQRLALSKIAANPSLMGQHALKQAALGMDAGASQAIYDGGYPGINAAAGTQQQQQQQLMYF

SEQ ID NO: 3287 - DNA, 2268 bp, Panicum virgatum
  misc_feature: Ceres CLONE 1790436
  misc_feature: Encodes the peptide sequence at SEQ ID NO. 3288
aggagagacgaaggcagtagccaagcgcatcacaactacacactctctccgtctctctctccctctctctcgccccggacctcctccgatcctgtaccttggacagagacaccgttgcctctttcggcactgatctctcgagaccagaatccatggcgccgcccctctcttcctggccatgggcgagcctcggtcaatacaagtacgtgctgttcggggctctggtgtggaaggtggtgcaggaatggcgggagcaggggggccttccgctgggctcgtggtggctgcacctgctggtgctcttcgccgtgcgcggcctcacctaccagttctggttcacctacggcaacatgctcttcttcacccgccgccgccgcgtcgtcgccgacggcgtcgacttccgccagatcgacgccgagtgggactgggacaactttctgctgctgcaaacgctgattggggccacggtagtcaacagccctctgctcccgggcctgcggcagctctgcctgtgggacccgcgcgggtgggccgtcgccctgctgctgcatgtgggcttctcagagccggccttctacctggcccaccgggccctccaccgggccccgctcttcgcccgctaccacgcagcgcaccactcctccggcgtcacccagccgctgacagccgggttcggcacgccgctggagagcctgctcttgacgctggcgatgggggccccgctcgcgggcgccttcctggtgggccacggctccctaggcctggtgtacggccacgccttcgtgttcgactacctgcgggccatgggctacagcaacgtggagatcgtgtcgcccagggtgttcgacgccttccccccgctcagatacatcctctacacgccctcgtacctgagcctgcaccaccgcgagaggcgcggcaacttctgcctgttcatgccggcgctggacgcggcgttcggcaccctggacgggcggtcgtgggcgctgcagcgcgcggcgtacgacggcgcggcgggcggcggcgcgctgggcacgccggagttcgtgttcctggcgcacgtggtggacatcatgtcgtcgatgcacgtgccgttcgtgctccggtcgctgagctccatccccttcgccaaccacttcatcctgctccccttctggcccgtcgccttcgccttcatgctcctcatgtggtgctgctccaagaccttcgtcgtcagcttctactacctccgcggccacctccaccagacgtggtccgtcccgcgctacggcttccagtacttcctgccggcggcgaagaagggcatcaaccaccagatcgagctggccatcctgcgggccgacaggatgggcgtcaaggtgctcagcctcgccgcgctcaacaagaacgaggcgctgaacggaggcggcaccatgttcgtgaacaagcacccggacctgcgcgtgcgggtggtgcacggcaacacgctgacggcggccgtgatcctcaaggaggtccccagcaacgtcagggaggtgttcctcaccggcgccacctccaagctcggcagggccatcgcgctctacctctgcaggaagaagatcagggtcctgatgttcaccatgtcgtcggagaggttcctcaagatccagcgggaggcgccgccggagtcccagcagtacctcgtgcaggtcaccaagtaccaggccgcgcagaactgcaagacctggatcgtgggcaagtggctgtcgccgcgggagcagcggtgggcgccgccggggacgcacttccaccagttcgtggtgccgcccatcatcggcttccggcgggactgcacctacggcaagctcgcggcgatgcggctccccaaggacgtgcgcgggctcggctcctgcgagtacaccatggagcgcggcgtcgtgcacgcgtgccacgccggcggcgtcgtgcacttcctcgagggctgggaccaccacgaggtcggcgccatcgacgtcgaccgcatcgacgtcgtctggaaggcggcgctcaagcacggcctcgcgcccgtgtgatcggttggcccccgtacgttaatttaatgtactgtggacgccagtaaaagaagaaaaaaggagagcgcgcgggtagaccggccaagatttataaagactcgccacttcctcagagagtcgtcatgtctcctttttgttggaatctaatattttccatgtaaatttaatataaatgagttgaaactcaacaattggagaaataaaaattgaagcagaaaaaaaaaaaaaaaaaaaa

SEQ ID NO: 3288 - protein, 626 aa, Panicum virgatum
  misc_feature: Ceres CLONE 1790436
  misc_feature (2)..(31): Pfam Name: adh_short Pfam Description: short chain dehydrogenase
  misc_feature (1)..(232): Pfam Name: Sterol_desat Pfam Description: Sterol desaturase
MAPPLSSWPWASLGQYKYVLFGALVWKVVQEWREQGGLPLGSWWLHLLVLFAVRGLTYQFWFTYGNMLFFTRRRRVVADGVDFRQIDAEWDWDNFLLLQTLIGATVVNSPLLPGLRQLCLWDPRGWAVALLLHVGFSEPAFYLAHRALHRAPLFARYHAAHHSSGVTQPLTAGFGTPLESLLLTLAMGAPLAGAFLVGHGSLGLVYGHAFVFDYLRAMGYSNVEIVSPRVFDAFPPLRYILYTPSYLSLHHRERRGNFCLFMPALDAAFGTLDGRSWALQRAAYDGAAGGGALGTPEFVFLAHVVDIMSSMHVPFVLRSLSSIPFANHFILLPFWPVAFAFMLLMWCCSKTFVVSFYYLRGHLHQTWSVPRYGFQYFLPAAKKGINHQIELAILRADRMGVKVLSLAALNKNEALNGGGTMFVNKHPDLRVRVVHGNTLTAAVILKEVPSNVREVFLTGATSKLGRAIALYLCRKKIRVLMFTMSSERFLKIQREAPPESQQYLVQVTKYQAAQNCKTWIVGKWLSPREQRWAPPGTHFHQFVVPPIIGFRRDCTYGKLAAMRLPKDVRGLGSCEYTMERGVVHACHAGGVVHFLEGWDHHEVGAIDVDRIDVVWKAALKHGLAPV

SEQ ID NO: 3289 - DNA, 1739 bp, Panicum virgatum
  misc_feature: Ceres CLONE 1790454
  misc_feature: Encodes the peptide sequence at SEQ ID NO. 3290
aacgcaaagctcccctcccctccccgccccatctccggcgagctagggtttccggctcccaccttgcctccccgccgctcccgctcggcaatcccggccctccccggatctccagccatgtacggcggagacgaggtctcggcaatcgtcatagacgtgggctcctacagctgcaaggcgggctacgccggcgacgacacccccaaagccgtcttcccgtcggttgttggttcaattgaacaaacgggagacactgatgactccaagccagagaaagaagctgactccgcatcagattctaagaatggagccaagcctatggatgtggacaaagccaagacaaaacgcaaactttatgttggtcaagagttggagttcaggagggataatatggaggtgatttcacctatgaaagatggaacagtaactgattgggatattgttgataatatatggaatcatgccttcagacggaggttgttgattaatcctgaggagcatcccatgctcatagccgaaccatctacaaacactgcacagcaaagagagaaagcagcagaacttatgtttgagaactacaaagtgccagcactattcctagcaaaaaatgcagtgctcacatcttttgcatctggacgagctacatctttggtggttgacagtggtggtgggtctactgtggtttcagccgtgcacgatggttttgttttgcaaaagtctgtcgcaacttctccagttggcggtgaatttttaactgactgcatgatgaaaagcttgaagagcaagggcgtcgttattagacccagatattcatttaagaagaaggaaatcagtcctggagaatataagattgtagatcttgatctaccaaacacaacagagagttacaggttgtactgcatgagggctattgctagtgacatcaaggagtctgtttgcagggttccagataccgcttttgatgaagtggcatatgcaaatgttcctacgacttcatatgagcttcctgatggacagactattgaagttggcgctgatagattcaagattcctgatattctatttaatccatctctatcccagactattcctggggttgatggatttgcagattcaatgtcagtccgtggccttccacgaatggtcattgatagcgtaaataggtgtgatgttgacatacgcaaggagttatttagcaacatcctgctttctggtggctcatcatcaattctgcagttaaaggagcgcctagagaaagaagtactagaggagtctccacaagctgctcgtgttaaggttatggcaagcggaaattcagtagagaggcgattcagcgtttggattggagggagtattcttgcatcacttgggtcgttccagcaaatgtggttctccaaagcagagtatgaagagcatggagtttcctatattcaaaggaagtgcccgtgaagcagtgcaacaacagttgtctgtccaaagggtgcgtgtgtacaacagttagatgccttgtcatgttggcttaagaagactcttgtcaagctatatttatcaatgtcgtgactagttagttttaggttatgcaggcagcaagggtgtaaccgtgtaagaacagggtcagctaatacttgtcattgatgctagataaatgtgctaaatcctttcctccctgctgtagaatgagaaggggtacttacctaccggagctaacttttttaccggaaaaaaaaaaaaaaaaaaaa

SEQ ID NO: 3290 - protein, 443 aa, Panicum virgatum
  misc_feature: Ceres CLONE 1790454
  misc_feature: Great-hit functional homolog of the protein sequence given in SEQ ID NO 9540
  misc_feature: Useful for making plants with modulated biomass
  misc_feature: Useful for making plants with modulated flowering time
  misc_feature: The plant flowers significantly late compared to wild-type.
  misc_feature: The rosette leaves do not appear in the normal fashion, i.e., their phyllotaxy may be abnormal or too many leaves may be emerging in comparison to the control.
MYGGDEVSAIVIDVGSYSCKAGYAGDDTPKAVFPSVVGSIEQTGDTDDSKPEKEADSASDSKNGAKPMDVDKAKTKRKLYVGQELEFRRDNMEVISPMKDGTVTDWDIVDNIWNHAFRRRLLINPEEHPMLIAEPSTNTAQQREKAAELMFENYKVPALFLAKNAVLTSFASGRATSLVVDSGGGSTVVSAVHDGFVLQKSVATSPVGGEFLTDCMMKSLKSKGVVIRPRYSFKKKEISPGEYKIVDLDLPNTTESYRLYCMRAIASDIKESVCRVPDTAFDEVAYANVPTTSYELPDGQTIEVGADRFKIPDILFNPSLSQTIPGVDGFADSMSVRGLPRMVIDSVNRCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 3291 - DNA, 1812 bp, Panicum virgatum
  misc_feature: Ceres CLONE 1790455
  misc_feature: Encodes the peptide sequence at SEQ ID NO. 3292
cccgaacccgcgaatcaatcccgaatcccgatcggccggcggcgctgggagggcgatgccggagaaggcggtcgacgacgtcatggaggcggcggtgggggcccacttcagcggcctccgccttgaggcgctccgcctctcctccccgtcctccccatcctccccttcctctgccagggcctccccggccgccgccacccactccaacggcgccgtctacgccaacggcactgccgccgcggcggcggtggagctcgcctccccgcccgccgccaggcagcccttcgtcatcggggtttccggagggacggcgtcggggaagacgacggtgtgcgacatgatcatccagcagctgcacgaccaccgcgtcgtgctcgtaaaccaggattccttctatcggggcctgactgctgaagaatctgcacgtgcccaagactacaattttgaccaccctgatgcatttgatacagaacaacttctggaatgcatgggacagctgaaacgtgctcagcctgtaaatgttcctatatatgatttcaagaagcaccgacggtgctctgaaagttttaggaaggtcaacgcatcagatgtcatcattttggagggaattttagtctttcatgatcagagagttcgcaatctgatggacatgaaaatttttgtggacacagatgctgatattaggcttgctcgaagaatcaggcgtgatactgttgaaagaggtagagatatcagctcggtgctagaccagtatggaaggtttgtgaagccagcattcgatgattttgttcttccctcgaagaagtacgctgacgtgattattccacgagaaggtgataaccatgtagcagttgatctgattgttgaacatatccgtacaaagcttggtcagcatgacttgtgcaaaatctaccccaatgttcatgtagttcaatcaacttttcagatccgaggaatgcatactcttattcgtgaccgggacatcactacacctgactttgttttttattcagatcgattgattcgtttggtagtagagcatggtctgggtcatttgccatttacagagaagcaggttattactccaacaggatctgtttatatgggagtcgacttctgcaagaagctctgtggagtatctatcgtgcgaagtggtgaaagtatggagaacgcattgcgtgcttgctgcaaaggaataaaaattgggaaaattctaatacatcgtgttggagacaatggacaacagcttgtatatcacaaacttccaatggatattgctgagcggcatgttctacttatggatccagtgcttggtacaggcaactcagcaaatcaggctattgaccttcttataagaaaaggtgttcctgaggaccgaatcattttcctgaatctcatctcggctcctgaagggattcaatgtgtttgcaagcgatttccattggtgaagattgtaacatcagagatcgattatggtctgaatgaggaattcagggtcatccctggactgggagagtacggcgatcgctactttggcacagacaattgatggctcctgccaccatcgaatctcacttgatccctggagaggggtgatacattggacgtaatgtttactgtggaaggctgtagttgtgttttgtaggttcacacaacctcctgcatatgttggaccgagggggagtgtcccgcgagaagccctgtacgggtgcagtagaagctttactcactacctggtgactaatgttttaaataatctttcttacgaagcgcctcaaactttaattttcggaaaaaaaaaaaaaaaaaaaa

SEQ ID NO: 3292 - protein, 497 aa, Panicum virgatum
  misc_feature: Ceres CLONE 1790455
  misc_feature (1)..(188): Pfam Name: PRK Pfam Description: Phosphoribulokinase / Uridine kinase family
  misc_feature (301)..(497): SWISSPROT Homolog: EC 2.4.2.9 Uracil phosphoribosyltransferase
MPEKAVDDVMEAAVGAHFSGLRLEALRLSSPSSPSSPSSARASPAAATHSNGAVYANGTAAAAAVELASPPAARQPFVIGVSGGTASGKTTVCDMIIQQLHDHRVVLVNQDSFYRGLTAEESARAQDYNFDHPDAFDTEQLLECMGQLKRAQPVNVPIYDFKKHRRCSESFRKVNASDVIILEGILVFHDQRVRNLMDMKIFVDTDADIRLARRIRRDTVERGRDISSVLDQYGRFVKPAFDDFVLPSKKYADVIIPREGDNHVAVDLIVEHIRTKLGQHDLCKIYPNVHVVQSTFQIRGMHTLIRDRDITTPDFVFYSDRLIRLVVEHGLGHLPFTEKQVITPTGSVYMGVDFCKKLCGVSIVRSGESMENALRACCKGIKIGKILIHRVGDNGQQLVYHKLPMDIAERHVLLMDPVLGTGNSANQAIDLLIRKGVPEDRIIFLNLISAPEGIQCVCKRFPLVKIVTSEIDYGLNEEFRVIPGLGEYGDRYFGTDN

SEQ ID NO: 3293 - DNA, 2068 bp, Panicum virgatum
  misc_feature: Ceres CLONE 1790464
  misc_feature: Encodes the peptide sequence at SEQ ID NO. 3294
ctaaaccctaagcacagtgttccccaatccccatggccgcgtcctcgccggcagcggcggcggccgcacggggcgcgttgacggagcagaagttctcggagatgtcccccgcgttatccgcggaggtggtggaggcactacgcagcggcggcttccggcgttgcacgccggtgcaggcggcgaccatcccgcacctgctgtcacataaggacgttgcagtcgacgccgccaccggctccggcaagacccttgccttcatcgttcccatcgtcgagatcctccgccgccgctcctccccgcccaagtcccatgaggttcttgctgtcatcgtctctcccacgagagaattatcctcgcagatatacaatgtggcgcagcccttcttcgcaacactgaaggacgtgtcgtccatactcctggttggtgggctggacatcaaggcagagctcaagagagtggacgaacagggtgcaaacatattggtgggcactcccgggaagctttgtgatgttatgcagcgagaagacactctagattttaagaatcttgagattttgattctggatgaggctgataggctcttagacatggggttccagaaacagattaatttcatactttcaaagttgccgaagcttaggaggactgggttgttctcagctacacagacaaaagctgttgcagaactttccaaagcagggttgaggaatcctatgagggttgaggttaagacagaagcaaagctgacaagcaaaaatgctggtcagcaagagcttggtccatccaaaacaccattggggcttcggttggagtatatgatatgtgaagcatcaaagaagtcatctcagcttgttgatttccttgtacagaataatggaaagaaaataatggtatattttgcaacatgtgcttgtgtagattactgggctgtggttcttccactgcttaactcactaaaaggttctccaataattgcctaccatgggaagatgaaacagaggcctcgagagaaagctttggcgtcattctctgctctttcaagtggtattctagtctgcactgatgttgcagcaaggggccttgacataccaagtgttgatctgattgtgcagtatgatccacctcaagatcccaatgttttcatacatagagctggccgaaccgcacgttatgatcaagaaggagatgctattgtatttctcttaccaaaggaggatacttatgttgagttcttgaagcttcgaggtgttcctctcacagaaagggaatgtccctcaaacattgaagatgttgtaacacagattagaagcgctgcacttgaagatcgcaatgtcatggagaaaggacttagagcatttgtttcattcgttcgagcatacaaggagcaccactgctcttacattttcagatggaaagatcttgagattggaaagctagctatggagtatggtttactccagatcccatccatgccagaagtgaagcatcattctctttcactggagggatttattcctgttgatgatgttgatgttacacaaatcaagtacaaggataaagcccgagaaaagcaacgcaagaaggcattgaaaaggaaagcagaagaggaagctcagaacccaaagccagagaagaagagagctcgggagaagcctgagaaaccaaagcgaaagaagacaggcaagcagcggcaatccatccaaaccaaggaggacctggatgagctggcgcatgagtaccggctcttaaagaagctgaagcgtggagacatcgatgaagacgagtacgagaagctcacctggttcggagactctgatggtgaagcctcggatggggacgcgagcgacttggacgagaagaaggagaggggcaacaaggcacaaaagaaactcaagcagagagggaaggatagaggagggtctaggaaatttgaagggaagagtaaaaggaggagcaaaaggagatagaattacatacaatgtttttgggaagaccatttttccggcaatcatgattaaatctttccacttttctgatgatgcttgcgcaggcagtatgcatgttccgc

SEQ ID NO: 3294 - protein, 644 aa, Panicum virgatum
  misc_feature: Ceres CLONE 1790464
  misc_feature: Great-hit functional homolog of the protein sequence given in SEQ ID NO 9223
  misc_feature (1)..(175): Pfam Name: DEAD Pfam Description: DEAD/DEAH box helicase
  misc_feature (1)..(77): Pfam Name: Helicase_C Pfam Description: Helicase conserved C-terminal domain
  misc_feature: Useful for making plants with altered alkaloid content
MAASSPAAAAAARGALTEQKFSEMSPALSAEVVEALRSGGFRRCTPVQAATIPHLLSHKDVAVDAATGSGKTLAFIVPIVEILRRRSSPPKSHEVLAVIVSPTRELSSQIYNVAQPFFATLKDVSSILLVGGLDIKAELKRVDEQGANILVGTPGKLCDVMQREDTLDFKNLEILILDEADRLLDMGFQKQINFILSKLPKLRRTGLFSATQTKAVAELSKAGLRNPMRVEVKTEAKLTSKNAGQQELGPSKTPLGLRLEYMICEASKKSSQLVDFLVQNNGKKIMVYFATCACVDYWAVVLPLLNSLKGSPIIAYHGKMKQRPREKALASFSALSSGILVCTDVAARGLDIPSVDLIVQYDPPQDPNVFIHRAGRTARYDQEGDAIVFLLPKEDTYVEFLKLRGVPLTERECPSNIEDVVTQIRSAALEDRNVMEKGLRAFVSFVRAYKEHHCSYIFRWKDLEIGKLAMEYGLLQIPSMPEVKHHSLSLEGFIPVDDVDVTQIKYKDKAREKQRKKALKRKAEEEAQNPKPEKKRAREKPEKPKRKKTGKQRQSIQTKEDLDELAHEYRLLKKLKRGDIDEDEYEKLTWFGDSDGEASDGDASDLDEKKERGNKAQKKLKQRGKDRGGSRKFEGKSKRRSKRR

SEQ ID NO: 3295 - DNA, 1770 bp, Panicum virgatum
  misc_feature: Ceres CLONE 1790470
  misc_feature: Encodes the peptide sequence at SEQ ID NO. 3296
gcatgtgctccctccactggtcgcccagccggccggccgccccactcctcacagccacttgacggcgtccccatggccgcctcttgccgccacagccatgtaagcttctgcttcctcctcctgctgcttgctgccgccgctgcgcatgctcttggcgcggcaggaagctcctcccatgtccagctgagtgcggagtcccttctccctgccgcgggctcgtcttgcctcacaccaaaagaggaacagcatggtgccgccacgggcacgcggatgcctgtcgtgcaccagcacggcccgtgttcgccgctagccggcaagcgcgagaaggcgccgtcccacgcggagatcctcgccgcggaccagcgccgcgtcgagtacatccaccgccgcgtgtctgagactaccggccgggtgaggccgaagcgcgccgcggcaccggcggtccacctccagcccggcgcgccgtcgacggcggccactccggcgtcggcctcgccctacgcgaagtcggcgaacctcccggcgtcgtccgggcgcgcgctgggcacgggcaactacgtggtgaccatcgggctcggcacgccgtcggcgcggttcacggtggtgttcgacaccggcagcgacacgacatgggtgcagtgccagccgtgcgtggcctactgctaccggcagaaggagccgctcttcagcccggccaagtcgtccacctacgccaacatctcgtgctcgtcgtcctactgcgacgacctctacgtcagcggctgcgacggcggccactgcctctacgccgtccagtacggcgacggctcccagaccgtcggcttctacgcccaggacaccctcaagctctcctacgacgtcgtcaaggagttccggttcgggtgcggcgagaagaaccgcgggctgttcgggcggtcggcggggctgatggggctcggccgcggcaagacgtcgctgacggtgcaggcgtacgacaagtacggcggcgtgttcgcgtactgcctcccggcgacgccgtcggggacgacggggttcctgaacctgggccccggcgcgccggcggcgaacgcgcggctgacgccgatgctgaccgacaacgggccgacgttctactacgtggggttgacaggcatcaaggtgggcgggcacctgctccccatcccagaggccgtcttctccgccgccggcgcgctcgtggactccggcacggtgataacgcgcctgccgccgtcggcgtacgagccgctgcggtcggcgttcgccaggggcatggacgcgctggggtacaggaaggcccccgcgttctcgatcctggacacctgctacgacctgacggggtaccaggggagcgtcgcgctgccggcggtgtcgctggtgttcaagggcggcgcgtgcctggacgtggacgcgtcggggatcctgtacgtcgcggacgtgtcgcaggcgtgcctggcgttcgccgccaacgacgatgacgccggcgtcgccatcatcgggaacacgcagcagaagacgtacggcgtgctccacgacctcggcaggaaggtcgtcggcttcgtccccggagcttgctgatccggctcgccggtggaccttcctgaataaccccaattaatcgcctgaatccgctaagcggtcggtgatcagcgttgaagattatcatgtctacaaatacgactgtcagatggtgcactataatataaattggcacacagtcgtctctccctgtctgaattgcacagggtttttcaaaaaaaaaaaaaaaaaaaa

SEQ ID NO: 3296 - protein, 500 aa, Panicum virgatum
  misc_feature: Ceres CLONE 1790470
  misc_feature (1)..(336): Pfam Name: Asp Pfam Description: Eukaryotic aspartyl protease
MAASCRHSHVSFCFLLLLLAAAAAHALGAAGSSSHVQLSAESLLPAAGSSCLTPKEEQHGAATGTRMPVVHQHGPCSPLAGKREKAPSHAEILAADQRRVEYIHRRVSETTGRVRPKRAAAPAVHLQPGAPSTAATPASASPYAKSANLPASSGRALGTGNYVVTIGLGTPSARFTVVFDTGSDTTWVQCQPCVAYCYRQKEPLFSPAKSSTYANISCSSSYCDDLYVSGCDGGHCLYAVQYGDGSQTVGFYAQDTLKLSYDVVKEFRFGCGEKNRGLFGRSAGLMGLGRGKTSLTVQAYDKYGGVFAYCLPATPSGTTGFLNLGPGAPAANARLTPMLTDNGPTFYYVGLTGIKVGGHLLPIPEAVFSAAGALVDSGTVITRLPPSAYEPLRSAFARGMDALGYRKAPAFSILDTCYDLTGYQGSVALPAVSLVFKGGACLDVDASGILYVADVSQACLAFAANDDDAGVAIIGNTQQKTYGVLHDLGRKVVGFVPGAC

SEQ ID NO: 3297 - DNA, 1930 bp, Panicum virgatum
  misc_feature: Ceres CLONE 1790471
  misc_feature: Encodes the peptide sequence at SEQ ID NO. 3298
aaaaaacctcccacgaaatccgcgattaaaatcctaaacccgcgtcttcccaaaatgccccccaacccccccgcttatctcctcctcgccctcctcctcctcctcgccggcaccgccgcctcggccgcgcggctccgcccgccgccggcgaacgccacctcggacggcgagcccgtctacctctggccgctgcccaagagcgtcacgtccgggtcccgtaccctcacggtcgacccggacctcgcgctcgacccgcggggccccggcggggcctcgcccgccgtggccgaggcgttcgagcggtacagggggcacgtcttcgcgccgtgggcgcacgcggcgcgcgcggccggcggcggcgggtacggcgtcgccaggctcaccgtcgtcgtcgcctccgccaacgagacgcttgcgctgggggtggacgagagctacacgatctacgtgggggcggcgggcggcgtcaactccatcgtcgggggagcaatcatagaggcaaacacaatatatggagctattcgtggactggagacattcagtcaactttgtgtttttaactacgacactaaaaatgtcgaggtgctgcatgccccatggcatattcaagatgagccccgcttcgccttccgtgggctactcctagacacctcacggcattacctcccagttgatgtgattaagcaagtgatcgactctatgtcatttgctaagctgaacgttcttcattggcatatcatcgatgaacaatccttccccttggaggttccatcatatccaaacctttggaaaggttcatactccaaatgggagcgctacaccgtggaagatgctcatgatattgtcaactacgctaaaaaaagaggtatcaatgtcatggcagaaattgacgtgcccggtcatgcagaatcgtggggaaatggatacccaacgctctggccttctcccaattgtacagagccattagatgtctctagtaatttcacatttgaagtaatttatgggattctgtctgatatgaggaaaatctttccatttgggctgtttcacttgggtggtgatgaagtatatacagggtgctggaatgtaacacctcatgtgaggcagtggcttaatgagcgcaacatgaccacaaaggatgcttacaagtactttgttctgaaggcccaagagttggccattaagctaaactggattcctgtgaattgggaagaaaccttcaattcattcaaagaaaacctcaatcctctaacagttgtgcacaactggctgggtcctggagtctgtcctaaggttgtggcaaagggtttcagatgtataatgagtaatcaaggcgtgtggtaccttgatcatcttgatgttccctgggaagatgtctatagtggcgagccactcgcagggattagtaataaaaaccagcaaaagctagtacttggtggggaagtttgcatgtggggtgagacagcagacacatctgatgttctacaaacaatatggccccgagcagcagctgctgctgagcgtctgtggagtcaattggaggctatatctgcccaagacctagagacaaccgtcttgtctcggctgcattatttcagatgcctgctgaatcaccgtggaatcgctgcggctccagtaacaaactactatgctcggaggcccccgaccgggccaggctcatgctttgttcagtaagctggcccttcaaagtgaagatatccacgaggtgctcagccttcatacacctgccaatgatacttgcaattcatacacctgccaatgatacttgcaacaaaaaaaattatattgtcccttgcactgtaccatatctgtttgtcattcacgataacaatttaataatctgcctttgtgtattccactctgaaactgaaataaaaactgcatcactcaaaaaaaaaaaaaaaaaaaa

SEQ ID NO: 3298 - protein, 546 aa, Panicum virgatum
  misc_feature: Ceres CLONE 1790471
  misc_feature (1)..(304): Pfam Name: Glyco_hydro_20 Pfam Description: Glycosyl hydrolase family 20, catalytic domain
MPPNPPAYLLLALLLLLAGTAASAARLRPPPANATSDGEPVYLWPLPKSVTSGSRTLTVDPDLALDPRGPGGASPAVAEAFERYRGHVFAPWAHAARAAGGGGYGVARLTVVVASANETLALGVDESYTIYVGAAGGVNSIVGGAIIEANTIYGAIRGLETFSQLCVFNYDTKNVEVLHAPWHIQDEPRFAFRGLLLDTSRHYLPVDVIKQVIDSMSFAKLNVLHWHIIDEQSFPLEVPSYPNLWKGSYSKWERYTVEDAHDIVNYAKKRGINVMAEIDVPGHAESWGNGYPTLWPSPNCTEPLDVSSNFTFEVIYGILSDMRKIFPFGLFHLGGDEVYTGCWNVTPHVRQWLNERNMTTKDAYKYFVLKAQELAIKLNWIPVNWEETFNSFKENLNPLTVVHNWLGPGVCPKVVAKGFRCIMSNQGVWYLDHLDVPWEDVYSGEPLAGISNKNQQKLVLGGEVCMWGETADTSDVLQTIWPRAAAAAERLWSQLEAISAQDLETTVLSRLHYFRCLLNHRGIAAAPVTNYYARRPPTGPGSCFVQ

SEQ ID NO: 3299 - DNA, 1783 bp, Panicum virgatum
  misc_feature: Ceres CLONE 1790477
  misc_feature: Encodes the peptide sequence at SEQ ID NO. 3300
aaacatctcgccagctgccatccctgcaaaacaaaccctacaaaacatggccatcagtggatgatagctgctcatcggttcttcagcctgccgaggagcttgctcgcttggttagctactctcccatgcgcacgtacagacacacgtacagcttgtgagcctccatgcatgtgtccatcgtgagttcatcaaaggcaaagcagcaccagcgctagctagtcgatcggcgcgtgcggtctcataccgccgtgatctgatcatggacaaagagcaggggagccaccacagtcacctggacagcttcgcgcccctggacggcgcggcggcgggggaccagcccggcggtggcgccgccgagatggtcgactacatgctgggccaggcgccgccgcatgcgcagccgccgcctcagagccaggtgtccttcgacaagctcagcttctccgacgtgctgcagttcgccgacttcgggcccaagctcgcgctcaaccaacccgccgcgtccgcgggcgtcggcgaccccggcgacgacgaggacgatgacgacgacggctacttcttcaggttccagtccctgccgtccctccccggcggccatcagggacagcatcacgcgaaccgtgagggcagcaaggcaacggcggccgacgacgagggcgtgcacgacggcggaggcggaggcgtctccgagagcacgacgctggtgcagcaggccgacggcggcgggcgcgcggagaagggcggggaccaggggaagagcggccggcggaagcgcccccggactgtcaagacgagcgaggaggtggagagccagcggatgacgcacatcgccgtcgagcgcaaccgccggcgccagatgaacgagtacctcaggatcctcaggtcactcatgccgggatcctacgtccagaggggagaccaagcatccatcataggaggcgccatcgagttcatcagggagctagagcagctgatccagtgcctggagtctcagaaacggcggcgcctgtacggcgggtccggcgacgcgccacggccggtggtggacgcagccggggccggcgcaccgacgtccacccagccgcagcaccaccagccgcaggtgccgccgccggcggcgttctttcctccaagcctccccttccccgcggcgtcgtccggcggcggcgactgcggcggcgccaagatactggacctggaagccggaggcgccgacgccgccggcgggctccgggaggaggtggccgagaacaagtcgtgcctggcggacatcgaggtgcgtgcgctgggcgcggacgccatgatcaagatcctgtcccggcgacggcccgggcagctgatcaagaccatcgccgcgctggaggacatgcagatgtccatcctgcacaccaacattaccaccatcgagcagaccgtcctctactccttcaacgtcaagatcctcggcgtggcaaggtactcggcggaggacatcgccggcgccgtccaccagatcctcagcttcatcgacgtcaactacgccctgtgatctcttatagtatctgtgtcaagaccaatatgaaagtgctatttcgcccacgttctataagtgcttgttgattatatagcataataaactgtgttatgttcgtttctatgtatgcaaactgattggaggacatgtaaaaggttagtgatagttgtagtattatattcagagacaatgtgtatgattgaagtgtactgcaattatcagctagttgaacaagaggatgctttctaccaaaaaaaaaaaaaaaaaaaa

SEQ ID NO: 3300 - protein, 422 aa, Panicum virgatum
  misc_feature: Ceres CLONE 1790477
  misc_feature (1)..(52): Pfam Name: HLH Pfam Description: Helix-loop-helix DNA-binding domain
  misc_feature: The sequence is a functional homolog of  SEQ ID NO 1503 in the  10/374,780 US patent application
  misc_feature: The sequence is a functional homolog of  SEQ ID NO 1504 in the  10/374,780 US patent application
  misc_feature: The sequence is a functional homolog of  SEQ ID NO 2786 in the  10/374,780 US patent application
  misc_feature: The sequence is a functional homolog of  SEQ ID NO 424 in the  10/225,066 US patent application
  misc_feature: Useful for making plants with modulated growth and phenotype characteristics
MDKEQGSHHSHLDSFAPLDGAAAGDQPGGGAAEMVDYMLGQAPPHAQPPPQSQVSFDKLSFSDVLQFADFGPKLALNQPAASAGVGDPGDDEDDDDDGYFFRFQSLPSLPGGHQGQHHANREGSKATAADDEGVHDGGGGGVSESTTLVQQADGGGRAEKGGDQGKSGRRKRPRTVKTSEEVESQRMTHIAVERNRRRQMNEYLRILRSLMPGSYVQRGDQASIIGGAIEFIRELEQLIQCLESQKRRRLYGGSGDAPRPVVDAAGAGAPTSTQPQHHQPQVPPPAAFFPPSLPFPAASSGGGDCGGAKILDLEAGGADAAGGLREEVAENKSCLADIEVRALGADAMIKILSRRRPGQLIKTIAALEDMQMSILHTNITTIEQTVLYSFNVKILGVARYSAEDIAGAVHQILSFIDVNYAL

SEQ ID NO: 3301 - DNA, 1558 bp, Panicum virgatum
  misc_feature: Ceres CLONE 1790485
  misc_feature: Encodes the peptide sequence at SEQ ID NO. 3302
ctctccaactccctgcagcttatatgcatcttatatctatccctgatctcttccttcttcccccccagtgcctttgctacctccctggttagctagctagatctctctctagttctctcttctcacatgtctaccatctacatgagccacatgtctactctccctctaatggagggagagcaggatcaggggctctttccggccttccatgtcacgaaggacccacctatcttgttcccgttcatgatcagcaaccccgtggatcagctccaagggcaaagtagctatggagatcagcgcttgagccatcaagttttggctgaatctactactcatcaacagttcactgatcgcatgatgatgatgagcggatcagacgtcttccctaggccatcaccgttccggccgaccattcaaagcatcgatggtgacatgatccagcggtccgcgtatgatccatacgatatcgagaacacgccgtgtgccgatggatcgatcagtggctgggcagcggcggcggcactgccggtgaagatgaagatcatgaggaaggcgacgagcagtgagtatcccgagggaggggcagcgagaaagccaaggagaagagcacaagcacaccaggatgagagccagcagctgcagcagcaggctatgggtgtcgtcgttagagtgtgctccgactgcaacaccaccaagacccccttgtggaggagtggtccttgtggccccaagtctctttgcaacgcatgcggcataaggcaaaggaaggcgcgccgggcgatggcggccgccgctgccgccagtgccagcaacggaggagctccacaggtggccagtgtcgccgcgcaggcaaagccggccaagaaggagaagatcagggcggatgccgatcagtcgctgccgttcaagaaacggtgcaagatggtcgccgtaaatcacgctgtcacggctgccaaggcggcggcgccgacgacagtcgctgctccgatcaagcaggatcaggatcacgtctccggtgacaaggttgctgctgcagcaacggcggtgagtatgcagagcaaggtcgccgccgctcctgatccgcctgccatgtcgtcgttccacgccttcgccgccgacgagatcaccgacgccgccatgctgctcatgacactgtcctgtgggctcgtccgcagctagctagcgagctatatatatagctagcttctactagcagatgagagatcactagtagacactgatgagttcgacccgatttgcaacgaactaagtactcaacccctatatatcatattgcttgcattgtgtttccttgtttgattttgtgctgaaggagaggaagaagatcaccaggagatatatagagtgatcacatggccaaggcaaaataataataagcgtaaaactctggctagccagtaattagtaccaggatttgctataagagtgagttttttaatttatttaccttttttcccagctgtggctaattattcaatccacaataagctatgcaactttgttcatttgtattagttaaaaaaaaaaaaaaaaaaaa

SEQ ID NO: 3302 - protein, 350 aa, Panicum virgatum
  misc_feature: Ceres CLONE 1790485
  misc_feature (1)..(36): Pfam Name: GATA Pfam Description: GATA zinc finger
  misc_feature: The sequence is a functional homolog of  SEQ ID NO 1032 in the  10/666,642 US patent application
  misc_feature: The sequence is a functional homolog of  SEQ ID NO 276 in the  10/666,642 US patent application
  misc_feature: Useful for making plants with modulated growth and phenotype characteristics
MSTIYMSHMSTLPLMEGEQDQGLFPAFHVTKDPPILFPFMISNPVDQLQGQSSYGDQRLSHQVLAESTTHQQFTDRMMMMSGSDVFPRPSPFRPTIQSIDGDMIQRSAYDPYDIENTPCADGSISGWAAAAALPVKMKIMRKATSSEYPEGGAARKPRRRAQAHQDESQQLQQQAMGVVVRVCSDCNTTKTPLWRSGPCGPKSLCNACGIRQRKARRAMAAAAAASASNGGAPQVASVAAQAKPAKKEKIRADADQSLPFKKRCKMVAVNHAVTAAKAAAPTTVAAPIKQDQDHVSGDKVAAAATAVSMQSKVAAAPDPPAMSSFHAFAADEITDAAMLLMTLSCGLVRS

SEQ ID NO: 3303 - DNA, 1944 bp, Panicum virgatum
  misc_feature: Ceres CLONE 1790499
  misc_feature: Encodes the peptide sequence at SEQ ID NO. 3304
aaaaaaccaccgaattcttgtcctcaaggagcccaatccacacgggagcacgcgggggacgcccccaattcttgaggtcgcaggatggatctacatagaaatggaactaatggttcctgctccagcccatgcgggccattgacagactactacatcccagattacatactgaaaccggacgctggacaaatcattccggacaatgcgccatgttgtcctgtggtagtcttcatcaactccagaagtggtggtcaactgggaagcagtctgatcaaaacataccgtgaacttctcaatgaagcacaggtttttgatctctcagaagaggctcctgataaggttctgcacagattgtactgcaacttggaaaagctcaagtctaacggtgaccctcttgctattcaaattcaaaagagcttgagactaattgttgctggtggtgatggcacagcaagttggctgcttggagtagttagtgatcttaagctttcgcatccacctcctgttgctactgtgcctctaggaactggaaacaacctacctttctcatttggatggggaaaaaagaatccagctactgatcaagcggcggtgaaatcattcctggcccaagtaaaaggagcaagggaaatgaatattgatagttggcatatcatcatgaggatgcgcattccacaggatggcccatgtgatcctattgctcccttagaccttccacattcattgcatgcattccaccgtgtatcagactgcgactctctcaatgtggagggttaccacacattccgtggaggattctggaattattttagcatgggaatggatgcacaagtatcttatgaattccactctgaaaggaagagaaatccagagaagttcaaaaaccagctaacaaatcagggtacatatgctaagcttggacttaaacaaggatggtttgctgcttctataacccatccttcctcaaggaacattgcccaacttgcaaaggtgaagatcatgaaaagacctggtggccagtggaaagagcttatgattcctcgcagcattcgatcaattatctgcctcaacctgccaagtttctcgggaggatttaacccttggggcacacctagcacgaggaaagtacaaggcagagacctgactgcaccatatgttgatgatggccttattgaggttgttggtttccgtgatgcctggcatgggctcgtcttgctggcacctaatggccatggaacccggctagcgcaggcccaccgaatccgtttcgagtttcacaaaggagctgccgagcacacattcatgaggatcgacggggagccatggaagcagcctctccccaaggaggacgacaccgtagtcgttgagatctcgcacctccgccaggtggccatgctggccaatgacccgtgcaagtcgaagagcgtcaacgacccctcctccccgtcgtgccacagccacgacgacgacgacagcaacagcctggaggacgaggacgagtgggaggacgggaggaagaagttcggtgcggcggccactttcaagatccccgacgaggtggaaatcgctcatcttagctagagcgcgtcctgctgcttctccgctcgtgctgggttgcccttgctgcttgaaagttcagaagccatttcagaatgaatgtttcactgctgcttagtgctgctgcgccctttcttcgctgtgtgaagttcagatttcagaagctaacaactgctgttagcgtccgatactgctcattatgctccatattatcctgtaaatctcaagtttaacggtggtgggaggggatcggtagatgtacatgggcaatgaatcagggttagaaactcgacagatttgaggcctcccatttgttagacagatggctggaccatcccttatgttaattaattaattggttgttgtcaaaaaaaaaaaaaaaaaaaa

SEQ ID NO: 3304 - protein, 498 aa, Panicum virgatum
  misc_feature: Ceres CLONE 1790499
  misc_feature (1)..(144): Pfam Name: DAGK_cat Pfam Description: Diacylglycerol kinase catalytic domain ( presumed)
  misc_feature (1)..(174): Pfam Name: DAGK_acc Pfam Description: Diacylglycerol kinase accessory domain
MDLHRNGTNGSCSSPCGPLTDYYIPDYILKPDAGQIIPDNAPCCPVVVFINSRSGGQLGSSLIKTYRELLNEAQVFDLSEEAPDKVLHRLYCNLEKLKSNGDPLAIQIQKSLRLIVAGGDGTASWLLGVVSDLKLSHPPPVATVPLGTGNNLPFSFGWGKKNPATDQAAVKSFLAQVKGAREMNIDSWHIIMRMRIPQDGPCDPIAPLDLPHSLHAFHRVSDCDSLNVEGYHTFRGGFWNYFSMGMDAQVSYEFHSERKRNPEKFKNQLTNQGTYAKLGLKQGWFAASITHPSSRNIAQLAKVKIMKRPGGQWKELMIPRSIRSIICLNLPSFSGGFNPWGTPSTRKVQGRDLTAPYVDDGLIEVVGFRDAWHGLVLLAPNGHGTRLAQAHRIRFEFHKGAAEHTFMRIDGEPWKQPLPKEDDTVVVEISHLRQVAMLANDPCKSKSVNDPSSPSCHSHDDDDSNSLEDEDEWEDGRKKFGAAATFKIPDEVEIAHLS

SEQ ID NO: 3305 - DNA, 1434 bp, Panicum virgatum
  misc_feature: Ceres CLONE 1790503
  misc_feature: Encodes the peptide sequence at SEQ ID NO. 3306
acgctgccccgaggagaggcgtttcacatagggatacggtgtcaacgtcggccggcgaaaaaatgaagatgaagaaggcgtgcgtgacaggagggagcgggtacatcgcgtcggcgctcatcaagatgctgctggagaggggctacgccgtcaagaccacggtcaggaacccagatgacatggcgaagaactcccacctcaagcacctgcaggcgctcggccccctgacggtcctccgcgccgaccttgacgtggaaggcagcttcgacgacgccgtcgccggctgcgattacgccttcctcgtcgccgcttcggtgaacctcgcgtcaggggaggatttagagaaagagctgatcgagccttccgtccggggaaccctgaacgtgatgaggtcgtgcgtgaaggccggcacggtgaggcgcgtggtcctgacctcgtcggcggccgcggtcttcgtcaggccagtgtcgctgcagggcgacgggcacgtcctggacgagggctcctggtccgacgtcgagtacctcagagccgagaagccgacgtcgtgggggtacccggtgtccaaggtgctcctcgagaaggcggcgtgcaggttcgcggaggagcacggcatcagcctcgtcaccgtctgcccggtcaccaccaccggcgcggcgccctccttgaacttcaacaccagcgtcccgagcagcctctcgctcctgtcaggcgacaaggtctggctcggcgtgctcaagttgaccgagaggaccgccggctcggtgccgctgtgccacgtcgacgacctctgcctcgcggagctgttcgtcgccgaggcgccggcgccggcgggaaggtacatctgctgcggcctcaacacgaccatcgccgagctcgcgcgtttcctggcgcgcaagtacccgcagtacgacgtgatgcggaatctgcaaaccatcgacgatgagctcctggagaagccgagagcctgcttgtcgtcggcgaagctgctcagggaaggattcgagttcgagcacaagacgctggacgagatcttcgacaacgtcttcgagtacggcaaggcactcgggattgatctgccctattagcgttagctccgtaagctcagatcattcgttcagtttgttactagctgtttgggctcagcgttccggctttactggagctgagcgcgtcctgtaatcatgcacgccagagacgtgcgcgttcacgtcgtggcgagtgtccgcgtcgcgcggcatgacccggcgtgggggatggcccacgcagagcacggttcatggcgcgcgcatgcagggggtagcagtagaccactccccgcctctcgtttgttttagagtctttactacaaataaagataagaataaattacacccaccatacaataacttgttaggtgggtgtaaattggtccaaaaaaaaaaaaaaaaaaaa

SEQ ID NO: 3306 - protein, 341 aa, Panicum virgatum
  misc_feature: Ceres CLONE 1790503
  misc_feature (58)..(283): Pfam Name: Epimerase Pfam Description: NAD dependent epimerase/dehydratase family
MKMKKACVTGGSGYIASALIKMLLERGYAVKTTVRNPDDMAKNSHLKHLQALGPLTVLRADLDVEGSFDDAVAGCDYAFLVAASVNLASGEDLEKELIEPSVRGTLNVMRSCVKAGTVRRVVLTSSAAAVFVRPVSLQGDGHVLDEGSWSDVEYLRAEKPTSWGYPVSKVLLEKAACRFAEEHGISLVTVCPVTTTGAAPSLNFNTSVPSSLSLLSGDKVWLGVLKLTERTAGSVPLCHVDDLCLAELFVAEAPAPAGRYICCGLNTTIAELARFLARKYPQYDVMRNLQTIDDELLEKPRACLSSAKLLREGFEFEHKTLDEIFDNVFEYGKALGIDLPY

SEQ ID NO: 3307 - DNA, 1883 bp, Panicum virgatum
  misc_feature: Ceres CLONE 1790506
  misc_feature: Encodes the peptide sequence at SEQ ID NO. 3308
tctgcctctgcggccctgcctctcttatctctccgcccgcctctgcccctctcgtggccttccttccctggcggccccgaccgggcgagccgcggcgccctccggcaccccttccccggcgacgaccgcccaccagctggtagactgaagccctgcagttagcccaggaaacattaaatggcgctggtacagttcagcggcgccttggttccccagctcggtgaaaagcctcgcttgctacccacatcgcctgccgtcgcaagggctgcctatgctgctgatgcaagattcctggcaccaaataatggtacaagaggcagaggtaaacacctggtgtcatctagttatagtttgcattcacagacctcttccgaacgactaaaccatttaccatcatcaagatttcgccagaaaaggggttcacgtttcgttgtcagagctgaagctgatttctattccgtacttggtgtctcaagaaatgctagtaaatctgaaatcaagagtgcctaccggaagcttgctaggagctatcatcctgatgtgaacaaagatcctggtgctgaacaaaagttcaaggatatcagcaatgcttatgaggttttgtctgatgatgagaagcgagcaatctatgataaatatggagaagcaggtctgaagggcgctggcatgggaacaggagattactcaaacccattcgatctctttgagtcactgtttgaaggatttggtggaatgggtggaatgggcagtggtcgtgctgctcggaacagaccaatgcaaggtgatgatgagacctacaatctggtactcaatttcaaggaagcagtgtttggtgtagagaaagagattgagataaccagactggaaggatgtactacctgtgatggaactggtgccaagccaggtacaaagccaacgacgtgtaaaacttgtggaggtcaggggcaggtggtctcctccacaagaacaccacttggaatttttcagcaagtctccacctgcaatacttgtggtggcactggcgaattctccactccttgcaacacctgtgggggtgatggccgagtgcgaagaacgaagaggatcagtctgaaggttcctgctggagtggattctggaagcaggctgagggtccggtctgagggtaatgctggccagagaggagggccccctggggacctttatgtcttcattgatgtcctttcagatcctgttcttaagagagatgggacaaacattctctacacatgcaaggtttcttacattgatgcaatccttgggacaaccgtcaaagtcccaactgttgatggaatggttgaccttaagataccctcagggactcagccaggcacaactctggtgatgtccaagaaaggtgttcctcttcttgggaagtcaaatgctcgaggagaccagctggtgcgaatccaggttgagattccgaaacgtctgagcagtgatgagaggaagctgattgaggagcttgcaaacctaaacaaagctgaaacagccaatagcaggagatgattatttcacaaggcttggtaggacaccctgcttgtgcgataggcaattttgatgcaaactgcagtgatgaaaattgagttggtagggtaaacacttctacaaactacatacagcatgcggtgcactggagcaaaatgtgtcatgccatatatgtaacctcatctataagctattgaaagtttaagtcactgcaagcaaaacacaaaatgaactggatgttttgcaatagctctaggcaagtttattagccattttttattatacggcttttgtattcttaaaagtcttaggctaaatctctgatggtggaaacgggcataatcttaatttttcttgaaaaaaaaaaaaaaaaaaaa

SEQ ID NO: 3308 - protein, 449 aa, Panicum virgatum
  misc_feature: Ceres CLONE 1790506
  misc_feature (1)..(62): Pfam Name: DnaJ Pfam Description: DnaJ domain
  misc_feature (1)..(84): Pfam Name: DnaJ_CXXCXGXG Pfam Description: DnaJ central domain (4 repeats)
  misc_feature (1)..(123): Pfam Name: DnaJ_C Pfam Description: DnaJ C terminal region
MALVQFSGALVPQLGEKPRLLPTSPAVARAAYAADARFLAPNNGTRGRGKHLVSSSYSLHSQTSSERLNHLPSSRFRQKRGSRFVVRAEADFYSVLGVSRNASKSEIKSAYRKLARSYHPDVNKDPGAEQKFKDISNAYEVLSDDEKRAIYDKYGEAGLKGAGMGTGDYSNPFDLFESLFEGFGGMGGMGSGRAARNRPMQGDDETYNLVLNFKEAVFGVEKEIEITRLEGCTTCDGTGAKPGTKPTTCKTCGGQGQVVSSTRTPLGIFQQVSTCNTCGGTGEFSTPCNTCGGDGRVRRTKRISLKVPAGVDSGSRLRVRSEGNAGQRGGPPGDLYVFIDVLSDPVLKRDGTNILYTCKVSYIDAILGTTVKVPTVDGMVDLKIPSGTQPGTTLVMSKKGVPLLGKSNARGDQLVRIQVEIPKRLSSDERKLIEELANLNKAETANSRR

SEQ ID NO: 3309 - DNA, 1607 bp, Panicum virgatum
  misc_feature: Ceres CLONE 1790507
  misc_feature: Encodes the peptide sequence at SEQ ID NO. 3310
atcaccgcctactctcctctcttgttcagttgttccactcctactcccacagtccgccggctccgatcccaactccacccatggcgctctccatctccacgcccacctcctcctccctccttccggcctcccgtcaggtgggcaggtggagtccattggcgcggtcggctaagcctgtgcctttcagcctctggaggtcgcctctggcggcgcggtccgccgccggcagcgcaccagcttcccccgtcgacgaggtcgtcactgagctcgacgcggtggccggcttcagcgagatcgtgccggacaccgtcgtgttcgatgatttcgagaggttcgcacccacagcggccacggtgagctcctcgctgctgcttgggatctctgggctcccggataccaagttcaagagtgcgatagatactgcactggcagatggtgagtgcaacgcgttggagaagcccgaggacaggctgtcctgttacctcaccaaggccctggcaaacgttggtgctgaactggctcagcaagtccctggacgcgtttcgactgaaatagatgctcggttggcttatgacacccagggcattatccagagggtgcatgaactgataaatctatacaaccaacatgatgtctcaactgatcgcctgctattcaaaattcctgctacatggcaaggtatagaggcctcaagattgcttgaatctgatggaattcaaacacatttaacattcgtgtacagtttcgcacaagcagcggccgcagcacaagctggtgcatctgttgtgcagatatttgtggggcggttgcgggattgggcaaggaatcactctggtgacccagagatagatgaaactttgcagaagggagaagatgctggccttgctttggctaagaaagtatatgcctatattcacagaaatgggtataaaacaaagttgatggctgctgccatacggaacaagcaggatgtgttcagccttcttgggattgattacatcattgcacctctgaagatactgcagtctctggaagaatctgtcactgatcctgatgtgaagtacggttatgtcccaaagttgactcctgctattgggaagacatatgagttcactgaagaggagcttttgaagtgggaccagttgagtcttgcagctgcgatggggccagccgctgaagaactacttgcttcaggattggagggatatgtgaaccaagcaaggcgtgttgaggagctcttcgggaagatctggccacctccaaatgtttaaagatgcctttctgggcctcggttttcagttcaaaagagccaataacaacaggcaagggccgtgctatccgggcattggccttcctgcttcgaagaacacttctcttgcctgtcaccggttccccaatgtgatttaccaagcagtctcaaaatgttgtgtaaaaaacatatttgcttcttttggatacgatacgatgcgagtgttgaattagtctgcttatgtgtattgtgcgttttgtgattcagttgatatgctggactgatcagaacttgtcacttgatattcccagcaatgtcagaatccaatatcccacatcaaaaaaaaaaaaaaaaaaaa

SEQ ID NO: 3310 - protein, 396 aa, Panicum virgatum
  misc_feature: Ceres CLONE 1790507
  misc_feature (1)..(317): Pfam Name: Transaldolase Pfam Description: Transaldolase
MALSISTPTSSSLLPASRQVGRWSPLARSAKPVPFSLWRSPLAARSAAGSAPASPVDEVVTELDAVAGFSEIVPDTVVFDDFERFAPTAATVSSSLLLGISGLPDTKFKSAIDTALADGECNALEKPEDRLSCYLTKALANVGAELAQQVPGRVSTEIDARLAYDTQGIIQRVHELINLYNQHDVSTDRLLFKIPATWQGIEASRLLESDGIQTHLTFVYSFAQAAAAAQAGASVVQIFVGRLRDWARNHSGDPEIDETLQKGEDAGLALAKKVYAYIHRNGYKTKLMAAAIRNKQDVFSLLGIDYIIAPLKILQSLEESVTDPDVKYGYVPKLTPAIGKTYEFTEEELLKWDQLSLAAAMGPAAEELLASGLEGYVNQARRVEELFGKIWPPPNV

SEQ ID NO: 3311 - DNA, 1593 bp, Panicum virgatum
  misc_feature: Ceres CLONE 1790539
  misc_feature: Encodes the peptide sequence at SEQ ID NO. 3312
aggtgcagcccccgccagggtcctccctaaatccggccacgcccgccggggaggcgacggttgatcagtcggcccggggtggaggatcgatcggccccggacgaataaactagttctgctaggtttccccgggggtcgctcgccttcttccccctttcgtcgctgccggtcagttcgatccggtggctgctcgcccgccgcccgcgtcgccgcctcgccgccggccggccgggtccgagtccgccgtccctcctgttcccttcggtctccgttactcggcgatcttcctcctcgcgtgctctgcttccgcttgcccccgtcgagcgagggttgagtggagccggaccatggcggaggtagaagacgcggtgggcgcgccgccgacggcgacgacgacggagtccgagggcaccaccacggacgacgagcatctctcgccgacctgcgcctgcggcggcaggggcccacgcgggggccgcatcaagatcctctgcagcttcggcggccgcatcgtgccccgcccgcacgacggcgtcctcaagtacgtcggcggggaaacccgcgtcctcgccgtgccccgatccatccccttccgcgagatgaagaagaaggtcgaggagatgttcaagacggaagtggccgcgatcaagtaccagctcctctccctcgccgaggacctcgacgtgctcgtctccgtcacctgcgaccaggacctggtccacatgctggaggagtacgaccgcctcgaggccaagcggtcgccgaccgcgtccccgcgcttccgcgtctacgtcttcgcgccgcagcccgccgcgccgctcctgtcggccgccgcgcctgcccgccacgccggcctgtcgcgcctccacccgcagcacctccaccaccaccaccagcagcacccgcaccaccacttccaggcggagcgctacgtggccaccgtgcccgtctcgccggacgggagcccgccgttcccggcccagccgcacggcgccgtctccgcgggcaactcgccgcgcgccaacgccgtcctcggcctcgggatgcagcgcgtgcggagcacgccgaacctcggcgccctggacgcggcggcgcagcacctgcagcagcacgcggcggacggcggcggcgtgccgggctacgtgggcggctcgccgagccacgccggcggcgcgggccgcctcctgctgcattcgaacagcttccaccagtaccagcaccagtacacgccggcgccggcggccgcgccgcaccatgccgggcggtacgacgcgcgcggcgggtacgtcagggtgggcaactacctggcgccaatggcggcgcctccttcccggccggtctcgaggggaggactggcgccgcacagcgagatggtcaagtctgcgatcgtgtgggactgacccggccggccgttcgccggagcccggagggaggctgatgagctgtaacgatttatccttttttgcatcagtacgaggggcagtgaaatgagtggtacgatgaagttgagagatgtaaatagacggtcggatatggatgcacgcggccttgttttaactgttgcgattgtgtcaaaaaaaaaaaaaaaaaaaa

SEQ ID NO: 3312 - protein, 350 aa, Panicum virgatum
  misc_feature: Ceres CLONE 1790539
  misc_feature: Great-hit functional homolog of the protein sequence encoded by LOCUS At5g49920
  misc_feature: Useful for making plants with modulated nitrogen use efficiency
MAEVEDAVGAPPTATTTESEGTTTDDEHLSPTCACGGRGPRGGRIKILCSFGGRIVPRPHDGVLKYVGGETRVLAVPRSIPFREMKKKVEEMFKTEVAAIKYQLLSLAEDLDVLVSVTCDQDLVHMLEEYDRLEAKRSPTASPRFRVYVFAPQPAAPLLSAAAPARHAGLSRLHPQHLHHHHQQHPHHHFQAERYVATVPVSPDGSPPFPAQPHGAVSAGNSPRANAVLGLGMQRVRSTPNLGALDAAAQHLQQHAADGGGVPGYVGGSPSHAGGAGRLLLHSNSFHQYQHQYTPAPAAAPHHAGRYDARGGYVRVGNYLAPMAAPPSRPVSRGGLAPHSEMVKSAIVWD

SEQ ID NO: 3313 - DNA, 1545 bp, Panicum virgatum
  misc_feature: Ceres CLONE 1790545
  misc_feature: Encodes the peptide sequence at SEQ ID NO. 3314
gtttcttgcggcattgcttgctgcttgctctaacacggagccaaaaattgcttccaagttattccaactccaaccctatcgttccatatatagcctttttattgccgcaatgcaaccgcagcagtaatggcgacgatgccggcgccgcaagccgcaacgcgcgtcgtcgcctccggcggccggcggctcgtgttcggcaagcctgagaaggccaagggcgggagactgcttgtgaggagctgtgacgatggcggcggcggcggcggcaggaatggcagacgtgtcggtgtctcagtggaagctgtcaatggcgctgtcaagctgaacggcgccgcggtggtggccgacgttcggccatcggtggacggcggcggcggcgatgccttccggctcggcgagtttgtggaagggaggctcgtgtacaggcagcagtttgtgatcaggtcctacgagatcgggcctgaccgaactgccaccatggagaccatcatgaacctcctgcaggagacagctctgaaccatgtgatgtgctctgggctcgccggagacggcttcggcgcgacgcggcagatgagcctcaggaagctcatctgggtggtcacgaggatcaacatccaggtcgacaagtacagcagatggggagatgtcgtcgagatcgacacctgggtcgcgtcgtcagggaagaacggcatgcgccgagactggatcatccgggaccgcaacaccaagaacatgatcgcaggagccacaagtaactgggtgatgatgaaccgagagacccggaggctgtccaagatccccgaggagatcaggcaggaggtgcttcccttctacctggaccggagcatcatcatcaccgccgccgacgccgacgccggcggccgcaagatcgagaagctcactgactcgacggcggagcacatacgatccggactagctcccaggtggagcgacatggatgtcaaccagcacgtcaacaacgtcaagtacatcggctggatcctggagagcgtgccgctggacgtgctggaggactaccacctgacgagcatcacgctcgactaccgccgggagtgccgccagtcgcagctcctggagtcgctcaccagcatgacgacgacgacggccgagccgccactgccggcggcgagcagccggtgcagcgccgacctgcacagcacgcatctgatacggcagcaggatgacggagccgagatcgtcagggcgcgtgcggagtggcgtggcaaggagcatcgaggggcgatgatgaaccagccctgacatatgtagtagttgtgtagtggcaaactctgttttgtactgagtatttgcttgcgcccatttcaggatttgtgtgtgttcttaggttgttcattcttttgcccctgctgggatgtgagatccgctgtgtgattggagattttcaagactcggtgaataagaactgtaagaatttcatatgtaaaggaagttcgatggaatcgaactgtaagagctatttaaataccctacacctttaagattcaaaaaaaaaaaaaaaaaaaa

SEQ ID NO: 3314 - protein, 384 aa, Panicum virgatum
  misc_feature: Ceres CLONE 1790545
  misc_feature (2)..(264): Pfam Name: Acyl-ACP_TE Pfam Description: Acyl-ACP thioesterase
MATMPAPQAATRVVASGGRRLVFGKPEKAKGGRLLVRSCDDGGGGGGRNGRRVGVSVEAVNGAVKLNGAAVVADVRPSVDGGGGDAFRLGEFVEGRLVYRQQFVIRSYEIGPDRTATMETIMNLLQETALNHVMCSGLAGDGFGATRQMSLRKLIWVVTRINIQVDKYSRWGDVVEIDTWVASSGKNGMRRDWIIRDRNTKNMIAGATSNWVMMNRETRRLSKIPEEIRQEVLPFYLDRSIIITAADADAGGRKIEKLTDSTAEHIRSGLAPRWSDMDVNQHVNNVKYIGWILESVPLDVLEDYHLTSITLDYRRECRQSQLLESLTSMTTTTAEPPLPAASSRCSADLHSTHLIRQQDDGAEIVRARAEWRGKEHRGAMMNQP

SEQ ID NO: 3315 - DNA, 2017 bp, Panicum virgatum
  misc_feature: Ceres CLONE 1790566
  misc_feature: Encodes the peptide sequence at SEQ ID NO. 3316
gagacaaagcggggggcactccacgccgctctgcgctctctctcgtcagcaattttttacacgaacaactcgggcgcaagccgcgcaacacaacaacgcgaccgagcaagagacaatggccggcacggcggcgccggccgcgggctactgcgcggacggcgtgtaccgctccctgcgcccggccgtgcgcatcgagtccgacccgggcctctccctcaccgacctcctcttccgccgcgccgacgcgtgcccctccgcgctcgcgctggccgacgccgccagcggccaagccctcaccttctccgccctccgctccgccgtcctcaccacggccgtcgctctcgcctcgcgcgcgggcgtccgaccgggcgacgtcgtcctccttctcgcccccaactgcgtcctttaccccgtctgcttcttcgccgtcaccgccctcggcgccgtcgccaccacggccaaccccctctataccccaagggaaatcgccaagcaggtcaccgactcccgcgccaagctcgccatcacagtgtctgagctgctccccaaaatcgcggagctccgcctcccaaccatactgctcgacggcgatgcagccagcgccaccgcttccatgcctcccggcgccagcgtcacgctctactctgacctcattgctggggcgcaggagacggagtaccgccgcccgccaataaagcagagcgacacggccgcgctgttgtactcgtcgggcacgacgggggcgagcaagggcgtcatcctgacgcaccgcaacttcatctcggcggcgcccatgatcacagcggatcaagacacgcacggagaggggcccaacgtcttcctctgcttcctgcccatgttccacatcttcggcttctccgtcctcacgttcgcgcagatgcagcgcggcaacgccgtcgtcgcgatgtccttgccgcggttcgacatggactttgtgatggccgccgtgcagcggtaccgtgtcacgcacatcttctgcgtgccgccagtcatgatcgcgctcgccaagattgagaggaccgggaaatacgacctcagctcgctcaggttcatcggctccggcgcggcgccgctcggcaaggacgtgatggaggtcgtggccagaaactttccggatgccatcatcgcccagggctatggaatgactgaaacttgtgggatcatatctttagagtggccagaaaaaggacaagctcgtcaatttgggtcagctggatcacttgtctcaggagttgaagcaaagattgtagatatagaaacattgaaatgtctgccaccaaatgaactgggagaaatttgtgttcgaggaccgaacataatgcaaggttatttcaacaatgtgcaagctactgaatttacaatcaagcaagggtggatgcatactggtgatattgggtactttgatgaaggaggtcagctttttgtagttgacagacttaaagagcttattaagtacaaaggtttccagattgcacctgctgagcttgaaggattacttctatctcatcctgaaattctggatgctgttgttattccgtttcctgatgccgaagctggggaagttcctattgcctatgtagtacggtcccctgttagttctttgactgaagttgatgtccagaaattcatcgagaagcaggtcgcatactacaaaagattgaggagggttacctttgtggacagcgtaccaaaatctgcttcaggaaagattttgagaagggagctcatcgctaaagtcagatcgtcaaagctatagcaaaaccacttcgaatctgtgtcagaagactgctttgcctcttagctatactagattcgaaacttgtggaatgattgtattgagtggaccttatgaaacatgacatttactaggcagcgtcatggggttcgcgggtcgcggcataagagccagcgagcgagccgttgctttgtaaaactctctttttttttcccctacttcattgaaagacacggctcttaaaaaaaaaaaaaaaaaaaa

SEQ ID NO: 3316 - protein, 553 aa, Panicum virgatum
  misc_feature: Ceres CLONE 1790566
  misc_feature: Great-hit functional homolog of the protein sequence encoded by LOCUS At4g05160
  misc_feature: Useful for making plants with altered cell wall content and/or composition
MAGTAAPAAGYCADGVYRSLRPAVRIESDPGLSLTDLLFRRADACPSALALADAASGQALTFSALRSAVLTTAVALASRAGVRPGDVVLLLAPNCVLYPVCFFAVTALGAVATTANPLYTPREIAKQVTDSRAKLAITVSELLPKIAELRLPTILLDGDAASATASMPPGASVTLYSDLIAGAQETEYRRPPIKQSDTAALLYSSGTTGASKGVILTHRNFISAAPMITADQDTHGEGPNVFLCFLPMFHIFGFSVLTFAQMQRGNAVVAMSLPRFDMDFVMAAVQRYRVTHIFCVPPVMIALAKIERTGKYDLSSLRFIGSGAAPLGKDVMEVVARNFPDAIIAQGYGMTETCGIISLEWPEKGQARQFGSAGSLVSGVEAKIVDIETLKCLPPNELGEICVRGPNIMQGYFNNVQATEFTIKQGWMHTGDIGYFDEGGQLFVVDRLKELIKYKGFQIAPAELEGLLLSHPEILDAVVIPFPDAEAGEVPIAYVVRSPVSSLTEVDVQKFIEKQVAYYKRLRRVTFVDSVPKSASGKILRRELIAKVRSSKL

SEQ ID NO: 3317 - DNA, 1670 bp, Panicum virgatum
  misc_feature: Ceres CLONE 1790581
  misc_feature: Encodes the peptide sequence at SEQ ID NO. 3318
gcacactccctccttccccccgcctccgtctcgatcccttcaccctctcgcgctttcgcctagtcaagcctctcgacgcctccttctgacctccgccgccgccgccacgcgcgtggtcaagccacaggaaccctagcatggcgaagacggcgcgatcgcccacggcagaggattccccgccggcggccgcggagaggcaccgctccggctccgcggccgggtcggggctgcggtccctcgccagcgccgcctccgggtggtgggaccggtgggcggtcatgggctccggcctctccaagctcgagagggccttcggcgaccagttccccgagggcgagcgctacttcggcctcgagaacttcggcaacacctgctactgcaacagcgtcctccaggcactttattattgcactccgttccgggagcagttactggaatactatgccaaaaacagaaatcttgaagatgctgaagaaaatttgttgacctgcctagcagatcttttttcacagataagcgcatcgaagaaaaagacgggtgttatcgctccaaaacgtttcattcaaatggttaagaaactgaatgaatattttcgtggttacatgcatcaggatgcccacgaatttttgaatttcttattgaatgaaattgttgatattctggaaaaagagtctagttctgcaaaggtttgtcctgagaccacatctcctgaaaaggtctcaaatggggtagctgtggatggagtcagaaaagagccactggttacatgggtacataagagttttcagggtactttgaccaatgaaaccagatgcctaatgtgtgagactgtcaccgcaaaggatgagacattttttgacttgagcgttgacattgaacagaatagttcactcacaagctgcctgaaaagtttcttctccactgagactttaaatgcggacgacaagttcttctgtgataagtgctgcagtttgcaagaagcggagaagagaatgaagataaaaaaggtaccgcagatattggtgatccccctaaagcgcttcaagttcatcgagcagcttaaccggcacaagaagctgtcttatcgggtggtataccccttggagctgaagctcagcagcaactctgatgatgcggactgcgagtactccctcttcgccgtggtggtccacctgggtagcggtccaaaccagggacactacgtagccaagatcaagagccatgaccactggctgtcctttgatgacgacaatgtcgagatgataccagagtccaccctgcagacgttctacggctcttctcgtgaatatgctggcaacacggatcatggctatatcctgttctacgagcgtgttggtgggaattgcaacggcaagcccgactctccagagggtggcgtgtgaccttaggcatgggatcttgggtggtttggtgtacatatgattgacacactttaaagtgataagagtgggaaactgatgttcattggtgtacattttttttctctggaaagcacggggaaaaaaggaagatgctagtttggactttgaagttataatttaagttgttacagaggatcaacccgtaggatagctcatttgattttatttcccgggatttaatttggcacagtatttgttctgaatggacaaaaaaaaaaaaaaaaaaaa

SEQ ID NO: 3318 - protein, 421 aa, Panicum virgatum
  misc_feature: Ceres CLONE 1790581
  misc_feature (1)..(345): Pfam Name: UCH Pfam Description: Ubiquitin carboxyl-terminal hydrolase
  misc_feature (48)..(407): SWISSPROT Homolog: EC 3.1.2.15 Ubiquitin carboxyl-terminal hydrolase 3
  misc_feature (48)..(407): SWISSPROT Homolog: EC 3.1.2.15 Ubiquitin carboxyl-terminal hydrolase 4
MAKTARSPTAEDSPPAAAERHRSGSAAGSGLRSLASAASGWWDRWAVMGSGLSKLERAFGDQFPEGERYFGLENFGNTCYCNSVLQALYYCTPFREQLLEYYAKNRNLEDAEENLLTCLADLFSQISASKKKTGVIAPKRFIQMVKKLNEYFRGYMHQDAHEFLNFLLNEIVDILEKESSSAKVCPETTSPEKVSNGVAVDGVRKEPLVTWVHKSFQGTLTNETRCLMCETVTAKDETFFDLSVDIEQNSSLTSCLKSFFSTETLNADDKFFCDKCCSLQEAEKRMKIKKVPQILVIPLKRFKFIEQLNRHKKLSYRVVYPLELKLSSNSDDADCEYSLFAVVVHLGSGPNQGHYVAKIKSHDHWLSFDDDNVEMIPESTLQTFYGSSREYAGNTDHGYILFYERVGGNCNGKPDSPEGGV

SEQ ID NO: 3319 - DNA, 2160 bp, Panicum virgatum
  misc_feature: Ceres CLONE 1790603
  misc_feature: Encodes the peptide sequence at SEQ ID NO. 3320
gcgacctgcgagcctgcgacgtccccatccgtcccaccttctggagttctggtcctgcccccagtcccccacccccaccggcgcagcgcgaggggggagcttcgcaatccgccgcggctcgtctagcctcgtctttcgccgcggatccgtggcgccgggtgcggaatttcgcggcggagcggagggcacgctcgtgaagaaaatggcctcattcgcgccgccgtccacggcgtcgtgcgctcgcatccatggtaggtacagaacttctgggttgccttgtgatacttcgcttccgccgagtgctacatcaaacagtttaaggataatcagatccattcgcttggaaaatacccaccgattcagaaacctccatgtatcttatgctgggggtgattcatcagagaatattgttataaatgggaaggccaacccatctaattcagttcaagcagatgctgttgcacttgggaccattgcagctgatatggctcctgttgttgatgggttttctgctgatgacgatgagcttgacttagacagcccgacaaagggtttctcatctatacctgaagctattgaggacattcgtcaaggaaaatacgtcattgttgtggatgatgaagacagagagaatgaaggtgatcttataatggcagcatcaaaggtcacacctgaagctatggcttttatagtgaggcatggcactgggattgtttgtgtcagcatgaaagaagaggatctggaaaggctacaactacctcttatggtgacgacaaaggaaaatgaagagaaactgcgaactgccttcactgtttcagtggatgccaaagagggaacaacaactggggtttcagctaaggaccgggcaaacacaatactagcacttgcatctcctaattccaagcctgaggacttcaaccggccaggacatatttttcctcttaaatatagagaaggtggtgtgctgaaaagggctggacatactgaagcatcagtggatcttgccctgttggctggtttacctcctgttgcagttctttgtgaacttgttgatgatgatgatggctccatggctttgttaccgaaactgcaacaatttgctaagagggagaacctgaagataatatcaatcgcagatctgataagatataggaggaagagagacagattggttgaatgtgtttgtgttacacctttgcaattgcaatggggatcgtttaaagcctattgttatagatctcttattgatgggatggaacacattgccatggtgaagggtgatgttggcgatggccaggatatcctagtaagagtgcattcggagtgcctaactggggacatatttggatctgcaaggtgcgactgtgggaatcaacttgctctggcaatgaccatgattgagaaaactggccggggtgtagtagtttatcttcgtggtcatgaaggcaggggcattgggctgggtcacaagcttcgggcttacaacttacaggatgatgggcgggatactgttgaggctaacttggagctagggctgcctgctgattctcgggagtatggtataggtgcccagatactacgtgatcttggtgtcaggactatgcggctgatgactaacaaccctgcgaaatacactggactcaagggttatggtttaagtgtcctgggcagagtgccgttgcttacaccgataactaatgagaatcggcgctatatggaaacgaagcgactaaagatggggcatgtctacggaacccgccctagcggcggtcatacaagtggcagtggcatgactgatggtggcgcgaaatgggaggcaaggcaagagcaaactccagaatcttaaccgcatatatctgtgttacttctggcagtaaatagactcctaaattccattgcaatatcttctatctttcgatgctgctcaagctttggtcatacgagtcgcgcaagtcttgtctgtgttgctgacgttagtagaggatatgctttcttcggtacttttagtgctttttttattttagatttagaaacagttgacgtattcagctgttggacgtttgtatgagcgtagtgacattgtgtactgtaccgtagtgttcttctgagatgaagttcgatgactgcagtatttggcacgaaaaaaaaaaaaaaaaaaaa

SEQ ID NO: 3320 - protein, 547 aa, Panicum virgatum
  misc_feature: Ceres CLONE 1790603
  misc_feature (1)..(170): Pfam Name: GTP_cyclohydro2 Pfam Description: GTP cyclohydrolase II
  misc_feature (1)..(199): Pfam Name: DHBP_synthase Pfam Description: 3,4-dihydroxy-2-butanone 4-phosphate synthase
  misc_feature (118)..(516): SWISSPROT Homolog: EC 3.5.4.25 Riboflavin biosynthesis protein ribAB [ Includes: GTP cyclohydrolase-2
  misc_feature (8)..(522): SWISSPROT Homolog: EC 3.5.4.25 Riboflavin biosynthesis protein ribAB, chloroplast precursor [Includes: GTP cyclohydrolase-2
MASFAPPSTASCARIHGRYRTSGLPCDTSLPPSATSNSLRIIRSIRLENTHRFRNLHVSYAGGDSSENIVINGKANPSNSVQADAVALGTIAADMAPVVDGFSADDDELDLDSPTKGFSSIPEAIEDIRQGKYVIVVDDEDRENEGDLIMAASKVTPEAMAFIVRHGTGIVCVSMKEEDLERLQLPLMVTTKENEEKLRTAFTVSVDAKEGTTTGVSAKDRANTILALASPNSKPEDFNRPGHIFPLKYREGGVLKRAGHTEASVDLALLAGLPPVAVLCELVDDDDGSMALLPKLQQFAKRENLKIISIADLIRYRRKRDRLVECVCVTPLQLQWGSFKAYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANLELGLPADSREYGIGAQILRDLGVRTMRLMTNNPAKYTGLKGYGLSVLGRVPLLTPITNENRRYMETKRLKMGHVYGTRPSGGHTSGSGMTDGGAKWEARQEQTPES

SEQ ID NO: 3321 - DNA, 2485 bp, Panicum virgatum
  misc_feature: Ceres CLONE 1790606
  misc_feature: Encodes the peptide sequence at SEQ ID NO. 3322
atctcttccttatcgaccgacgctgtggccgccgagccgcccacgtcgctcgtcccccaaccccacccccgacctctctccttcggcgagacaatccccacgcaaccgcgcaccgggagcctgaacaagcggagggggagaaaaatctgcaccccgtacgcctcgccagtgtgctcgcctacttatacactccgctcgctccccccatcccctagttcctcggcttcccctctcccccccccttctccaggccccggctccggtccacacacacagtgagcaaagatggtgccaccatctctgagccttgctgcaaaggcggtggttcccttctcagtacttgcttcaagcggcgttacgcaaaggccggtgtcagtgactgcttccttggagcacaagaccagtgatggcagaaggaagttccttaaacttgcgcttggaaaccttggagttgggctgcccaccctgttgggtgctaagaaagctctcgctgatgagcagggtgtctcttcctcaaggatgtcttactcgaggttccttgagtatcttgacaaggacagagtgaagaaggttgatttgtttgagaatgggacaattgctatcgtggaggccatctctcctgagctcggcaatcgtgtgcagagagtccgtgtgcaacttccaggtctaagccaggagcttcttcagaagttgagggaaaagaacattgattttgccgcacacagcaaccaggaggactctggttcccttctgtttaaccttattggaaatttggcattcccccttatcctcattggtggtctatttttgctatcaagaagggcacaaggtggccttggcggaccaaatggtcctggctttccccttggttttggtcaatctagggccaagtttcagatggaacccaacactggtgttacatttgatgatgttgctggcgtcgatgaagcaaagcaagacttcatggaagtggtcgagttcttgaagaagcctgaaaggttcactgctgttggtgctcgcattcctaaaggtgttcttcttgttggtccacctggaactggtaaaactttgcttgccaaggcaattgctggagaggctggtgtgccatttttctcaatttcgggctctgagtttgtggagatgtttgttggtgttggtgcttcccgagttcgtgatcttttcaagaaggccaaggagaatgctccttgcatagtgtttgttgatgaaattgatgctgttggtaggcaaagaggtacaggtattggtggcggaaatgatgaaagggagcagacactcaaccaactgttgactgagatggatggttttgagggaaacactggaattattgttattgctgccactaaccgagctgacatcttggattctgctttacttaggcctggacgctttgacagacaggtgtctgtcgatgttcccgatgtgcgtggaaggacagagattttgaaagtgcacggtggcaacaagaagtttgatcctgatgtttctcttgatgtcatagcaatgagaacacctgggttcagtggagcagacttggcaaaccttctgaatgaagcagccatactggcaggccgacgtgggaaaacagcaatttcttcaaaagagattgacgattcaattgacagaatagtggctggcatggaaggaactgtgatgacagatgggaagagcaaaagtcttgttgcttaccatgaagttgggcatgcgatttgcggaactttgacacctggccatgatcctgtccaaaaggttaccttagttccaaggggtcaagctcgtggtcttacatggtttatcccgatggatgactcaacgctgatctccaggcagcaactctttgccagaattgttggtggccttggtggtagagctgctgaggaggtcatatttggagagcctgaggtgacaacgggagctgctggtgacttgcagcaaattaccggtttagccaaacagatggtcgtaactttcggtatgtcagagatcggcccatggtctctgatggagggtggagcacagagtggggatgtcatcatgagaatgatggcaaggaactccatgtcggagaagctcgcggaggacatcgatgcggctgtgaagaggttttccgatgaggcctatgagatcgctttgagccacattaggaacaacagggaggcaattgacaagatcgttgaggtgctcattgagaaggagacattgaacggagatgagttccgggcaattctttccgagtttgtggagatccctgtcaagaaccgggttcctccagccacaccggcggcagctctccctgcctaaattcttagttttgcaggggaaatttgttgttataagatgttcatattttggattcttggtgtacactaactctacttcaccagccggatttttggtacactacatgtaacttacacatggtgaattatagtaactgtaattagcttaaaaaaaaaaaaaaaaaaaa

SEQ ID NO: 3322 - protein, 677 aa, Panicum virgatum
  misc_feature: Ceres CLONE 1790606
  misc_feature (1)..(211): Pfam Name: Peptidase_M41 Pfam Description: Peptidase family M41
MVPPSLSLAAKAVVPFSVLASSGVTQRPVSVTASLEHKTSDGRRKFLKLALGNLGVGLPTLLGAKKALADEQGVSSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGGNKKFDPDVSLDVIAMRTPGFSGADLANLLNEAAILAGRRGKTAISSKEIDDSIDRIVAGMEGTVMTDGKSKSLVAYHEVGHAICGTLTPGHDPVQKVTLVPRGQARGLTWFIPMDDSTLISRQQLFARIVGGLGGRAAEEVIFGEPEVTTGAAGDLQQITGLAKQMVVTFGMSEIGPWSLMEGGAQSGDVIMRMMARNSMSEKLAEDIDAAVKRFSDEAYEIALSHIRNNREAIDKIVEVLIEKETLNGDEFRAILSEFVEIPVKNRVPPATPAAALPA

SEQ ID NO: 3323 - DNA, 1568 bp, Panicum virgatum
  misc_feature: Ceres CLONE 1790610
  misc_feature: Encodes the peptide sequence at SEQ ID NO. 3324
gcttaaatccccgaagcccccccaaatcccccggccctcctgttcattcctctcctcctcccacttcccctcctcgccgctgaagagggaggttcccggctcccgcgtgcgtgcgcgcgggatggaggcggcgacgatggcgtggacggcggcggtcgtcggggtcggactggtgtactggttcgtctgggtgatgggcgcggcggaggtgaagggcaagcgcgcggtggatctcaagatgggatccatcacgcgggacaaggtgcaggacaagtacacgcagtactggtccttcttccgccgccccaaggagacggccaccaccgccgccgcggcggagaaggtgcccgacttcgtggacaccttctacaacctcgtcaccgacatctacgagtggggctggggccagtccttccacttctcgccctccctcccgggccgctcccaccgcgaggccacgcgcgtccacgaggagcgcgtcgtcgacctcctcggcgccaagccgggccaccgcctcctcgacgtcggctgcggcgtcggcgggcccatgcgcgccatcgccgggtactcgggatccaacgtcgtcggcatcaccatcaacgactaccaggtgaaccgcgcccgcgcccacaaccgcaaggccggcctcgactcccgctgcgaggtcgtctgcggcaacttcctctccatgcccttcccggacgcctccttcgacggcgcctactccatcgaggccacctgccacgcgcccaggctgcaggacgtctacggcgaggtgttccgcgtgctcaagcccggcggcctctacgtctcctacgagtgggtcaccacatcgctgtaccgcgccgaggacccggaccacgtcgactgcatccaaggcatcgaacgcggcgacgcgctcccggggctgcgccgccaggacgagatcgcgtccatcgccaaggaggtcggcttcgaggtggtcaaggagcaggacctcgccctgccccccgcgctgccctggtggacgcgcctcaagatggggcgcatcgcctactggcgcaactccctcctcgtccgcgtgctcaccatgctccggatcgcccccaagggcgtgtgcgaggtgcacgagatgctcttcgagaccgcccagcacctcaccaaaggcggcgagaccggcatcttcacgcccatgcacatggtgctcctccgcaagccccccgccgccgccgccaccgaggaggcgaaatagggtaagactaggacactcgaccaccgcaagggggagaagaaataatctggcaggagcagcagaggtggtaattaaggagagccggctactcggagagcttcaggaatcagataatttgatctcttaagagaggatactgctaggaaggaaccatatgcttgttgttactcttttcttgttcgtaaatttcagtttgttttttttgtgtggaggattatccggttggagagagagagggagggagaggaggttggaagttagatttgatttctcgctcgcttgatcggtggatccatctatatttatctacttctatctaaaaaaaaaaaaaaaaaaa

SEQ ID NO: 3324 - protein, 369 aa, Panicum virgatum
  misc_feature: Ceres CLONE 1790610
  misc_feature (1)..(99): Pfam Name: Methyltransf_11 Pfam Description: Methyltransferase domain
  misc_feature (1)..(120): Pfam Name: Sterol_MT_C Pfam Description: Sterol methyltransferase C-terminal
  misc_feature (1)..(359): SWISSPROT Homolog: EC 2.1.1.143 24-methylenesterol C-methyltransferase 2
MEAATMAWTAAVVGVGLVYWFVWVMGAAEVKGKRAVDLKMGSITRDKVQDKYTQYWSFFRRPKETATTAAAAEKVPDFVDTFYNLVTDIYEWGWGQSFHFSPSLPGRSHREATRVHEERVVDLLGAKPGHRLLDVGCGVGGPMRAIAGYSGSNVVGITINDYQVNRARAHNRKAGLDSRCEVVCGNFLSMPFPDASFDGAYSIEATCHAPRLQDVYGEVFRVLKPGGLYVSYEWVTTSLYRAEDPDHVDCIQGIERGDALPGLRRQDEIASIAKEVGFEVVKEQDLALPPALPWWTRLKMGRIAYWRNSLLVRVLTMLRIAPKGVCEVHEMLFETAQHLTKGGETGIFTPMHMVLLRKPPAAAATEEAK

SEQ ID NO: 3325 - DNA, 1347 bp, Panicum virgatum
  misc_feature: Ceres CLONE 1790639
  misc_feature: Encodes the peptide sequence at SEQ ID NO. 3326
aggattgtcattttccttcagtgaacgccggggcgccacggcaaacacccccgccggttgcgccacgcgagcggtctctcgcctggctcgatagctcggcgctgctcctgaatcatctccggcctctctgcactccacagcaatggcggaaactcctctgctgcatcactccacggatccgttcgcagacggcgagcacaatgggcacgaccctgccgcgccctcgtcggacgtcgcaacatgcggcgcggacggcggcatccccgtcgtcgatttcgacgtcctcgtcaacggctccgccgatcgaagggcgcgggcgatccgggacctcggccgggcgtgcgaggactggggcttcttcatggtggtcaaccacggggtgcccgaggagctcaaggaggcaacaatggaggcatgcagggagctgttcagcttaccggaggaggagaaggcggggtacctggaggccgggccgatggatcctgtacgaatcgggacgggcttcttctccgtcgtcgacggcgtcaggtactggagggactacctgaagatgttcgtgcaccctgagctccactgccctgcaaagccaccaaaattaagggacgttgctgccgagtactcggcgaagacgagaggcctgctgctggtgctcgccaaggcaatctccgagagcttgggcctcgacggcggtcgaattccggaggccatggacctcgagtcgtgcttccagatcctcgtcgccaaccactacccgccgtgctccggtccgccgggcgacgcgggcctggggatgcccgcgcactccgaccacggcttcctcaccctgctcttccagaacggcgtcgacgggctccaggtcgagcgcgacgggcggtggggcctcgccaagcccctccccggcgcgttcttcgtcatcgccggcgaccagctggagatcgtgagcaacgggagatacaagggcgcgctccaccgcgcggtggtcggcggcgagcgcgcgaggatgtccgtggtgagcatgatctcgccgtgcctggacaccgtggtcgagccggtcccggagctggtgcccgacggccggggcctcgagttccggggcgtcaggtaccgagactacatggagcatcagcagagcaacaagctcgacgggaaaggagcgctggacatcgccagagtgaagcgtgacatcgcagcgcagcctgagaactgagatcgaatgctctgctaaatcctaagactgcatctgcagatcttgatgcttaaaaccgtatccctgtgacatgtttgacaaaattcagaaaaaaatgaaagtggagtctgtttttttttgaaaaaaaaaaaaaaaaaaaa

SEQ ID NO: 3326 - protein, 354 aa, Panicum virgatum
  misc_feature: Ceres CLONE 1790639
  misc_feature (1)..(101): Pfam Name: 2OG-FeII_Oxy Pfam Description: 2OG-Fe(II) oxygenase superfamily
MAETPLLHHSTDPFADGEHNGHDPAAPSSDVATCGADGGIPVVDFDVLVNGSADRRARAIRDLGRACEDWGFFMVVNHGVPEELKEATMEACRELFSLPEEEKAGYLEAGPMDPVRIGTGFFSVVDGVRYWRDYLKMFVHPELHCPAKPPKLRDVAAEYSAKTRGLLLVLAKAISESLGLDGGRIPEAMDLESCFQILVANHYPPCSGPPGDAGLGMPAHSDHGFLTLLFQNGVDGLQVERDGRWGLAKPLPGAFFVIAGDQLEIVSNGRYKGALHRAVVGGERARMSVVSMISPCLDTVVEPVPELVPDGRGLEFRGVRYRDYMEHQQSNKLDGKGALDIARVKRDIAAQPEN

SEQ ID NO: 3327 - DNA, 1698 bp, Panicum virgatum
  misc_feature: Ceres CLONE 1790645
  misc_feature: Encodes the peptide sequence at SEQ ID NO. 3328
atcgtctcgcctccccgtccagacctctcaccacagcgagaggagagagagagagaggggctagggtttcgtgctcccccacgcctcacgcatcgaatccgagccggatcggggggcgcgcagagtcgctggcttcccggcggtgcctgggctgtttgcaatggcatctggaactgatgacaaacctaagatggagagtttgacatcagctgcagcctttgtagagggtggcattcaggatgcatgtgatgatgcatgtagcatttgccttgaggctttctgtgagagtgacccttctgcattgaccagctgcaaacatgagttccatctccaatgcattctggaatggtgccagagaagttcacagtgcccaatgtgttggcaaccaattagtatgaaggatcctaccagccaggagctgcttgaggcagtagagcgcgagaggaacataagaaccaatcaaactcgaaacacaactatattccatcatcctgctcttggggattttgagctgcagcatctacctgttgttggtaatgatgctgagcttgaagagcgtatactacagcatctagctgctgccgctgcaatgggaagggcacaccatcttggaagaagggagggccaccggggccggtctggctctcatggtcgcccacagttcctagttttctctgctcatccaaattcaccttctgctggcacaatttcttcctcttctgctcatgtggagggggacaatgattcaaatcctgttacccctagagctagtgagtcatctccacgagcgattcgcattggagacgcgggtaatcaaagtcctgggatgctcacctatgatgctgaacaggatgctgtcgtttcttctggaaatagcactcctgtatcaagtcctaggttttttaacaggagacactccactgggcagtcaactccagacagggctggcccgtcggatgttcagtctttctcagactccctgaagtctcgcttgaatgctgtctcaatgaagtacaaagaatctattacgaagagtactcgagggtggaaggagagactcttttcgcgcaactcatcggtggcggatcttggttccgaagtgagaagagaagttaatgctggaattgcctctgtctcaaggatgatggagcgtctggaaactagaggaagtagcagaacaggtgatagcccaacaccatccacatctgaagttcctcctacagagtcaagcaatgaaagggcaccagagagcaactctgctcctagtactactactactacaagtgcaagcaacactctggccccctgtgttacgacttctggttcaaattaggacatgtaagagtttaagaaagaaggcctacacatgcccgttcttcatcttgaaaggatgtgtcagtcacgtcgcagagctacaatgtgctatatcacgaagctgtcatcttctcaaccattgcataaacgactgccggaaaaatggaatgatgatttgatgtattgggtggcacgatgaaagggtgttgcggggcctaggaacgtcgatttgatcttctgtttcatctttgtaaaaatttcctctgagcagatttttaccggtataaataacagatatttcaccttcatagtatttgggtcgctataaatatgattggaacagcaaagtttgatgctgttatacaaaaaaaaaaaaaaaaaaaa

SEQ ID NO: 3328 - protein, 390 aa, Panicum virgatum
  misc_feature: Ceres CLONE 1790645
  misc_feature (1)..(41): Pfam Name: zf-C3HC4 Pfam Description: Zinc finger, C3HC4 type (RING finger)
MASGTDDKPKMESLTSAAAFVEGGIQDACDDACSICLEAFCESDPSALTSCKHEFHLQCILEWCQRSSQCPMCWQPISMKDPTSQELLEAVERERNIRTNQTRNTTIFHHPALGDFELQHLPVVGNDAELEERILQHLAAAAAMGRAHHLGRREGHRGRSGSHGRPQFLVFSAHPNSPSAGTISSSSAHVEGDNDSNPVTPRASESSPRAIRIGDAGNQSPGMLTYDAEQDAVVSSGNSTPVSSPRFFNRRHSTGQSTPDRAGPSDVQSFSDSLKSRLNAVSMKYKESITKSTRGWKERLFSRNSSVADLGSEVRREVNAGIASVSRMMERLETRGSSRTGDSPTPSTSEVPPTESSNERAPESNSAPSTTTTTSASNTLAPCVTTSGSN

SEQ ID NO: 3329 - DNA, 2632 bp, Panicum virgatum
  misc_feature: Ceres CLONE 1790646
  misc_feature: Encodes the peptide sequence at SEQ ID NO. 3330
gcgaggtcttcgtctccgcctgggtccagcactgggatttacgcgccctccacccacaaccaacgagcggctgcaatggcggagcccgaggtctcctccgcggcggccggcggcggcggacgactccgtaacgccttcggcggcgtgctctgcgccttcacgctcctcctcatcggcgtcgtcgcgttctcgatccgcctcttctctgtaatcaagtacgagagcgtgatccacgagttcgacccctacttcaacttccgcgtcactcagtttttgtcgaagaatggaatttacgagttttggaactggtttgatgataggacatggtaccctcttggccgtgtgattggtggcactgtgtatcctggtttgacattgactgctggaactatttggtggttggtgaactctcttaacatcccattgtctgtggagacagtttgtgtgttcacagctccaattttctcggcaaatgcttcttgggctacttacctgttaacaaaggaagcaaagggcactggagctggattaatggcagcagccattttggcaatggtcccctcgtacatctcaagatcagttgcaggcagctatgataatgaagctgtagcaatattcgccttgatatttacattttatctgtatgtaaagacactgaacacagggtcactcttttatgcaacgctcaatgccctctcgtatttctacatggtgtgctcttggggaggctacacgttcattatcaaccttatcccgatgcatgttctcttgtgcattgtaactggccgttattcatcgcggctctacattgcatatgctccccttgttatacttggaacacttctggcagccttagtacctgttgttggttttaatgcagtaatgacctctgagcacttcgcatcatttctggtgttcataatccttcatgtggttgctcttgtgtattacatcaaagggcttttgtctcctaggctgttcaaaattgctatgactcttgtcatatctgttggcttagccgtttgttttgctgtagtagctgtgcttgttgcgttggtggcatctagtccaacaaaaggctggagtggccgcagtttgagtctacttgacccaacttatgcaagcaagtatatccccatcattgccagtgtcagtgaacaccaacctcctacctggccctcttattttatggatatcaatgtgttggccttcctgattcctgctgggattatttcatgcttattgcctttgtccgatgcaagctccttcatggtcttgtacttagtcactgctgtttatttttctggagtaatggtgcggcttatgcttgttcttgctcctgctgcatgcattctatctgggattgcgctctctgaagtttttggtgtcctcacacgatccattaaatttcagctgtcaaaattatttgatgatagctctgctgcttcaggtgacagtagctcagagagttctacaaattcagcaaaaagtgaaactaggaatgaaaaatctgaaacagctccaaaggaaaaaccatcaaagaagaaccgaaagaaggaaaaagaagtggcagagagtgttcctgtaaagactaaaaaggaaaagaggcttttggttctgccttttgaattatccgttatgggtattttgttgctgattgtgttaggtggtttctatgtggtccattgtgtatgggcagcagctgaagcgtactctgcgccttcaattgtgctgacatctcactcacgcgatggattgcatgtttttgatgatttccgtgaagcttatgcatggctgagccataacacagatgttgacgacaaggttgcttcctggtgggactacggttaccaaacaactgcaatggccaacagaactgtgattgtagacaacaatacctggaacaacactcacatagcaacagttggtacagcaatgtcatccccggaaaaagcagcttgggaaatcttcaattctttagatgtcaaatacgtgcttgttgtctttggagggcttgttggctaccctagtgatgatatcaataagttcctttggatggttcgcataggaggtggtgtatttcctcacatcaaagagccagattatcttagggatggccagtaccgtgttgatgctcaagccactccaactatgctgaattgcctcatatacaagctttgctattacaggtttgtggagactgatggaaaaggctttgacagagtaagaggatatgaaataggaaagaagcatttcaagctaacacattttgaggaggtattcacaactcaccattggatggtccgaatttacaaactgaaaccccaaaagaacagggttcgaggcaagttgaagaagttgaaatctaatgccaaaactagttccacccttgcggcaggccgaaagaagaacccgtggcaatagatgaagttaacaatactcgatacttgctgttgataggtcaactgcactgagtttgtgaaccagaaaaccacagaactagattagagatatctgcactgttgttgtatttgacccttgtcatgttcttggaaccggccagcagggtgctgatgaaatttttgatagacctgagcaaattttcgcgacctaaaaaaaaaaaaaaaaaaaa

SEQ ID NO: 3330 - protein, 782 aa, Panicum virgatum
  misc_feature: Ceres CLONE 1790646
  misc_feature (1)..(686): Pfam Name: STT3 Pfam Description: Oligosaccharyl transferase STT3 subunit
  misc_feature (30)..(462): SWISSPROT Homolog: EC 2.4.1.119 Dolichyl- diphosphooligosaccharide-- protein glycosyltransferase subunit STT3A
MAEPEVSSAAAGGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTIWWLVNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLSPRLFKIAMTLVISVGLAVCFAVVAVLVALVASSPTKGWSGRSLSLLDPTYASKYIPIIASVSEHQPPTWPSYFMDINVLAFLIPAGIISCLLPLSDASSFMVLYLVTAVYFSGVMVRLMLVLAPAACILSGIALSEVFGVLTRSIKFQLSKLFDDSSAASGDSSSESSTNSAKSETRNEKSETAPKEKPSKKNRKKEKEVAESVPVKTKKEKRLLVLPFELSVMGILLLIVLGGFYVVHCVWAAAEAYSAPSIVLTSHSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLIYKLCYYRFVETDGKGFDRVRGYEIGKKHFKLTHFEEVFTTHHWMVRIYKLKPQKNRVRGKLKKLKSNAKTSSTLAAGRKKNPWQ

SEQ ID NO: 3331 - DNA, 2008 bp, Panicum virgatum
  misc_feature: Ceres CLONE 1790661
  misc_feature: Encodes the peptide sequence at SEQ ID NO. 3332
aactccaatttcacttcacctcgacagcgcacaccccacccaccggtctccctcctccaccaccaccgaattagccaaggcacaggcggagcaggggggcctctcctctccttcccttcctcgccgccttcgcccggcgagccagccagccatggagccggcggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgccctggcgcgggcgctcgtcgagtactacccgctcgcgggccgcctcgccgtgtccgacgccgccggggggctccacgtcgactgcagcggcgagggcgtctggttcgtcgaggccgccgttcggtgccggctcgaggacgtcgactacctcgagtacccgctgcagatccccaaggacgacctgctcccgcacccgctgccgcgccccacccgcgaggaggagaacaagctcatcctgctcgtccaggtgaccacgttcgggtgcggcggcttcgtggtggggttccggttcagccacgcggtggcggacgggctgggcgccgccaagttcatgggcgcggtgggggagctggcgcgcggggcggaccagatctcgccgcccccaacctggggccgcgacgccatcccggacccggccggcgcgcacgtcggcagcctcccagagctggacggcgccaagcgcctcgagtacctggccatcgacatctccgccgactacatcgaccacttcaagtcccagttcgcggcggcgtcgggcgggggccgctgctctgcgttcgaggtgctcatcgccaaggcgtggcagagccgcacccgcgccgcggcgttcgacgccgacacccccgtccacctctgcttcgccgtgaacgcgcgcccgctcctcgccgcccgcctcccgcgcgccggcgtcggcttctacggcaactgctactacatcatgcgcgtgtcctccacggccgggaaggtctccacctcctcggtcaccgacgtggtgaggatcatcagggaggggaagaagcggctgccgtccgagttcgcgcggtgggcggccggggaggaggccggggacccctaccagatcacctccgactaccggacgctgctggtgtcggactggacgcggctgggcttcgccgaggtggactacgggtggggcccgccagcccacgtggtgccgctgacgaacctggactgcatcgccacgtgcatcctcgtcaagccctgggcccacaagccaggggcgcggctcatcacgcagtgcgtgacgcccgaccgcgtcgccgccttccacgacgccatggtggacatgaactgctagcaatccacaccttccattccatctgttgttcttttaaactcttcgattaaattaccgcggtacgtaattagcagggggtaatggcattaaacagcccttctggtgacgaagagcgacagcaaagaataaagtcagaaagtgacaaaatatcgataaagtacatagagccagcaggtttgggggactggtagacaactagacggtagttggcaatagtgggattggtattggattccttatttcctttggatgtcgtcttcttttgttggtggtggtgggaggcaggtctaggactctagctgtgtgtatacatgtcctcttttcttcttattttctgctgtcagttcttgggggggctttgattgaaggaaggatgatcaaagctggacttggtgggaagccaccaactaacctccccctaaatctcaatataaagatgtggattcgatgacctgtattatagtattcaacattttttttcttctttgtcatatactatacacaagccaataatgagtacagcctttgaattgcggattctaaaaaaaaaaaaaaaaaaaa

SEQ ID NO: 3332 - protein, 431 aa, Panicum virgatum
  misc_feature: Ceres CLONE 1790661
  misc_feature (1)..(432): Pfam Name: Transferase Pfam Description: Transferase family
MEPAAKTVERLAQRLVPPAEPTPTGPHRLSWLDRYPTQMALIESLHVFKPDPARDGVSPAETIQRALARALVEYYPLAGRLAVSDAAGGLHVDCSGEGVWFVEAAVRCRLEDVDYLEYPLQIPKDDLLPHPLPRPTREEENKLILLVQVTTFGCGGFVVGFRFSHAVADGLGAAKFMGAVGELARGADQISPPPTWGRDAIPDPAGAHVGSLPELDGAKRLEYLAIDISADYIDHFKSQFAAASGGGRCSAFEVLIAKAWQSRTRAAAFDADTPVHLCFAVNARPLLAARLPRAGVGFYGNCYYIMRVSSTAGKVSTSSVTDVVRIIREGKKRLPSEFARWAAGEEAGDPYQITSDYRTLLVSDWTRLGFAEVDYGWGPPAHVVPLTNLDCIATCILVKPWAHKPGARLITQCVTPDRVAAFHDAMVDMNC

SEQ ID NO: 3333 - DNA, 1674 bp, Panicum virgatum
  misc_feature: Ceres CLONE 1790662
  misc_feature: Encodes the peptide sequence at SEQ ID NO. 3334
gtaactaccaaacggcaattgaatattcgtgatcacacaagtataagtccggcctccgtccaatggaagaagaatcgatcaagcccacactactgcctttctctctcttgcccttccaagcgaaaagatggagtcgctagcggcacggttgcttctgctggtggccgtggtggccgcggccacgggcgccccggccgccgccgcgacaccgccccaccccgccaagggcctgcgcgtgcgcctgacgcacgtcgacgcgcacggcaactactcgcggctgcagctgctgcagcgggcggcgcgccggagccgccaccgcatgtcgaggctcgtcgcgcgggccactggcgcgccgatgtcgtcgagcaaggcagccgccgcggcgggcggcgacctgcaggtgccggtgcacgcgggaaacggcgagttcctgatggacctggccatcggcacgccggcgctgccgtacgcggccatcgtggacaccgggagcgacctggtgtggacgcagtgcaagccgtgcggggagtgcttcaaccagagcacgccggtgttcgacccctcggcgtcctccacctacgcccccgtgccgtgctccagcgacctgtgcggcgacctgcccacctccagctgcacgtcggcgtcccggtgcgggtacgcctacacctacggcgacgcctcgtcgacgcgcggggtgctggccaccgagaccttcacgctggccaagtccaagctcccgggcgtggcgttcggctgcggggacaccaacgagggcgacgggttctcgcagggcgcggggctcgtggggctcgggcgcggcccgctgtcgctcgtctcccagctcggcctcgacaagttctcctactgcctcacctccctggacgacaccggcaagagcccgctgctcctgggctccgccgccggcatcgccgagagcgcggccacggcgcccgtgcagagcaccccgctggtgaagaacccgagccacccgtccttctactacgtgaccctgacgggcctcaccgtggggtccgcccgcatcaccctcccgagctcggcgttcgcgatccaggacgacggcacgggcggcgtcatcgtcgactccggcacctccatcacgtacctggaggcgccgggctaccgcgcgctgaggaaggcgttcgtggcgcagatgtccctgccggtcgccgacgcgtcggagatcgggctggacctgtgcttccaggcgcccgccaagggcgtggaccaggtgcgggtgccgaagctggtgctccacttcgacggcggcgcggacctggacctccccgccgagaactacatggtgctcgactccgcgtccggcgcgctgtgcttgacggtgatgccgtcgaggggcctctccatcatcggcaacttccagcagcagaacttccagttcgtgtacgacgtcgccgcgaacacgctctcgttcgcgcccgtgcagtgcggcaagctgtgagccgccggactcgcagccgtacgcgtgcctgactacctgtaaatgtgtggttgtattggatgggcgattgattggtcttcgcttgagcttgacgatggggtggttaccggtcagtgaatcgatgccgacttgtagatatcatcatgttcgttcatgacacgctgagatttaggatggaaaaaaaaaaaaaaaaaaaa

SEQ ID NO: 3334 - protein, 449 aa, Panicum virgatum
  misc_feature: Ceres CLONE 1790662
  misc_feature (1)..(346): Pfam Name: Asp Pfam Description: Eukaryotic aspartyl protease
MESLAARLLLLVAVVAAATGAPAAAATPPHPAKGLRVRLTHVDAHGNYSRLQLLQRAARRSRHRMSRLVARATGAPMSSSKAAAAAGGDLQVPVHAGNGEFLMDLAIGTPALPYAAIVDTGSDLVWTQCKPCGECFNQSTPVFDPSASSTYAPVPCSSDLCGDLPTSSCTSASRCGYAYTYGDASSTRGVLATETFTLAKSKLPGVAFGCGDTNEGDGFSQGAGLVGLGRGPLSLVSQLGLDKFSYCLTSLDDTGKSPLLLGSAAGIAESAATAPVQSTPLVKNPSHPSFYYVTLTGLTVGSARITLPSSAFAIQDDGTGGVIVDSGTSITYLEAPGYRALRKAFVAQMSLPVADASEIGLDLCFQAPAKGVDQVRVPKLVLHFDGGADLDLPAENYMVLDSASGALCLTVMPSRGLSIIGNFQQQNFQFVYDVAANTLSFAPVQCGKL

SEQ ID NO: 3335 - DNA, 2601 bp, Panicum virgatum
  misc_feature: Ceres CLONE 1790667
  misc_feature: Encodes the peptide sequence at SEQ ID NO. 3336
acttggcgccgcgacacacgcgcacacagccatgggacgccgcgcgcgctcctgcccccacgtcgccgcgccggcggcggtcctcctcctcctcctgcacctggtgctggcgccgcacgccgccgcggcgtccgacccgccctacacctgcggcgccggcgcgccgcccaacatcccgttctgcgacacgggcctgccgatcgaccggcgcgtgggcgacctcgtcgcgcggatgacggtggcggagaagatctcgcagctcggggacgagtccccggccgtccccaggctcggcgtgccggcgtacaagtggtggtccgaggcgctgcacggcgtgtcggaccacggccgcggcgtccacctcagcggcccgctccgcgccgccaccagcttcccgcaggtcatcctcaccgccgcgtccttcaacccgcacctctggtaccgcatcggccaggtgatcggcgtggaggcgagggcggtgtacaacaacgggcaggcggaggggctcaccttctgggcgcccaacatcaacgtgttccgggacccgcggtggggcaagggccaggagacccccggcgaggacccgacggtgaccggcaagtacgccgccgtcttcgtccgcggcgtgcagggctacggcatctccggccccgtcaactccaccgacctcgaggcctccgcctgctgcaagcacttcaccgcctacgacctcgagaactggaagagcgtcacccgatacgtcttcgacgccaaggtgacggcccaggatctggaggacacgtacaaccctccgttcaagagctgcgtggaggacggccacgccagcggcatcatgtgctcctacaaccgcgtcaatggcgtgccgacgtgcgccgactacaacctcctctccaagaccgccaggcagaactggggattctacggatatatcacttcggactgcgacgctgtgtcaatcatccatgacgcgcaagggtatgccaagacggcagaagatgcagttgcagatgtcctcaaggctgggatggacgtgaactgtggcagctacgtgcagcagcacggcgcgtctgcgctgcagcaggggaagatcaccgagcaggacatcgacagagccctgcacaacctgttcgccgtcaggatgcggctggggctcttcaacggcgaccccaggcgcaaccggttcggcaacatcggcccggaccaggtctgctcgcaggagcaccaggacctggccctgcaagcggcgcaggagggcatcgtcctcctcaagaacgacggcgccgcgctgcccctgtccaagtccacggtcgcctcgctcggcgtcatcgggttcaacgcgaacgacgccacgcggctgctcggcaactacttcggcccgccctgcgtgacggcgacgccgctccaggtgctgcagggctacgtcaaggacacgaggttcgccgccggctgcaacgccgccgcctgcaacgtgacggcgatccccgaggccgtccaggtggcgagctcggtggactccgtcgtgctgttcatgggcctggaccaggatcaggagagggaggaggtcgaccggctggacctgacgctcccggggcagcagcagagcctcatcgagagcgtggcgaacgccgcgaaaaagccggtgatcctggtgctgctgtgcggcgggccggtggacgtgagcttcgcgaagacgaaccccaagattggcgccatcctgtgggctggctaccccggcgaggccggcggcatggccattgcgcaggtcctcttcggagagcacaacccaggtgggaggctaccggtgacgtggtatcctcaggatttcacggaggtgcccatgacggacatgcggatgcgcgccgacccggcgacgggctaccccggccggacgtaccggttctaccgcggccagaccgtgttcgacttcggctacggcctgagctactccaagtactcccaccgcttcgtcgccagtggcacgaagcccccctccatgagcagcatcgccggcctgaaggcgctggagccgacgacgactgcggccggcgcggcgatgtacgacgtggaggcgatcgggtcggaggcgtgcgagcggctcaagttcccggcggtggtgcgggtgcagaaccacgggcccatggacgggaagcacccggtgctgctgttccttcggtggcccaacacgacggacggcagcggtaggccggcccggcagctgatcgggttccggagcctgcacctgcgggcgatgcaggcggcccacgtggagttcgaggtgagcccgtgcaagcacttcagccgggccagcaaggacggccggaaggtgattgaccaggggtcgcacttcgtgatggtcggcgaggatgacgagttcgagatgagcttcatggcgtgatcgggtgggcccgttagaactgcgacgtaccctcgctgagttcccaaagaaaattgtattccgatgctctctaacttattattgcaagcacaaaagatggtaatttaagcatgattacggcattgctagtgccagatgttcattgataaatcagtctgccaccgtcagacccggacttacgggagcaaaaaaaaaaaaaaaaaaaa

SEQ ID NO: 3336 - protein, 787 aa, Panicum virgatum
  misc_feature: Ceres CLONE 1790667
  misc_feature (1)..(232): Pfam Name: Glyco_hydro_3_C Pfam Description: Glycosyl hydrolase family 3 C terminal domain
  misc_feature (1)..(257): Pfam Name: Glyco_hydro_3 Pfam Description: Glycosyl hydrolase family 3 N terminal domain
MGRRARSCPHVAAPAAVLLLLLHLVLAPHAAAASDPPYTCGAGAPPNIPFCDTGLPIDRRVGDLVARMTVAEKISQLGDESPAVPRLGVPAYKWWSEALHGVSDHGRGVHLSGPLRAATSFPQVILTAASFNPHLWYRIGQVIGVEARAVYNNGQAEGLTFWAPNINVFRDPRWGKGQETPGEDPTVTGKYAAVFVRGVQGYGISGPVNSTDLEASACCKHFTAYDLENWKSVTRYVFDAKVTAQDLEDTYNPPFKSCVEDGHASGIMCSYNRVNGVPTCADYNLLSKTARQNWGFYGYITSDCDAVSIIHDAQGYAKTAEDAVADVLKAGMDVNCGSYVQQHGASALQQGKITEQDIDRALHNLFAVRMRLGLFNGDPRRNRFGNIGPDQVCSQEHQDLALQAAQEGIVLLKNDGAALPLSKSTVASLGVIGFNANDATRLLGNYFGPPCVTATPLQVLQGYVKDTRFAAGCNAAACNVTAIPEAVQVASSVDSVVLFMGLDQDQEREEVDRLDLTLPGQQQSLIESVANAAKKPVILVLLCGGPVDVSFAKTNPKIGAILWAGYPGEAGGMAIAQVLFGEHNPGGRLPVTWYPQDFTEVPMTDMRMRADPATGYPGRTYRFYRGQTVFDFGYGLSYSKYSHRFVASGTKPPSMSSIAGLKALEPTTTAAGAAMYDVEAIGSEACERLKFPAVVRVQNHGPMDGKHPVLLFLRWPNTTDGSGRPARQLIGFRSLHLRAMQAAHVEFEVSPCKHFSRASKDGRKVIDQGSHFVMVGEDDEFEMSFMA

SEQ ID NO: 3337 - DNA, 1578 bp, Panicum virgatum
  misc_feature: Ceres CLONE 1790691
  misc_feature: Encodes the peptide sequence at SEQ ID NO. 3338
aaaaagaggacaagtcggagacgaaaacgggagggagacgaaactagtggagtggtcatcccatgatagaagctccattagccccttgataaagcgaggcagcggcttgtttacgtgccacacttcgctccgctccgctcccgacctagccaggcccgacgatgcagcggtggctcccggcgatcctccgccgcgcgtcccccggcggcggcgcggcgcggcttttctcctcgtcctccctcctcttcgacgagacgcaggagcagttcaaggagagcgtgcacaagttcgcgcaggaggccatcgcgccgcacgccgccgcgatcgacgcctccaaccgtttccccacgggcgttgacctgtggaggctcatgggggacttcaacctccacggcctcaccgcgccggaggagtacggcgggatggggctcggctacatgtaccactgcatcgccatggaggagatcagcagggcctccgggtccgtcggcctctcctacggcgcgcactccaacctctgcatcaaccagctggtccgtcatggcaacccggagcagaagcagaagtatctacccaagctgatcagtggtgagcatatcggggcgttagcaatgagcgaacccaactctggttctgatgtggtcagtatgaaatgcaaagctgagaaagtggacggtggctatgtcatcaatgggaataagatgtggtgcacgaatgggccttctgctcagacactggttatttatgcaaaaacggatttagctgcagggtcaaaaggaataactgcattcataatcgagaaagggatgcctgggttcagtactgctcagaagttggacaaacttggcatgcgaggaagcgacacgtgtgagcttgtttttgagaattgctttgtgccacacgaaaatgttcttggtgaagagggcaaaggtgtttatgtcatgatgtcagggcttgatctggaaagacttgtattagctgcaggtcccattggtcttatgcaggcatgccttgatgccgtacttccatatgttcgccagagggagcagtttggccgtccaattggtgaatttcagttcatacagggtaaaatggctgacatgtacacctcgctgcaatcatcaagatcattcgtatactcagttgctagggactgtgataatggcaaagttgaccgcaaggattgtgcaggagtaattctttttgctgctgaaaaggcaacccaagttgcacttcaggcaatccagtgtcttggtggcaatgggtacataaatgagtacccaactgatcgtctcctcagagatgcaaagctgtttgagattggtgctggtactagtgagataagaagaatgataattggccgtgagctcttcaaagaggattgaaattgttattttgcaagccagatatcaatagatgttgttaactggaggaggtgagcgagatttagatatttagcaaaccgcctctatggttcaatagttgattctgctctatgctagcatcctcatgcttttgtataatttcaacattcatcaaataaagttcgcttccttgtaaaaaaaaaaaaaaaaaaaa

SEQ ID NO: 3338 - protein, 407 aa, Panicum virgatum
  misc_feature: Ceres CLONE 1790691
  misc_feature (1)..(150): Pfam Name: Acyl-CoA_dh_1 Pfam Description: Acyl-CoA dehydrogenase, C-terminal domain
  misc_feature (20)..(407): SWISSPROT Homolog: EC 1.3.99.10 Isovaleryl-CoA dehydrogenase, mitochondrial precursor
  misc_feature (24)..(405): SWISSPROT Homolog: EC 1.3.99.10 Isovaleryl-CoA dehydrogenase 1, mitochondrial precursor
MQRWLPAILRRASPGGGAARLFSSSSLLFDETQEQFKESVHKFAQEAIAPHAAAIDASNRFPTGVDLWRLMGDFNLHGLTAPEEYGGMGLGYMYHCIAMEEISRASGSVGLSYGAHSNLCINQLVRHGNPEQKQKYLPKLISGEHIGALAMSEPNSGSDVVSMKCKAEKVDGGYVINGNKMWCTNGPSAQTLVIYAKTDLAAGSKGITAFIIEKGMPGFSTAQKLDKLGMRGSDTCELVFENCFVPHENVLGEEGKGVYVMMSGLDLERLVLAAGPIGLMQACLDAVLPYVRQREQFGRPIGEFQFIQGKMADMYTSLQSSRSFVYSVARDCDNGKVDRKDCAGVILFAAEKATQVALQAIQCLGGNGYINEYPTDRLLRDAKLFEIGAGTSEIRRMIIGRELFKED

SEQ ID NO: 3339 - DNA, 1512 bp, Panicum virgatum
  misc_feature: Ceres CLONE 1790722
  misc_feature: Encodes the peptide sequence at SEQ ID NO. 3340
atcacaacacagcacaagcaagacacacactctctatctgagccaggcagcaatagctgcagcagcaatggcgagactagcgctggtgccggcggccatggcggccgcgctggtggtggtgctgctgctggccgcggccccggcgccggcggccgcgatcgagttcggcgcggaggacctggcgtcggaggaggcgctgtgggcgctgtacgagcggtggcgcggcgtgcacgcggtggcgcgcgacctgggcgacaaggcccggcgcttcaacgtcttcaaggagaacgcgcgcctcatccacgacttcaaccagcgggacgagccgtacaagctccgcctcaaccgcttcggcgacatgaccgccaacgagttccgccgccactacgccggctccagggtcgcgcaccaccgcatgttccgcggcgaccggggcgacgccgccgggtcgtccttcaggtacgccgccgcgcgcgacctcccggcctccgtcgactggcgccagaagggcgccgtcaccgacgtcaaggaccagggccagtgcgggagctgctgggcattctcgacgatcgccgccgtggagggcatcaacgcgatcgtgaccaagaacctgacgtcactgtcggaacagcagctggtggactgcgacaccaaggccaacgccggctgcaacggaggcctcatggactacgcgttccagtacatcgccaagcacggcggggtggccgccgaggacgcatacccgtaccgggcccggcaggccgcctgcaggaaggccgccgccgccccggccgtgagcatcgacgggtacgaggacgtgccggccaacgacgaggcggcgctgcgcaaggcggtggcgcaccagccggtggcggtggccatcgaggccagcggttcgcacttccagttctactcggagggcgtgttcgcggggcgctgcggcacggagctggaccacggcgtggcggccgtcggctacggggtcgccgccgacgggaccaagtactgggtggtcaagaactcgtggggccccgagtggggggagaaggggtacatccgaatggcccgcgacgtggccgccaaggaggggctctgcggcatcgccatggaggcgtcctaccccgtcaagacctcgccaaacccagtcaagctccgcgccgctgccgctgccggcgacgaggacctccacgacgagctctgaattaattctgagtcgtcgtccgatcgatgatatgatatggatcgatcgagtggagtggagtgactggataattaagcactacttaacttattacctactctatctatctagttattatatactgatcgatggaagacttgcacactatgtaacactaccgttcgtccgtgcatgtagtacgtacgttcgagaggtgatctacaagcaagcagcttgcattatctatccagtatatatgatgtaactcattattaagactttattatttgagacatctatcaatattgctacaaaaaaaaaaaaaaaaaaaa

SEQ ID NO: 3340 - protein, 377 aa, Panicum virgatum
  misc_feature: Ceres CLONE 1790722
  misc_feature (1)..(218): Pfam Name: Peptidase_C1 Pfam Description: Papain family cysteine protease
MARLALVPAAMAAALVVVLLLAAAPAPAAAIEFGAEDLASEEALWALYERWRGVHAVARDLGDKARRFNVFKENARLIHDFNQRDEPYKLRLNRFGDMTANEFRRHYAGSRVAHHRMFRGDRGDAAGSSFRYAAARDLPASVDWRQKGAVTDVKDQGQCGSCWAFSTIAAVEGINAIVTKNLTSLSEQQLVDCDTKANAGCNGGLMDYAFQYIAKHGGVAAEDAYPYRARQAACRKAAAAPAVSIDGYEDVPANDEAALRKAVAHQPVAVAIEASGSHFQFYSEGVFAGRCGTELDHGVAAVGYGVAADGTKYWVVKNSWGPEWGEKGYIRMARDVAAKEGLCGIAMEASYPVKTSPNPVKLRAAAAAGDEDLHDEL

SEQ ID NO: 3341 - DNA, 1530 bp, Panicum virgatum
  misc_feature: Ceres CLONE 1790738
  misc_feature: Encodes the peptide sequence at SEQ ID NO. 3342
aaccttaactgaacagcagcctccatacctgctccagtagagctagtttggaaacgagagagctaacccagggaggtacgccctggaaagtgaattctgcggcaaatgctctcatcgtctctttcctagctgtgatatcatatccatattggtcagaatgatcagtacagaacaggatttccatatggtcgaaggggaaggggaaaatagctacacgaagaattccaggtgccaggagaagatttttcatgggagtataccaatgcttgagaatggcatcagaaaagtatttgaaactcttggtgtcaaaaccatgaccattgttgatctaggatgctcttcaggaccaaacacattgctctttgtctctaaattaatagatatcacaactgaacaatgcaacaaagctgttgagtgtgatcctatggaacttctgatcttcctgaatgacctaccaggtaacgacttcaaccaagttttccgttcactcgaaaacttggagaaaggtacatcagatcaaaagggaaacacacaagttttttaccatatttctgggttgccaaaatcatactacaacaggctattacccagagaaagtgtccatctctttcactcctcttccagccttcactggcggtcgcaggtacctgaggtactggaagcaagtagagatgccttgctaaacaaagataacatttacatctcagagactagtacatcatttgtagtaaagtgcttcagagagcagtttaataaggacttctctaccttcctaaagctgcgtcatgaagaacttgtgtatggagggaaaatggttctaacattttgtggaaggaaggatgaagatgtatacaatggagatctcaacaaactttttggattacttgctatgtcactgcaatctcttgtcacaaagggtcttgtggagagcgaaaagctagactccttcaatttaccattttatgggccatcaatttctgaagtgaagtatatagtaatgcaaagccacatgtttgaattggatcatatcaaactatttgaaataaactgggatccttatgatgatacagaaggtgatgatgttcatgacagtgtctgcagtggcatcaatgtttctaagtttattagagcagcgctggaacctatgattgcacgccattttggggaaaccatacttgacacattgttcacggagtatgcattttttgtctccaagcacctccagaaggagaagacgaagtttgcgataatcaccatgtccttgaagaaggtgtagtaggaacaaattaatgggatcaatcagattgcactcttccagataccatattgtgacgtcttgctatacatattttattttcattagtgtgtgtctacgggttaattgtcgtcagagtgtctatatctctttgctgtatgcatcctggttgtcgtgagtgacgaaaatgttgtttgctgtgtgtatcctcgttgtgcagagtctgctagtattttcaatatggatgtatatagttgatataccaacaatattgc

SEQ ID NO: 3342 - protein, 372 aa, Panicum virgatum
  misc_feature: Ceres CLONE 1790738
  misc_feature (1)..(336): Pfam Name: Methyltransf_7 Pfam Description: SAM dependent carboxyl methyltransferase
MISTEQDFHMVEGEGENSYTKNSRCQEKIFHGSIPMLENGIRKVFETLGVKTMTIVDLGCSSGPNTLLFVSKLIDITTEQCNKAVECDPMELLIFLNDLPGNDFNQVFRSLENLEKGTSDQKGNTQVFYHISGLPKSYYNRLLPRESVHLFHSSSSLHWRSQVPEVLEASRDALLNKDNIYISETSTSFVVKCFREQFNKDFSTFLKLRHEELVYGGKMVLTFCGRKDEDVYNGDLNKLFGLLAMSLQSLVTKGLVESEKLDSFNLPFYGPSISEVKYIVMQSHMFELDHIKLFEINWDPYDDTEGDDVHDSVCSGINVSKFIRAALEPMIARHFGETILDTLFTEYAFFVSKHLQKEKTKFAIITMSLKKV

SEQ ID NO: 3343 - DNA, 1401 bp, Panicum virgatum
  misc_feature: Ceres CLONE 1790759
  misc_feature: Encodes the peptide sequence at SEQ ID NO. 3344
gagtgaagcgctaagcaaatcacaaaagctctaatcatcaatggcagtctcctcctcctcgggctctgccaatgccctagcgtgcttccacgcctccctcctcgcgccccaaacccgaagaacagcggtggcgtcagcttcgccgcatcgcgcttccgtcaggatgcgcgcctctactgctgcaccggcggagctgaagaagaccgtctgggtgtggaccgagaatcggcaggttatgaaggcggccgtggagagggggtggagcactttcctcttcggatccaaagatctcggcgaggattggtcatctactgctcgcatcaatcctctctttattgatggtccagagattttcgatggcgaaaatcaaaaagttgctgaaatttcgcaagtctcttcacccagagagcttgaactcgtacaaccagacaatgtagaagtcaagaacattgtcatagactttcgaggtggttggcaggttataccggccgaaaatatagttgctgcattccaaggatgtagaggaactgtattggctgtttcaacaaattcaactgaggctcaagtttttcttgaggccttagagcaagggcttgatggagttgtacttaaagtagatgaaatggatgatatcattaagctcaaggattattttgacagaaggaatgaggcaaagagtcaattaccattgacaaaggctactgtatcaaaggttgaagttgttggtatgggtgatcgtgtttgtgtggacctttgcagtatgatgcgacctggtgaaggccttctggttggatcctatgcaagaggaatgttccttgttcactctgaatgcttggagacgaactacattgcaagcaggcctttcagggtcaatgcggggcctgtgcatgcatatgtcactgtccctgggggcaagactagctacctctctgagttgcgatcaggaaaggaaatcattgtggttgatcaacatgggctatggcgtactgcgattgtgggtcgtgtgaagattgaatcaaggcctctcgtccttgtagaagcaaaggacaactctggagacgatacgtatagcattttcctacagaatgcagagacagttgcgctcatcaccgacgacacaggatcaagtggaagaactgctattcctgtgacttcgctgaaagtcggtgatgaagttttggtgaggaaacagggtggcgctcgtcacactgggatagagattcaggagttcattgtcgagaaatgaaaacagaacgcagaatgcagctgttacctgctaccaactttcgttttgcccaaaacaatttatgtatggatgcaacttgcgcaccaaatttcgagtgaaaaaagcgggggaaactgtgtcaaaaaaaaacttgcacaaaaaaaaaaaaaaaaaaa

SEQ ID NO: 3344 - protein, 401 aa, Panicum virgatum
  misc_feature: Ceres CLONE 1790759
  misc_feature (1)..(348): Pfam Name: DHQS Pfam Description: 3-dehydroquinate synthase (EC 4.6.1.3)
MAVSSSSGSANALACFHASLLAPQTRRTAVASASPHRASVRMRASTAAPAELKKTVWVWTENRQVMKAAVERGWSTFLFGSKDLGEDWSSTARINPLFIDGPEIFDGENQKVAEISQVSSPRELELVQPDNVEVKNIVIDFRGGWQVIPAENIVAAFQGCRGTVLAVSTNSTEAQVFLEALEQGLDGVVLKVDEMDDIIKLKDYFDRRNEAKSQLPLTKATVSKVEVVGMGDRVCVDLCSMMRPGEGLLVGSYARGMFLVHSECLETNYIASRPFRVNAGPVHAYVTVPGGKTSYLSELRSGKEIIVVDQHGLWRTAIVGRVKIESRPLVLVEAKDNSGDDTYSIFLQNAETVALITDDTGSSGRTAIPVTSLKVGDEVLVRKQGGARHTGIEIQEFIVEK

SEQ ID NO: 3345 - DNA, 1602 bp, Panicum virgatum
  misc_feature: Ceres CLONE 1790760
  misc_feature: Encodes the peptide sequence at SEQ ID NO. 3346
cacccatcaacgacctggactcacgccgtatctccccttcccaccggcaaccgggcatcgtcgtcggctcgtcgccgcctgcgccgccgccgcggccgccatgtggaggggcggcgccaccgccgccgccgccgcaaaggctcttcgctcgcgcctcatccccgaccccatccaccacccggccacgtcgctcgctcctatcgcctcggcgcgtgcctcctcctccgcaccctccgccgccgcagcagcgaacaacgtcgttgaagaagcagcggcggcggccgtatccgtctcccagcaggccggatccttttccaacgcgctatatcactacgggaggtgctactgggagctctccaaagctcgcctcagtgctcttgttgtggcaacttctggggctggctatgtgcttggtagtggcaatgtcgtggatgttgccggactttgttgcacatgcgctggtacaatgatggttgcggcatctgcaaataccctcaaccaggtgttcgagataaaaaatgataccaaaatgaaaaggacaatgcggcggcccctgccgtcaggtcgaattagtcctgcacatgctgccatgtgggctacgagtgttggagctgcaggaacagctttgttggcctggaaggctaatggcttggcagctgagcttgcagcttctaatcttgtcctgtacgcatttgtatatactccactgaagcaaatacacccagttaatacatgggtaggagcagttgttggtgccattccaccacttctggggtgggcagcagcttctactgaattgtcactaaatgctatgattctccctgctgcattgtactattggcaaataccccattttatggcgcttgcatacttatgtcgtgatgattaccttgctggagggtaccgtatgttttcttttgctgaccctactggtaaaaaaactgcgtgggtatcgctcagaaattgcctgtacatgctgcctttgggattttttgcatacaactggggcctctcatctgagtggttcggccttgaagcatcactactaacaatgggccttaccattggagctctatcgtttgtgctggaaccaagcccgaaaactgcaaggagaatgttctatggaagcctgctgtatctccctgctttcatggctgaacttctattacatcggctgcctaacgaacataaggtgcacaatctgactgagaaaagtgagctcgatggagttctctatggggctgatctgcaggatgaccaaagagcgagacagaagcacgaagacaggaaaccttctcgtgtgcaatcacgccctccagttgcttatgcttccgtggctccgttccctttcttgccggtgcccatatacgagtcatgaaaaccttctccagttcttcctgcatcagtgggcctctgcctgccggagcaatatgttcatgcacttttggcttcatacatgaattttctgccgccaagggggtccttggtctcgttgttgttgaaattatagaatatttttttgggtggtgggctctttgcggtccatctgaatgtaaaaaaaaagtgctgctggtcctcattcaaaaaaaaaaaaaaaaaaaa

SEQ ID NO: 3346 - protein, 425 aa, Panicum virgatum
  misc_feature: Ceres CLONE 1790760
  misc_feature (1)..(268): Pfam Name: UbiA Pfam Description: UbiA prenyltransferase family
MWRGGATAAAAAKALRSRLIPDPIHHPATSLAPIASARASSSAPSAAAAANNVVEEAAAAAVSVSQQAGSFSNALYHYGRCYWELSKARLSALVVATSGAGYVLGSGNVVDVAGLCCTCAGTMMVAASANTLNQVFEIKNDTKMKRTMRRPLPSGRISPAHAAMWATSVGAAGTALLAWKANGLAAELAASNLVLYAFVYTPLKQIHPVNTWVGAVVGAIPPLLGWAAASTELSLNAMILPAALYYWQIPHFMALAYLCRDDYLAGGYRMFSFADPTGKKTAWVSLRNCLYMLPLGFFAYNWGLSSEWFGLEASLLTMGLTIGALSFVLEPSPKTARRMFYGSLLYLPAFMAELLLHRLPNEHKVHNLTEKSELDGVLYGADLQDDQRARQKHEDRKPSRVQSRPPVAYASVAPFPFLPVPIYES

SEQ ID NO: 3347 - DNA, 1559 bp, Panicum virgatum
  misc_feature: Ceres CLONE 1790775
  misc_feature: Encodes the peptide sequence at SEQ ID NO. 3348
atcataattcatacaagctaagtcaagccttatctttggcctactagtgcatatattcttgaaaggttacccaggctcaaaaataccccaactgctacttcagctcactccaatccaacgtaagaggctgctaccaagatcagttcaccatggacagcaatggcacggcggtgctggccccgccgccgtctcaggggaggctgatcaccgtgctgagcatcgacggcggcggcatccgcggcctcatcccggccaccatcatcgcctgccttgaggccaagctccaggagctggacgggccagaggccaggatcgccgactacttcgacgtgatcgccgggacgagcaccggcgcgctgatcacggcgatgctggcggcgccggacaagaagaagcggccgctcttcgccgccaaggacatcaaccagttctacctcgacaacgggcccaagatcttcccacaaagaaagatcgggttcctgaagccgacggcgaacctgctgagcctgatgagagggctcaagtacgacggcgccttcctgcacgacaagatcacgagcctgacgcacgacgtgaggatcgcggacacggtgaccaacgtcgtggtgccggcgttcgacgtcaagtccctgcagccggtcatcttctcgacgtacgaggcggtgcacgagcccctcaagaacgcgcacctctccgacatctgcatcagcacggcggcggcgccaacctacttcccggcgcacttcttcaggaccgagggcgagaagcccggcggccgggagttccacctcgtcgacgggggcgtcgccgccaacaaccccaccatggtcgctatgtccatgctcaccaaggaggtgctccgccacaacccggccttcaggcccgtggagtacggcaacttcctcatcgtctccatcggcaccgggtcgcccaagcaggccgagaagtacaccgcccccaagtgcgccaagtggggcctgctccggtggctctacaacggtggcttcaccccgctcatcgacatcttcactcatgccagcgccgacatggtcgacatccacgcccaagtgctcttcgaggcccttcggtgcgagaagaactacctccgcatccaggatgattcgctagtaggacacacatcgtcagtggacatcgcgaccaagaagaacatggaggcgctgatcgggatcggaagggagctcctcaagaagccggtggcgagggtgaacatcgacacgggggtttacgagcctgtctccggcgagggcaccaacgagcaggctctcgagcgcttcgctaggaagctctccgacgagctcaagctacgcaagaaaaacttcaactcctactagcttagcttgcttgcttaattgccaaccagagtgggcctcgatcaaaagcagcaaactatgtgcatatcaataaagagttctgcttgcttttcatcagaaacctgaactgataatgtgtatctggagttgtaattttgcctgtgcttgctattgggctaaaaatgtttcggtgttatgtttcgatcttaaaaaaaaaaaaaaaaaaaa

SEQ ID NO: 3348 - protein, 400 aa, Panicum virgatum
  misc_feature: Ceres CLONE 1790775
  misc_feature (1)..(209): Pfam Name: Patatin Pfam Description: Patatin-like phospholipase
MDSNGTAVLAPPPSQGRLITVLSIDGGGIRGLIPATIIACLEAKLQELDGPEARIADYFDVIAGTSTGALITAMLAAPDKKKRPLFAAKDINQFYLDNGPKIFPQRKIGFLKPTANLLSLMRGLKYDGAFLHDKITSLTHDVRIADTVTNVVVPAFDVKSLQPVIFSTYEAVHEPLKNAHLSDICISTAAAPTYFPAHFFRTEGEKPGGREFHLVDGGVAANNPTMVAMSMLTKEVLRHNPAFRPVEYGNFLIVSIGTGSPKQAEKYTAPKCAKWGLLRWLYNGGFTPLIDIFTHASADMVDIHAQVLFEALRCEKNYLRIQDDSLVGHTSSVDIATKKNMEALIGIGRELLKKPVARVNIDTGVYEPVSGEGTNEQALERFARKLSDELKLRKKNFNSY

SEQ ID NO: 3349 - DNA, 1551 bp, Panicum virgatum
  misc_feature: Ceres CLONE 1790811
  misc_feature: Encodes the peptide sequence at SEQ ID NO. 3350
aatcacaaggtcgctctagctcagacctcagagagagagagagagagagagagagagatgctgaagcaggcggaggtggtggtggtggacacggcgctggtgccgccaagcaaggagacgccggggcagccgctgtggctgtccaacctcgatctggccgtgccgaggacgcacacgccgctcgtctactactacccggcgcccgcgcaaggcgccgccgcggcgggcacgggctccttcgcgccggaccggctcacggccgcgctggccggggctctggtgccgttctacccgctcgcggggcgactcggtcccggcccggacgggcggccgcagatcaactgcaccggcgagggcgcgctcttcgtcgtcgccagggcggacctcaccggcgacgacatctttgaggacttcgagccgtcgccagagatccggagagcttttgtgccgtcaccgcggcctggcgacgcgtcctgccccttggccgtgttccagttgactttcctcaagtgtggcggcgtggtgctgggcaccggcatccaccacgcggtgctggacggcgtgggcgcgttccagttcatccagacgtgggcggggctcgcccgcggcctcgacgccgccgaggcgtgcgggccggtgccgttccacgaccggaccctcctccgcgcgcggtgcccgccgtgcccaaccttcgaccacttcgtctactccccggccttcctcagcggccgcccgcgccccttcgtcacccggttctacgccgtctcccccaagctcctcgccgacctcaagtcccggtgcggcgccggcgtgtccacgtactgcgccgtcaccgcgcacctctggcgctgcgtgtgcgtcgtgcacgggatggcgccgggcgcggacacccgcctcgggctgccggccaacatccgccaccgcctgagcccgccgctcccacgcagcttcttcgggaacgccgtcgtgcgcgacctcgtcacggcgcgggtcggcgacctgctgggcagcccgctcgggtccgtggcggagacgatcaagaaggcggtggacggcgtgggcgacgcgttcgtgcggtccgtgctggactacctggagctggagcaggcgaagaagcgaggcggcgacgacgacagcgcccagggcgagcagatggtgccggcgaccgacctgtgggcggtgagctggctggggatgcccatgtacagcgccgacttcggctcgggcgcgccgcggttcgtcgcgccggcgcagatgttcggcgtcggcacggcgtacatgaccccctgcgccaacaaggacgacggcatcaccgtcatcttctcgatggaggccgagcacattgagtgcttcgagaaggtcttctacggggaatgaattgaaacagctcgagataacagtactacgttttgtgctttttaatttattttaatttttccatgtaaaagaagcattttatcagggtaaatcctcataaatcgccctaagccttgtatacgatctcttgcttacggggaaatgcttatctatcaaaaaaaaaaaaaaaaaaaa

SEQ ID NO: 3350 - protein, 439 aa, Panicum virgatum
  misc_feature: Ceres CLONE 1790811
  misc_feature (2)..(438): Pfam Name: Transferase Pfam Description: Transferase family
MLKQAEVVVVDTALVPPSKETPGQPLWLSNLDLAVPRTHTPLVYYYPAPAQGAAAAGTGSFAPDRLTAALAGALVPFYPLAGRLGPGPDGRPQINCTGEGALFVVARADLTGDDIFEDFEPSPEIRRAFVPSPRPGDASCPLAVFQLTFLKCGGVVLGTGIHHAVLDGVGAFQFIQTWAGLARGLDAAEACGPVPFHDRTLLRARCPPCPTFDHFVYSPAFLSGRPRPFVTRFYAVSPKLLADLKSRCGAGVSTYCAVTAHLWRCVCVVHGMAPGADTRLGLPANIRHRLSPPLPRSFFGNAVVRDLVTARVGDLLGSPLGSVAETIKKAVDGVGDAFVRSVLDYLELEQAKKRGGDDDSAQGEQMVPATDLWAVSWLGMPMYSADFGSGAPRFVAPAQMFGVGTAYMTPCANKDDGITVIFSMEAEHIECFEKVFYGE

SEQ ID NO: 3351 - DNA, 1337 bp, Panicum virgatum
  misc_feature: Ceres CLONE 1790816
  misc_feature: Encodes the peptide sequence at SEQ ID NO. 3352
aggaagagctgcccagctgtggaggagactcggaggaggcctcgtcaacgccatggccgggagttcgacggtgtgcgtgaccggcgccggcgggttcatcgcctcgtggctcgtcaagctcctcctctcccgcggctacaccgtccacggcaccgtccgcgacctgggtgacaagaagtcagcccatctgaagcggctcgagtatgccgctgaaagcctcaggattttcaaggccgatctcctggactacgacgcgatggctgctgccattgtgggatgccagggggttttccatgtggccactcctgtgccatcagagaagctgactgatctagagctgcaaatgctggctccggctgttactggcaccacgaatgtgctcagggctgcctcggccgcgggtgtccagcgagtggtggtcgtgtcatccatagtggccgtggagatcaacccgaaagattggcctgaaggcaagatcagagacgagagctgctggtcagacgaggagttctgcaggaacaataacatctggtacccggtcgccaagatcatctcggaagaggcggcgctggagtacgggcgtcagaccgggctcgacgtggtgtccgtcaatccggggttggtgttcgggcccatgctgcagccgacggttaacgcgagcagccagttcctcatctacttactgaaaggaggccctgacaaggtgaggaacaagctctggcacatcgtcgacgtccgcgaccttgccgaggcgctgctcttggtctacgagggtgctggagcctccggtaggcacatctgcgcacctcatgtcgtcagcgtccgcgaactcctcgactcgctgaagagcaactaccctgattacccttgcattgccaaggagagcgtatttgacagagatcacccggctccgatgagttctgagaagctgaagaagctcgggtggagcttccggccgctggaggagacgatcgccgacgcgatcgggttctgccagcgcgctgggttccttggtgatgcggatggggcggctccctgccgtttccctcctcttttcaaccaaatctagtcttggaaatcgcatggatcaatcgttcagaaaaaaaaagaaatcgcatggatctgggggcaacgcagccaagcgtgcaaatgtttatgcttttctgtatctctcgtgtggtaccaacttagatttgtgaactgttttggttgtaatctggtgatgctactgtgcatgcgcttatcaggtcagcagaatggttatcaggtctgtaattctttcctatgaataaaagggaagtattgtactcttcgtctaaaaaaaaaaaaaaaaaaaa

SEQ ID NO: 3352 - protein, 338 aa, Panicum virgatum
  misc_feature: Ceres CLONE 1790816
  misc_feature (1)..(243): Pfam Name: Epimerase Pfam Description: NAD dependent epimerase/dehydratase family
MAGSSTVCVTGAGGFIASWLVKLLLSRGYTVHGTVRDLGDKKSAHLKRLEYAAESLRIFKADLLDYDAMAAAIVGCQGVFHVATPVPSEKLTDLELQMLAPAVTGTTNVLRAASAAGVQRVVVVSSIVAVEINPKDWPEGKIRDESCWSDEEFCRNNNIWYPVAKIISEEAALEYGRQTGLDVVSVNPGLVFGPMLQPTVNASSQFLIYLLKGGPDKVRNKLWHIVDVRDLAEALLLVYEGAGASGRHICAPHVVSVRELLDSLKSNYPDYPCIAKESVFDRDHPAPMSSEKLKKLGWSFRPLEETIADAIGFCQRAGFLGDADGAAPCRFPPLFNQI

SEQ ID NO: 3353 - DNA, 1468 bp, Panicum virgatum
  misc_feature: Ceres CLONE 1790838
  misc_feature: Encodes the peptide sequence at SEQ ID NO. 3354
gcgtcactgacaagtgcagcagcaactcagtcagtccatcgcatcagcatcaggccactgacaagtgcgatggcctcctcgtggctcatcttggccctgctccccgcgctctgcctgggaacgctgccgagctcccacgcggcccgcgccttcttcgtcttcggcgactccctcgtcgacaacggcaacaacaactacctggtgacggcggcgcgggccgactcaccgccctacggcatcgacacgccggaccaccgcgccacggggcgcttcagcaacggcaagaacgtgccggacatcatcagtgagcacctcggcgccgagccggtgctgccgtacctgagcccggagctggacggcgacaagatgctcgtcggcgccaacttcgcgtcggccggcgtcgggatcctgaacgacacgggaatccaattcgccaacgtcatccacatctcgaagcagctgctctacttccagcagtaccagaagcgtctgagctcgctgatcggcgcggagcagacggcccggctggtgcacggctcgctggtgctcatcaccctcggcggcaacgacttcgtcaacaactactacctggtgccctactcggcgcgctcccgcgagttctccctccccgactacatcaactacatcctctccgagtacaggcagatcctcacgaggctgtacgacctgggcgcccggcgcgtgctggtgcagggcgtcggcccgatcgggtgcgtcccggcggagctggcgctgcacagcctggacggcagctgcgaccgggagctgcagcgcgcggcggagatgtacaacccgcggctgatggcgctgctgaaggagctcaacgcgcgctacggcggcggcgtgttcgtcggcgtcaacatgcagcgcatccacaacgacttcatcgaggaccccaaggcgtacggcttcgagacggccacccaggcgtgctgcggccagggccgcttcaacggcatggggctctgcaccatggtgtccaacctctgcgccgaccgcgacacctacgtgttctgggacgccttccaccccacggagcgcgccaaccgcctcatcgtgcagcagttcatgtcaggatccaccgactacatcgcgcccatgaacctcagcaccgtcctcgccgtcgacctccacaaggagcagatgcgcacatgatgatctatttgattgatccaacgccagcgagctccgtcttcgtccatagaccgatcgatcagccagcagcagtcatgttcgtctcagactgattgtattcgtgcttgcaattcgtatgcacgcgtgcttttcttttctcgtgtttttgagggtgtcgtcagtgcgtatgtagtagagtgcttctcctgctagtgtcagtttcacattcagttttcagagcttcccgcattggaactctgtctgtggcttgcttgagtgatttgagggagtccaaaaaaaaaaaaaaaaaaaa

SEQ ID NO: 3354 - protein, 368 aa, Panicum virgatum
  misc_feature: Ceres CLONE 1790838
  misc_feature (1)..(313): Pfam Name: Lipase_GDSL Pfam Description: GDSL-like Lipase/Acylhydrolase
MASSWLILALLPALCLGTLPSSHAARAFFVFGDSLVDNGNNNYLVTAARADSPPYGIDTPDHRATGRFSNGKNVPDIISEHLGAEPVLPYLSPELDGDKMLVGANFASAGVGILNDTGIQFANVIHISKQLLYFQQYQKRLSSLIGAEQTARLVHGSLVLITLGGNDFVNNYYLVPYSARSREFSLPDYINYILSEYRQILTRLYDLGARRVLVQGVGPIGCVPAELALHSLDGSCDRELQRAAEMYNPRLMALLKELNARYGGGVFVGVNMQRIHNDFIEDPKAYGFETATQACCGQGRFNGMGLCTMVSNLCADRDTYVFWDAFHPTERANRLIVQQFMSGSTDYIAPMNLSTVLAVDLHKEQMRT

SEQ ID NO: 3355 - DNA, 1924 bp, Panicum virgatum
  misc_feature: Ceres CLONE 1790847
  misc_feature: Encodes the peptide sequence at SEQ ID NO. 3356
atccaccaacctcagctcactatcctcatcttgccgcctctgcacgtctctccacctcatggctcgctctcgctccaaccgctaccgccaggacctgttcgtcgccgtcgcggcgtgtcttgccgtcggggaggcggcgtccttcgtcggcttcgacctccaccaccgcacctccccggtggtccggcgctgggcggaggcgcggggccaccacgccctcgccgcggagtggccggctaaaggctcgccggagtactactccgagctctcccgccatgaccgcgcccgccgcggcctcgccggcgccggcgaccaactcctgaccttcggtgatggcaacgcaaccgtccaatacctcggatccttgtactacgcgttggtggcgctgggcacgccgaacgcgacgttcctggtggcgctggacaccggcagcgacctcttctgggtgccctgcgactgcaagcagtgcgcgccgctgcccaacaacggcacggcggagggcgtgccgccgctccgcgagtacagcccgaggcggtcgtcgacgagcacgccggtgacgtgcgagagcccgctctgcgaccggcccaacgcctgcggcaacgccaccaacggcagctgcccgtacggcgtccgctacgtgtccgccaacacctcctcctccggggtgctcgtccaggacgtgctccacctcacccgggagggtcccggcccaggcgccgccgcggagcccctgcaggcccccgtcgtgttcgggtgcgggcgggtgcagacgggcgcgttcctcgacgacggcggcttcgacggcctgctggggctcggcatggacagggtgtccgtgcccagcgtgctcgccgccagcggcctcgtcgcgtccgacagcttctccatgtgcttcggcgacgacggcgtcggccggatcaacttcggcgacgccggcagccgcggccagcccgagacgccattcatcccgaggaccacacacccgacgtacaacgtgagcttcacgacgatcaacgtcggcagcgagtcggcgccggtggagttcgccgccgtcatggactccggcacgtccttcacctacctcaacgacccggagtacacggcgctcggcaccagtttcaactctcggattcgcgagaggagggccaacttcagcagcggatctgcaggccgtttccccttcgagtactgctacacactcagccctgaccaaagggagttggatctcccggtggtgagcctgacggcggcggggggagcactgttcccggtcaccgacccgatcatcggggtctccgacggggccagcgcccgtcccatcggttactgcctggccgtcgtcaagaacgacatccccatcaacatcgtcggccagaacttcatgaccgggctcaaagtggtgttcgaccgggagaggtccgtcctgggctggcaggaattcgactgttacaagaacgccagagtggcggacggaccgggcgggagcccaagccccgcgccggcgccgacgaagctcacgccgcggcagaacgacgccaccagcgggtaccccggcgcggcgcccgtgccgcggccgccgtccgccggctcgcgcggagggatctccctgctgctccctctgctgctgggcgctgctgccgcccttgtctgacgctcgccagcggctttcttcttcctcttcttcttccagccggctgctctggagcgtggatgtgtacataattacatatacacatacagatactgctcgactccgattcagagttcagattttggaattaggattaggtttgcaggttgccgtgtatactggagacatgactgactggagacgaaatttcttggtggtgactgatgaggggagggtcatttcgtgatcacatactattcatatttcgtatacgaataaacgtatggttgacac

SEQ ID NO: 3356 - protein, 530 aa, Panicum virgatum
  misc_feature: Ceres CLONE 1790847
  misc_feature (1)..(363): Pfam Name: Asp Pfam Description: Eukaryotic aspartyl protease
MARSRSNRYRQDLFVAVAACLAVGEAASFVGFDLHHRTSPVVRRWAEARGHHALAAEWPAKGSPEYYSELSRHDRARRGLAGAGDQLLTFGDGNATVQYLGSLYYALVALGTPNATFLVALDTGSDLFWVPCDCKQCAPLPNNGTAEGVPPLREYSPRRSSTSTPVTCESPLCDRPNACGNATNGSCPYGVRYVSANTSSSGVLVQDVLHLTREGPGPGAAAEPLQAPVVFGCGRVQTGAFLDDGGFDGLLGLGMDRVSVPSVLAASGLVASDSFSMCFGDDGVGRINFGDAGSRGQPETPFIPRTTHPTYNVSFTTINVGSESAPVEFAAVMDSGTSFTYLNDPEYTALGTSFNSRIRERRANFSSGSAGRFPFEYCYTLSPDQRELDLPVVSLTAAGGALFPVTDPIIGVSDGASARPIGYCLAVVKNDIPINIVGQNFMTGLKVVFDRERSVLGWQEFDCYKNARVADGPGGSPSPAPAPTKLTPRQNDATSGYPGAAPVPRPPSAGSRGGISLLLPLLLGAAAALV

SEQ ID NO: 3357 - DNA, 1540 bp, Panicum virgatum
  misc_feature: Ceres CLONE 1790886
  misc_feature: Encodes the peptide sequence at SEQ ID NO. 3358
gccgtctcctccatattgatctccggtagggaacactccccgactccccacagccccaccttcgtagctctatcattaccactagtagctagtatcacgcgatgggaacgatactcccgccaagcaatggccgcttccatcccctcttccttctcgtgctcgccgtcgctgatttcacggtggtgcaggggcagccgacacagaacggcgagatgccctacgccagcttcagcccgtccatggccatagtcatcgtcgtgctcatcgtggccttcttcttcctcggcttcttctccatctacgtccgccactgctatggcaacggcccgagcggctcctccgcgagcccgttacccaacggcgtcgccgcgcgctcgcggcgccagcgcgggctcgacgcggcggtgctcgagaccttccccaccatggcgtacgccgacgtgaaggcgcacaaggccggcaagggcgcgctcgagtgcgcggtgtgcctcagcgagttcgacgacgacgagacgctgcgcctgctgcccaagtgctcccacgtcttccacccggactgcatcgacacctggctcgcctcgcacgtcacctgccccgtctgccgcgccaacctcgtcccggaccccaacgccccggccgacgacgcgcccgcggagcagcagccggctcctcctcccgcgcaagagctgccgtcgcccacgtccgcgccggctgcggcggcggtggtcattgacgtggaggagacggaggagcagaggatcatcagggaggaggccgacgagctgatgcgcatcggcagcgtcaagcgcgcgctgcgctccaagtccggccgcgcgcccgcgccgttcccgcgctcgcactcgacggggcactcgctcgcggcgcccgcgcccggcaccggcgccggcgacgagcggttcacgctgcggctgcccgaccacgtgctccgggacctcgccgcggcggggaagctgcagcgcaccaggagcctcgtcgcgttccgcgccagccgcgggggcagcacgcggcacggcgccggcgtcagggccggcgaaggcagcagccgcggcggcgggaggagcatccggctgggccagtccgagcggtggccgtcgttcctggcgcggacgttctccgcgcggctccccgcgtggggttcgcggtcgacgcggaggggcgccgaggccgacgggtccagcaagggcggcagggcggccggcgccgccggcgcaggcgcgaagtcagtggaattcgacgaccaggcgtgcttggctgggcaacgtgtttgacgcggcttgctctgtcgtggtcaatcggtggctgctaggaaactctcggtgctctcgtcgccgtcgtggtggtagaaacaattttttggcagttgaattttggacgggaagagcttggtcgctccttctggacgcgtgttgtattcatttttttttctacacaaaaatcttgtacagaaaatggtagtacttaaaatatcatggagcggagaaaaccctcctgtcctgtacaaaaaaaaaaaaaaaaaaaa

SEQ ID NO: 3358 - protein, 395 aa, Panicum virgatum
  misc_feature: Ceres CLONE 1790886
  misc_feature: Great-hit functional homolog of the protein sequence given in SEQ ID NO 9641
  misc_feature (1)..(42): Pfam Name: zf-C3HC4 Pfam Description: Zinc finger, C3HC4 type (RING finger)
  misc_feature: The sequence is a functional homolog of  SEQ ID NO 1131 in the  10/666,642 US patent application
  misc_feature: The sequence is a functional homolog of  SEQ ID NO 1133 in the  10/666,642 US patent application
  misc_feature: The sequence is a functional homolog of  SEQ ID NO 380 in the  10/666,642 US patent application
  misc_feature: Useful for making plants with modulated nitrogen use efficiency
  misc_feature: Useful for making plants with modulated growth and phenotype characteristics
MGTILPPSNGRFHPLFLLVLAVADFTVVQGQPTQNGEMPYASFSPSMAIVIVVLIVAFFFLGFFSIYVRHCYGNGPSGSSASPLPNGVAARSRRQRGLDAAVLETFPTMAYADVKAHKAGKGALECAVCLSEFDDDETLRLLPKCSHVFHPDCIDTWLASHVTCPVCRANLVPDPNAPADDAPAEQQPAPPPAQELPSPTSAPAAAAVVIDVEETEEQRIIREEADELMRIGSVKRALRSKSGRAPAPFPRSHSTGHSLAAPAPGTGAGDERFTLRLPDHVLRDLAAAGKLQRTRSLVAFRASRGGSTRHGAGVRAGEGSSRGGGRSIRLGQSERWPSFLARTFSARLPAWGSRSTRRGAEADGSSKGGRAAGAAGAGAKSVEFDDQACLAGQRV

SEQ ID NO: 3359 - DNA, 1697 bp, Panicum virgatum
  misc_feature: Ceres CLONE 1790897
  misc_feature: Encodes the peptide sequence at SEQ ID NO. 3360
atgttaatccttgattgattcctcgcatagccgccggccccgcaccgccgagcccagtttcataaacaatcgaccagcggtgagattggatcgagaaacacgttctccattgggtgggtgctcgaggctcaagccgatggggcggaccggcggcggactggtggcggtggtggtcggtgctcgtcgtcgtgtactaggtcgtaaaaaaaaaagctcgtcgggattcgcggtccacatggcggcttctgctcgcgttcggcgccatttccgcgagcacccgctccgctccgccaataaatccttgcccctcgtcggcgaaattcctcgacggatcgatcttgatttctcgccgccgtccccgcatctctgccaccaccttcctgtttgggaggactccaggccgcgctcccatggccgtcacggtgtgcgtcaccggcgccggcggcttcatcgggtcgtggatcgtcaagctcctcctcgaccgcgggtacgccgtccggggcacctcccgccgcgcagatgaccccaagaacgcgcacctctgggcgctcgacggcgcggcggagggcctcacgatgctgcaggtggacctgctcgacagggccagcctccgcgccgccttcgacggctgcgacggcgtcatccacaccgcctcgccgatgcacgacatccccgaggagatcatcgacccaattatcgccgggacgcggaacgtcgtcgaggccgcggccgacgccggcgtgcggcgcctggtgttctcctccaccatcggcaccatgtacatgaacccgcaccgcgaccccgacgatcccctggacgagtggagctggagcgacctcgagtactgcaagaggaccgcgcactggtactgctacgcgaagacgatcgcggagcagagcgcgtggcaggcggcgcgggcgcgggagctggacctggcggtggtcatcccggtggtggtgctcggcgagctgatgcagccaagcatgaacaccagcaccctgcacatactcaagtacctcaccggcgaggccaagaattacgtcaacgagtcgcaggcgtacgtgcacgtcaaggacgctgcagaggcgcacgtcagggtgctcgaggcgcccggcgccggcgggcatcgctacgtctgcgccgagcggactctgcaccgcggcgagctgtgccgaatgctcgctgaactcttcccggagtaccctgttccgacgaggtgcaaggatgaggtgaatccaccaaagaagggctacaagtttacaaaccagcctctgaaggacctaggcatcaggttcacacctgcgcatgagtacctctatgaagcagtaaaatccctgcaacaaaagggttttctccccaaggccaaagcttctgtcacagaggtgactgaaagtcgcagttccccgcctcaaaagttgcaactggggatgttgatttcaaatctttgacagatttgcacacgaagtgaccatgtaacacgccgacgtgttaatttgatttcaaacctcagaataagtgtagtgcagtggttaatttgattggttaaatttttggtggcctgctcttatagggtcataggactgtgcaacttaattttgtacgctatactactctctgccatgcatcaaatcattcctcaaatttactttttttttacaataaaatgccaggagttataaaaaaaaaaaaaaaaaaaa

SEQ ID NO: 3360 - protein, 345 aa, Panicum virgatum
  misc_feature: Ceres CLONE 1790897
  misc_feature (1)..(240): Pfam Name: Epimerase Pfam Description: NAD dependent epimerase/dehydratase family
MAVTVCVTGAGGFIGSWIVKLLLDRGYAVRGTSRRADDPKNAHLWALDGAAEGLTMLQVDLLDRASLRAAFDGCDGVIHTASPMHDIPEEIIDPIIAGTRNVVEAAADAGVRRLVFSSTIGTMYMNPHRDPDDPLDEWSWSDLEYCKRTAHWYCYAKTIAEQSAWQAARARELDLAVVIPVVVLGELMQPSMNTSTLHILKYLTGEAKNYVNESQAYVHVKDAAEAHVRVLEAPGAGGHRYVCAERTLHRGELCRMLAELFPEYPVPTRCKDEVNPPKKGYKFTNQPLKDLGIRFTPAHEYLYEAVKSLQQKGFLPKAKASVTEVTESRSSPPQKLQLGMLISNL

SEQ ID NO: 3361 - DNA, 1051 bp, Panicum virgatum
  misc_feature: Ceres CLONE 1790901
  misc_feature: Encodes the peptide sequence at SEQ ID NO. 3362
aatccaccactatcatcccaatctttctcctcccgcatcgcacccacctcccctacccgaaaaacccccaaattgcaatcaggtcccaggcgggctcctccccaaatccgcaacccagctcgacgaaattggcgaattcatcgagggagcctgacggatcgggcggcgaggatgggcatctcgagcatgccgacgcccaaggacagcctgatggggttcgtgctgtacaacacggcggtgtcggtggcgatcctggcggggctggtgcgcgcggcgttggtgttcctgggcctggcggcgccgtcgccgtgggagggcctcgccgctgacgagcaccaccaccaccgccaggtggtgtcgtcgacctcgcccctggggccgagcctcgcggatcggttccggagccgggtccgcccgtcgcggttcgggcggcggcgcggcggcgccggcgccggcgcagactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgacgactacgcggccgtggcggcgggcctggccgcccggttttaggagggatctccaggaggccaccgggggccgcggccgggtcggtgcggccctgccgcgtgcgcgtaggaattcgagaggcaggcagaggctccgttagctctagtgctccgctcccaattagtagcgcctttccttttttttttttcatgtgtttttcctctccccccaccatttcgtgctcctttttttttccttctttcgttttcgtcgctcgcgcttgcagctgtaccgtttgtaaatattcgcagcgtgctccgatggtgttgcacttgcagtactgtgtacaggcttttcgaaagcgaagagatgagaagaagaaaaaaaatgggaaaaaattgatcaagaaaaagccgatccccttttgctttaaaaaaaaaaaaaaaaaaaa

SEQ ID NO: 3362 - protein, 163 aa, Panicum virgatum
  misc_feature: Ceres CLONE 1790901
  misc_feature: Great-hit functional homolog of the protein sequence given in SEQ ID NO 9350
  misc_feature (1)..(42): Pfam Name: zf-C3HC4 Pfam Description: Zinc finger, C3HC4 type (RING finger)
  misc_feature: Useful for making plants with altered Lignin content
  misc_feature: Useful for making plants with modulated low light sensitivity
MGISSMPTPKDSLMGFVLYNTAVSVAILAGLVRAALVFLGLAAPSPWEGLAADEHHHHRQVVSSTSPLGPSLADRFRSRVRPSRFGRRRGGAGAGADCRVCLARFEPESVVNRLPCGHLFHRACLETWLDYDHATCPLCRLRLLPPAADDDYAAVAAGLAARF

SEQ ID NO: 3363 - DNA, 1316 bp, Panicum virgatum
  misc_feature: Ceres CLONE 1790902
  misc_feature: Encodes the peptide sequence at SEQ ID NO. 3364
acaccttcaaacagatcatgaagctggtggtgctcactgctctcccggccctgctgatcaccaatcaccagatgatgggcctatgagtgaaccagcagcctgcagcaactgttactactaccgccaccgccagcactgggaaagaactcaagaagccaagcctccaattcgccatcagcgagatcgagctcggctgtgctaattccacccaaagctagctgatccatggacatgtcgccgaaccccgacagcccctcgtcgggagggggcaacggcggcatcgggtcgagcagcggcggcgcgtcgccgtccgttggttcgatgacgccgcagtcgccgagccggtacgaggcgcagaagcggcgcgactggaacacgttcgggcagtatctgcggaaccaccggccgccgctgagcctggcgcagtgcagcggcgcccacgtcctcgagttcctccgctacctggaccagttcggcaagaccaaggtgcacggcccggcgtgccctttcttcggccacccgaacccgccggcgccgtgcccctgcccgctccgccaggcctggggcagcctcgacgccctcgtgggccgcctccgcgccgccttcgaggagaacggaggccgcccggagtccaaccccttcgccgcgcgcgccgtccgcctctacctccgcgaggtccgcgagcaccaggcccgcgcccgcggcgtcagctacgagaagaagaagcgcaagaagccgcagcagctgcaggcaggcgacggcagcggcagcctccacggccacccccaccagccgccgcccccgccgcccgccggcgccgcctgctgagctcgatctggtcgaccgacggctcgatcgcgcgcccaaccacgctctcctatttggccggtacgatatgccagattgagctcgagcatctacatattttatgtatcgttcagttcgcgtacgatgaatgcatgcatggcatgtgctttggcaccaccagtagtgggtgctgctgcctgcgtgtactgcattgcagcttgtgtgtttaattcgattggctttagctctggtgttgtttattagtcggtctatttgcttgtagccttgtaggagtgagcaagtgtttgctgtacttcgaataagaggatcggagtgtgtcctttgaggtctagctagggacagggagatacatatatggagatctctctagctgtttgtggaagatttgaaagcccctctgtgtttgtgtgtgtccagtgtccgtccgtctagacatgcatgtgtcaatcgattctggcaagcagcagcaaaaaaaaaaaaaaaaaaaa

SEQ ID NO: 3364 - protein, 200 aa, Panicum virgatum
  misc_feature: Ceres CLONE 1790902
  misc_feature: Great-hit functional homolog of the protein sequence given in SEQ ID NO 9188
  misc_feature: Useful for making plants with modulated low light sensitivity
MDMSPNPDSPSSGGGNGGIGSSSGGASPSVGSMTPQSPSRYEAQKRRDWNTFGQYLRNHRPPLSLAQCSGAHVLEFLRYLDQFGKTKVHGPACPFFGHPNPPAPCPCPLRQAWGSLDALVGRLRAAFEENGGRPESNPFAARAVRLYLREVREHQARARGVSYEKKKRKKPQQLQAGDGSGSLHGHPHQPPPPPPAGAAC

SEQ ID NO: 3365 - DNA, 1515 bp, Panicum virgatum
  misc_feature: Ceres CLONE 1790917
  misc_feature: Encodes the peptide sequence at SEQ ID NO. 3366
gtggctaagcccaaccaaactaggaagcggcagcaatggcggcggctctgcaagctacgccgctcaaaaccctagccttctcccgccggcgagccgccggcgcgccgctgcgcccgcggcaaatggcttccttccggtgctccgccgccgcgaggagctacaacatcacgctcctcccaggggacggcatcgggccggaggtggtcgccgtcgccaaggacgttctctccctcgccgtagcactcgaaggcgtcgagctccggttccaggagaagctgatgggcggctcggcgctcgatgccaccggcgtaccactccccgacgaaacgctcgcggcagcaagggattctgatgccgtcctcctcggagccataggggggtataagtgggataacaatgagaagcacctcaagcctgagacaggcttgctccagctccgtgctgggctccgtgtgtttgccaatctgcgtcccgccgcggtactgccgcagctagtcgatgcatctactctgaagaaagaggtagctgaaggtgttgacatcatggttgtcagagagcttactggaggaatatactttggcaaacctaggggttttggaacaaatgacaacggcgacgaaactggcttcaacacagaagtttattcagcttctgagattgatcgcatcgcacgtgttgcatttgaggttgctcgcaagagaagagggaaactatgctcagttgataaagcaaatgtcctggaggcatccatgctttggagaagaagggtgactgcactagcttctgaattccctgacattgaactctcgcacatgtatgtcgataatgctgcaatgcagcttgttaggaatcctaagcagtttgacacaattgtcacaaacaacattttcggtgacatactgtctgatgaagcatcaatgattacgggaagcattggaatgcttccatctgccagtgttggtgaatcgggacctggtctttttgaacctattcatggctctgcccctgatattgctgggcaggacaaggccaatccattagctacaattcttagcgcagcaatgctactgcgatatggccttggagaagaaaatgctgcaaagagaattgaatctgcagttacagaaactctgaaccagggattccgaactggggacatatattctcctggaacgacactggttggatgcaagcggatgggggaggaagtcttgaagacagtggagtcacaaaaggcggtggctgctataaactgatgcatgttggtatagctgtagcccggtgaaatgaggttggcagttttttagaagttgagccttctgaaagagcccatagcatctggattgttgattttattgcctgccgttgaattgattgggcggtctccttttctctttgttgcttgttgtccatgatgtatggtatatgactgttcgtcctataaatggggatagttcccatcatgccagccgggaaatgaggctggatattgcccaaaaaaaaaaaaaaaaaaaa

SEQ ID NO: 3366 - protein, 406 aa, Panicum virgatum
  misc_feature: Ceres CLONE 1790917
  misc_feature: Great-hit functional homolog of the protein sequence given in SEQ ID NO 9292
  misc_feature (1)..(350): Pfam Name: Iso_dh Pfam Description: Isocitrate/isopropylmalate dehydrogenase
  misc_feature (1)..(398): SWISSPROT Homolog: EC 1.1.1.85 3-isopropylmalate dehydrogenase, chloroplast precursor
  misc_feature (1)..(399): SWISSPROT Homolog: EC 1.1.1.85 3-isopropylmalate dehydrogenase 2, chloroplast precursor
  misc_feature: Useful for making plants with modulated biomass
  misc_feature: The plant is abnormally small.
MAAALQATPLKTLAFSRRRAAGAPLRPRQMASFRCSAAARSYNITLLPGDGIGPEVVAVAKDVLSLAVALEGVELRFQEKLMGGSALDATGVPLPDETLAAARDSDAVLLGAIGGYKWDNNEKHLKPETGLLQLRAGLRVFANLRPAAVLPQLVDASTLKKEVAEGVDIMVVRELTGGIYFGKPRGFGTNDNGDETGFNTEVYSASEIDRIARVAFEVARKRRGKLCSVDKANVLEASMLWRRRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAAKRIESAVTETLNQGFRTGDIYSPGTTLVGCKRMGEEVLKTVESQKAVAAIN

SEQ ID NO: 3367 - DNA, 1715 bp, Panicum virgatum
  misc_feature: Ceres CLONE 1790933
  misc_feature: Encodes the peptide sequence at SEQ ID NO. 3368
acccgcactgcacactccccttaccctttcctacgccgccgcctcttctgctgacgccatggccgccgcccccgcctcttctgccgccgctatggccgcggcacccgcaatcaccgcgtcctcctcctttgtctcgtcgtcgccgtgctctctcagggtgtcgaagacaagcccccggcgacccacgggaagagtgtcccacaaaatcagctgcgtcagtagcccaccggccgccgaaacatcttacaagactagtgtcccgcgcaatgctaacatggccaagctccaagcaggatatttatttcctgagattgccaggagaagagcagctcatttgctcaagttccctgatgctaagattataagccttgggataggtgacactacggagcccattccagatgtcataacgaatgccatggcagagagagcacatgccttatcaacaattgatggctacagtggttatggagctgagcaaggtgaaaagaaactaaggtcagcaattgctgcaacctactatgtggaccttggtattgaagattcagacatatttgtctctgatggtgccaaatgtgacatttcccgcctgcaggttctttttggatctaatgtgacgattgcggtccaagacccatcataccctgcatatgttgattcaagtgttatcatgagccaaactggcttatatcagcaagatgttcagaagtacgggaacatcgagtacatgagatgcaatcctgaaaatggatttttccctgatctgtcaactgtcccacgtacagatataattttcttttgctcaccgaacaaccccactggtgctgctgcctctcgggaccaactgacgagactagtcaaatttgctaaggacaatgggtctatcattgtctatgattctgcctatgctatgtacatatcagatgatagcccaaagtctatctttgaaattcctggtgcgagagaggttgccattgagacagcatcattctcgaaatatgctgggttcactggtgtccgtctaggttggactgttgtccccaaggagcttcttttctcagatgggcatccagtcgctaaagatttcaaccgcattgtgtgcacctgcttcaatggcgcatcaaacattgctcaagctggtggcttagcttgcctctctccagagggtctgaaggctatgcatgatgttgttggcttctacaaggagaatactgaaataattgtcgacacgtttacatcgcttggattcaatgtatatggtgccaagaacgctccttatgtgtgggtgcacttccctggtcgcaattcgtgggatgtgttcgctgagatccttgagaaggcgaacgttgtcactacgcctggcagtggatttggacctggcggcgaaggctttgtgagggtcagcgcgtttggccacagagaaaacatcattgaagccgctaggagattaaaacagctgtacaagtgagcactgacgcagcttcagtaacgtcttggaaggacgatatcaataagattgcatcatgatttggaacaccaaattcgctctgtcgagctacttggagatattagaagcgaaacttgataatttcctaggcttttatgttgtggtagttctttcaaataatttccaattcgaaagatgcttgttgtatccccgagacatttgaatcaccaggtagtggttatatggccaaaaaaaaaaaaaaaaaaaa

SEQ ID NO: 3368 - protein, 469 aa, Panicum virgatum
  misc_feature: Ceres CLONE 1790933
  misc_feature: Great-hit functional homolog of the protein sequence given in SEQ ID NO 9635
  misc_feature (1)..(370): Pfam Name: Aminotran_1_2 Pfam Description: Aminotransferase class I and II
  misc_feature: Useful for making plants with modulated nitrogen use efficiency
MAAAPASSAAAMAAAPAITASSSFVSSSPCSLRVSKTSPRRPTGRVSHKISCVSSPPAAETSYKTSVPRNANMAKLQAGYLFPEIARRRAAHLLKFPDAKIISLGIGDTTEPIPDVITNAMAERAHALSTIDGYSGYGAEQGEKKLRSAIAATYYVDLGIEDSDIFVSDGAKCDISRLQVLFGSNVTIAVQDPSYPAYVDSSVIMSQTGLYQQDVQKYGNIEYMRCNPENGFFPDLSTVPRTDIIFFCSPNNPTGAAASRDQLTRLVKFAKDNGSIIVYDSAYAMYISDDSPKSIFEIPGAREVAIETASFSKYAGFTGVRLGWTVVPKELLFSDGHPVAKDFNRIVCTCFNGASNIAQAGGLACLSPEGLKAMHDVVGFYKENTEIIVDTFTSLGFNVYGAKNAPYVWVHFPGRNSWDVFAEILEKANVVTTPGSGFGPGGEGFVRVSAFGHRENIIEAARRLKQLYK

SEQ ID NO: 3369 - DNA, 1151 bp, Panicum virgatum
  misc_feature: Ceres CLONE 1790958
  misc_feature: Encodes the peptide sequence at SEQ ID NO. 3370
tcgatgtgagcttagcggagaagcagctgaggtgagccgaagccgagcgcagctgccccatctctatccctccctccctggaggtctctcgcgtgctcacagggacaggggcgttcctcggccgggcgagcttcggtagcggcggaccatgaaggcgctggtggtggcggtgctgcttctgctctcctccaccctcgccgcgtcacaatggtgcgtgtgcaggcaggatgcgccgcaggccgcgctgcagaagaccatcgactacgcctgcggcgcgggggcggactgcaactccatccatgagaacgggccgtgctacaaccccaacaacgtccccgcgcactgctcctgggcggccaacagctactaccagaacaacaaggccaagggcgccacctgcgacttcaccggcaccgccactctcaccaccagcgacccaagttcttctggctgctctttcccaacaagtgcaagcgctgttggaacaatgaccccgactactggaggcacaatgggaggaaccccaggaacaggaaccttcacgcccggtgccggcaccaccggcaccaccggcactggcatgggaaccggcagtactactggaaccactggcactgggttcggtttaggaccagcaggcaccggcgccggtatggacactgcagcggcgggcttgctcccaagggctggtctggtcgccgtcctcaccatgctcttccccgccatcgcattcgcatgacatttgatccctagagacaagtccctactcctactagcagctagtagaaagtacaccacccttttggtaagcttgcttcaggaatgctctgatgatccatggagaaaggaagagaaacctaatgcatcctgtccgaaactccactagcggctgctaggtgtttggtgccgatggggattcatgggtggggtgtcgttttgtttctgtgtgaccacaccatgttcttctgcgtgctctgtaatttggtgggatggctgtctctgtcatgcaaggacgattgtctaccttttatttctgttattaatcatgtaaatgtagggaagccagtaggttagctagaggctggttgcaagagaatgctgctgggacaatgccatggtgtgcttttcatcaaaaaaaaaaaaaaaaaaaa

SEQ ID NO: 3370 - protein, 196 aa, Panicum virgatum
  misc_feature: Ceres CLONE 1790958
  misc_feature: Great-hit functional homolog of the protein sequence encoded by LOCUS At5g08000
  misc_feature: Great-hit functional homolog of the protein sequence given in SEQ ID NO 9377
  misc_feature: Useful for making plants with altered alkaloid content
  misc_feature: Useful for making plants with altered cell wall content and/or composition
MKALVVAVLLLLSSTLAASQWCVCRQDAPQAALQKTIDYACGAGADCNSIHENGPCYNPNNVPAHCSWAANSYYQNNKAKGATCDFTGTATLTTSDPSSSGCSFPTSASAVGTMTPTTGGTMGGTPGTGTFTPGAGTTGTTGTGMGTGSTTGTTGTGFGLGPAGTGAGMDTAAAGLLPRAGLVAVLTMLFPAIAFA

SEQ ID NO: 3371 - DNA, 1623 bp, Panicum virgatum
  misc_feature: Ceres CLONE 1790964
  misc_feature: Encodes the peptide sequence at SEQ ID NO. 3372
caatcatcagtcgcggggggcttcaaataccggggaagcgcacaagtgtcgatccaccgagccaggggagtgacgggagcacgagcgagcgatagccgataggaggcgggccatggcgggtgcgggcagaagtcgccaccgtcgtcgcgagtcgccgccggcgacggtgaggctggcgctgctggtggcggtggccaccatggccggcgtcgcggcggagggcaaggcggtgcgcgtgggggagccgcaccggcggagcatgctggccaacggcctcggctccgcccctcccatggggtggaacagctggaaccacttccagtgcggcggcaacggcgaggtggtcatcagggagaccgctgacgcgctcgtgtccaccgggctcgctgctctcggctacaaatacgtcaacatcgatgactgctgggcggagccaaaacgtgatgcaacgggcaatctggtggccaacaccaagacgttcccgcacgggatcaaggcgctggcggactacgtccacagcaaggcgctcaagctcgggatctactccgatgccgggttccagacctgcgccaaagcccagcccggctccctcggccacgaggagcaggacgccaaaaccttcgcggcatggggagtcgattacctcaagtacgacaactgcaacaacggcgacatcaagccgctggagaggtaccctgagatgagcaaggccctgatgaagaccggccggccgatctacttctcgctgtgcgaatggggcgacatgcacccggcgcggtggggcgcggcctacggcaacagctggaggaccaccaacgacatcgccgacacctgggaaagcatgatcgcaacggcggaccagaacgaggtgtgggcggagtacgcgcgccccggcggctggaacgatcccgacatgctggaggtgggcaacggggggatgacgaacagcgagtacgtcgtgcacttcagcctctgggcgatttctaaggcgccgctcatcatcggctgcgacgtgaggcacatgtcgcaggagacgtacgacatcctggccaacaaggaggtgatcgccgtcaaccaagatccgctcggcgtgcaggggaagaaggtgaggatggaggggagcaacgagatctgggcggcgccgctgtccgactaccggacggcggtggtgctgctgaaccggcacgcgacggacggggccaccatcaccgcgcactgggacgacgtcggcctccccgccggcctggacgtcgaggccagggacctgtggcagcacaagacgctggacggcgcgttcacggacaggatggcgttcgacgtcgcggcgcggtcgtgcaggatgttcgtgctcaggcccaggctccccatgaaagcatagcattgcgcggcggcgccggggccgcgcggacggaccgacgacggagcacgctggtggccggcgggcggcggcgacgccgcgttggcggtgtggtggtgggtattgggcgaattgtgtgtacttgctactttgcattaacagccattaagggaatttgccacaggctatcgacggtaagcgaagggcgcggcccagtccaggccgagaactcccgatttgtcggccaaaaaaaaaaaaaaaaaaaa

SEQ ID NO: 3372 - protein, 421 aa, Panicum virgatum
  misc_feature: Ceres CLONE 1790964
  misc_feature (21)..(416): SWISSPROT Homolog: EC 3.2.1.22 Alpha-galactosidase precursor
  misc_feature (47)..(416): SWISSPROT Homolog: EC 3.2.1.22 Alpha-galactosidase precursor
MAGAGRSRHRRRESPPATVRLALLVAVATMAGVAAEGKAVRVGEPHRRSMLANGLGSAPPMGWNSWNHFQCGGNGEVVIRETADALVSTGLAALGYKYVNIDDCWAEPKRDATGNLVANTKTFPHGIKALADYVHSKALKLGIYSDAGFQTCAKAQPGSLGHEEQDAKTFAAWGVDYLKYDNCNNGDIKPLERYPEMSKALMKTGRPIYFSLCEWGDMHPARWGAAYGNSWRTTNDIADTWESMIATADQNEVWAEYARPGGWNDPDMLEVGNGGMTNSEYVVHFSLWAISKAPLIIGCDVRHMSQETYDILANKEVIAVNQDPLGVQGKKVRMEGSNEIWAAPLSDYRTAVVLLNRHATDGATITAHWDDVGLPAGLDVEARDLWQHKTLDGAFTDRMAFDVAARSCRMFVLRPRLPMKA

SEQ ID NO: 3373 - DNA, 719 bp, Panicum virgatum
  misc_feature: Ceres CLONE 1790967
  misc_feature: Encodes the peptide sequence at SEQ ID NO. 3374
acagcaaagccccgataatggccggagaccagcagcaagaggaagccatggcggcagatcctctccacgtcgtggtgttcccatggctggcgttcggccacctcatcccgttcctcgagctctccagtcggctggcggcgcggggccacgccgtcaccttcatctccacgccgaggaacgtcgccaggctcccgccggtgccagaggacctgtccggcctggtccggaccgttgccctgccgctgccggcggtggacgggctgccggagggcgccgagtcgacggccgacatgccgccggagaaggtcgagctcctcaaggccgccttcgacggcctcgccgcgcccttcgccgacttcctcgccgccgcctgcgccggcggccgggagcaagcgtcggggttcggtaggaggccggactgggtcgtgctcgacttcgcgcaccactggctctgccccatcgctgagcaacaccaggtgagaacatcaagttacatatcggcgtggaattctttattattacaagaataatcggcgtaaaacttgatcttcaccattaatttgtgagaatttatccaaatcaaaaatagctccactcagcataaattagaacggtaaaactgcaggcggcaaacaccatttcaatagtgtgtataataaatttgtgagaatttatccaaatgaaaaatagtttttttctaaaaaaaaaaaaaaaaaaaa

SEQ ID NO: 3374 - protein, 170 aa, Panicum virgatum
  misc_feature: Ceres CLONE 1790967
  misc_feature (1)..(131): Pfam Name: Glyco_transf_28 Pfam Description: Glycosyltransferase family 28 N-terminal domain
MAGDQQQEEAMAADPLHVVVFPWLAFGHLIPFLELSSRLAARGHAVTFISTPRNVARLPPVPEDLSGLVRTVALPLPAVDGLPEGAESTADMPPEKVELLKAAFDGLAAPFADFLAAACAGGREQASGFGRRPDWVVLDFAHHWLCPIAEQHQVRTSSYISAWNSLLLQE

SEQ ID NO: 3375 - DNA, 2278 bp, Panicum virgatum
  misc_feature: Ceres CLONE 1790977
  misc_feature: Encodes the peptide sequence at SEQ ID NO. 3376
tcgatgtgagcttagcggaacacacacacacaacaatccgtcgtcctcttcgccagcgccccgaacccgccaccagcctcctcccaccaccgaagcacgctgcctccccggaggagctctcccctcgcagccatcgccaccgcggtcgccctcgttcctcccctcctccgctgctatcggattggcggtggagtggagatcgacccggtcttggaatttcctttgttggtaaggaaccctaatttggtcggatgggatttccatcctcgacaacgcgcgcgagatcgatcgacctcagctgacgcgaagggattgggaagccgaggtgcgggtgcagttgattttctaggaagattggggtttcagctcaaacccccatgctcgacgctgaggacgaccccggcgggagatgacgaggatcttcgtgcagcgcggggccgccggctcctcgtccagctccggccgcgcgggctcgcagccagcgcagcagcagcagccggcagctcctgcccgggaggaggagctgctgctgcagcctcagccacagcagccgccggagcttttggcctcagatgatatagccgagcatctaaatgagggcagcgagaacagcagcagcagcatcaataagcctttgaggctggatgaccccgtttcggagagctcgagctcggcggaggagagggctgcaagggagaaacctcctaaggatgactctaatgttatcaactccactttcttggtggaggaactgatagggctccagattcctgatgagatcgagcatgagaattctgtgccatcaggcactggttcatcacagatggcgggtgcagcatcacacccaccgccgccgccagctccacctccaaaaccatcatctgggaataatgggttgcggagaatggggtctggaagttcaaacagtgtgcggattggatcttcaagaaggccagtagcttggccaccagtggcaacccggacatctacttcaggttctcgcccttcttcgcctaggtcactggttgatggtgaaggatacaacagtgcagatgaacagggtccctgttacgcctcgagttatgatgattcggaaagggaccgcatgtttgagcatgacctaaggctggtgaaagggttggaaatcagaaagatggcggaagacggtaactgtctattcagagcagttgctgatcaagtttatggagatgcggaagcttatgatatggctaggcagatgtgtgttgattatatggaaagggaacgggatcatttctatcagttcattactgaaagttttacattatactgtaagaggaaaaggagagataaggtatatggcaacaatgttgagatccaggcatttgcagagatgtacaatcgccccattcacatatattcctacagtacagagcccattaacattttccaaggaagctataacacagacgttcctccgattaggttgagttaccatcatggtaatcattataattcagtggttgatccccgtcgacagacagttggggcaggccttggatttagctccctcagagggaccaataatgttgacagggaccaggtgaaggctgctataagggctcagcaagatcagcagattgagaatgcacttttggccgaagggagattctactctgatttggagttgacagaaagggaaatagaacggatggtgatggaggcctcaagggcagagtatctggctgaggagaaaaagcttaacatcagagaatcatcaacatcaggggcagaaccatcatcttctgctgcaattagcgggtcgtctcgttcggctacagcagtagatagagggagtgatgaatgctttgtgctcccagacaccgtgctgactcgcagcatgcagctgctcctggcaatgggcttcagttacatccaggtcatggaggcctacagcatattcggcgaggatgtggactcgatgatctgctacctggtggagacaggaggccctggagcctccgcaggcagtagcaaccgccgtaaaggaaaggctgctgagtgatgtgcgcaccttccttgatgtgaatgtgatggatcggaattgttgggcataagtcataccggataatgacagccgtgtgagttgagatgtcggtgtacctgctaccttatgggtgataaataaatggaactcgcaagttgcgacttacatcaggtattctggtgtttgatgtgaatggttgttgatgctttgttgcttggaaaattgctgggttaaaaaaaaaaaaaaaaaaaa

SEQ ID NO: 3376 - protein, 544 aa, Panicum virgatum
  misc_feature: Ceres CLONE 1790977
  misc_feature (1)..(112): Pfam Name: OTU Pfam Description: OTU-like cysteine protease
MTRIFVQRGAAGSSSSSGRAGSQPAQQQQPAAPAREEELLLQPQPQQPPELLASDDIAEHLNEGSENSSSSINKPLRLDDPVSESSSSAEERAAREKPPKDDSNVINSTFLVEELIGLQIPDEIEHENSVPSGTGSSQMAGAASHPPPPPAPPPKPSSGNNGLRRMGSGSSNSVRIGSSRRPVAWPPVATRTSTSGSRPSSPRSLVDGEGYNSADEQGPCYASSYDDSERDRMFEHDLRLVKGLEIRKMAEDGNCLFRAVADQVYGDAEAYDMARQMCVDYMERERDHFYQFITESFTLYCKRKRRDKVYGNNVEIQAFAEMYNRPIHIYSYSTEPINIFQGSYNTDVPPIRLSYHHGNHYNSVVDPRRQTVGAGLGFSSLRGTNNVDRDQVKAAIRAQQDQQIENALLAEGRFYSDLELTEREIERMVMEASRAEYLAEEKKLNIRESSTSGAEPSSSAAISGSSRSATAVDRGSDECFVLPDTVLTRSMQLLLAMGFSYIQVMEAYSIFGEDVDSMICYLVETGGPGASAGSSNRRKGKAAE

SEQ ID NO: 3377 - DNA, 2243 bp, Panicum virgatum
  misc_feature: Ceres CLONE 1790996
  misc_feature: Encodes the peptide sequence at SEQ ID NO. 3378
acggcaaagggagagctcgccaaacccctctttccacagcaccccgcctctgtttgcgcgttcgctcgctccctcgctttaccccgcgagtcgaggccttccgctagctcccgctcgctccctgactggctgcctccccccgccccgcgaccgaaggcgaccgcgccccgcggcggcactgcgacccgcgccacggatctgcggctgcgacgatccgtgtgacagagggtaggaatttcgtttggcctttatgaatcccgagggttctgcttgctaaagggagggcaaggcaagttggaatccgagatgaggggaagaaatgacgcagggcagagcaagaggcccattgtgctgtgctgcatgatgattgtgtgcctatgccttctcttcctatatttctcgggctccaacgggcaggctaagagcaccgcgtttgagtatggaaccaaattctcgcgtacacttggatggggcactgatgacggtgaggatggctctgaagaatccattttcgggactggggatgcagatgatattaagcccaagagcttccctgtgtgtgatgaccggcactcagagctaatcccctgcttggataggaacttgatatatcaaatgaggctaaagctggatttaaacctgatggagcactatgagaggcattgccctcctcctgaaaggcgctttaattgcttgattcctccaccacatggctataaggttcctataaaatggccgaaaagtcgtgatgtagtgtggaaagcaaatattccacacactcaccttgcaaaacagaagtcagaccagaactggatggttgaagcagatgaaaagatcaagtttccaggtggtggaacccattttcatcatggagctgacaaatatatatcaaatattgcaaatatgctaaatttcaaagacaacaatataaacaatgagggaatgcttcgtacaattcttgatgttggttgtggagttgctagttttggaggataccttctttcttctaatgtgatagcaatgtctttggcaccaaatgatgtgcatcagaaccagattcaatttgcacttgaaagggggatccctgcatatcttggtgttttgggaacaaaaaggcttccgtacccaagtagatcgtttgaattagcccattgttcacgctgtaggattgattggcttcaaagagatgggattcttctgcttgaattagacagattgctcaggcctggaggttattttgcttactcctctcctgaagcatatgcacaagatgaggaggatctccgaatctggaaagaaatgagtgctcttgtggaaaggatgtgctggaaaatcgcagagaaaagaaaccagactgttatttgggtcaagcctctgaacaatgattgttacaggagacgagcacttggaacgaagccacctctatgtaaaagtggtgatgatccagattcagtgtgggaagtgccaatggaagcttgcattactccttatccagaacaaatgcacagagatggaggaactgggctggctccctggcctgctcgattaacaaccccgcctccccgtcttgctgatttatatgttactgctgacacatttgaaaaggatacggaaatgtggcagcaaagagtagaaaattattggagtttgttgggcccaaaggtgaaaccagacactattagaaacattatggacatgaaagcaaactttgggtcatttgctgccgcactcaaggataaagatgtatgggtgatgaatgttgtgccacatgatggaccaagcaccctgaagataatctacgatagaggactgataggcagcaatcacgactggtgtgaagccttctcgacctatcctcgaacatatgatcttctccacgcatggacagtcttctccgacctcgacaaaagaggttgcagtgcggaagacctgctccttgaaatggaccgtatcctcaggccgacagggtttatcattgtgagggacaagagcgttgccattgagttcatcaagaagtatctccatgcacttcactgggaagcaataactgctgtggatgctgaacccagcccagaatcagaggagaatgaaatgatcttgataatccggaagaagtcttggttcaaaaaatcgctaagcgctgcgcgcgcgctcgagcacggaaaatgagtaatcgtgaataatcgtgattaaatgtgattaatcgtttgtactaatattgccaaaaaaaaaaaaaaaaaaaa

SEQ ID NO: 3378 - protein, 620 aa, Panicum virgatum
  misc_feature: Ceres CLONE 1790996
  misc_feature: Great-hit functional homolog of the protein sequence encoded by LOCUS At1g04430
  misc_feature: Useful for making plants with altered cell wall content and/or composition
MRGRNDAGQSKRPIVLCCMMIVCLCLLFLYFSGSNGQAKSTAFEYGTKFSRTLGWGTDDGEDGSEESIFGTGDADDIKPKSFPVCDDRHSELIPCLDRNLIYQMRLKLDLNLMEHYERHCPPPERRFNCLIPPPHGYKVPIKWPKSRDVVWKANIPHTHLAKQKSDQNWMVEADEKIKFPGGGTHFHHGADKYISNIANMLNFKDNNINNEGMLRTILDVGCGVASFGGYLLSSNVIAMSLAPNDVHQNQIQFALERGIPAYLGVLGTKRLPYPSRSFELAHCSRCRIDWLQRDGILLLELDRLLRPGGYFAYSSPEAYAQDEEDLRIWKEMSALVERMCWKIAEKRNQTVIWVKPLNNDCYRRRALGTKPPLCKSGDDPDSVWEVPMEACITPYPEQMHRDGGTGLAPWPARLTTPPPRLADLYVTADTFEKDTEMWQQRVENYWSLLGPKVKPDTIRNIMDMKANFGSFAAALKDKDVWVMNVVPHDGPSTLKIIYDRGLIGSNHDWCEAFSTYPRTYDLLHAWTVFSDLDKRGCSAEDLLLEMDRILRPTGFIIVRDKSVAIEFIKKYLHALHWEAITAVDAEPSPESEENEMILIIRKKSWFKKSLSAARALEHGK

SEQ ID NO: 3379 - DNA, 1787 bp, Panicum virgatum
  misc_feature: Ceres CLONE 1790998
  misc_feature: Encodes the peptide sequence at SEQ ID NO. 3380
ctcgcacaagccgcaaccgcgtccaccgggatcgggatggagagctgggtccgcgcggtggtggaggccatccactcctcccgctctcaggccgtcatctacctcgccggcggcgcatctcaggcgctcggctggctcctgtccgtgcccggcgcgtcgagcaccgtcctcgaggtcgtcgtgccctactccagggcctccatggcgcagctccttggcaagatgcccttgcaattcaccagcaagcaggctgcagaggacatggctctggctgcatacaaccgagcactcaagctttctggaccaggtctgcaagttatgggtgttggatttactgggtcactggcaagctcacgtccaaaactcggtgaccataggttttatgtgtcaacgtggacacacaattgcctcaggacatcacatgttaacttgtcgaagggtttacggagcagagaggaagaagacaaggtttcaagctattttttgcttaaggcgatagcagatacctgcagagtatctgcaaccattgagcaagacattcaagaacctgaaattccagaagaaagcgtggaaccatttgatgaagatcaagagctccagcaagttataaatgggcaaatttgcatgaaagtctatcattttgctggtccactggaaaagaacttcagcaggaaagtaattttacctggttcattcaaccctttgcatgatggccaccttaggctgttggaagttgcatcaagcatgtgtgatgacgggattccattctttgagatatcagcaattaatgccgataaacctccactatctatttcagaaattaagaggcgtgttgagcaatttagaaaagcagggaagaatgtgataatatctaaccaaccgtacttctataagaaagcggaacttttcccaggaagcgcttttataattggtgcagacactgcagctaggcttgttaatcctaagtattatggaggagattacaatagaatgctggagatacttctcgaatgtaaatgcacaggtaccacttttcttgttggtggtcgaaagattgaaggagttttcaaggtccttgaggatttagacattccaaaagagctgagagacatgttcatctccataccagaggaaaagtttcgcatggatatttcatctactgaaataaggaagaggcaagggctctgatttaccaaatatggtcatactactattctacagcaggttcgagatgattctccacaactatagaagtatagatacatttggatgctagtagcagccaggtctgaattcttcaagctcaattagtgtttcttcacattgtgggattttgttcacgaatccttttgcaaattatgatgtctatcttcagggagtatattttagttaacttttgtcttgacaggacctcttggtattttgttgagcaaatttgaatcaatcctcttgtagaaccttttgatgtcttcactacctcttgcagctagatggtccacctctgtctcatatctttggtacaatgccggcaaagtgtgggcacatagaaatactgtggaagtaagaaacatagacttgttaaatgtatagtgacagttgggtttatatgttatcttgtgtgcttatcttgttaacagtgactattttctgtgctactcaccaagatatagcagacttgtgaagctgtaagaacttccaatctctgacaatattagtagggacatgatgacctaaatgttagaaacataatattgttagaccaagattaaaaaaaaaaaaaaaaaaaa

SEQ ID NO: 3380 - protein, 383 aa, Panicum virgatum
  misc_feature: Ceres CLONE 1790998
  misc_feature (1)..(57): Pfam Name: CTP_transf_2 Pfam Description: Cytidylyltransferase
MESWVRAVVEAIHSSRSQAVIYLAGGASQALGWLLSVPGASSTVLEVVVPYSRASMAQLLGKMPLQFTSKQAAEDMALAAYNRALKLSGPGLQVMGVGFTGSLASSRPKLGDHRFYVSTWTHNCLRTSHVNLSKGLRSREEEDKVSSYFLLKAIADTCRVSATIEQDIQEPEIPEESVEPFDEDQELQQVINGQICMKVYHFAGPLEKNFSRKVILPGSFNPLHDGHLRLLEVASSMCDDGIPFFEISAINADKPPLSISEIKRRVEQFRKAGKNVIISNQPYFYKKAELFPGSAFIIGADTAARLVNPKYYGGDYNRMLEILLECKCTGTTFLVGGRKIEGVFKVLEDLDIPKELRDMFISIPEEKFRMDISSTEIRKRQGL

SEQ ID NO: 3381 - DNA, 1774 bp, Panicum virgatum
  misc_feature: Ceres CLONE 1791004
  misc_feature: Encodes the peptide sequence at SEQ ID NO. 3382
attgcagccgactcagtctccttatccggtccggtcccacccaaccaaacacgcggccgaatccaccttccttgacctttccccttcttctccgtgcagcccctccccaacacgcgttcccctcaaattctccagcacctgctagaaatccccaaatccgccgcggcgggcttcgaattcgatccccttcccccgagtcgtcggctcgatctgatcggcggagcggcgagagcagccaccaagccaaccatgtgggcggcgtcgtgcctggcgtcgtgctgcgcggcgtgcgcgtgcgaggcctgccggacggcggtcggcagcatcggtcgccgctccgcgcgtatcgcctactgcggcctcttcgcgctctccctcgtcgcctcatgggcgctccgcgaggtcgccgcgcccctcctccagtccatcccatggattaaccacttccacaagacgccggaccgcgagtggttcgagaccgacgcggtgctcaggatcagcctcggcaacttcctcttcttcaccatcctcgccgtcatcatggccgggataaaggaccagaaggacccccgcgacaagatccaccacgggggatggatggcaaagatcttctgctgggccgtcatcgtcttcttcatgttcttcgtgcccaatggcgtcgtcagcttctatgagtcgatttccaagtttggatccgggctgttccttcttgttcaggttgttcttctgttggactttgtgcacggatggaatgagaactgggtcgctaaggatgagcaattctggtacatggctctattggtcgtgtcagttgtctgttacattgccacattctctttctcaggtcttctgtttcactggttcactccatgtggacatgactgcggactcaacctgttcttcattgtcttcacattgattcttgtttttgcatttgctattattgccctccacccaaagatcaatggtagcttgctgcctgcatcggttattggtctctactgcacctatctgtgctacagtggactctctagtgagcccagggattacgagtgcaacgggcttcacaatcactcaaaagctgtgtcaactggtagccttacactgggactggcaaccaccatcctttccgtggtgtactctgctgtccgtgctggctcctctgcgactgtgctctcaccacccgactcgccacgtggtaccgacaagccattgcttcccttcagcaaggcagatgaacaagaagataagaaggatgtgcccaggccagtgacatactcctactctttcttccacctcatattctccctggccagcatgtactcagcaatgctcttgactggctggtcaacctccattggtgagagcggaaagcttgttgatgtcgggtggccatctgtctgggtcaggattgcaacccagtgggcgactgcaggtctgttcatatggtcccttgttgctccgatcctcttccccgacagggaattctaggtcaaccacgacaacctatgaatgcatgcatccctttggagcatcaaccatcaatcatttctactatggtagctaatctgtcctataaaaatatttgatctgtaatacatgccgtgagcgaatcgagcatgaagtcagtgtctgtccgtggctatcaagtctgtcaacttaataatatttggcatcaggtattgtgccagtatgtgaacagtgaaattgtgctgcttgtgttgtatatactggaatttgtgtttgtgtaggtcaaaaaaaaaaaaaaaaaaaa

SEQ ID NO: 3382 - protein, 413 aa, Panicum virgatum
  misc_feature: Ceres CLONE 1791004
  misc_feature (1)..(405): Pfam Name: Serinc Pfam Description: Serine incorporator (Serinc)
MWAASCLASCCAACACEACRTAVGSIGRRSARIAYCGLFALSLVASWALREVAAPLLQSIPWINHFHKTPDREWFETDAVLRISLGNFLFFTILAVIMAGIKDQKDPRDKIHHGGWMAKIFCWAVIVFFMFFVPNGVVSFYESISKFGSGLFLLVQVVLLLDFVHGWNENWVAKDEQFWYMALLVVSVVCYIATFSFSGLLFHWFTPCGHDCGLNLFFIVFTLILVFAFAIIALHPKINGSLLPASVIGLYCTYLCYSGLSSEPRDYECNGLHNHSKAVSTGSLTLGLATTILSVVYSAVRAGSSATVLSPPDSPRGTDKPLLPFSKADEQEDKKDVPRPVTYSYSFFHLIFSLASMYSAMLLTGWSTSIGESGKLVDVGWPSVWVRIATQWATAGLFIWSLVAPILFPDREF

SEQ ID NO: 3383 - DNA, 3112 bp, Panicum virgatum
  misc_feature: Ceres CLONE 1791007
  misc_feature: Encodes the peptide sequence at SEQ ID NO. 3384
aactgagagggagagataaactggagtagagaacaagccctggggaccaagaattcggtgtggaagcggaggcgaaggggagggaggaagaagggaagcgcggtgaagggcgagcgcgccgggcgtcgtcatcgatctcggaattcaaactgtacagtcctagctactttgataagaaggcccccaagttgtcttgagaccagaatattgaaaccatggtttcaaaatcatattcaaatctgttagacatgaccactggagatggatttgactttcggcaaccttttaagtctcttcctcgtgttgtaacttctcctggctttatatctgatcctgattgggatacaagaagtgatggtgattcagttggttcggcatcttctactgaaaagaaaataattgttgccaactttcttccactgaactgtacaagagatgaagctggacagttgtccttctcattggatgatgatgcactactcgtgcaactcaaacatggtttttcgaatgagactgatgttgtgtatgtcggcagtttaaaggttcaggtagatcccagtgagcaggaccaagttgcacagaagcttcttagagaatatcgatgcattcctacttttctcccatctgacctgcagcagcagttctatcatggcttctgtaaacagcagttgtggccacttttccattatatgcttccaatttgccttgacaagggtgagctatttgatcgcaacctgtttcaagcctatgtccgagccaacaaactttttgcagataaagttatggaagcaatcaatacagatgatgattatgtttgggttcatgattatcacctcatgctgcttcctacattcttgaggaagaggttacaccgaataaagcttggtttctttcttcacagcccgtttccttcctctgaaatctacaggactctgcctgtaagggatgaaatccggaagtcgctgctcaatgctgatctcattggtttccaaacatttgactacgctcgccacttcctttcttgctgcagccgattgctaggccttcattatgaatcaaaacgtggttacattggaatagagtattttggcagaacagtgagcctgaagatcctttcagtgggtgtccatgttggtcggcttgaatctgtcttaaagttgcctgctacagttagcaaggttcaagaaattgaacaaaggtataagggcaagatgctgatgttaggtgtagatgacatggatatcttcaaaggaataagtctgaaactgctcgggctggagcttcttctggagagaaatccaaagcttatagagaaggttgtccttgtacaaattatcaatccagcaagaagcacggggaaggatgtgcaagaagctattacagaaactgtttctgtggctgaaaggattaatagaaagtatggttcttcaggttacaagcctgttgtcctaattgaccactgcataccattttctgaaaagattgcgttctatgctgcatctgattgttgtattgtaaatgctgtgagggatggtatgaacttagttccatatgagtatactgtttgcagacagggtaataatgagattgatagactcagaggtcttgacaaagacactagtcacacaagcacacttattgtttcggagtttgtgggttgctccccatctcttagtggtgctttcagggtaaatccatggagtgtcgatgatgtggctgacgccttgtgccaagcaactgacttgactgagtctgagaaacagctacgacatgaaaagcattatcgctatgtcagcactcatgatgttgcttactgggcacacagctttgctcaagatctggaaagagcatgcaaagatcattacagccgaaggtgctgggctatcgggtttggtctaaattttagagttattgctctgtctcctgtcttcaggaagctgtcttcggagcactttgtttcttgttataacaagccttcgagaagagcaatatttcttgactacgacggtacacttgtgccccagtcatcaatcaacaaagctcccagtgctgaagtcgtttcaattcttaacaccttatgcaatgatccaaagaacaatgtatttatagtcagcggacgaggacgagattctcttgatgagtggttttctccatgtgagaagcttggtatagctgcagaacatggctattttatcaggtggagcaaagaagctgaatgggaatcaagctatccaagtccgcaacgtgaatggaagcacattgctgaacctgttatgcaggtatacactgagacaactgatggatcctccatagagccaaaggaaagtgctctagtatggcactatctggacgcggaccataattttggttcctgccaagcaaaggagctacaggatcatcttgagagggtgctatcaaatgagcctgttgttgtaaagtgcggtcattatatcgtagaagtgaaaccgcagggagttagcaaagggcttgctgttgacaagttgattcgcacattggtcaataatgggaaggcacctgattttctgatgtgcatcggcaatgaccggtctgatgaggacatgttcgaaagcatcaacagtatgacctccaacactttcttatcacccacggtaccagaggtctttgcctgttcagttggccagaagcccagcaaagcgaagtactacgtcgatgacaccagtgaagtaatcagattgctcaagaacgtcacccgcatctcgtctcagcgggaggatgtcatccctggacgtgtgaccttcagagatgtactcgatttcgtggaataggcaccaccagctatttacctgaaattattagccgcaaagcatgtacattccattgtctccagtctctcaatggttcattttaggagggtttgttaatccagaggtctagagtagccaacatgaatcgtcaccattacaagaacagcagaaatgcaagccgaagttcgccattttgagggttcaggtgatttatgtgtaggcgattttgatagggaaggagggctgttgctggaggtttgctgtgtgaaagcaaaggctgtggcttctgcagccattggttgtctgaaaaaaaaaaaaaaaaaaaa

SEQ ID NO: 3384 - protein, 863 aa, Panicum virgatum
  misc_feature: Ceres CLONE 1791007
  misc_feature (1)..(488): Pfam Name: Glyco_transf_20 Pfam Description: Glycosyltransferase family 20
  misc_feature (1)..(234): Pfam Name: Trehalose_PPase Pfam Description: Trehalose-phosphatase
MVSKSYSNLLDMTTGDGFDFRQPFKSLPRVVTSPGFISDPDWDTRSDGDSVGSASSTEKKIIVANFLPLNCTRDEAGQLSFSLDDDALLVQLKHGFSNETDVVYVGSLKVQVDPSEQDQVAQKLLREYRCIPTFLPSDLQQQFYHGFCKQQLWPLFHYMLPICLDKGELFDRNLFQAYVRANKLFADKVMEAINTDDDYVWVHDYHLMLLPTFLRKRLHRIKLGFFLHSPFPSSEIYRTLPVRDEIRKSLLNADLIGFQTFDYARHFLSCCSRLLGLHYESKRGYIGIEYFGRTVSLKILSVGVHVGRLESVLKLPATVSKVQEIEQRYKGKMLMLGVDDMDIFKGISLKLLGLELLLERNPKLIEKVVLVQIINPARSTGKDVQEAITETVSVAERINRKYGSSGYKPVVLIDHCIPFSEKIAFYAASDCCIVNAVRDGMNLVPYEYTVCRQGNNEIDRLRGLDKDTSHTSTLIVSEFVGCSPSLSGAFRVNPWSVDDVADALCQATDLTESEKQLRHEKHYRYVSTHDVAYWAHSFAQDLERACKDHYSRRCWAIGFGLNFRVIALSPVFRKLSSEHFVSCYNKPSRRAIFLDYDGTLVPQSSINKAPSAEVVSILNTLCNDPKNNVFIVSGRGRDSLDEWFSPCEKLGIAAEHGYFIRWSKEAEWESSYPSPQREWKHIAEPVMQVYTETTDGSSIEPKESALVWHYLDADHNFGSCQAKELQDHLERVLSNEPVVVKCGHYIVEVKPQGVSKGLAVDKLIRTLVNNGKAPDFLMCIGNDRSDEDMFESINSMTSNTFLSPTVPEVFACSVGQKPSKAKYYVDDTSEVIRLLKNVTRISSQREDVIPGRVTFRDVLDFVE

SEQ ID NO: 3385 - DNA, 2557 bp, Panicum virgatum
  misc_feature: Ceres CLONE 1791024
  misc_feature: Encodes the peptide sequence at SEQ ID NO. 3386
acggtactctctcaccctccactcgcatctcacccagagccgccgccagggtcgaacgccacgaccgcacgcccggccgccggccaccaccgcccgcccgcccggccgccggccaggaccgccggcgccgccagccgggcccgcacgccgccgaccccgcccgcggtctcctttcccggccgccccgcccgcgcgccggacccgcctggaagccgctctcctggccggcggccgcgcccgcccgcccgtcggtcccctgcccagaagctccgcccgccggtgtcccaacccccgccaggctcctgtgccgccaggccgtcggcgccgccccaccgttcccctccctccaccggtcccctccattgctcaagatttgagatcacactggatacttccttatggcatctgatatgcaaccacttagtggccatgagatacccacccgtgctgtggagaactgtggagtttctgatcatacatgtcatggcaaatgccaaagctgtgatagcgatgtaaaaccatcttgtgctgaagtgaatggaatttccttgtcgtttggtagtcatactgatgggaaggcttcaaaagagacctgtgattgcgctgatcctgatggctgtttgattgccacaaatggaagttgcatggctattgatgagctaacacaggagtttgagagagaacaagctggggctacactagaggatctgattttctctaacgatgaagaggaagatgacagtgactgggaccctgctagtagccttgttatgaataggtggttttgcttgaattgcacattgccaaatgtggacgcggttatgtattgcctgaattgccatgagcttaagggatcaggtgtagatggatatgatgctttcaaaactcaaattgcagaggcagctttggtatctcctgacacagaattgtcggaggtgtctacagcgattggttttgatgaaagaatgctgctccacagtgagctagaagttaaaccaaatccacatccagaaagaccggaccgccttcgtgcaattgctgccagtctttctgctgcaggaatctttccctcaaaatgtgctttggtaccccctcgggaaattaccaaggaggaacttctaatggttcatacttcagaccacattgaaagtgttgagcagacaaagaacatgctttacagttacttcacttcggatacttatgcaaatggacactcagcatgtgccgccaaacttgcagcaggactctgtgctgatcttgctagtttgatagtatctgggcgtgttcaaaatggctttgcaatagtgagacctcctggacatcatgcaggggtgaagcaagcaatgggtttttgtcttcacaacaatgcagcagtggctgcgttagctgcaaaaagagcaggtgccaagaaagtcctcatagttgactgggatgtgcaccatggaaatggcacacaagagatattcgaaggggacaaatctgtcttgtacgtatcattacatcgtcatgagtatggaaacttctaccctggaactggagcagcacatgaggttggaattcttgatggtcaaggtttctcagttaatataccttggagccgtggcggtgttggagacaatgactacatctttgcttttaagactgtggtgcttccaatagctgcagaatttgccccagacatcacaataatatcggcaggattcgatgcagctagaggtgaccctctgggttgttgtgatgttactccgatgggatactctataatgacatccttgttaactgcttgctcagggggaagattgttggtgatacttgagggaggatacaatcttcggtctatatcctcatcagctactgaagttgttaaggtcttagttggggacggttcaagttttgatgttgcaactgcaccatcaaaagagggcttggagactgttttacaagtactgaagattcagcaacaattttggccaattttaggtccaacctatgcatcgctgcaggcacatcaggggtcgtttttttccaaatctactagcaagaaaaggaagcattcaggagtgccagggcccttctggtggaactttggaagcaaaaggctactgtacaaagcactctatgagggcccccttctgaggaagatcaaggggtttggacaaggaaaagcaattgattcggcagagccttaaatgatatgccggacatgaacagcatagttgtctgactggggttcctaaagcagtagtttgcatttacctagagccaagttttgactggtttcttgaatggtggtcgaccattttagatgaagtttaacagcaaccccgttttgttgacgtgtggtgtttcagccgatgtatcatctgaaccttttatttggctggtttgtaccataagcctccaggcttcagcgttagcaacattgcatgattggagtttgcattcccgttgggctattagaatgccattgatgtatgtagcagattctcaattggaataccttgaagattttgaatgacatctcagtatttagctccaaaaaaaaaaaaaaaaaaaa

SEQ ID NO: 3386 - protein, 596 aa, Panicum virgatum
  misc_feature: Ceres CLONE 1791024
  misc_feature (1)..(314): Pfam Name: Hist_deacetyl Pfam Description: Histone deacetylase domain
MASDMQPLSGHEIPTRAVENCGVSDHTCHGKCQSCDSDVKPSCAEVNGISLSFGSHTDGKASKETCDCADPDGCLIATNGSCMAIDELTQEFEREQAGATLEDLIFSNDEEEDDSDWDPASSLVMNRWFCLNCTLPNVDAVMYCLNCHELKGSGVDGYDAFKTQIAEAALVSPDTELSEVSTAIGFDERMLLHSELEVKPNPHPERPDRLRAIAASLSAAGIFPSKCALVPPREITKEELLMVHTSDHIESVEQTKNMLYSYFTSDTYANGHSACAAKLAAGLCADLASLIVSGRVQNGFAIVRPPGHHAGVKQAMGFCLHNNAAVAALAAKRAGAKKVLIVDWDVHHGNGTQEIFEGDKSVLYVSLHRHEYGNFYPGTGAAHEVGILDGQGFSVNIPWSRGGVGDNDYIFAFKTVVLPIAAEFAPDITIISAGFDAARGDPLGCCDVTPMGYSIMTSLLTACSGGRLLVILEGGYNLRSISSSATEVVKVLVGDGSSFDVATAPSKEGLETVLQVLKIQQQFWPILGPTYASLQAHQGSFFSKSTSKKRKHSGVPGPFWWNFGSKRLLYKALYEGPLLRKIKGFGQGKAIDSAEP

SEQ ID NO: 3387 - DNA, 1905 bp, Panicum virgatum
  misc_feature: Ceres CLONE 1791051
  misc_feature: Encodes the peptide sequence at SEQ ID NO. 3388
ccagcgagacggggggagatcgccgaatccttccttatccacctcgccgcggcgccatggccgccgccgccgcggtcgtccacctctcctcccacgcccgcctccgccgctcgccgcccgagccgccctccacctcctcccgccgcccaccgctcctgcgctgccgcgcgttcaagcaggaggctgacgggggcggcaccgacccgcccgcgtcgccgaaccgcaggaagaaggggccgctgtacaagctcaaggccgcgatccaggggctcgcgggctcccgctcggccgccgcggaggcgtacgggggagagtaccagcgcgccgtggagaaggcggaggagatcttcttctcggttgctactcagctaggaaaatatgttatcactatgatgagcagtggtgttgtactcggggtcggatttcagctatcaggtggagacagccaaatgaatgaactaatttggtacagctggcttggtggggtgattatcggtacaatgataggtacaaacagtgttctagaggaacactgcaaagctggacctcgcaatgtcgtcataactggaagcacaagagggttaggaaaagcacttgctcgtgagtttcttctttcaggagaccgggttgttattacttcacgaagtcctgaatcagttcttcagactatcaaagaacttgaagagaacattcaggagggcttatcagtcgccaaaaagaaagaaaggaaaactttatctcatgccaaggttgttggtacagcttctgatgtctgtaaacctgaagatgtgaagaagttagtgaattttgctattaatgagcttggctcagttgacatttggatcaataatgcggggacaaataaaggttttaggccactggtaactttttctgatgatgacattactcagatcgtctcaacaaacctagttgggtctctgctgtgcaccagagaagccatgaatgtcatgcaataccaagacaagggaggccatatattcaacatggatggagcaggttctggaggatcaagtacaccactgacagctgtctatggttcaactaaatgtggactgagacagttccaatcatcacttctgaaggaaagcagaagatcaaaagttggagtgcacactgcctctcctggtatggtcctcacagaccttcttttgagtggttcatccctcaggaataaacagatgttcaatttaatatgcgaacttccagaaacagtagctaggacattggttccaaggatgagagttgttaaaggaagtggaaaggcaatcaactacttgacaccaccaaggatcttgctggccttggttactgcatgggttcgaagggggcggtggtttgatgatgagggaagagcagtatatgcagccgaggctgatcgaatccgcaactgggctgaaagccgagcacgcttctctttcaccgatgccatggagatgtacacggaaaacacatgggtttccgtattctcgctctctgtggtctgtgcattcataattctttccagctcaggtggacctcttccaggcacatgatccccagagttgccaacctagatactccaaatttattttcaccaaaggcgttctattatcagaaggcatatgacacaacacttgtgaatggggaagaagatgaacccacaaatgtagataggtgcaagggagatcagcagctgcttcctctctcaccatttaaggcttggctaaccatgttctcagaaaaagggtaaatagaatttgttttgtgggcattcccacttctgtaagctagtctgtgatctgtgacttttaagaacatgtatgagaaagtgagcacgatcagagtcgataaaagttcttgcctgctcgggcatgcttatttaattaaaaaaaaaaaaaaaaaaaa

SEQ ID NO: 3388 - protein, 498 aa, Panicum virgatum
  misc_feature: Ceres CLONE 1791051
  misc_feature (1)..(195): Pfam Name: adh_short Pfam Description: short chain dehydrogenase
MAAAAAVVHLSSHARLRRSPPEPPSTSSRRPPLLRCRAFKQEADGGGTDPPASPNRRKKGPLYKLKAAIQGLAGSRSAAAEAYGGEYQRAVEKAEEIFFSVATQLGKYVITMMSSGVVLGVGFQLSGGDSQMNELIWYSWLGGVIIGTMIGTNSVLEEHCKAGPRNVVITGSTRGLGKALAREFLLSGDRVVITSRSPESVLQTIKELEENIQEGLSVAKKKERKTLSHAKVVGTASDVCKPEDVKKLVNFAINELGSVDIWINNAGTNKGFRPLVTFSDDDITQIVSTNLVGSLLCTREAMNVMQYQDKGGHIFNMDGAGSGGSSTPLTAVYGSTKCGLRQFQSSLLKESRRSKVGVHTASPGMVLTDLLLSGSSLRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 3389 - DNA, 1787 bp, Panicum virgatum
  misc_feature: Ceres CLONE 1791066
  misc_feature: Encodes the peptide sequence at SEQ ID NO. 3390
tttttctgctcgcgtgacgtcagtcaaatcagcttcgcgggatccacccaatcccacccgctatatatgtccaatcgacggccgcccggcatggccgtagcgagactccgttgcgcggccgccgccatcgccgtcgccacagccaccccggccgctgcagcgcgcccgcttcgccgccaacgggccttcctccccgtccccgtccccgtccccggcgccgcccgcctccgccggatcccgccgctgagggcagcggctgcggccatgtcgtcgtccgcgagggcggagcacgaggccggcgcgtggtacgcggtgccgggcctcagcctccgcgaccacctgttcgccgtcccgctcgaccactccagccctgacagcggagccgccatcaccgtcttcgcgcgcgaggtcgtcgccgctgggaaagaagatgcagctctgccttatttgttgtacctacaaggtgggcctggatttgagagtccccgtcccatggaaccaggaggatggttaaagaaagcatgtgaagactaccgtgttgtgctgctagatcagcggggaacagggttatccacaccattaacaccatcatctctttcgcaaattacatctcctgcaaagcaggttgagtacttgaagcatttcagggcagataatatagttaaggatgcagaatttattcgtctacggcttgtaccagatgccaagccttggacagtcctaggacagagttatggtggattttgtgcggttacatatttgagttttgctccagaaggcctgaaatctgttcttttgactggagggcttccaccactaggagaaccttgcactgcacaaactgtatacagagcctgctttaaacaggttcaacagcaaaacgagaagtactataagagatatcctcaagatatacaagttgttcatgacgctgtaagatacttgagtgaatctgaaggcggaggggttgttcttccatctggtggtaggttaacccctaagatgctgcagtgtcttggactgtcaggtttgggctctggtggtggatttgaaaggctgcattatctgctcgagagggtgtgggatcctgtactagttcctggagctaaaaagagcataagctattacttcttgaaagagtttgaaatgtggttaggttttgatcaaaatcctctttatgccctcttgcacgagtctatctactgtcagggctcttcgtcaaaatggtctgctgaaaaggttcgcggtgaatatgaaagtttgtttgatcctatcaaggctacagaagaaggccgtcctgtgtattttactggagagatggtatttccatgtatgtttgacgagattcatgctctgcgagacctaaaggaggctgcccatttattagctgaaaaggaagactggcctccactatatgatgttagcaagctgaataacaataaggttcctgtagctgctgcggtctactacgaggacatgtacgtgaacttcaatatcgccaaggagaccgcctcccagatcgccgggatccggctctgggtgactaacgagtacatgcattctggcatccgcgatggtggcccacatgtcttcgagcatctcatgggtcttctgaacggcaagaagccgttgttttagctgttgtggaggtttgagtgacagctgagctgagctgagcttgctatgagttaaaataagtaaataatacagcctgtttgatttcttgtagatcaaagcaaagaaatgaattgaaaacattttactggcaaaaaaaaaaaaaaaaaaaa

SEQ ID NO: 3390 - protein, 523 aa, Panicum virgatum
  misc_feature: Ceres CLONE 1791066
  misc_feature (1)..(97): Pfam Name: Abhydrolase_1 Pfam Description: alpha/beta hydrolase fold
MSNRRPPGMAVARLRCAAAAIAVATATPAAAARPLRRQRAFLPVPVPVPGAARLRRIPPLRAAAAAMSSSARAEHEAGAWYAVPGLSLRDHLFAVPLDHSSPDSGAAITVFAREVVAAGKEDAALPYLLYLQGGPGFESPRPMEPGGWLKKACEDYRVVLLDQRGTGLSTPLTPSSLSQITSPAKQVEYLKHFRADNIVKDAEFIRLRLVPDAKPWTVLGQSYGGFCAVTYLSFAPEGLKSVLLTGGLPPLGEPCTAQTVYRACFKQVQQQNEKYYKRYPQDIQVVHDAVRYLSESEGGGVVLPSGGRLTPKMLQCLGLSGLGSGGGFERLHYLLERVWDPVLVPGAKKSISYYFLKEFEMWLGFDQNPLYALLHESIYCQGSSSKWSAEKVRGEYESLFDPIKATEEGRPVYFTGEMVFPCMFDEIHALRDLKEAAHLLAEKEDWPPLYDVSKLNNNKVPVAAAVYYEDMYVNFNIAKETASQIAGIRLWVTNEYMHSGIRDGGPHVFEHLMGLLNGKKPLF

SEQ ID NO: 3391 - DNA, 1684 bp, Panicum virgatum
  misc_feature: Ceres CLONE 1791074
  misc_feature: Encodes the peptide sequence at SEQ ID NO. 3392
aaaagaaaaaagtagtggtcgcccggtcgccttctcccctctccgtgtctcgtcgtccccaacctcctcagctagggtttccacccatggcggcgcccaccacctcccgccgcggccccggcgccgcccgcaacatggacgacgacaacctcaccttcgagacctccccgggggtcgaggtcgtcagcatcttcgaccagatggggatcaaggacgacctcctccgcggcatctacggctacggcttcgagaagccctccgccatccagcagcgcgccgtcctccccatcatcaacggccgggacgtcatcgcgcaggcccagtccggcacgggcaagacgtccatgatctccctcaccgtctgccagatcgtcgacaccgccgtgcgcgaggttcaggctttgatcctctcacctactagggagcttgcttcacagacggagagagttatgctggctattggtgactacctcaacatccaagtgcatgcttgcattggtggaaaaagtattggtgaggatatcaggaggctggagaacggggtgcatgttgtctcaggaacaccaggcagagtctgtgatatgatcaagagaaggaccctgcgaacaagagccatcaagcttctagttctggatgaagctgatgagatgttgagcagaggctttaaggatcagatttatgatgtctacagatatctcccaccagaacttcaggtggttttgatctctgccacccttcctcatgagatcctggagataactagcaagttcatgaccgaaccagttaggatccttgtgaagcgtgatgagttgaccctggagggcatcaaacaattctttgttgctgttgagaaagaggaatggaaatttgatactttgtgtgatctttatgatacattgaccatcacccaagctgtcattttctgcaatactaaaagaaaggtggattggcttactgagagaatgcgggccaataacttcacggtatcagctatgcatggtgacatgccccaacaggaaagggatgccattatgtctgagttcagatctggcgcaactcgtgtgctaatcactacggatgtttgggcccgaggactggatgttcaacaggtttctcttgtcataaattatgatctcccaaataaccgtgagctttacatccatcgcattggtcgttctggtcgttttggccgcaagggtgtggcgatcaatttcgtgcgcaaggacgacatccgtatcctgcgagatatagagcagtactacagcacacaaattgatgagatgccaatgaatgttgctgatcttatctgagcagacgactgggagagtgctattgtgttttttttaatcatgccttcacaacgtttggcttagttcctgaatgttgctattggtgaaacgtttgttgtggctgtaaactggacgaggggcttccaaagtggagtggagtagagcagagatttgcttctgttttggtcatcgcatgaactgtatatattttagcttgctccagctcatgtaacttactactgcatttgtggttgggactgtgacttgtgtcgattaggttgtagcgagacaattggatttgatgttgcgttcatgtttaatgtatctgtatctggatttgttttgcttattatgatggttttgactgtttgcagcaaaaaaaaaaaaaaaaaaaa

SEQ ID NO: 3392 - protein, 407 aa, Panicum virgatum
  misc_feature: Ceres CLONE 1791074
  misc_feature (1)..(167): Pfam Name: DEAD Pfam Description: DEAD/DEAH box helicase
  misc_feature (1)..(77): Pfam Name: Helicase_C Pfam Description: Helicase conserved C-terminal domain
MAAPTTSRRGPGAARNMDDDNLTFETSPGVEVVSIFDQMGIKDDLLRGIYGYGFEKPSAIQQRAVLPIINGRDVIAQAQSGTGKTSMISLTVCQIVDTAVREVQALILSPTRELASQTERVMLAIGDYLNIQVHACIGGKSIGEDIRRLENGVHVVSGTPGRVCDMIKRRTLRTRAIKLLVLDEADEMLSRGFKDQIYDVYRYLPPELQVVLISATLPHEILEITSKFMTEPVRILVKRDELTLEGIKQFFVAVEKEEWKFDTLCDLYDTLTITQAVIFCNTKRKVDWLTERMRANNFTVSAMHGDMPQQERDAIMSEFRSGATRVLITTDVWARGLDVQQVSLVINYDLPNNRELYIHRIGRSGRFGRKGVAINFVRKDDIRILRDIEQYYSTQIDEMPMNVADLI

SEQ ID NO: 3393 - DNA, 1754 bp, Panicum virgatum
  misc_feature: Ceres CLONE 1791075
  misc_feature: Encodes the peptide sequence at SEQ ID NO. 3394
attggtgttcaacccaacaccacacgacggccatacgagagcgtacaacgatttccctttccagtccccacagtgcgcacacaaactgagtgacggccgcatctagcagaaagacttgctcagctcagcgtagctagtccatccatggctccggcaagtcctctgctcgtcctcgtcctcctcgccgtaactgccccgctctcggctgatgcgggggtggcactggtgttccccgatgaagcgctcccgaccaagtcgggctacctccccatcccgcccgccaacgcctcgctcttcttcgccttctacgaggccacccacccgttcacgccgccggcctccacgccgctcctcctctggctgcagggcgggcccggctgctccggcctcgtgggcaacttcttcgagctcggcccctacttcgtcaaccccgacagcgtctccctctcgcccaaccccttcgcgtggaaccgccgcttcaggctcctcttcatcgacagcccgctcggcaccgggttcagcgccgcgccggcccccgccgacatccccaccaaccagtccgtcgtcgccgcgcacatcctcgcggcgctgcagtcgttcctcgccctcgatcccggcttccgcgcgcggccgttcttcctcaccggggagagctatgccggcaaatacatccccgcggcgggggcgcacatcctggacgtgaacccgacgctgccggaggcgcttcgggtcaacctccgcggcgtggccatcggcaacggactcacgcaccccgtcgcgcaggtggccacgcacgcggacgcggcctacttctcgggcctcatcaacgcgcggcagaagcgggagctggaggcgctgcaggcggaggcggtggcgctgacgcgcgcggagcggtggcgcgaggcggcggacgcgcggggccgggtgctgtcgcggctgcagaacatgaccggcctggccacgctgtacgacgcggcgaagcagcggccgtaccggacggaccccgtgggcgcgttcctgaaccggccggaggccaaggcggcgctgggcgcgcgcggggacgcggcgtgggaggagtgcagcgacgcggtgggcgcggcgatgcacgcggacgtgatgaggagcgtggtgccgcaggtggagtcgctgctgcggcgcacgcgcgtgctgctgtaccagggcatccgcgacctcagggacggcgtcgtgtccacggaggcgtggctcggcgaggtgcgctgggacgggctggccgccttcctcgacgccgaccgcgccgtgtggcggacgcgcgacggggacctcgcggggtacgtgcagcgctccggcgcgctctcgcacgtggtggtgtacggggccgggcacctggtgccggcggacaacggccgcgccgcgcaggagatgatcgaggactgggtgctgggcacggggctgttcgggagccgcgaaggcaacggcaggaggcgcgcagcctgatgctgcctggcgcccgctggtgaagcacgtacgaacgtgagtatggacgattgcgtgggcgaaaaatgtagtgtagtacaataaaagaatttcgatggttttttttacacagattttgatgggtttagcggaacggtgatactatttcagatcggttctgatcgtgtccgaccattcctattacgagcagtgtgtaatcagtggcggatgcaggatgaaaggcaagggggctgaaacaatgaagatgttgatttgtgtaaaaaaaaaaaaaaaaaaaa

SEQ ID NO: 3394 - protein, 443 aa, Panicum virgatum
  misc_feature: Ceres CLONE 1791075
  misc_feature (1)..(402): Pfam Name: Peptidase_S10 Pfam Description: Serine carboxypeptidase
MAPASPLLVLVLLAVTAPLSADAGVALVFPDEALPTKSGYLPIPPANASLFFAFYEATHPFTPPASTPLLLWLQGGPGCSGLVGNFFELGPYFVNPDSVSLSPNPFAWNRRFRLLFIDSPLGTGFSAAPAPADIPTNQSVVAAHILAALQSFLALDPGFRARPFFLTGESYAGKYIPAAGAHILDVNPTLPEALRVNLRGVAIGNGLTHPVAQVATHADAAYFSGLINARQKRELEALQAEAVALTRAERWREAADARGRVLSRLQNMTGLATLYDAAKQRPYRTDPVGAFLNRPEAKAALGARGDAAWEECSDAVGAAMHADVMRSVVPQVESLLRRTRVLLYQGIRDLRDGVVSTEAWLGEVRWDGLAAFLDADRAVWRTRDGDLAGYVQRSGALSHVVVYGAGHLVPADNGRAAQEMIEDWVLGTGLFGSREGNGRRRAA

SEQ ID NO: 3395 - DNA, 1511 bp, Panicum virgatum
  misc_feature: Ceres CLONE 1791083
  misc_feature: Encodes the peptide sequence at SEQ ID NO. 3396
aacggcgccagctcggggcaggcaccatgctggtggtctggtacaaaagagaggccaggctcaggcagcagctccgccacagataacagccttcttgcttgcttcagctggctagccggtagcgcccctcacggcctcgccctcactccaccggaattcccactccacctcacctcatcagggttctcgagttcttcaggtagctctggtctggtctggtctggccaggtgactgcagctgatcgatcttgcctcagcagatcaagtgccatggaggaagactccagagggagagctccttccactccccaactgctaaacctcatccgaggcgagggagaatggaaggtggttagggaggcagcagatggagggagatcgtcaagaaccacaagctctgaagccgaggaggacacggagctggagctgaagctcggcctccctggtgtccaagaagaagagagaccagccggccccagagagaagatgcagcaagaacaggagagctgcacggcactctcccttggttgcttcccatcacattcgaggctcgccgctagcactgctactgccacaggggcaaagagaggcttcttggcgaccgttggtgccaaggcagaaggttgtaatcagaggcaccaggacaggcaagggtgtgggaatgagttaacattgggagatgaaaacatggcaggtgagaggaagaaagggtgctgtcccccgtcgtcgtcgcatgactcggctgctgcgcctgtgcacagcagcagaaacacccaccaccaggggagaggtgctgttcttccagtggtcggttggcctccagtccgggccatcaggagaaacctcacaaatggtagttcatctaggcaatcccctgaccgacaaaacgatgaagctggtgacaaggcgaagataacctgcaagaggagcccgcttgtcaaaataaacatggacggcatccccattggaaggaaaatagaccttgcagcatacgacaactttcagaagctgtcatctgccgtgcaggagttgttttctggctttcttgaagctcagaaggacttagactgtactgaaagtggagagcaaggaacggaagagaaactattttctgggttattggatggaagtggcgaatacactttagtttatgaaggcgatggagggagcaggacaccaattggggacctaccttggaatgtatttatttctaccgctaagagactgagggtcatgaaaagttcagaacttccttatggcttgattaaaactacctcggggagggcatcagatcattaatatgaggccagtcgtccagccattggatcatgcaagctgtttcaatcacaggcttatgactctttttcgcttgtagagataaatctactaagataaatggtagcatattgcagatgcctaaatgtactgcatattttgtaatttccttgctatttcagatatagctatgcaacatgatctagtaggattagtaaaaaaaaaaaaaaaaaaaa

SEQ ID NO: 3396 - protein, 342 aa, Panicum virgatum
  misc_feature: Ceres CLONE 1791083
  misc_feature (2)..(277): Pfam Name: AUX_IAA Pfam Description: AUX/IAA family
MEEDSRGRAPSTPQLLNLIRGEGEWKVVREAADGGRSSRTTSSEAEEDTELELKLGLPGVQEEERPAGPREKMQQEQESCTALSLGCFPSHSRLAASTATATGAKRGFLATVGAKAEGCNQRHQDRQGCGNELTLGDENMAGERKKGCCPPSSSHDSAAAPVHSSRNTHHQGRGAVLPVVGWPPVRAIRRNLTNGSSSRQSPDRQNDEAGDKAKITCKRSPLVKINMDGIPIGRKIDLAAYDNFQKLSSAVQELFSGFLEAQKDLDCTESGEQGTEEKLFSGLLDGSGEYTLVYEGDGGSRTPIGDLPWNVFISTAKRLRVMKSSELPYGLIKTTSGRASDH

SEQ ID NO: 3397 - DNA, 1639 bp, Panicum virgatum
  misc_feature: Ceres CLONE 1791109
  misc_feature: Encodes the peptide sequence at SEQ ID NO. 3398
gttcaagcgcgagtgcggacagagaggtggcacaacagccacgagcgcccaagatcccggcctcgccggcggcaccctccgcgtcgtgagatctttggagagagagagagagagagagagagagagatcggccatggcgctgagggcgtcgtcccccgtgtcgcacgtggcggcgccgctgccgccgtgcgggccgaggaggagggcgagcggggtggtggtggccatggcgtccaccatcaacagggtcaaaactgtcaaagaaccctatactccaccacgagaggtgcgtcgccaattcacccattcactaccagcccaaaagaaggaaatttttgattcacttcaaccttgggccaaggataacttgttgaaccttctgaagccggttgagaagtcatggcagccacaagacttcctaccagagccttcttctgatgggttttacgatgaagttaaagaactgagggagcaggcaaaggaaatacctgatgagtattttgtttgtttagttggtgacatggttactgaggaagcactacctacctatcaaacaatgctcaacacccttgatggagttcgggatgaaactggtgcaagtccaaccacttgggctgtttggacgagggcgtggacagctgaagagaacaggcatggtgatctccttaataagtacatgtaccttactggacgggttgacataaaacaaattgagaagaccatacagtatctgattgggtctggaatggatccaggtactgagaacaatccctatttgggtttcctttacacatcattccaagagagagcaacatttatatctcatggcaataccgcaaggcatgccaaggagtatggtgatctcaagctggctcagatatgtggcacaatagcagctgatgaaaagcgccatgagacagcctacaccaagatagtcgagaagctctttgagatcgatcctgactacacggtgatggcgtttgccgacatgatgaggaagaagatcacaatgcctgctcatctcatgtacgatgggaatgacaaccacctgtttgagcacttcagcgcggtggcgcagaggctgggcgtctacaccgctaaagactacgccgacatccttgagttcttggtccagaggtggaaagttgctgatctaacagggttatctggagaagggaggagggcgcagaactttgtctgtaccttagcaccgagaatcaggaggttggatgagagagctcaagcaagggcaaagcagggaccggttattcctttcagttggatatatgaccgcaaggtgcaactttaattgattgtggtaggcaatgggagcacattctatatccgttttgagtcctggagttctatataagaaagcagcctttaggttatctagctgggtagaattcaactgcttatcaatctcacttacgcaaagtatgcatgctatcagttgtctgtgtgttgcaagtttggatctggtgtaagactcatgtgagttgcctttctggcagccacggacggttccattgcaactgagtaaacttgtgtcgtattgaatatctagtgtgagatttacaggacttataagttccaaagtaataatatggagattgtataaaaaaaaaaaaaaaaaaaa

SEQ ID NO: 3398 - protein, 391 aa, Panicum virgatum
  misc_feature: Ceres CLONE 1791109
  misc_feature (1)..(330): Pfam Name: FA_desaturase_2 Pfam Description: Fatty acid desaturase
  misc_feature (10)..(391): SWISSPROT Homolog: EC 1.14.19.2 Acyl-[acyl-carrier-protein] desaturase, chloroplast precursor
  misc_feature (5)..(391): SWISSPROT Homolog: EC 1.14.19.2 Acyl-[acyl-carrier-protein] desaturase, chloroplast precursor
MALRASSPVSHVAAPLPPCGPRRRASGVVVAMASTINRVKTVKEPYTPPREVRRQFTHSLPAQKKEIFDSLQPWAKDNLLNLLKPVEKSWQPQDFLPEPSSDGFYDEVKELREQAKEIPDEYFVCLVGDMVTEEALPTYQTMLNTLDGVRDETGASPTTWAVWTRAWTAEENRHGDLLNKYMYLTGRVDIKQIEKTIQYLIGSGMDPGTENNPYLGFLYTSFQERATFISHGNTARHAKEYGDLKLAQICGTIAADEKRHETAYTKIVEKLFEIDPDYTVMAFADMMRKKITMPAHLMYDGNDNHLFEHFSAVAQRLGVYTAKDYADILEFLVQRWKVADLTGLSGEGRRAQNFVCTLAPRIRRLDERAQARAKQGPVIPFSWIYDRKVQL

SEQ ID NO: 3399 - DNA, 1555 bp, Panicum virgatum
  misc_feature: Ceres CLONE 1791141
  misc_feature: Encodes the peptide sequence at SEQ ID NO. 3400
aactttagccgcaaaattcagccaaaaaagttccaaataaaaaaggaaggggaaaaaaacactaggagcggcatccaccaccggagctcctatcggcccatccctctgtgtcaaccccctccggaaaaaatttatttgcaatccagtccctggccggcggcccttgcagcggctcccgctcgccggaggaatccacccgtctccttgctctgcggcggggtcatggggttctcgctgtaccccatgaagacgtccacgcgcgttctctggagcaccagcttcttccgccataagctcgcctcctcctgctgcttcatctgagccagcccaacaccgccctcgatcgcctcggcggcggccgctgctgcgcggattttcaaagcaggcgtttaagagtgtgtgtttgtgtgcgcgcgtttgcgtttcaagattgggttttgtttcgttctttgggaggaaggggcaaggagaaggagagggcaagaagaagaacaagaatcagcatggatccgggccgcgtcggcgtcgactcgggcggcgcgcggcggggcggcggcgggggcggcgcgcagatgctgctcttcggcggcgggggcagcgccaacagcaacggcttcttccgaggtgttccgacggcggttctgggcatggacgacgcggcgcgcgtgggcaagcggccgttcttcacgacgcacgaggagctcctggaggagtactactacgacgagcaggcgccggagaagaagcgccggctgacggcggagcaggtgcagcttctggagcggagcttcgaggaggagaacaagctggagccggagcgcaagaccgagctggcgcgccggctggggatggcgccccgccaggtggccgtctggttccagaaccgccgcgcgcgctggaagaccaagcagctcgagaccgactgcgaccgtctcaaggctgcctacgacgcgctcgccgccgatcaccagggcctactcgccgacaacgacagcctcagggcacaggtaatctccctgacagagaagctgcaaggcaaggatacatccccatcggcgaccatcactgcccaagaggttgaccagctggacgagcacactgtggcgtcaggcactgagaagctgctggtgcagctcaaggacgaccacctcagcagtggcgactgtaccggccacggtaccctctcatctgaggaagaggacggtggcgtgatcagcgatgaggtatgcagcttcgaccttccagatgccttgttcgctgctgttggggtcacccatcgtggcgctgaggaagcgcagctgtgcaactggaactcctggttgtggaacaactgatcatcggtggatggctggatggatccatgccccatgtgcgaaggagcaagttctcccctggtttcgacccttttctgtaccgtataattactgtgttaattatgttccgccaaatgtttttgtgtgatgaaacagaactggtgttgtaagtttacgtttttgaagattttatgtgttcacatataataatatgttttgaacaaaaaaaaaaaaaaaaaaaa

SEQ ID NO: 3400 - protein, 276 aa, Panicum virgatum
  misc_feature: Ceres CLONE 1791141
  misc_feature (1)..(55): Pfam Name: Homeobox Pfam Description: Homeobox domain
MDPGRVGVDSGGARRGGGGGGAQMLLFGGGGSANSNGFFRGVPTAVLGMDDAARVGKRPFFTTHEELLEEYYYDEQAPEKKRRLTAEQVQLLERSFEEENKLEPERKTELARRLGMAPRQVAVWFQNRRARWKTKQLETDCDRLKAAYDALAADHQGLLADNDSLRAQVISLTEKLQGKDTSPSATITAQEVDQLDEHTVASGTEKLLVQLKDDHLSSGDCTGHGTLSSEEEDGGVISDEVCSFDLPDALFAAVGVTHRGAEEAQLCNWNSWLWNN

SEQ ID NO: 3401 - DNA, 1736 bp, Panicum virgatum
  misc_feature: Ceres CLONE 1791144
  misc_feature: Encodes the peptide sequence at SEQ ID NO. 3402
agtcgccgccacacccacctcaaatccccgacccatcaatctttcaaagaaaaaaaaagatccccgacccatcggactcgaccaccaattacagcaccgccgccgccgcgccccctgcttcccaagccatctcatggcagcgtcggcctcttccctcctcgccgccgcagcatcctcgtcctgcgcggccatctctccccggctcccccgcggagctcaggccgccgcctccgttccttcgccgtcgcgccactcctgcgcttccctccgcgcttcccccgcgaggctccataggagccgcttcgtagccagcgccagcgtcgctcccgcgatgcagcctccggcggagtccagggtctctacggtggtcgacgtcgacctcggcgaccgtagctacccgatctacatcggcgcaggcctcctcgacgagccggacctgctgcagaggcatgttcacgggaagagggttctggtggtgaccaacacgaccgtcgcgccgctttacctggacaaggtgacctgggcactcacgcacaacaacccgaacgtgtcagtggagagcgtgatcctgccggacggcgagaaatacaaagatatgggcacgatgatgaaggtgtttgacaaggcagtcgagtcccggcttgaccggcgttgcacatttgtagcactgggtggtggtgtcattggggacatgtgcgggtttgcagcttctgcgttccttcgtggtgtcaacttcatacagataccaactactctgatggctcaggtggattcatctgttggtggaaagactgggattaaccacccaaacgggaagaacttaattggggcattctaccagcctcagtgtgtactgatagacacggatacactgaatacattgcctgacagggagctagcctcaggcattgctgaggtagttaagtatgggctcataagggatgcaccattctttgagtggcaagagaagaacatgtcagcattgttggcaagagaaccaagtgctttggcatatgctattaagagatcatgtgaaaacaaagctgaagtggttgcacaggatgagaaggaaagtggtcttcgagcaacactaaacctgggtcacacatttgcccatgctatcgaaactggggctggatatggggcatggctccatggggaggcggttgcagctggaacagttatggcagctgatatgtctcaccgcctggggtggatagacgagtcaatcaaaaaacgtgtagtggatatactagagcaagccaagcttcccattacacctccagagactatgacagtggagaagttcgaaagtattatggctgttgacaagaaggttgctgatggtttgttgaggctcatccttctgaaagggcctctggggagctgtgtttttactggggaatatgacaggaaagcacttgatgaaacccttcatgcattctgcaacaactgatacttcttgattttggatttcgcctcttgtatactaataggctcccttcatgcattctgcaacaactgatccttcttgattttggatttcgcctcttgtaaggctatattgatcatcagggaggagagtgcattgtgtatttatacccattgagttttttttgttgttggaaataatgggattgttagggattggtttgagtttgtagtaataaactgtgatcagtcatcttctagtaataaagaagttttactgcatcgaaaaaaaaaaaaaaaaaaaa

SEQ ID NO: 3402 - protein, 440 aa, Panicum virgatum
  misc_feature: Ceres CLONE 1791144
  misc_feature (1)..(312): Pfam Name: DHQ_synthase Pfam Description: 3-dehydroquinate synthase
  misc_feature (81)..(434): SWISSPROT Homolog: EC 4.2.3.4 3-dehydroquinate synthase
MAASASSLLAAAASSSCAAISPRLPRGAQAAASVPSPSRHSCASLRASPARLHRSRFVASASVAPAMQPPAESRVSTVVDVDLGDRSYPIYIGAGLLDEPDLLQRHVHGKRVLVVTNTTVAPLYLDKVTWALTHNNPNVSVESVILPDGEKYKDMGTMMKVFDKAVESRLDRRCTFVALGGGVIGDMCGFAASAFLRGVNFIQIPTTLMAQVDSSVGGKTGINHPNGKNLIGAFYQPQCVLIDTDTLNTLPDRELASGIAEVVKYGLIRDAPFFEWQEKNMSALLAREPSALAYAIKRSCENKAEVVAQDEKESGLRATLNLGHTFAHAIETGAGYGAWLHGEAVAAGTVMAADMSHRLGWIDESIKKRVVDILEQAKLPITPPETMTVEKFESIMAVDKKVADGLLRLILLKGPLGSCVFTGEYDRKALDETLHAFCNN

SEQ ID NO: 3403 - DNA, 1924 bp, Panicum virgatum
  misc_feature: Ceres CLONE 1791161
  misc_feature: Encodes the peptide sequence at SEQ ID NO. 3404
aggccatggccatccaaccacacccacgagcgcaacctcccaaaagcgccaccgattccacaacctcccgtactcgtgagtcgaggctccaatccttgcacaggaggaggaggaggacgagcccaccatggccatggcgacggctctccgaaagctctccgccaacgcgctccgccgccaccagccgctctcccgcatcacgccgctctactacatggcgtccctgccggcgagggaggagagatccagtattacctggccaaagcagttgaacgcgccgcttgaagaggtcgaccccgagattgctgacatcatcgagctcgagaaggcccgccaatggaaggggctggagctaatcccgtcggagaatttcacgtcggtgtcagtgatgcaggcggtgggttccgtcatgaccaacaagtacagcgaggggtaccccggcgcgagatactacggtgggaatgaatacattgatatggctgaatccttgtgtcagaaacgtgctttggaggctttccgcttggacccagcgaagtggggagtgaatgtgcaacctctatcaggttcacctgccaacttccaggtgtacactgcgctattgaagccacatgaaaggatcatggctttggatcttccacacggtggacatctttctcatggttaccagactgacactaagaagatttcggcaacttcgatattctttgagacgatgccctacagattggatgaaagcactggcttaattgattacgatcagttggagaaaagtgcagttcttttcaggccgaagttgatcatagctggtgcgagtgcatatgctcgcctatatgattatgatcgtatgcggaagatatgcaacaagcagaaagcaatacttctagcagacatggcacatatcagtgggcttgttgcagctggcgtcattccatctccttttgattatgcagatgtagtgactaccactactcacaagtcacttcgtgggccacgtggagccatgatattttacaggaagggagtgaaagaaataaataagcatggaaaagaggttatgtatgattttgaggacaagatcaacgctgccgtctttccaggtttgcaaggtgggcctcataaccataccattactggcttagctgttgcgcttaagcaggcaactactccagagtaccgagcttatcaagagcaagttatcagtaacagtgctaaatttgcacagagcttggtagcaaaaggatacgagcttgtctctggtggaactgataaccatttggtccttgttaacctcaagaataaggggatagatggttcaaggatggagaaggttttagaaactgtgcatattgcagcaaacaagaacactgttcctggcgatgtttcagctatggtaccaggaggcatcaggatgggaaccccagctcttacatccagaggatttgtggaggaagatttcgctaaggttgctgacttctttgatgcagcagtgaacttggctgtgaaggttaaggctgcaacgacaggtggaacgaagctgaaggactttgttgccaccttgcaatctgatagcaaaatccaagctgagattgcaaagcttcgccatgacgtggaggaatttgcaaaacagttcccaacagttggatttgagaaagagaccatgaaatacaagaactaagatctgaatgataagcagcaagcaaagatgccaagacaattgttggagttcagatgggcatgatcatgtaaacataaatccatggcgaaagtggaatggcatcttatgttaagagagtgattggcaatttacagcatatgcgacttctgtcaatagcccatattgtaaacacctactgcaagatcttataatgaataatagcccatattaagcatcactcttcttggacaaaaaaaaaaaaaaaaaaaa

SEQ ID NO: 3404 - protein, 515 aa, Panicum virgatum
  misc_feature: Ceres CLONE 1791161
  misc_feature (1)..(400): Pfam Name: SHMT Pfam Description: Serine hydroxymethyltransferase
  misc_feature (1)..(515): SWISSPROT Homolog: EC 2.1.2.1 Serine hydroxymethyltransferase, mitochondrial precursor
MAMATALRKLSANALRRHQPLSRITPLYYMASLPAREERSSITWPKQLNAPLEEVDPEIADIIELEKARQWKGLELIPSENFTSVSVMQAVGSVMTNKYSEGYPGARYYGGNEYIDMAESLCQKRALEAFRLDPAKWGVNVQPLSGSPANFQVYTALLKPHERIMALDLPHGGHLSHGYQTDTKKISATSIFFETMPYRLDESTGLIDYDQLEKSAVLFRPKLIIAGASAYARLYDYDRMRKICNKQKAILLADMAHISGLVAAGVIPSPFDYADVVTTTTHKSLRGPRGAMIFYRKGVKEINKHGKEVMYDFEDKINAAVFPGLQGGPHNHTITGLAVALKQATTPEYRAYQEQVISNSAKFAQSLVAKGYELVSGGTDNHLVLVNLKNKGIDGSRMEKVLETVHIAANKNTVPGDVSAMVPGGIRMGTPALTSRGFVEEDFAKVADFFDAAVNLAVKVKAATTGGTKLKDFVATLQSDSKIQAEIAKLRHDVEEFAKQFPTVGFEKETMKYKN

SEQ ID NO: 3405 - DNA, 1904 bp, Panicum virgatum
  misc_feature: Ceres CLONE 1791162
  misc_feature: Encodes the peptide sequence at SEQ ID NO. 3406
gaatccgtcaccaccgcgatggcgctgcaccacctgcgcctcgcgccgctcgcgctcctccgcgtcgcgggcctcccgcctcgcgcctcctcccgtctcgccgcgcgccaccacctccacctcctcctcttcgcgccgccggcgcggccgtggcgcctcctctcgcccgctgcgagaccgcgcgcgctcgccaccgcggcggccgaggccgacggcacgggcgacggcttcttcgcggaggataccacgtcgtgggggtccctcggcgtgtccgaccgcctcgcctacgccctgcgcggcgccgggctcgcgcggccttcccttgtccaggcatcctgtataccacatgttctcacaacgaatgatgtaattgttgctgcagagactggcagtggcaaaacccatggttacctggttcctttaattgaaaaattgtgctccaaatcttctaacacggaagatgataattcccagggcactgccccaggggcccatgacatcgtgttggtcctttgtcccaatgtcatgctgtgcgagcaagttgttcgcatggctaattcattgcttgacgagtctggtgaaccacttaaaagtgctgcggctgtttgtggactgaagggttggccagctgtacatccagatattctcgtagccaccccagctgctctcttgaattatctatttgactatgacccagaaaagaggcgaagagagagattcatgcgtcatgtgaaatttgtagtgtttgatgaggcagacatgctactttgtggaagttttgagaaccaggtcattcgtcttatccatatgctgagatttgatgaaaagttactgtctagagcactagatgctggaaaggaagtatcacctgggagtgacgatgaatatcatgaggattcagactctgagggtgctgaattcagtggttctgatgaggaaaatgaaggcaaccttgttcgagatagaccaggcaaggtggagaatagtcctgctggggcacgcaaggactggaggagggttagaaaaatatataaacggagcaagcagtatgtctttgtcgctgccacccttcctcagagtggcaaaaagactgctggtggtgtgttgaagcgaatgtttcctgatgctgtatgggttagtggaacttatctgcatcgtcataaccccagattagagcggagatggatagaggtcactgctgatacacaagttgatgctcttatagatgcagtaaaatatggcctaaagagtaaagatcatgatgcaccaaaacgaactatggtgttcacaaacactgttgatgctgccaattcagtctctgacatattgcagcgagttggcattccatgcatcttgtaccatcgtgagagttcattagaggaaagagccaataatttgcaatcttttcgggaaaatggtggtgtgcttgtatgcactgatgctgctgcccgttggctcgatgtcccgaatgtttctcatgtcattcaggcagaatttgctgcctgtgctgttgattttttgcacagggtgggtcgcacagccagagctggccagtctggcatagtgaccagcctatacacagaggcaaatcgtgatcttgtaagagcagtccgtcaagcagaggaattggcccagccagtggagagagcgtttagtaggaaaagaagcttccgcaataagttgaagaagcaagcactacagagacgggaagcgtcgctagcgtgaccgattatatttgtagagaggacaatggatagcttttctcctttattgttggtgatgaatgtttttgtattacatagggctgcaacatacatattggatggaagtgattttcctgatggaatgcgttgaatcaatctgatgaaagtgtactctctgtacaaaaaaaaaaaaaaaaaaaa

SEQ ID NO: 3406 - protein, 568 aa, Panicum virgatum
  misc_feature: Ceres CLONE 1791162
  misc_feature (1)..(76): Pfam Name: Helicase_C Pfam Description: Helicase conserved C-terminal domain
  misc_feature (1)..(260): Pfam Name: DEAD Pfam Description: DEAD/DEAH box helicase
MALHHLRLAPLALLRVAGLPPRASSRLAARHHLHLLLFAPPARPWRLLSPAARPRALATAAAEADGTGDGFFAEDTTSWGSLGVSDRLAYALRGAGLARPSLVQASCIPHVLTTNDVIVAAETGSGKTHGYLVPLIEKLCSKSSNTEDDNSQGTAPGAHDIVLVLCPNVMLCEQVVRMANSLLDESGEPLKSAAAVCGLKGWPAVHPDILVATPAALLNYLFDYDPEKRRRERFMRHVKFVVFDEADMLLCGSFENQVIRLIHMLRFDEKLLSRALDAGKEVSPGSDDEYHEDSDSEGAEFSGSDEENEGNLVRDRPGKVENSPAGARKDWRRVRKIYKRSKQYVFVAATLPQSGKKTAGGVLKRMFPDAVWVSGTYLHRHNPRLERRWIEVTADTQVDALIDAVKYGLKSKDHDAPKRTMVFTNTVDAANSVSDILQRVGIPCILYHRESSLEERANNLQSFRENGGVLVCTDAAARWLDVPNVSHVIQAEFAACAVDFLHRVGRTARAGQSGIVTSLYTEANRDLVRAVRQAEELAQPVERAFSRKRSFRNKLKKQALQRREASLA

SEQ ID NO: 3407 - DNA, 1555 bp, Panicum virgatum
  misc_feature: Ceres CLONE 1791203
  misc_feature: Encodes the peptide sequence at SEQ ID NO. 3408
actgcaaagaccatctctgtttactactccgctgacttgactgctccgctccaccaacagacgccgccatgtgcgccacccccaccgtcgagaaatcggccccggagctcgtccagccggcggggccgacgccaggaggcaccctcccgctatcctccatcgacaagaccgcggcggtgcgcgtcccggttgtcctggtccaggtgttcccccgggccgccagcgacgtcggcggcggccagcaggacgccgccgtggcggcgatgcgcgacggcttcgcgagggcgctggtgccgtactacccggtggccggccgcgtcgccgacgtgagccccggggacggggagcccgtcgtggactgcaccggccagggcgtctggttcgtggaggccgcggcgagctgcacgctcgccgacgtgaactacctcgagcgcccgctgctcatccccaagaaggacctgctccccaaggaggagctcgaggatctcatcatcatggcccaggtgaccaagttcacctgcggcgggctcgccgtcgggatctgcttcagccacatggtgttcgacgggcagggcgcggcgcagttcctcaaggcggccggcgagatggcgcgggggctgccggcgccgtcagtggcgccggtctgggaccgcgacgccatcccgggcccgccgcggccgcccaagctgccgcgcggcggccccccgccgccgtgcacggcgttcagcttcgtgacccaggcggccgacatctcgccggagagcctcgcacgcatcaaggacgcgttccgcgcggcgacggggcaggcctgctccaccttcgacgccgccacggccgtgctgttcaagtgccgcgcgctggcggcggggctccccgacggcgccgaggtccggctcgcctttgccgcctgcacgcggcgcctcctccgcggcgtgctgccgtcggtggacggctactacggcaactgcgtgtacctcgcggtcgccgcccggaccagcagggccatccgcgaggcgccgctggaggaggtgatccgcctgacgcgggcggctaaggaggcggtcgccgcgcggttcgcggactggatgcgcggcggcggcgccatggaggaccactacagcgtggcgctggactacggcacggtgacggtgtcggactggagccgcgtggggttcagcgaggtggactacggcttcggcgagccggggtacgtgttctcgctcaacgaccatgtcagggtcgtcccatcggcgatctacctcaggccgccggcgcccaagcgtggcgtcaggctcatgctccgctgcgtcgaggagccgcacgccgccgcgttcgccgacgagctcgccaagttcgcctaggtgctggttcttggcctggctttggtcaaacgtgctctctctgttttttttcctcttttttaaatgcagtacctaaacttcactgctgtagcctgtcattgcctcattggcattgttgtgggatgatctgacttttcaagtcaacaagaacaccaaaacaactcgcggtgcttcaaaaaaaaaaaaaaaaaaaa

SEQ ID NO: 3408 - protein, 430 aa, Panicum virgatum
  misc_feature: Ceres CLONE 1791203
  misc_feature (1)..(427): Pfam Name: Transferase Pfam Description: Transferase family
MCATPTVEKSAPELVQPAGPTPGGTLPLSSIDKTAAVRVPVVLVQVFPRAASDVGGGQQDAAVAAMRDGFARALVPYYPVAGRVADVSPGDGEPVVDCTGQGVWFVEAAASCTLADVNYLERPLLIPKKDLLPKEELEDLIIMAQVTKFTCGGLAVGICFSHMVFDGQGAAQFLKAAGEMARGLPAPSVAPVWDRDAIPGPPRPPKLPRGGPPPPCTAFSFVTQAADISPESLARIKDAFRAATGQACSTFDAATAVLFKCRALAAGLPDGAEVRLAFAACTRRLLRGVLPSVDGYYGNCVYLAVAARTSRAIREAPLEEVIRLTRAAKEAVAARFADWMRGGGAMEDHYSVALDYGTVTVSDWSRVGFSEVDYGFGEPGYVFSLNDHVRVVPSAIYLRPPAPKRGVRLMLRCVEEPHAAAFADELAKFA

SEQ ID NO: 3409 - DNA, 1597 bp, Panicum virgatum
  misc_feature: Ceres CLONE 1791205
  misc_feature: Encodes the peptide sequence at SEQ ID NO. 3410
gtcgacctcgcagcactcgcagtctctcacatcacgagctatctccacctccaattaatccgccagcttagcctgccgctctatccctcatcttgctgcttgtacggctgtacctgtgctatccggcgaagctacggggatgaaagcgtacgcggcgatggcgtcgccgcccaccaaagccatggccgtggacaagctcagctacgagatcttctccctgctcgagagcaagttcctcttcggcgccgccaatgggtgcctgtcctccggccccgggacgccggcgcgggcgttcctcgacggcgggcgcgtgcgggtgctggccatcgacggctgcggcgcgggcgccgaggacgcgctcctggccgccgcggcgctcgccaggctcgaggccgggctgcgggagcaagccggggaccccgacgcgagcgtcgccgacttcttcgacctggccgcgggcgccggcgctgggggcgtgctggccgcaatgctgttcctgaggggcaccgacgggcggccgcggtactcggcccaggaggcgctcgcgttcgtggccgggagcgtcgggaggaagggctggggcggccggcgcgggcgctgggcgaagctgctccgcggctcccggagcggcgagcgggcgctccggcgcgtgttcggcgacgcgacgctcagggacaccgcggcgccgctgctcgtgccgtgctacgacctcgccacggccgcgccgttcgtgttctcgcgcgccgacgccgtcgagagcgacggattcgatttccgcctccgcgacgtctgcgccgccacctgcgccgcgggcggcaagcccgtccccgtgaggtccgtggacggccgcactgccatcgccgcggcgtccgcgggagtggcggccatgggcaacccggccgcggcagccatcacgcacgtgctccacaacaagcaggagtttcccctggcgaccggcgtcgaggacctcctcgtcctctccatcggctccagcgcctccgccaccgcctccgacggggcgagaacgccgatgccgacacggtcgccgtcgccgcgggaagtggcgcgcgtcaccgccgagggcgtcgccgacatggtggacgaatcagtagccatggcgttcgggctcgcgtgcggaagcaactacgtgcgtctccaggccggcaaggcgccgacgccgcttcacgcggagacggcggccgctgccgcgggagcgatgctggcgcagcggaacgtggagtcggtcctcttccgcgggcggaggctgtcagagcggacgaacgccgagaaggtggacgcgctggcgacggagctggtgaaggagcaggagcgacggaggcgcagcccgctcccgaacgtggccatcaaggaggtagccgcgccgcggctgtcatcggcgaccaccgcgtcgtcgggcacggcgacggcaaaggaccgtctcgacaatgccgtcgccggcgtcgtgggattctcgccggtagttgagttttatttagtttagcccgtgaatgcgatgaggatctttgtgtacatgcatgtcacaaacaagggtagagtagagacgtgtgttcttttggaaaaaaaaaaaaaaaaaaaa

SEQ ID NO: 3410 - protein, 453 aa, Panicum virgatum
  misc_feature: Ceres CLONE 1791205
  misc_feature (1)..(199): Pfam Name: Patatin Pfam Description: Patatin-like phospholipase
MKAYAAMASPPTKAMAVDKLSYEIFSLLESKFLFGAANGCLSSGPGTPARAFLDGGRVRVLAIDGCGAGAEDALLAAAALARLEAGLREQAGDPDASVADFFDLAAGAGAGGVLAAMLFLRGTDGRPRYSAQEALAFVAGSVGRKGWGGRRGRWAKLLRGSRSGERALRRVFGDATLRDTAAPLLVPCYDLATAAPFVFSRADAVESDGFDFRLRDVCAATCAAGGKPVPVRSVDGRTAIAAASAGVAAMGNPAAAAITHVLHNKQEFPLATGVEDLLVLSIGSSASATASDGARTPMPTRSPSPREVARVTAEGVADMVDESVAMAFGLACGSNYVRLQAGKAPTPLHAETAAAAAGAMLAQRNVESVLFRGRRLSERTNAEKVDALATELVKEQERRRRSPLPNVAIKEVAAPRLSSATTASSGTATAKDRLDNAVAGVVGFSPVVEFYLV

SEQ ID NO: 3411 - DNA, 1595 bp, Panicum virgatum
  misc_feature: Ceres CLONE 1791206
  misc_feature: Encodes the peptide sequence at SEQ ID NO. 3412
acccgcagaccaacgcacgccgacgccaccgccaccgcccccgaagcacagacacggcgcgcatggcggcggcggcgtcgttccgctgctgcttccccggctccgctatcggtggcggcttcatcaggccctcctcctccaggcggggccgacacgcagcggccgtggtggcgccgccgcctcccgcttcgctggggaaccgaacgcgcgttgacttccctatcctccaccaggaatttgatggtgccaaattagtttatttcgacaatggtgcaacctcacagaaaccttatagtgtaatgaaaacattagatgagtactacagatcgtacaactcgaatgttcatcgtggtattcatgcactcagcgcgaaagctactgatgcatatgagggtgcaagaacaaaagttgcaaattttgtcaatgcagctgatagcagagagattgttttcacacgtaatgctacagaagctatcaatttggtagcctattcatggggtctatctaacataaaacaaggagatgagattcttcttactgttgcggagcatcatagtgctattgttccatggcaatttgtttcccagaagactggtgccactttaaagtatgttgggttgactaaagaagaggttccagacattgagcagttaaaagggcttctgtcaaacaaaacaaagatagttgttgtccatcatgtctcaaatgtacttggttcaatgcttcctattgaggagattgtaacatggtcaaaaggagttggagctaaggttcttgtagatgcttgtcaaagtgttcctcatatgccagttgatgttcagaaacttggtgccgactttcttgtagcatcctcacataagatgtgtggccctacaggagttggatttatgcatggcacatttgagatcttgtcatctatggagcctttcttaggtggtggtgaaatgattgcagatgtgttcaatgacaaatctacatatgctgagcctccctctagatttgaggctggaactcctgcaattggagaagctataggattgggagcagcaattgactatctatcatgcattggcatggatcagatccatgaatatgagaaagagttggcaacatatctctatgaaagccttatttcagttccaaatgtccgggtatatggtccagcaccttcccaaacagatcaccgtgctcctttatgctctttcaatgttgagaatgttcatcctacagatattgcagaaattcttgatctccagcatggcgtagcaattcgatcagggcatcattgtgcacagattttgcataggacccttggtatcaatgcaagtgctcgtgcaagtcttcacttttacaatacaaaagaggagatggatgctttcatcgatgcactgaaagatactattcacttccttacttctcaacactagtgctgttgaattagttagtccacacttgttgccattttcctcatttcttgtttcagccattgtatgatatagttggaacttggaacgagaaaaacatccaaaggctatgcctacataaattgtcaactccctttttgaccgtttttgcaaaaaaaaaaaaaaaaaaaa

SEQ ID NO: 3412 - protein, 454 aa, Panicum virgatum
  misc_feature: Ceres CLONE 1791206
  misc_feature (1)..(375): Pfam Name: Aminotran_5 Pfam Description: Aminotransferase class-V
  misc_feature (32)..(452): SWISSPROT Homolog: EC 2.8.1.7 Cysteine desulfurase 2, chloroplast precursor
MAAAASFRCCFPGSAIGGGFIRPSSSRRGRHAAAVVAPPPPASLGNRTRVDFPILHQEFDGAKLVYFDNGATSQKPYSVMKTLDEYYRSYNSNVHRGIHALSAKATDAYEGARTKVANFVNAADSREIVFTRNATEAINLVAYSWGLSNIKQGDEILLTVAEHHSAIVPWQFVSQKTGATLKYVGLTKEEVPDIEQLKGLLSNKTKIVVVHHVSNVLGSMLPIEEIVTWSKGVGAKVLVDACQSVPHMPVDVQKLGADFLVASSHKMCGPTGVGFMHGTFEILSSMEPFLGGGEMIADVFNDKSTYAEPPSRFEAGTPAIGEAIGLGAAIDYLSCIGMDQIHEYEKELATYLYESLISVPNVRVYGPAPSQTDHRAPLCSFNVENVHPTDIAEILDLQHGVAIRSGHHCAQILHRTLGINASARASLHFYNTKEEMDAFIDALKDTIHFLTSQH

SEQ ID NO: 3413 - DNA, 1151 bp, Panicum virgatum
  misc_feature: Ceres CLONE 1791210
  misc_feature: Encodes the peptide sequence at SEQ ID NO. 3414
agccaaagctctctcctttcttccgtgtctgctgcttcttcctcttccccctatccgtctccgatagcgagagcaagttgttgcggcgcactgaacccctgcagcctgcagcaggaggagaagaagctccttcgccgccccctctccgccccgctgggcttccctgtcccgaggttctccagcagaacccaatttccctgctcaagcttaacatagcataacaagatagatgggttccgaggggccttctcccgtcaccgttcatgtgaccggattcaagaggttccatggagtcgcagacaacccaaccgagaaaatcgtgcgcaatctccagtcattcgtggagaagagagggctgcccaagggacttgtgcttggaagctgcactgtccttgaggcggccgggcagggcgcactaggtccattgtatgaattgttggagtcaactgtccatggccgggaatatggatcactgaatcaggagcaagtaattctgctccattttggagccaacagtggttcacttaggtttgctcttgagaatcaagctgttaatgaagctactttccgttgccctgatgagctaggatggaaaccacagagggttcctatcatgtcatcggatggaagcatcttgcatgcaagacagactacattgccagtgaaggaaataagcaaatctctccaacaaatgggatacgatgtgatgccttcagatgacgctggtcgatttgtgtgcaactatgtctattaccactctcttaggtttgcggagaatcatggtatcaggtcactcttcgttcatttccccctcttcttggcaattgatgaggaagttcagatgcaatttgttgcttcccttcttgaagtcctcgcttccttaaaattacagtaatctaattgtccactcttcccaatttacaagtggtgggaataagaatggtcaatcattcatggcattatgtgtgctccaaaatgtgtataaaaaaactctcttagaaagcatgtccatgtggtcctgatgtccaaatatccaaatgggtcatgtgtgcatgttctcagagcttatgtttcactgtctgatgctattcagaacttgtgtatttcctcattatgaacaacatttttctgaaaaaaaaaaaaaaaaaaaa

SEQ ID NO: 3414 - protein, 221 aa, Panicum virgatum
  misc_feature: Ceres CLONE 1791210
  misc_feature (1)..(207): Pfam Name: Peptidase_C15 Pfam Description: Pyroglutamyl peptidase
MGSEGPSPVTVHVTGFKRFHGVADNPTEKIVRNLQSFVEKRGLPKGLVLGSCTVLEAAGQGALGPLYELLESTVHGREYGSLNQEQVILLHFGANSGSLRFALENQAVNEATFRCPDELGWKPQRVPIMSSDGSILHARQTTLPVKEISKSLQQMGYDVMPSDDAGRFVCNYVYYHSLRFAENHGIRSLFVHFPLFLAIDEEVQMQFVASLLEVLASLKLQ

SEQ ID NO: 3415 - DNA, 1733 bp, Panicum virgatum
  misc_feature: Ceres CLONE 1791217
  misc_feature: Encodes the peptide sequence at SEQ ID NO. 3416
cagcgagtcaccaccatggcggggaagcagttcccctccctggcgcacgcgcgccccgcctccgcctcctcccgccggctcctcgccgccgcgggcgccctcgtcctcctctccgccgtctacttcctcctcctctccccctcctcgccccgccccgccgacgccgtcctcgcgagccatacccccaccacctcctccttcctcgcctccctcgaaagcttcctcgccgccccgcacccttccgactccgcggccgctcccggcgacctcgacgccgcgatccgtgcccaggaggaggcccggctcctcggagaccccgcgtggcccgcgcccgccgcggggccgctcagggtttacgtgtacgagatgccgagcaagttcacctacgatctgctgaggcgcttcagggactcgtaccgcaagacggaaaacctcacgtccaatgggagccccgtgcaccggctcattgagcagcattctattgactactggctgtgggcggatctcatggcgcctgaatcacaaagacttttgaagagtgtcgtcagggttcagcggcaagaagaagcagacattttctatgtgccattcttcacaacaatcagttacttcttgctggagaaacaagaatgcaaggcactttatagggaagctttaaagtgggtgactgatcagcctgcttggcaacgttcagaaggtagagatcatgtaattcctgttcatcacccatggtcatttaaatcagtccggagatttatcaagaagacaatatggcttctacctgatatggactcaactggcaactggtataaaccaggacaggtatatctggaaaaggatgtcatccttccatatgttccaaatgttgatcattgtgattctaagtgtgtatcagaaactcagtccaaaagaagtatattgctgttctttcgaggaagactgaagagaaatgctggagggaagatccgcagtaagcttgtggaggaattaaaaagtgcagaagacatagttatagaagaaggctctgctggagctcagggaaaagctgcagctcaggatggcatgcgcaagtctctcttttgcctgagtccagccggagataccccatcttctgctcgtctgtttgatgcaattgttagcggatgtatcccagttataataagtgatgaactagagcttccttttgaaggaatacttgactatagggagatagcattgtttgtttcatcaagtgatgctttgcaacctggttggcttgtgaagtacctaagaagaatggatgccaaaaggataagagaaatgcaatctaatcttgtgaagttttccaaacattttttgtattcaagccctgctcggtctcttggaccagaagaccttacatggagaatgattgccggtaagctgttaaacatcaagttgcacatccgacgctcgcaacgtgtggtcagagagtcgaggagcatatgtacatgtgaatgcagagttgggaacagcacgaggatgctttgaaccaatctttttcctttgtgtttacaccattttaaaacctctgtagcatagccaagatttagttgccaatagtgcgagctttgagttaggattctttttttttttggccgatgtatgtaaaccaaatagttttgtaacagaacttggaactggggaaaagttgtgacactacaatttgtggaatgtgaaatcctatcacggctgaaaaaaaaaaaaaaaaaaaa

SEQ ID NO: 3416 - protein, 497 aa, Panicum virgatum
  misc_feature: Ceres CLONE 1791217
  misc_feature: Great-hit functional homolog of the protein sequence encoded by LOCUS At5g16890
  misc_feature: Useful for making plants with altered cell wall content and/or composition
MAGKQFPSLAHARPASASSRRLLAAAGALVLLSAVYFLLLSPSSPRPADAVLASHTPTTSSFLASLESFLAAPHPSDSAAAPGDLDAAIRAQEEARLLGDPAWPAPAAGPLRVYVYEMPSKFTYDLLRRFRDSYRKTENLTSNGSPVHRLIEQHSIDYWLWADLMAPESQRLLKSVVRVQRQEEADIFYVPFFTTISYFLLEKQECKALYREALKWVTDQPAWQRSEGRDHVIPVHHPWSFKSVRRFIKKTIWLLPDMDSTGNWYKPGQVYLEKDVILPYVPNVDHCDSKCVSETQSKRSILLFFRGRLKRNAGGKIRSKLVEELKSAEDIVIEEGSAGAQGKAAAQDGMRKSLFCLSPAGDTPSSARLFDAIVSGCIPVIISDELELPFEGILDYREIALFVSSSDALQPGWLVKYLRRMDAKRIREMQSNLVKFSKHFLYSSPARSLGPEDLTWRMIAGKLLNIKLHIRRSQRVVRESRSICTCECRVGNSTRML

SEQ ID NO: 3417 - DNA, 2180 bp, Panicum virgatum
  misc_feature: Ceres CLONE 1791220
  misc_feature: Encodes the peptide sequence at SEQ ID NO. 3418
ccctcccccctccgccctctctctctctctctctctcccctccgtcgattcccctctcccccgccccgcaatctcacctcccgtgaagccccccacaaccctagcggaacccgctcctaccccgagagctcgcggcgctggggagcggcctctgcgtcgggcgtcagccgccgccgagcggtgccagatccggggccccgcgccgttcggtcgggggttcttctccggcgacggcgcggtcgctggatgcaggtcgggcggatcggggcccggcgttcgcgtgactcgagttaggcgacgtggggttctgatgtttgattcacatgaatgagctcagagcatctgattgataaaactatcagcatattaattccctttctttaagaaatatgggagctaattgctgtgttgctgcaaaggagaggacacagccatgcattactccaatagaagtatcagcatacaggaatgtaaggcactcaccatcatggagctttcgatgggacaatcgcacacacatagaagacataatggaaatccctactctgttctccaaccatagcagtggaagcattcggcctgaaaccaagagtggttccattgcaccaactgaaggcttctctaatggaaatagccttggaactagcccttctgatgtgtttcgcagaacaaagtggcacaaatctgataagaaaatggaagctcctaaggctactaaggctgatcctcatgctgatcgctccatagcaagtaattcgttccctgaggtgaagctttccaggaaatcattggacatggtaagtgttgcttcagatttgaagacatcagcatcagttccttcaacaccacccttagtatccagagcagatccttcatcctccaggggtcattcgcaatcaacagattcagattcgatgaagaaaggctggcgttcaccaggatatcaattatacaggcagatctcggatagcaaaattccatctctcagatctctcaacgaaatcagctctcctgaaggaagaccatcctcttccatgctctctgtctgtagcaatgacctgtcagcagcaggatctcatggtgagtcatctgatggttggtcaatgcgcacgttttctgaaatggttgcgacgtcccaaagagagaggtggtcacttgacagtgagctcttaggatccatttccagtaaaatgacaagatcaaatgcttcaaattccacaagccttcctccagaccaagaggtgtgcaagctgtgtttgaaattgttaaaggaaagatcggcttggaatgctcaggagctggctgttgttgctgtgttgttttgtggccatgtttaccatgctgactgtctcgatagcataactacagaagctgaaaaatatgatcctccatgccctgtatgcacgcacggggagaaatgttcggtgaagctatttgggaagctggaatcaaagatcaagaataagataccaaaagatgtggtagtcgatattgatctagatggaaacattaagcaccagaagaaaggcagaagagagcccaggttaggcacaagttcaagcatgaaggtcccatttagtcgtccatttttgaggaggcatttctccattggctctcgaccaccacggtcagtctcagagactgattcaacaagaaagaggggattctgggcaaagcactggagagagtagcatagcttgcaattgtcattgtcataaggaaggatctttaagaggaggtgaactcccctagcatgcaattgagtcagaactggcccaagggctattgagcaactaacatatttggaggtttctcccagccatcattttggatactggtgtgccgggcatgctagcgcaggtcccaggaattcaggatagtagaataacaaggtttcttataccatgcgaaacagggttgttgtaggccctggttgcagattagtaatagtagcaggtaatctaacagaaaagggtgtggccttccaggatgtaaggcccaatgcagggttgcaagattacataacccagcatgctagattatttattgtactcagcagttgtttttgtatgattggctatggcacctattgttgtttgttcgtgtacgtttgttggtttgaaagcttcatagagaattcaaatgagataatcgctctcgaaaaaaaaaaaaaaaaaaaa

SEQ ID NO: 3418 - protein, 433 aa, Panicum virgatum
  misc_feature: Ceres CLONE 1791220
  misc_feature (1)..(53): Pfam Name: zf-C3HC4 Pfam Description: Zinc finger, C3HC4 type (RING finger)
MGANCCVAAKERTQPCITPIEVSAYRNVRHSPSWSFRWDNRTHIEDIMEIPTLFSNHSSGSIRPETKSGSIAPTEGFSNGNSLGTSPSDVFRRTKWHKSDKKMEAPKATKADPHADRSIASNSFPEVKLSRKSLDMVSVASDLKTSASVPSTPPLVSRADPSSSRGHSQSTDSDSMKKGWRSPGYQLYRQISDSKIPSLRSLNEISSPEGRPSSSMLSVCSNDLSAAGSHGESSDGWSMRTFSEMVATSQRERWSLDSELLGSISSKMTRSNASNSTSLPPDQEVCKLCLKLLKERSAWNAQELAVVAVLFCGHVYHADCLDSITTEAEKYDPPCPVCTHGEKCSVKLFGKLESKIKNKIPKDVVVDIDLDGNIKHQKKGRREPRLGTSSSMKVPFSRPFLRRHFSIGSRPPRSVSETDSTRKRGFWAKHWRE

SEQ ID NO: 3419 - DNA, 1786 bp, Panicum virgatum
  misc_feature: Ceres CLONE 1791241
  misc_feature: Encodes the peptide sequence at SEQ ID NO. 3420
aaccaaacaaagcccaaacatcgtcgcgtttcgtatcgtgtggtgcctgccgctcttctcgtcttccctcttactcttcctccacctactgctccgtcttgatcggggagctcgccggatccgcgagggggaagttcgcgggggcctcgagcgcggtgatgggcagcttgggaggtaacgatggcgccggggccggcggcaaggtcgggcttccggcgctggacgtggcgctcgcgttccctcaggccacgccggcgtcgctcttcccgcccgccgtgtcggactactaccagtttgatgatttgctgactgatgaagagaaggcactcaggaagaaggtccgaggcattatggaaaaggaaattgcgcccattatgactgaatactgggagaaggcagaattcccatttcatgccattcccaaccttgcaactcttggcttagctggtggtacaacaaaggggtatgggtgcccaggactgtcacttacagctagtgctgtttgcatagcagaagttgcacgtgtcgatgcgagctgctccacatttattttagtacactcctctttggctatgtccacgattgccctttgtggatccgaggctcaaaagcagaaatacttgccatcactttcccagttcaagactgttggttgttgggcattgacagagccagattatggaagtgatgccagctccttaaggacggcagcaaccaaggtacctggtggttggcatttggatggccaaaagcgttggataggtaacagcacttttgcagatgtgctcatcattttagctagaaatgcagatacaaaccaactaaacggatttattgtaaagaaaggagctccgggtctaaaagcgacaaaaattgaaaacaaaattggactcagaatggttcaaaatggagacataattcttaataaagtatttgtccctgagcaagacagattaacaggtattaattcatttcaggatataaacaaggttctcgctatgtctcgcattatggtagcctggcaaccgataggcatatcaatgggagtttttgacatgtgccatcggtatttgaaagaaaggaaacaatttggagccccactggcagcttttcagctcaaccaagagaagcttgtacgtatgcttggcaacattcaggccatgcttctcattggctggcgactatgcaagctgtacgagtcaggcaaaatgacaccaggccatgctagtttaggcaaggcatggacgtccaggaaggcaagggaggtagtttctcttggccgagagctattgggcggcaatggcattttggccgattttctggttgccaaggcattctgtgatttggagccgattttttcatacgagggcacgtatgacattaacagcctggtgacgggcagagagatcaccgggatcgctagcttcaaacctgctgtgttaacaaaatcacgcttgtgaaattctccatgttttctcttacagaggaagccaccgtgaacacaatagatgcccaccttgtataaagtctcatgactgggaaaaggagccacggaagattatattaattgcactgtcagtttttctgatggtgcccgtggtcattttaatttcgtcttgcaaattttcctagctcgaaataatgccatctgttcctacatagatgccactgctacatatatatggctggtagaaaatatgtcattatggattgagttcctgatgtaacacacatttgtttttaagaatcttcatcctggtggttctaaaaaaaaaaaaaaaaaaaa

SEQ ID NO: 3420 - protein, 433 aa, Panicum virgatum
  misc_feature: Ceres CLONE 1791241
  misc_feature (1)..(53): Pfam Name: Acyl-CoA_dh_M Pfam Description: Acyl-CoA dehydrogenase, middle domain
  misc_feature (1)..(141): Pfam Name: Acyl-CoA_dh_1 Pfam Description: Acyl-CoA dehydrogenase, C-terminal domain
  misc_feature (18)..(433): SWISSPROT Homolog: EC 1.3.3.6 Acyl-coenzyme A oxidase 4, peroxisomal
MGSLGGNDGAGAGGKVGLPALDVALAFPQATPASLFPPAVSDYYQFDDLLTDEEKALRKKVRGIMEKEIAPIMTEYWEKAEFPFHAIPNLATLGLAGGTTKGYGCPGLSLTASAVCIAEVARVDASCSTFILVHSSLAMSTIALCGSEAQKQKYLPSLSQFKTVGCWALTEPDYGSDASSLRTAATKVPGGWHLDGQKRWIGNSTFADVLIILARNADTNQLNGFIVKKGAPGLKATKIENKIGLRMVQNGDIILNKVFVPEQDRLTGINSFQDINKVLAMSRIMVAWQPIGISMGVFDMCHRYLKERKQFGAPLAAFQLNQEKLVRMLGNIQAMLLIGWRLCKLYESGKMTPGHASLGKAWTSRKAREVVSLGRELLGGNGILADFLVAKAFCDLEPIFSYEGTYDINSLVTGREITGIASFKPAVLTKSRL

SEQ ID NO: 3421 - DNA, 1815 bp, Panicum virgatum
  misc_feature: Ceres CLONE 1791249
  misc_feature: Encodes the peptide sequence at SEQ ID NO. 3422
aacacgagaacgagcacgctgaacgggggaacgcttcacgccccgccgccacctccccctcctcggctcctcccgacctccccctcccccgctcgcctcgctccaccgcttccgcgcccccgaaaggcaaaacccccgcccggtcccctcctccgcctccgcctccgcctcggtcaaaccctagcagacgtgcgcgcagacaagccaccgcacccattccccaatctcgctatggcggcgctctccgtgcccctccgcgccgcggccgccggatcccgcgccgccgtcgaccccatcaaggtctcacgtgtgaggagcaccggctcagcacacttcggctgcagcttcccctccatcaaggcctcctcgtcatttgcgaggaacatcgagccactgagggcgattgctacagaggcaccccctgccgtcccacaatattcgagtggggagaagacgaagattggcatcaacgggtttggacggattggcaggttggtcctgcgaattgcaaccagcagagatgatattgaagttgtggctgtgaacgatcctttcattgatgctaagtacatggtctatatgttcaagtatgactccactcacggtccatttaaaggttctattcatgttgtggatgattcgaccctggagatcaatgggaagaagatcacaattacaagcaaaagagatcctgcagagattccgtggggtaactatggagcagaatatgttgttgaatcttctggtgtgtttacgacaactgagaaagcatcagcacacttgaagggtggtgccaagaaagtggtgatatctgcaccatcaacagatgctcccatgtttgttgttggagttaatgagaacagctatgacccaaagatgaatgttgtttctaatgcaagttgcaccaccaactgccttgctccacttgccaaggttgtccatgaggaatttggcattgtggagggcctcatgacaactgttcatgccacaacagccacccagaagactgttgacggtccttcgatgaaggattggagaggaggacgtggtgctggccaaaacataattcctagctccactggtgcagcaaaggctgttggaaaagtcttacctgagctgaacggaaagctcactggcatggccttccgagttccagcaccaaatgtctctgtggtggatttgacatgccggattgagaaaagcgcctcctatgatgatgtgaaagcagccatcaaggcggcatcagagggtgcgctcaaaggtattctaggctacacagatgaggacgttgtttccaatgactttgttggtgattccaggtcaagcatctttgatgccaaggctggtattggactgagctcatctttcatgaagcttgtgtcttggtacgacaacgagtggggctacagcaaccgggttctggacctgatcgcgcacatggctcttgtcaacaccaagcactgatgtgctgggatccttgcccattcccccagtagcctaggaaaggctgcaattttgacggccattttctttctagctgttgtttcgaataagatggtgatgtggagcacttcgaactgagaagaaatggactcagatccatggcttgtatgttagttgtagaaggggtaaaacttgctcgtagtgaccaggcatctatctacggagctgttgagtggattatatggttcgtcgacttgattcattacttgtgatgtgtgccctctgtgtaaggtggtataatttggcagtccttggttggagccaaaattgcaatgagcaataatcattcaccaaaaaaaaaaaaaaaaaaaa

SEQ ID NO: 3422 - protein, 410 aa, Panicum virgatum
  misc_feature: Ceres CLONE 1791249
  misc_feature (1)..(150): Pfam Name: Gp_dh_N Pfam Description: Glyceraldehyde 3-phosphate dehydrogenase, NAD binding domain
  misc_feature (1)..(158): Pfam Name: Gp_dh_C Pfam Description: Glyceraldehyde 3-phosphate dehydrogenase, C-terminal domain
  misc_feature (70)..(404): SWISSPROT Homolog: EC 1.2.1.12 Glyceraldehyde-3-phosphate dehydrogenase, cytosolic
MAALSVPLRAAAAGSRAAVDPIKVSRVRSTGSAHFGCSFPSIKASSSFARNIEPLRAIATEAPPAVPQYSSGEKTKIGINGFGRIGRLVLRIATSRDDIEVVAVNDPFIDAKYMVYMFKYDSTHGPFKGSIHVVDDSTLEINGKKITITSKRDPAEIPWGNYGAEYVVESSGVFTTTEKASAHLKGGAKKVVISAPSTDAPMFVVGVNENSYDPKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPAPNVSVVDLTCRIEKSASYDDVKAAIKAASEGALKGILGYTDEDVVSNDFVGDSRSSIFDAKAGIGLSSSFMKLVSWYDNEWGYSNRVLDLIAHMALVNTKH

SEQ ID NO: 3423 - DNA, 2352 bp, Panicum virgatum
  misc_feature: Ceres CLONE 1791258
  misc_feature: Encodes the peptide sequence at SEQ ID NO. 3424
accagctccgttcccccgcgcctccgcccacccggatccggaaaaccctaaccctagagctcgcccgggcgccgccatggatcccgacggcgacccggcgttccaccgcagcgaggccatctccgccgtccaggacgtcgaccagtactacggcgacgacgacgacttcgacgacctctacaacgacgtcaacgtcggcgacggtttcctccacgcctcccaccaggcgccgccgcccccgcccccgccggcccagcaggccccgccgccgcagcagaaccagcgccagcagcaacagctgcctccgccgccccagcagcagccgcagcagcatccaccggcccacaccctcccgccgccgccgccacaggccccacccccgcagcagcagcagcaggtacgcatcccaggggtgcccggtcctgctcctggcatacctcccgcccagcccaacctcccgccgccacctcagcctccggccgcgcccccgccgccgctgcctcagcaccaccagattcagcaaggcgacgggatgaaccgccccggagggaacttcggcggtggtcccatcgtggtcgggaacggtggccccgctggcgggggtgacggccctggcggcacgacgctgttcgtcggggagctccactggtggacgacggacgcagatctggagtccgagctcagcaagtatgggccggtgaaggaggtgaggttctttgatgagaaggccagcggcaagtccaagggctattgccaggccaacttctacgaccctggtgcagccgctgcatgcaaggagggcatgaacgggcacctgtttaatggccgtccatgtgttgtggcctttgccacaccgaacactgtgcgacggatgggcgaggcacaggtgaagaaccagcaggccatggctgcacagacgtcctctatgcagccgaagggtgggcgaggcggtggtggttccgcagggccacaggtaggtggtaattatggtggtggccgtggaggagctgctggacctggtgctggtggtggagcaggtggaggcggtgggaattggggaagaggcggcggaggcatgggaaatagaggtcctgttggtaatatgaggaacagaatggggcctggtggtggccgcgggatcatgggcaatggaggaatggttgctccgccaccacctatgatgccaccgggtggaatgctggggcagggtttcgatcctactggctatggcgctatgggaaggatgggtggtggatttggcggtttccctggtggaccaggagccatgccattccctgggctgatgcagccattcccgccggttgttgctccacatgttaacccggctttctttggccgtggtgggatgggtgctggcggaatgtggcctgatcccaacatgggggcttggggtggggaggaacaatcaagttatggggatgatgcggcatctgatcagcaacatggggaagggggaagccatgggaaggagaggccaccagagagggagtggtctggtgcaccagagaggaggcgtgagagggagagggatgtgcccccagcacaggagtggccagataggaggcatcgggatgagcgtgacatggaccgagagaggaatcgtgactatgacagagagagggaaagagatcgtgacagagagagagatcaagacagagacagagagagggacagagacaggaagagggacaggcatagggatgacagagatcgctatggtgattatcacaggcacagagatcgtgattcagaacgcaacgaggactgggacagggggaggtcatctggaatacgcagcaggtcgagggaggccgaccactccaagcgtaggcggatgacacctcaataatgtagcttggtgagctactaatgtagaggcaacaatgatccagggcagcatcttatttgcacacaggcatggttcagtagcaactagcatcttcttaatcaatctggctatggtgttcatgtgtctccggcgatttgttgtagcaagaatttgagatgaatgcgtggttgggaccctgttcagctgtgcaaaaggcctacttccctggataatagttgctgcctcgtattgtatgcagtgttaaatgtctgagtttcctgaagacgtaatgatctagttgtgtaattcaggactgatgctttgcgttgttgttatcgaagaactgagacaaatatgtctgtagtagccttaggatgatcaaatggtttgtgttatggttgtcctttgcccatctacctctgttggtagtggacaaattataatgactttttgacattcttgttgttcatccttctttgagacaaaaaaaaaaaaaaaaaaaa

SEQ ID NO: 3424 - protein, 597 aa, Panicum virgatum
  misc_feature: Ceres CLONE 1791258
  misc_feature: Great-hit functional homolog of the protein sequence given in SEQ ID NO 9604
  misc_feature: Useful for making plants with altered terpenoid content
MDPDGDPAFHRSEAISAVQDVDQYYGDDDDFDDLYNDVNVGDGFLHASHQAPPPPPPPAQQAPPPQQNQRQQQQLPPPPQQQPQQHPPAHTLPPPPPQAPPPQQQQQVRIPGVPGPAPGIPPAQPNLPPPPQPPAAPPPPLPQHHQIQQGDGMNRPGGNFGGGPIVVGNGGPAGGGDGPGGTTLFVGELHWWTTDADLESELSKYGPVKEVRFFDEKASGKSKGYCQANFYDPGAAAACKEGMNGHLFNGRPCVVAFATPNTVRRMGEAQVKNQQAMAAQTSSMQPKGGRGGGGSAGPQVGGNYGGGRGGAAGPGAGGGAGGGGGNWGRGGGGMGNRGPVGNMRNRMGPGGGRGIMGNGGMVAPPPPMMPPGGMLGQGFDPTGYGAMGRMGGGFGGFPGGPGAMPFPGLMQPFPPVVAPHVNPAFFGRGGMGAGGMWPDPNMGAWGGEEQSSYGDDAASDQQHGEGGSHGKERPPEREWSGAPERRRERERDVPPAQEWPDRRHRDERDMDRERNRDYDRERERDRDRERDQDRDRERDRDRKRDRHRDDRDRYGDYHRHRDRDSERNEDWDRGRSSGIRSRSREADHSKRRRMTPQ

SEQ ID NO: 3425 - DNA, 1440 bp, Panicum virgatum
  misc_feature: Ceres CLONE 1791261
  misc_feature: Encodes the peptide sequence at SEQ ID NO. 3426
aaaaagagttagaatccttcttcctgtccggccggttgtgatggcggcggcggccatggcgacgtcggcgagcacgtccggggagtggctcaagggcgccctgcagaatcttcgggagagtaaggggagcgatctggagctcgacgctgatctcatctcgggcctcgtctccttctgcgagctcgcatctccccccgacgccgccagctacctcgagaactttattggaaaagaagctgctcagcacattattcaggagtacttgcggaggaggggtcacattgttggagctgaaagcttgcaatcatctaaccttcagccttatgttaagccatctgctgatgcgacggctacacaaaaaaagaaacaaatgcgtgcacaaaaggaagcagcgtcttcttctagtcagagttccaagagtcaagcagaaactgcagaatcccaacttgcttccaagacaggttcaaaaaagaaaggggcaaaggccatttccctcgctgaagcagcgaagggttccattgtcttcaagcaggggaaaccttgttcgtgccaagcacggcagcatagccttgttagcaactgcttatcatgtggcaaaattgtgtgtgaacaagagggcgagggaccctgtagtttctgtggtgcgctggtcttgaaggaaggtagtacatatgctggtttaagtgatgttggactacctctttcagaagcagaagctgcagctgaagcatatgcaaagaggcttgttgactatgacaggaacgctgctgcaaggactaaagtttatgacgaccaaagtgactattttgaaatggaaggaaacagttggctctcttcaaaggaaaagtcagtcctacagaagcagcaagaggaagctcaggaagcagctgcaaatcaaaaggggaaagtggttgttacatttgatttggtgggtcgtaaggtgattatgaacaaggatggagccactgagctggaaacggagcacccgatcatgagaccacctgaagagaaggatcagagccaccgcatacagcccaaccccacaatcagagagcaacctgtgtacatcgaaacaggtccagtgaagccaaaaactgaccgagcaaaacagagtaagaaacttgcgaagaatggtctgtgcctggaggtaactggcaggctgcagcacgatgacaaggatctgcagagcattctgagtggcaaggtgaagaatggtgatcacttggcttacagttcctttggtcaggcacgcgaaagggatgacgtcgaatgctcccaagattttgattgacagtatgaatcctagtgatctaaaaaaaatcacgacacagcctgtaaaatcattgagttccccatctaactaaccttttggacccaatttcctgcaaaatgcaaatgcgagtgtttggcacctttgccctttcgcgttactctcagttc

SEQ ID NO: 3426 - protein, 416 aa, Panicum virgatum
  misc_feature: Ceres CLONE 1791261
  misc_feature (1)..(51): Pfam Name: zf-C2HC5 Pfam Description: Putative zinc finger motif, C2HC5-type
MAAAAMATSASTSGEWLKGALQNLRESKGSDLELDADLISGLVSFCELASPPDAASYLENFIGKEAAQHIIQEYLRRRGHIVGAESLQSSNLQPYVKPSADATATQKKKQMRAQKEAASSSSQSSKSQAETAESQLASKTGSKKKGAKAISLAEAAKGSIVFKQGKPCSCQARQHSLVSNCLSCGKIVCEQEGEGPCSFCGALVLKEGSTYAGLSDVGLPLSEAEAAAEAYAKRLVDYDRNAAARTKVYDDQSDYFEMEGNSWLSSKEKSVLQKQQEEAQEAAANQKGKVVVTFDLVGRKVIMNKDGATELETEHPIMRPPEEKDQSHRIQPNPTIREQPVYIETGPVKPKTDRAKQSKKLAKNGLCLEVTGRLQHDDKDLQSILSGKVKNGDHLAYSSFGQARERDDVECSQDFD

SEQ ID NO: 3427 - DNA, 1814 bp, Panicum virgatum
  misc_feature: Ceres CLONE 1791284
  misc_feature: Encodes the peptide sequence at SEQ ID NO. 3428
accaaacccagagcccaagcgcagcagcgaaacacacgggtgggtctccggcggcgaggcgacccacctaccacccccaccttccccttccaaagcgagcagtacaaccgagccgagcgctgccccgccacttcgcaccaacgcgccaccagccagccagcagagagccgctgctccaatggtctccttctcctcctcctccaccccgtccttcaccgtccccaccaaaacctcccccggcaccgcctccgtctcattccccagggcgagtgagtcgcgcaagcgcggggccaggatggcgacggtgagggcggaggcggtggacgcgaccatcaacccgcgggtgagcgcgctccgcccgtccaagaccatggccatcaccgaccaggccaccgcgctgcgccaggccggcgtgcccgtcatcggcctcgccgccggggagcccgacttcgacacgccgaccgtgatcgccgaggctggaatgaatgctatcagggatggtgccacaagatacacgcccaatgctgggactctggagctgaggaaggctatctgcaaaaagcttcaggaggagaatggattatcctacacccctgatcaggtgctagtgagcaatggagccaagcagtgtatcacacaagctgtgcttgccgtatgctcacctggtgatgaagttttgatacctgctccatattgggtcagctaccctgagatggccagactggctggtgcaacgccagttattctccctacaagcatatcagacaattacctgctaaggccagagtcacttgcctcggtgatcaatgaaaattcaaggatcttgattctctgctctccatctaatccaacagggtctgtttatcctaaggagttgcttgaggagattgctgctatagtcaggaagtatcctaggctcctggttttatctgatgagatctatgagcatatcatctatcagcctgctaaacatacaagctttgcttcattgcctggaatgtgggaaagaacattaactgtaaatggcttttctaaggcttttgctatgaccggttggagacttggatatttagctgcccctaaacatttcgtctcagcctgtggaaagatccaaagccagtacacctctggggccagtagtatatcacagaaggcaggtcttgcagctttgaacctgggttatgccggtggcgaagcagtatcaaccatggtcaaagcattccaggagcgtcgtgattaccttgtaagaagctttggggagctgtcaggagtcaagatatcagaacctcagggagccttctatttgtttatcgatttcagctcctactatggttctgaggtggaaggttttggcactatcaaggactctgagtccctctgcatgtttctgctagaaaaggcacaggttgcacttgtgcctggggatgcatttggagatgacaagggtgttcgcatttcatacgctgcagctatgtcaacgctggaaactgcaatggggaagataaaagaagcgatggctctgctcaggccccctgttgccgtttaacgaaacgaacgtgttgcaaggcctctgtggagtgtggaccaagaggcttctgcaatgttctatcatattaaatacattctattgacgtaaaataggatccattttcgtttcttcttggaaaaactgttttggctatcattcgactgtttcgttatctgtatctgaaaacttggaatttatacttgttacagtggaatgaactctatagtgttttttttaacatgcaatggagatgtctcctttattttaaaaaaaaaaaaaaaaaaaa

SEQ ID NO: 3428 - protein, 455 aa, Panicum virgatum
  misc_feature: Ceres CLONE 1791284
  misc_feature: Great-hit functional homolog of the protein sequence encoded by LOCUS At2g22250
  misc_feature (1)..(364): Pfam Name: Aminotran_1_2 Pfam Description: Aminotransferase class I and II
  misc_feature: Useful for making plants with modulated nitrogen use efficiency
MVSFSSSSTPSFTVPTKTSPGTASVSFPRASESRKRGARMATVRAEAVDATINPRVSALRPSKTMAITDQATALRQAGVPVIGLAAGEPDFDTPTVIAEAGMNAIRDGATRYTPNAGTLELRKAICKKLQEENGLSYTPDQVLVSNGAKQCITQAVLAVCSPGDEVLIPAPYWVSYPEMARLAGATPVILPTSISDNYLLRPESLASVINENSRILILCSPSNPTGSVYPKELLEEIAAIVRKYPRLLVLSDEIYEHIIYQPAKHTSFASLPGMWERTLTVNGFSKAFAMTGWRLGYLAAPKHFVSACGKIQSQYTSGASSISQKAGLAALNLGYAGGEAVSTMVKAFQERRDYLVRSFGELSGVKISEPQGAFYLFIDFSSYYGSEVEGFGTIKDSESLCMFLLEKAQVALVPGDAFGDDKGVRISYAAAMSTLETAMGKIKEAMALLRPPVAV

SEQ ID NO: 3429 - DNA, 1718 bp, Panicum virgatum
  misc_feature: Ceres CLONE 1791289
  misc_feature: Encodes the peptide sequence at SEQ ID NO. 3430
aggtgagccacagctagccggtgcgcgcacccaccaccaccgccggtccaccgccgcgtccgcgtgcccctccagatcccccaccgccggcggccaccatgcggagcgaggcggcggcggcggcggcggcggccacggtgacgcgcgtggcgcagcgggtggtggccccgtcggcgcccacgccccgcggcgagctgccgctctcctggctcgaccgctacccgacgcagcgcgcgctcatcgagtccctccacgtcttcaagggccgcgccggcaacgacggcgacgccgaggtgcccgcccgggtcatcgagcgcgcgctggccaccgcgctcgtgagctactaccccatcgctggccggctcgcggtctccgacgagggggacctggtggtggactgcacgggcgagggcgtctggttcgtcgaggccacggcgagctgcaccctcgaggacgtggactacctcgagtacccgctcatggtgcccaaggacgagctcctgccgcaccccacctacccggcctccgaccccctccccgaggactcgctcatcctccttgtccaggtgacgcagttcgcgtgcggcggcttcgtggtggggttccggttcagccacgccgtcgccgacggccccggcgcggcgcagttcatggcggccgtgggcgacgtcgcgcgcgggcacgcggcgccgctgctggcccccgcgtgggcgcgcgaggcgatcccgaacccccccgccggcgcggcggtcggcccgctcccggtcccgacggagctccgcctccagtacctggccatggacatctcggcggagtacatcgagcacctcaaggcccggttcctggagcggacgggccagcggtgcagcgcgttcgaggtggtcatcgccaaggcgtggcagtcccgcacccgcgcggccggcttcgcggcgggctcacccgtgcacgtctgctttgccatgaacgcgcggccggcgctggcggcgctgcgcgggcgggcgctcccgggcgggttctacggcaactgctactacatcatgcgcgtgacggcggacgccggggcggtggcgggcgcggcggtgcacgacgtggtgcggctgatccgcgagggcaaaaggcggctgccgggcgagctggcgcggtggatcgccggcggcggcggcggcggggaggaggggggcgacccgtaccggatcacgtcggactaccggacgctgctggtgtcggactggtcgcggctggggttcgcggaggtggactacgggtggggcagccccgcgcacgtggtcccgctcaccaacctcgactacatcgcgacgtgcatcctggtccggccgccggcgcgcaagcccggcgcgcggctcatcacgcagtgcgtcgccgccgccgccgtcgacgacttccacaaggacatgatgcgcctcgactgatccctatgctcccccctggccctacgctacgacctgttattagtaatcccaagctgcataaattcaattaattcgttcgttggtgagtgggaactctttattatgtatacaaatatcttatgtcctaaaaaaagatcaagcagcgtgtgtgtgcgtgtgcctgtatcacgaagcatttgtttattcttccttcttctacagacggatgaaaactctaccagaaagagtaggtggggagccactgtctgctgtcccctctcgcttaagcaaaaaaaaaaaaaaaaaaaa

SEQ ID NO: 3430 - protein, 443 aa, Panicum virgatum
  misc_feature: Ceres CLONE 1791289
  misc_feature (2)..(432): Pfam Name: Transferase Pfam Description: Transferase family
MRSEAAAAAAAATVTRVAQRVVAPSAPTPRGELPLSWLDRYPTQRALIESLHVFKGRAGNDGDAEVPARVIERALATALVSYYPIAGRLAVSDEGDLVVDCTGEGVWFVEATASCTLEDVDYLEYPLMVPKDELLPHPTYPASDPLPEDSLILLVQVTQFACGGFVVGFRFSHAVADGPGAAQFMAAVGDVARGHAAPLLAPAWAREAIPNPPAGAAVGPLPVPTELRLQYLAMDISAEYIEHLKARFLERTGQRCSAFEVVIAKAWQSRTRAAGFAAGSPVHVCFAMNARPALAALRGRALPGGFYGNCYYIMRVTADAGAVAGAAVHDVVRLIREGKRRLPGELARWIAGGGGGGEEGGDPYRITSDYRTLLVSDWSRLGFAEVDYGWGSPAHVVPLTNLDYIATCILVRPPARKPGARLITQCVAAAAVDDFHKDMMRLD

SEQ ID NO: 3431 - DNA, 1885 bp, Panicum virgatum
  misc_feature: Ceres CLONE 1791325
  misc_feature: Encodes the peptide sequence at SEQ ID NO. 3432
ccccgccccacctacactcccagcccacacccaccccatcttcccactcgtccacagccaaatccgcctcctccccccatccagcgcccgcccacccaccaccgttccagtgagttcgagcgaggtaagctttagatctgagcgagttctcgcgcgtcgcaggtaaagttcgcactcccgacccctcctcttcctccccccttccttttgtttgttctcttggttcttggtttcgtctccatcgagcagacagcgagggacccggggccttttcgatcccgggcttcagatctgctgtttcttcttcggtttggttttgagtagcaagtctaggttgctagtagttcggtagccaagaggggttatttttccacacctcccttgtgccagttcgtgtgcagatctaccaccagaggccacctgtttttactgcggctgctgggttctgcctgatctgttcttggtttgcttgctagagagaaaaaaaacaaaaaaagagtttgtttttgtttcttcagatctgctatagtagtctagatggctgccgctatagatctgtccggggaggagctgatgagagcactcgagccttttatccaggacgcctccgctcctcacgagtccagtctgcttctccagcacccccacccgctgagccccacttcgcctttctccttcccccacgccgcctccgcctacggtagcgggtacccgttcgccgccgcggccgagggggcgggccagctaagccaggcccagatgcagtacatccaagcccgcgtccacctgcaggcgcagtcctccgtcctgggcccacgggcccagcccatgaaggtctcgtcggcggccccggccccagcgcggccgcagaagctgtaccgcggcgtgcggcagcggcactggggcaagtgggtggccgagatccgcctcccgcgcaaccgcacccgcctctggctcggcaccttcgacaccgccgaggaggcggctctcgcctacgaccaggccgcctaccgcctccgcggcgacgcggcgcgcctcaacttccccgacaacgccgcctcccgcggcccgctccacacctccgtcgacgccaagctccagcagctctgccagagcatcgccgcatccaagaagggcgccaagaagtccgctcccgccgccgccacgtcctcctccgcccccaccagcaactgctcctcgccgtcctccgacgacgcgtcctcgtcctgcctcgagtccgccgccgagtcctcatgcacgtccccgtcgccgtccgcctcccccgagtcggcggtgccggagatgcagcagctggacttcagcgaggcgccgtgggacgaggccaccggcttcgctctcaccaagtacccgtcgtacgagatcgactgggactccctcctcgccgccaattaaattaaccaccttcttggctccttactactactgcagcagcagcagctgaggcttaacggccgttgcgcagatggtttttttgacatctcgcgcgggcacactagtggattattagctctaatcccgtttgttttgtgtagatgtttcagtcaggactcgtttttggtgttggtgtcagtgagttgtaaatctctgttacggtccatctggttcccggatggggagaaccagccgatgggagggccggcgtttttgtgtccgtcgcctcccggtggtcggtcgggtggtcagtggctccggccggtcaagtgtccattgctgtactagctctgtttctttggtaggtggtgctgctgctcctgctgttctacgggttgtaagaacagcggagcatgatgtgatattattatttctagtatggtgtaaaatcagctcgcggtgtcgaggacctgaaaaaaaaaaaaaaaaaaaa

SEQ ID NO: 3432 - protein, 291 aa, Panicum virgatum
  misc_feature: Ceres CLONE 1791325
  misc_feature (1)..(65): Pfam Name: AP2 Pfam Description: AP2 domain
  misc_feature: The sequence is a functional homolog of  SEQ ID NO 1290 in the  10/374,780 US patent application
  misc_feature: The sequence is a functional homolog of  SEQ ID NO 1436 in the  10/412,699 US patent application
  misc_feature: Useful for making plants with modulated growth and phenotype characteristics
MAAAIDLSGEELMRALEPFIQDASAPHESSLLLQHPHPLSPTSPFSFPHAASAYGSGYPFAAAAEGAGQLSQAQMQYIQARVHLQAQSSVLGPRAQPMKVSSAAPAPARPQKLYRGVRQRHWGKWVAEIRLPRNRTRLWLGTFDTAEEAALAYDQAAYRLRGDAARLNFPDNAASRGPLHTSVDAKLQQLCQSIAASKKGAKKSAPAAATSSSAPTSNCSSPSSDDASSSCLESAAESSCTSPSPSASPESAVPEMQQLDFSEAPWDEATGFALTKYPSYEIDWDSLLAAN

SEQ ID NO: 3433 - DNA, 1557 bp, Panicum virgatum
  misc_feature: Ceres CLONE 1791326
  misc_feature: Encodes the peptide sequence at SEQ ID NO. 3434
acgggcacactaatgtaaagtagagccaaacgggagcacgaggagaccgaccaaccccaaccagtgcggcggcggcggcggcggccatgatcggcgggcaggcggcggacagccagccgccgtcggcgtcctgctcctcctcgtcctcgtcctcgccgtcgggcccggcggccgggggtggcgcccgcctccaccgcagcaagaggcggcccgacatcctcaacatgctcatgaccgcagcatgtctcactacatcatcatctgatactggaaaaggacaaagtaagttgtcaagcaacaaagtaacacacggatttcacttagtggaaggaagatctggccatgacatggaagactaccatgtagcagagtacagatatgaaaatgatcacgaacttggtctgtttgccatttatgatggccatttgggagatagcgtggccagttatttgaaagctaatctttttaacaacatactgaaagagcctctcttctggtcggaccctcaagaagccattaaaaatgcatacagctctacaaacaaatatattctggaaaattctaaacaactaggaccaggaggttcaacagcagttactgctattgtagtagatggtaaagatttgtggatagcaaatataggtgattcaagagctgttgtctgtgacagaggtactgctaatcagcttactgttgatcatgaaccccatacaactaatgaacgaaaaaggattgaaaagcaaggtggttttgtttctactttccccggtgatgttcctcgcgtaaatggccaacttgccgttgcaagagcttttggtgatcagagcctcaaggcacacttgagctcagaaccggatgttaagcatatacagataagctcgagtactgaatttgtcatacttgccagtgatggattatggaaggtaatgaagaaccaagaagctgttgatctggtgaggtctaccaaggacccacaaacagcagcgaagcgactaacgtcgcaggcattggggaggatgagcaaggacgatatctcatgcatcgtcatccggttccgatgctgagtctcggaccatcaatctcaagagtctggacctgtcacattccaccttatctacatccacggaattgtcccctcctatgcggctataccaggtctgggtacgttgtagctggtgaagtctggatctgtcgcagctcaggaccggagtgggcagattcttgaccaaaggaaaattgttgggttggatgttttcagcctttgtaggctgtttttttttctttcttgtgcatatatgtacacacgttagaagcaaatatatacttgctggccggagattcgaaataattaactgcccaaattaaagatgcaaagacggtacagattatatgtaaggtttgtttagacttctagtggtagtttggtgattgtttttagtgagtcgtgtgtgtttgtgtgtatatgtaaacagcttgggaaaaagtaccgttgccattcacgtcctaatggagccagagcaaatgatatgcttgacttaaaaaaaaaaaaaaaaaaaa

SEQ ID NO: 3434 - protein, 325 aa, Panicum virgatum
  misc_feature: Ceres CLONE 1791326
  misc_feature (1)..(244): Pfam Name: PP2C Pfam Description: Protein phosphatase 2C
MIGGQAADSQPPSASCSSSSSSSPSGPAAGGGARLHRSKRRPDILNMLMTAACLTTSSSDTGKGQSKLSSNKVTHGFHLVEGRSGHDMEDYHVAEYRYENDHELGLFAIYDGHLGDSVASYLKANLFNNILKEPLFWSDPQEAIKNAYSSTNKYILENSKQLGPGGSTAVTAIVVDGKDLWIANIGDSRAVVCDRGTANQLTVDHEPHTTNERKRIEKQGGFVSTFPGDVPRVNGQLAVARAFGDQSLKAHLSSEPDVKHIQISSSTEFVILASDGLWKVMKNQEAVDLVRSTKDPQTAAKRLTSQALGRMSKDDISCIVIRFRC

SEQ ID NO: 3435 - DNA, 2210 bp, Panicum virgatum
  misc_feature: Ceres CLONE 1791341
  misc_feature: Encodes the peptide sequence at SEQ ID NO. 3436
atccacaccagtgtgccaaacccctctaaactcgcgggagcctaatccattcttttccggagcccacgcgcgccttgcattgcatcaccgatcaccccgccgctccaggctccaccgatcgatcgacggaacgccccctctgctgtaacgtgtcccgctcgccgcgcccgcgcgctccgcgttgcgggctcgccgcccacgcgccccgccatttaaatgcgctttagatcgatccatcatcttctcaaactgccctcccctccgattctccggttcccttatcctctcccatggccgccagcctcgcgctccaactgcgcctcgcgccgtcgtcgtcggcgccgctgagcctccaccgccgccggcgcggagccggaatcctcacctgccgcgccacagccacgttccaccaactcgacgccgtcgcggtgagggaggaggaggcaaagttcaagtcctcggccaaggagggatgcaacctgctgccgttgaagcggtgcatcttctccgaccacctgacgccggtgctcgcataccggtgcctcgtcaaggaggacgaccgcgaggcgcccagcttcctcttcgagtccgtcgagcagggctccgagggcaccaatgtggggaggtacagtgtcgtaggggcgcagcccgccatggagatcgtggccaaggccaaccacgtgacggtgatggatcatgagatgaagtcgaggagggagcatttcgtgcctgatccgatgaatatccccaggagcattatggagcagtggaacccacatataaccgacggcctacctgatgcattttctggaggatgggttggattcttctcatatgatacagtgcgttatgttgaaacaaagaagcttccatttagtaaggcaccacatgatgataggaaccttcctgacattcatttaggcctctacaatgatgtcattgtgtttgaccatgttgagaagaaaacacatgttatacattgggtgagggtggactgctataattctgttgatgaagcatatgaagatggaacaaatcgactagaatctctgttatcaagattacattctcttaatatcccaacactttcttctggttctattaaacttaatgttgggcacttcggctcagcattacaaaaatcatcaatgtcatgtgaagaatataagcatgctgttgttcaagcaaaagaacatattctggctggtgatatttttcaagtagtcctaagccagcgttttgagagacggacattcgctgacccctttgagatctaccgtgcattgcgcattgtaaatcctagtccatatacggcctatctacaggcacgaggttgtattcttgtggcatcaagtcctgaaattctcactcgggtgcaaaagaggacaatcatcaatcgaccacttactggaactataagaagagggaaaacgaaagcagaagacaaagttttagaacagctgcttttgagtgatcagaagcagtgtgctgaacatattatgttagtagatctcggtcgaaatgatgtcggaaaggtgtcgaaaccaggttcagtaaaggtggagaaacttatgaatattgaacgatattcacatgtcatgcacattagctcaacagtaactggggagctacgtgatgatcttacctgttgggacgcgcttcgtgcagcgttgcctgttggaacagttagtggcgctcctaaggtgagagcaatggagctgatcgacgagctggaagtgaatatgcgtgggccgtacagtggtggctttggagggatttcgttctgtggtgacatggacattgctcttgctcttcgcactatcgtcttccccaccggatctcggttcgacaccatgtactcatacactgatggaaacccgcgccaggagtgggtggctcatctccaggccggagctgggatagtggctgacagcaaaccagatgacgagcaccaggagtgcctcaacaaggcagctggcgctgcccgtgccattgaccttgccgaatctacatttctagacgagtagcctagtctccgtgtggcacatgtttgtttctaatttctatgtaaatgctgaccgtagcagaaaccttagcttcctggctatgaagctctaggattatgctgttctgaataaaactcttgtgtaataaagttataataaatgttaagtagatgacaatttcaaccaaaaaaaaaaaaaaaaaaa

SEQ ID NO: 3436 - protein, 578 aa, Panicum virgatum
  misc_feature: Ceres CLONE 1791341
  misc_feature (38)..(576): SWISSPROT Homolog: EC 4.1.3.27 Anthranilate synthase component I-1, chloroplast precursor
  misc_feature (7)..(577): SWISSPROT Homolog: EC 4.1.3.27 Anthranilate synthase component I-2, chloroplast precursor
MAASLALQLRLAPSSSAPLSLHRRRRGAGILTCRATATFHQLDAVAVREEEAKFKSSAKEGCNLLPLKRCIFSDHLTPVLAYRCLVKEDDREAPSFLFESVEQGSEGTNVGRYSVVGAQPAMEIVAKANHVTVMDHEMKSRREHFVPDPMNIPRSIMEQWNPHITDGLPDAFSGGWVGFFSYDTVRYVETKKLPFSKAPHDDRNLPDIHLGLYNDVIVFDHVEKKTHVIHWVRVDCYNSVDEAYEDGTNRLESLLSRLHSLNIPTLSSGSIKLNVGHFGSALQKSSMSCEEYKHAVVQAKEHILAGDIFQVVLSQRFERRTFADPFEIYRALRIVNPSPYTAYLQARGCILVASSPEILTRVQKRTIINRPLTGTIRRGKTKAEDKVLEQLLLSDQKQCAEHIMLVDLGRNDVGKVSKPGSVKVEKLMNIERYSHVMHISSTVTGELRDDLTCWDALRAALPVGTVSGAPKVRAMELIDELEVNMRGPYSGGFGGISFCGDMDIALALRTIVFPTGSRFDTMYSYTDGNPRQEWVAHLQAGAGIVADSKPDDEHQECLNKAAGAARAIDLAESTFLDE

SEQ ID NO: 3437 - DNA, 1453 bp, Panicum virgatum
  misc_feature: Ceres CLONE 1791350
  misc_feature: Encodes the peptide sequence at SEQ ID NO. 3438
acttctgttctctctcccccacctcgcccacacccacacgaacccggagccctcgcccgcccaactgaagcctcagatctccgtcccctgcgccgccgcttcgttcgtgtggaggcgagaggagaggaaatggcggcgagcgagggcgtgctcctggggatgggcaaccccctcctcgacatctccgccgtcgtcgacgacgccttcctcacgaagtatgacatcaagctcaacaatgccattctggccgaggagaagcacttgcctatgtatgatgagttggccagcaagagcaatgttgaatatattgccggaggagccacccagaactctatcagggttgcccaatggatgcttcaaactcctggtgcaacgagttacatgggatgcatcggaaaggacaaatttggtgaggagatgaagaagaatgctcaagctgcaggagttactgctcactactatgaggatgagactgctcctacaggcacatgtgctgtatgtgttgttggcggtgaaaggtcattgattgcaaatctgtcggcggcaaactgttacaaatctgagcatctaaagagaccagagaactgggcactagttgagaaggcaaaatacatctacattgctgggtttttccttaccgtgtcgcccgaatctattcagctagttgctgagcatgctgctgcaaacaacaaggtgttcctgatgaacctttctgctcccttcatctgtgagtttttccgtgatgcccaagagaaggttctcccgtatgttgactacatcttcggaaacgaaactgaggcaaagatcttcgccaaagtccgtggatgggagactgagaatattgaggagattgctttgaagatctcccagcttcctctggcttcaggcaagcaaaagaggattgctgtcattactcagggtgctgatccagttgttgttgctgaggatggaaaggtgaaaacattccctgttatcctattgcctaaggagaagcttgttgacaccaacggtgcaggtgacgccttcgttggaggcttcctctctcagttggtccagggcaagagcatcgaagactgcgtgagggccggttgctacgctgccaacgtcattatccagcgctctggctgcacgtaccctgagaagcctgacttcaactagagcaaactcaggcacgccatgagagggatcgttataggcacacttattcttaaccgctgagtggttccgtatgttcaacctgtattcttccgaggcttttcttctgatccggccaatatttttgccgtgatatttgttgcacaactataaacgtcgatgttgtctctgtataaggcaggatttgccagcgtggcctgttgctttgctgatgcttgcaatgcgatcagggtcggtggagtcaaacgatatatacgttgctccgtttcgctgttgttaaaaaaaaaaaaaaaaaaaa

SEQ ID NO: 3438 - protein, 342 aa, Panicum virgatum
  misc_feature: Ceres CLONE 1791350
  misc_feature (3)..(317): Pfam Name: PfkB Pfam Description: pfkB family carbohydrate kinase
  misc_feature (1)..(342): SWISSPROT Homolog: EC 2.7.1.20 Adenosine kinase 1
  misc_feature (1)..(342): SWISSPROT Homolog: EC 2.7.1.20 Adenosine kinase 2
MAASEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPESIQLVAEHAAANNKVFLMNLSAPFICEFFRDAQEKVLPYVDYIFGNETEAKIFAKVRGWETENIEEIALKISQLPLASGKQKRIAVITQGADPVVVAEDGKVKTFPVILLPKEKLVDTNGAGDAFVGGFLSQLVQGKSIEDCVRAGCYAANVIIQRSGCTYPEKPDFN

SEQ ID NO: 3439 - DNA, 2025 bp, Panicum virgatum
  misc_feature: Ceres CLONE 1791369
  misc_feature: Encodes the peptide sequence at SEQ ID NO. 3440
gtgctcgagaaaataaggacaccagcagcacgaaagaggaaaaaggagagcgaaaatccccaatcccctccactccgatccactcgagccctagccccgaatcccccggagcgtcagactgaatccattcgattaccgcatggcaggctccgtctgcatctgctgattcccgggatcgtctccatcgacgcgcttgccgcagccatggagccgcgcatcggcaacaggttccgcgtcggccgcaagctggggagcggctctttcggggagatcttcctcggtaccaacgtgcagaccaacgaggaggtcgcaataaaactggaaaatgtcaagacaaaacatcctcaattgctttacgagtcaaaattatacagaatacttcaaggaggaattggaattccaaatgttaagtggtttggtgttgagggtgattacaatgttttggttatggatttactgggaccaagcctcgaagatcttttcagtttttgtaacaggaagctgtccctcaaaactgttttgatgcttgctgatcaaatgatcaaccgagttgagtttgtccattccaagtcattcttacatagagatatcaagccagacaattttctcatgggcctcggaaaaagggcaaaccaggtttacgttatagattttggacttgcaaagaagtacagagatacatcaacacaccagcacatcccatacagagagaacaagaacttaactggaacagcaagatatacaagtgtgaatacccaccttggaattgaacaaagccggagagatgacatggaatctcttggatatgtactgatgtacttcttgagaggaagccttccttggcagggtctgaaagctgggaacaagaaacaaaagtatgaaaagatcagcgaaagaaaaattgctacttcaactgaggccctctgtcgtggatatcctaccgaatttgcttcttacttccattactgccgctcactacgcttcgaagatgcgccagactatcaatatctgaagagattgttcagagacctttttatccgagaaggctttcagtttgattacgtttttgactggacaatcctaaagtaccagcaggcacagatgaccagtgctcctcctcatgcaattgctccagcggtaggacaaagctctgggatggctcctgtggcaaacaataataggcattcaggcactgaagagggaaggagaagtgggtggtcagacatggacgcaacgcgtcggcaggttccaccaccggctataaatgctggcagcctagccaagcagaagtcccctgttcaacatgagcaatcgacatcgaaagatgctgtgttctccagttcgacttttttgggacgttcaagcggatcgtcaaggcggcctgctgtctctagtagccgagaaccaagcactgaagcggagcaaacgcgtagtcgtactactgacgcaagcccagggacattccagaggtcaggagctccacggtggagcccgcagatgcctgactcctcggatggcaggcgctcgtcatctggcaggcgccactcatctaacctgaagaactacgagtccactatcaggggcatgcagggcctgaatttcgacggtgatgacagggttcactattagcctcgtgtcttgggaccggacagggtgcatcaacggtgcgctgccccccatatgatgccccatttaccaccggctgatgagatggaagtaccgaggggtggctggctaataagaggtttgggtgagtgagcctaagcgtgttgggttgatggctgtttgaaactgtgtcgatggctatgcttagcctccgttgtacagtttggcatttgtttaattgcgcggaaaggcgctgagtcctgtgaacgatggggattattctaagatttgtgcaggttcgcgtttgatgcaatgtgctgctttggaattcaatgtccgcttgggaaagctttgaacattttgggagaatttatcacttttatggcgccggctctggtgcaaaaaaaaaaaaaaaaaaaa

SEQ ID NO: 3440 - protein, 474 aa, Panicum virgatum
  misc_feature: Ceres CLONE 1791369
  misc_feature (1)..(299): SWISSPROT Homolog: EC 2.7.11.1 Casein kinase I isoform epsilon
  misc_feature (1)..(452): SWISSPROT Homolog: EC 2.7.11.1 Casein kinase I isoform delta-like
MEPRIGNRFRVGRKLGSGSFGEIFLGTNVQTNEEVAIKLENVKTKHPQLLYESKLYRILQGGIGIPNVKWFGVEGDYNVLVMDLLGPSLEDLFSFCNRKLSLKTVLMLADQMINRVEFVHSKSFLHRDIKPDNFLMGLGKRANQVYVIDFGLAKKYRDTSTHQHIPYRENKNLTGTARYTSVNTHLGIEQSRRDDMESLGYVLMYFLRGSLPWQGLKAGNKKQKYEKISERKIATSTEALCRGYPTEFASYFHYCRSLRFEDAPDYQYLKRLFRDLFIREGFQFDYVFDWTILKYQQAQMTSAPPHAIAPAVGQSSGMAPVANNNRHSGTEEGRRSGWSDMDATRRQVPPPAINAGSLAKQKSPVQHEQSTSKDAVFSSSTFLGRSSGSSRRPAVSSSREPSTEAEQTRSRTTDASPGTFQRSGAPRWSPQMPDSSDGRRSSSGRRHSSNLKNYESTIRGMQGLNFDGDDRVHY

SEQ ID NO: 3441 - DNA, 1183 bp, Panicum virgatum
  misc_feature: Ceres CLONE 1791381
  misc_feature: Encodes the peptide sequence at SEQ ID NO. 3442
attttgctagggttttacctcgccttcctcggcaccgttgcctgatcgcctccacccgcctactcctcttccggtgcttccgaggcggggagatcggccatgagggacctccacctctcactgaaccagactcagcgggtccgcctcgaggcggcgttccacgagctccagtccctcgcgcccgccgccgcgtccgccgccgccgtcaccgtcgcggacaccatccccgtcaaccaggaggacaacatcctcaaggggcacgggacgtcggaccaggacggggaggtggtggcgacgctatgcggggtggtggagcgggtcaacaagctggtctacgtccgtactctccgggcgagatataagccggaggttggtgatatcattgttggacgtatcattgagattgctcctaagcgctggagattggagataaattttagccaggatgctgtgttgatgctttcttccatgaatttgcctgacggcattcagagaaggagaactgctgttgatgaacttaatatgcggagtatctttgaagaaaatgatgttatctgtgctgaagttcgtggtttccaacatgatggatctctgcacctacaagcaaggagtgaaaagtatggaaagcttgagaggggtcaattgctgacggtacctccgtacttggttaaacgaaggaagcagcatttccatcatctcgcacagtatgatgttgatttgattcttggttgcaacggattcatctgggtaggtcagcatgttgtggtgggtgaaaaaactaaaacgacagaggatcagcagaaatccagtgctgatgcagagaatttcaccccactagaaacgaggaagcatatctgccaacttgccaatgccgtgcgtgtactttcagccctaggattcactttgactgttgagctgataattgagacagcggaagcaagtgtgacatcaaatgttgaggtaaacaacatgctgggggctgaattttatgtccagacggctgagagagaggctaagcgccgagctgatctgctgaggaagaagaatggggggaggtaaaataggtgacgccttgatgatcctggctacctgatttgcagagaacagtacctgacatgtagcagtgtgtaaacatttccatttgaggtctggcatttccatcgaaaaaaaaaaaaaaaaaaaa

SEQ ID NO: 3442 - protein, 319 aa, Panicum virgatum
  misc_feature: Ceres CLONE 1791381
  misc_feature: Great-hit functional homolog of the protein sequence given in SEQ ID NO 9619
  misc_feature: Useful for making plants with altered Lignin content
MRDLHLSLNQTQRVRLEAAFHELQSLAPAAASAAAVTVADTIPVNQEDNILKGHGTSDQDGEVVATLCGVVERVNKLVYVRTLRARYKPEVGDIIVGRIIEIAPKRWRLEINFSQDAVLMLSSMNLPDGIQRRRTAVDELNMRSIFEENDVICAEVRGFQHDGSLHLQARSEKYGKLERGQLLTVPPYLVKRRKQHFHHLAQYDVDLILGCNGFIWVGQHVVVGEKTKTTEDQQKSSADAENFTPLETRKHICQLANAVRVLSALGFTLTVELIIETAEASVTSNVEVNNMLGAEFYVQTAEREAKRRADLLRKKNGGR

SEQ ID NO: 3443 - DNA, 1772 bp, Panicum virgatum
  misc_feature: Ceres CLONE 1791384
  misc_feature: Encodes the peptide sequence at SEQ ID NO. 3444
aaaacctcctccgcctccgcctccgcctcatcctcctgctccgccacttccaagccccgcgggcgccgcattgctcgccgccgccgccgccttggttcctcttgcgcccccttctgtatttggtggtttggtctgggtttggttgcgaggagttgtttgatcggaggaggggaaaatgtgggtggagcgggtggtcggggagcgccggatgcgggagatccagcgcttcgcgcggaacgctaagctcaccgccgtctgcctcctcctcaccatcgtcgtgctccgcggctacgtcggcgccggccgctacggcacgccgcagcaggacctcatcgagctccgccagcacttcgtctcccacccgcaccgggcgctcgccgagcaccacgacgccaggtccaggggctccgccacaaccacctcgtcgtcctcctccggacgcggcgacgacgagcctgacccgccgccgaggacgctcagggacccgccctacacgctgggccccaagatctccgactgggacgagcagcgcgccgcctggcaccgccgccacccggagacgccgcccttcctcaacgacgtcaagccgcgggtgctgctcgtcaccggctcctcccccaagccctgcgagaaccccgtcggtgaccactacctcctcaagtccatcaagaacaagatcgactactgccgcgtccacggcatcgagatcttctacaacatggcgctgctcgacgccgagatggccggattctgggccaagctcccgctcatccgggcgctgctcctggcgcacccggaggtcgagttcctctggtggatggactccgacgccatgttcaccgacatggcattcgagctcccttgggagcgctacgggccgtacaacctcgtcatgcacggctgggacgagatggtctacgacgacaagaattggattgggctcaacacaggcagcttcttgctgcgcaattgccagtggtcgcttgatatgctggatacctgggcgccaatggggccaaagggccctgtccgcattgaggctggcaaggtgctgaccaagtccttgaaggatcggccagtatttgaggctgatgatcagtcggccatggtgtacatcctcgccactcagcgtgagaaatggggtgacaaggtgtaccttgagaatgggtactacctccacggctactggggcatcttggttgataggtatgaggagatgcttgagaattacaagccagggcttggggatcaccggtggccgctcgtcactcactttgtcggttgcaagccttgcggcaaatttggggactaccctgttgagcgttgtctcaaacagatggaccgtgcattcaattttggggataaccagatcttgcagatgtatgggttcacgcacaagtcgcttgcaagcaggagagtgaagaggatcaggaatgagactagtaacccactcgagatgaaggatgagcttgggttgctccaccccgcattcaaggctgtgaagacttccacatgataattagagtaccaattccacttgttattttgtttcttcgttctagatcctgttgggtctgaatctgaagtgttctttttgtagaatctggtgacaatgggagggttgggatcatgggatggatatgttataatgtaatgaaatgttaggataatgatgttatgtttatttgttggcataagttatgtcttacactcctagaaattgagttaatgaatgaactcaagttattggtcaaaaaaaaaaaaaaaaaaaa

SEQ ID NO: 3444 - protein, 446 aa, Panicum virgatum
  misc_feature: Ceres CLONE 1791384
  misc_feature: Great-hit functional homolog of the protein sequence encoded by LOCUS At3g62720
  misc_feature: Great-hit functional homolog of the protein sequence encoded by LOCUS At4g02500
  misc_feature (2)..(245): Pfam Name: Glyco_transf_34 Pfam Description: galactosyl transferase GMA12/MNN10 family
  misc_feature (3)..(446): SWISSPROT Homolog: EC 2.4.2.39 Xyloglucan 6-xylosyltransferase
  misc_feature: Useful for making plants with altered cell wall content and/or composition
MWVERVVGERRMREIQRFARNAKLTAVCLLLTIVVLRGYVGAGRYGTPQQDLIELRQHFVSHPHRALAEHHDARSRGSATTTSSSSSGRGDDEPDPPPRTLRDPPYTLGPKISDWDEQRAAWHRRHPETPPFLNDVKPRVLLVTGSSPKPCENPVGDHYLLKSIKNKIDYCRVHGIEIFYNMALLDAEMAGFWAKLPLIRALLLAHPEVEFLWWMDSDAMFTDMAFELPWERYGPYNLVMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKQMDRAFNFGDNQILQMYGFTHKSLASRRVKRIRNETSNPLEMKDELGLLHPAFKAVKTST

SEQ ID NO: 3445 - DNA, 1768 bp, Panicum virgatum
  misc_feature: Ceres CLONE 1791385
  misc_feature: Encodes the peptide sequence at SEQ ID NO. 3446
aatttcctagctagctagctagcgtcgtaccggggagagagagagagagagagagagagagagagagagagagagagatggcaggcggcggggtatggcggccgttgctcgccggcgcctggctgctgtggcttctcccgtgggcttcggccgtccgccggagcgacttcccggcgtccttcctcttcggcaccgccacttcctcgtaccagatcgaaggtgcttacctcgagggcaacaaaagtttaagcaattgggatgtgctcactcatctaccagggagaatcaaagatggaagcaccggggacatcgcggatgatcattaccatcgtttcgaggtgcgaactatcgacgacgtcgaactgatgtactctctcggcacaaacgcttacaggttctctatatcatgggccagaatccttccaagagggagattcggcgaagtgaacccagaaggcatcaagttctacaacgaactcatcgactcactcctgctcaaaggaatagagccgttcgtcacgctgagccactacgacatgccgcaggagctggaggacaggtacggggcgtggctgagcgccgagatccggcgcgacttcgggcacctcgccgacgtgtgcttcgcggcgttcggcgaccgcgtcaagtactgggtcaccttcaacgagcccaacgtcgtcgcgcgcaagggctatttgctcggcacctacccgcccgagcgctgctcgccgccgtacggctcctgcgcccgcggcgactccggcgccgagccctacctcgccacgcacaacatcgttctgacccacgccaccgccgtcgagatttacaagaggaagtaccagagcaagcagaagggctcgatcggcatcgtcatgtcgaccacctggtacaagccgctgacggactcaccagaggaccggctggcgactgaacgggtgctggccttcgacgttccatggtttcttgatccaatagtctacggcgactaccctccggagatgcggcagctcttgggctcccggctgccgaccttctccccggaggagagaaggaagctgggttacaagctcgacttcatcgggatcaaccactacaccaccctgtacgccagggactgcatgttctcaccaggttgcccattggggcagcagagccagcccgcgctggctgccaccaccggagagaggaacgggatccccatcggacctccgacaccaatgccgacgttctacgttgtccccgaagggatagagaagattgtcacctacgtcatgaagagatacaacaacctgcccatgttcataaccgaaaatggttacgcacaaggcggagatggttacgcccatgtcgatgactggcttgacgaccagggcaggattcagtacctcgacagttacctcacaaaactcgccgaagttatcagggacggagctgaagtccgtggctacttcgtctgggctctcatggacaattttgagtggctgtatgggtacactctacggtttggacttcactacgtggactaccaaacgcaggaaaggaagcccaagtcatcagcgctgtggtacaaaggattcctccaaagtctgcatgaagctcaatagaggactatgccttgtttctaaatcttgaaaagtttgagacccaacgttatgcttgctcttcagtcttcaccaataatttatgaaaccgaagagcttgatcctgtatataccgattgatcatgaataaagcatcccaactttactaaaaaaaaaaaaaaaaaaaa

SEQ ID NO: 3446 - protein, 508 aa, Panicum virgatum
  misc_feature: Ceres CLONE 1791385
  misc_feature: Great-hit functional homolog of the protein sequence encoded by LOCUS At1g61820
  misc_feature (3)..(475): Pfam Name: Glyco_hydro_1 Pfam Description: Glycosyl hydrolase family 1
  misc_feature: Useful for making plants with altered cell wall content and/or composition
MAGGGVWRPLLAGAWLLWLLPWASAVRRSDFPASFLFGTATSSYQIEGAYLEGNKSLSNWDVLTHLPGRIKDGSTGDIADDHYHRFEVRTIDDVELMYSLGTNAYRFSISWARILPRGRFGEVNPEGIKFYNELIDSLLLKGIEPFVTLSHYDMPQELEDRYGAWLSAEIRRDFGHLADVCFAAFGDRVKYWVTFNEPNVVARKGYLLGTYPPERCSPPYGSCARGDSGAEPYLATHNIVLTHATAVEIYKRKYQSKQKGSIGIVMSTTWYKPLTDSPEDRLATERVLAFDVPWFLDPIVYGDYPPEMRQLLGSRLPTFSPEERRKLGYKLDFIGINHYTTLYARDCMFSPGCPLGQQSQPALAATTGERNGIPIGPPTPMPTFYVVPEGIEKIVTYVMKRYNNLPMFITENGYAQGGDGYAHVDDWLDDQGRIQYLDSYLTKLAEVIRDGAEVRGYFVWALMDNFEWLYGYTLRFGLHYVDYQTQERKPKSSALWYKGFLQSLHEAQ

SEQ ID NO: 3447 - DNA, 1804 bp, Panicum virgatum
  misc_feature: Ceres CLONE 1791397
  misc_feature: Encodes the peptide sequence at SEQ ID NO. 3448
gcagtcaatcgttcgagacacgccatacgacacggatagagacgacaacgccgcagcgcgaggacgacgacgaccacctcctctgaggccatggcgcagctgccgtctgggagcgtcgaggcggagctcgtcccgacgctctcctcgctggagccggtctacggcgagggctcccagctcgacgaggcgcggctccgcttcgcgcgcctcggggaccgcttccaggccgtccacggcgcccgcccagcgctcttcgcccgctccccagggagggtgaatctgatcggggagcacatcgactacgagggctactcggtgctgcccatggccatccgccaggacatgatcgtcgcgatccggaaggcagacggcggccaggtgcgggtcgccaatgtcgacgacaagtaccccgtctgcgtctacccggccgaccccgacaaggaaattgacataaaaaaccacaaatgggggcactatttcatgtgtggatacaagggcgtatatgaatattgtagatcaaaagggatagatctgggcaaacctgttgcgcttgatgttgttgttgacggcacagtacctcaaggatctggtctgtcaagctctgcagcatttgtctgttcagcaacaattgctatcatgggggtccttgagaaaaacttcccaaagaaagaagttgctcaattcacgtgtctgtccgagcgccacattggaacacagtctggaggtatggatcaggctatatcaatcatggccaaacctggattcgctgagttgatagactttaacccaatccatgcaactgatgtccaactacctcgaggtggtacatttgttattgcccattgtttggcagagtccaagaaagcagagacagccgcaacaaactacaacaaccgtgttgtggagtgtcgcttaacagcaattgttcttgccatcaaactagggatggatgccaaaaaagctgtctcttctgttacagcgctctcagatgttgaggggctatgtgtttcttttgctgggaatgaaggttcatctgaccctggagtagctgtgaagaaacttctgcttgaggagccatatacagcagaagaaatagagaaaattacaggtgaaagcctgacatctatcttcaagagctcccaaacttccttggatgttataaaagctgcaaagcactacaagctatttcagcgtgctagtcatgtctactcggaagcaaggcgggtttatgccttcagggatactgtctcgtcaaagctcagtgaggaagataagcttaagaaactcggtgatcttatgaacgaaagccattatagctgcagcgtgctatatgaatgcagctgccctgagctggaggagcttgtgaaaatatgtagagaccatggagccctgggagcgcgtctcacgggagctggctggggcggctgtgcagtcgctctagtcaaagaacccatcgtcccgcagttcatcctcaatctaaaggaaatgttctacaaatcaaggatcgaccggggagtgatcaagcaaacggatctggggctgtacgtgttcgcgtccaagccgtcgagcggcgcggccatattcaagttgtagggggccgttccccgttgtacatgcatgaaccaaaagcagcagccagggacgagacgcggaattaaattaaattcttcttgtgtgtagtctagctccagagttgtgttcgtccccggtggacacccgagatataattgtacgttatgtatcgaattatctcagaccgtgcgtataccaagtcgttccagttcaaaaaaaaaaaaaaaaaaaa

SEQ ID NO: 3448 - protein, 500 aa, Panicum virgatum
  misc_feature: Ceres CLONE 1791397
  misc_feature (14)..(500): SWISSPROT Homolog: EC 2.7.1.6 Galactokinase
MAQLPSGSVEAELVPTLSSLEPVYGEGSQLDEARLRFARLGDRFQAVHGARPALFARSPGRVNLIGEHIDYEGYSVLPMAIRQDMIVAIRKADGGQVRVANVDDKYPVCVYPADPDKEIDIKNHKWGHYFMCGYKGVYEYCRSKGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPRGGTFVIAHCLAESKKAETAATNYNNRVVECRLTAIVLAIKLGMDAKKAVSSVTALSDVEGLCVSFAGNEGSSDPGVAVKKLLLEEPYTAEEIEKITGESLTSIFKSSQTSLDVIKAAKHYKLFQRASHVYSEARRVYAFRDTVSSKLSEEDKLKKLGDLMNESHYSCSVLYECSCPELEELVKICRDHGALGARLTGAGWGGCAVALVKEPIVPQFILNLKEMFYKSRIDRGVIKQTDLGLYVFASKPSSGAAIFKL

SEQ ID NO: 3449 - DNA, 1937 bp, Panicum virgatum
  misc_feature: Ceres CLONE 1791430
  misc_feature: Encodes the peptide sequence at SEQ ID NO. 3450
gtcagacttcacctgccgccgccgatgctccggtgggagtcaacggaacacacaagctcagcacgcagcgcagcgcagccatcgcacattcgcaccatggcgcctctccgccaccgccgcctcctgctcgccgtcctcctcctctgcggtctcccccgccccgcccaccccttcaccgagctcgagtccgaccaggtcgcccgcttccaggagtacctccgcatccgcacggcgcacccgtcccccgactacgccggcgccgccgccttcctcctcccctacgccgcgtccctgggcctccgcaccaccacgctccacttcaccccgtgcaagaccaagcccctgctcctcctcacctggccgggctccgacccgtccctcccctcggtgctcctcaactcccacatcgactccgtccccgcggaggccgagcggtggtcgcacccgcccttcgccgcgcaccgcgaccccgccaccggccgcgtctacgcgcgcggcgcgcaggacgacaagtgcctccccgtccagtacctcgaggcgatccggggcctccgggccgcggagttcgcgcccgcccgcaccgtccacatctcgctcgtccccgacgaggagatcggcggcatggacgggttcgagaagttcgcgcagtcggaggagttccgcgccctcaacatcgggttcatgctcgacgaggggcaggcgtcgccgacggatgtgttcagggtcttctacgcggacaggctggtgtggaggctcatcgtgaaggcagcgggggcgcccgggcacgggtcgaggatgttcgacggcgccgccgtggacaatttgatggattgcctggagaccgtgtccgggttcagggaggcgcagttcgggatggtgaaggccggggagaggggtcccggggaggtggtttcagtgaaccctgtgtacatgaaggccggcataccaagccccacgggttttgtgatgaatatgcaaccttcagaagcagaggttggctttgatcttcggcttcccccaaccgcagacattgaacagataaaacgaagagtcaaagaggaatgggcaccagctcataaaaacttgacctatgagctgacacagaaaggaccagtaacggatggggcaggacatcccatatttacagcaaccgatgagtcaaacccatggtggtctgtatttgagcaggctatcacctctgcaggtggaaagctatccaagcctgagatcttatcttcaaccacagattcacggtttgtgaggcagttgggcattcccgcccttgggttttctccgatgagcaatactccgatactacttcacgacaatgatgagtttctggaggataaagtattcctgaggggcatcaaagtgtacgaacatgttattagagcactgagctccttccagggctgattcggaaaaggatacttttgtacatagagtatgcatcgttgagttcccatctcattcagtggaggcaggaggcagagctctgacctccaggtttctcattattgcagtctcaaacataccaaaggaaacacactgaagcaatcaaatctgcctaagatgctgatttgaatgacaatcaagcatattgattcatgcatacacagggtatggagttatgacatgaatgtaacatgataacatagaagccatgtgtggctagatatttctcccatttggaggttccattggttgtacccgtgtgctggaggaaaccggtgttgtggaataagttctctccacttggacatttgaatgagtagagagacaaggcatgcatggctactgtagatggagccctgaaattttgatctttagttgtacgagggtatgaaataaagaggcagatatgcccaaaactgtatctcatgtccaaacatatattgcaaaaaggatatggctgtcaaaaaaaaaaaaaaaaaaaa

SEQ ID NO: 3450 - protein, 463 aa, Panicum virgatum
  misc_feature: Ceres CLONE 1791430
  misc_feature (1)..(335): Pfam Name: Peptidase_M20 Pfam Description: Peptidase family M20/M25/M40
MLRWESTEHTSSARSAAQPSHIRTMAPLRHRRLLLAVLLLCGLPRPAHPFTELESDQVARFQEYLRIRTAHPSPDYAGAAAFLLPYAASLGLRTTTLHFTPCKTKPLLLLTWPGSDPSLPSVLLNSHIDSVPAEAERWSHPPFAAHRDPATGRVYARGAQDDKCLPVQYLEAIRGLRAAEFAPARTVHISLVPDEEIGGMDGFEKFAQSEEFRALNIGFMLDEGQASPTDVFRVFYADRLVWRLIVKAAGAPGHGSRMFDGAAVDNLMDCLETVSGFREAQFGMVKAGERGPGEVVSVNPVYMKAGIPSPTGFVMNMQPSEAEVGFDLRLPPTADIEQIKRRVKEEWAPAHKNLTYELTQKGPVTDGAGHPIFTATDESNPWWSVFEQAITSAGGKLSKPEILSSTTDSRFVRQLGIPALGFSPMSNTPILLHDNDEFLEDKVFLRGIKVYEHVIRALSSFQG

SEQ ID NO: 3451 - DNA, 1819 bp, Panicum virgatum
  misc_feature: Ceres CLONE 1791432
  misc_feature: Encodes the peptide sequence at SEQ ID NO. 3452
attggagcgcgcaaagctggacggcaccaccatttaaagaaggccaggggcgcggcggaggaggagaagagaccaccagctcatcacactccgttcccgcacgtttgcctcctctgcttccgctagctcggcggacgaatcggtggcgtcggctcaggaagtctagtgtggacgtgtctcaaaactaagtatactttcattagaagaaagatctattcagtcaagctttgctaatcatcgtcctagttttggatggcatccatggttacttcaatgagtttatggcacccttgttgtcgagctgatgtgggctgtatcacaatggaactgtaatatttgctccaaaagtttcctcatcttcggagaaaggttcaaggggggttaacaacttataagtgttgttctgaagcttgatgacgtgttcgtgagggttaagtgagagtgaaaagttttcgtctggcatgcagatgtcaacagatcctaaccactttggggtatttccacattcattctgcaaccaacatgtggtttcatttcagacgagttcaattaccagtggatcaggaggagccatgccagtttgtctggacacttccagcgcaatgaatggcaatatggcgatgttgaacactacatcttccacaattgtatccactggttcaccaaacatgattcccgattcctctggccagagcctcaagtatagtgcaccaatggccgtggagtggtcctatgctgagctgcaaatgttgaatgacggcctcatgaagtatgcaaatgaaccgggaatcatgaagtacataaagatagcagccacgttaccagacaagacagtaagagatgttgccatgagatgccaatggatggcagcgagaaaagaagctacaagacgacgaaagcctgaagaacactatcctggaaaaaagataaaagatagaaaggacaaaatggctgagccatcatcatgggttaccaatcctccagttcagactgacatgagagcttctgcctttatgcctcgtaacaccagacacaataacggatttctatctggagactctcaaatcgatcatgaaatgttaaatatattggaagaaaatgctcgacttctcaacgaaatagaagtaaatattttgacatcgcaggctcagaacaacattgatctcttccatcgcacaagaaggaacatcaacggtctactacaaagcatgagccaaattcccggaataatgagcaagatgcccccattgcctgtttcagtggatgaaaggctagctagttacatactcccttgctctcctatggcacaagttcttggcagcagtcatttgaaagaagaaccgagagtatggtagaccattggagacagagcagcggctcaattttcagcaatagtttgatcaaaatatctaaagagccatgtgcttgggtacctgcatggagaagcacagatcgaagaaaggtcgtgcttttctgaaagctatgaagcaacaggatccactgcaccatatggccttcaaaacgctgtccagcttaccttctcaggaagctctatattagtgattgagaatttgagatagggagagttttccgtaaactgcagttttcctcaccctggttgcacatattgattcttttttgggttttctcctggtgatcgatgttaacagaggtgtagcatagatactaaacttatatatgaataattagctggaaaagcttagcctttttgtcagttactacaaggtaacaaccttctgtgtgtatctattataattcatatgcaagcctggctctctaaaaaaaaaaaaaaaaaaaa

SEQ ID NO: 3452 - protein, 297 aa, Panicum virgatum
  misc_feature: Ceres CLONE 1791432
  misc_feature (1)..(50): Pfam Name: Myb_DNA-binding Pfam Description: Myb-like DNA-binding domain
MQMSTDPNHFGVFPHSFCNQHVVSFQTSSITSGSGGAMPVCLDTSSAMNGNMAMLNTTSSTIVSTGSPNMIPDSSGQSLKYSAPMAVEWSYAELQMLNDGLMKYANEPGIMKYIKIAATLPDKTVRDVAMRCQWMAARKEATRRRKPEEHYPGKKIKDRKDKMAEPSSWVTNPPVQTDMRASAFMPRNTRHNNGFLSGDSQIDHEMLNILEENARLLNEIEVNILTSQAQNNIDLFHRTRRNINGLLQSMSQIPGIMSKMPPLPVSVDERLASYILPCSPMAQVLGSSHLKEEPRVW

SEQ ID NO: 3453 - DNA, 1816 bp, Panicum virgatum
  misc_feature: Ceres CLONE 1791445
  misc_feature: Encodes the peptide sequence at SEQ ID NO. 3454
ctgctggagacctggagtgtgaggtgcgtgggctgggcggaccctccaaagccgagcgagcgtgagcgcccagccttgtttccctaaccccctctctctcccctcccgtcttcctcggtctctccgccgcccaccacctcgctccccacctctccctttatacgcctccgcggctccgcctccgccgccatctccccgacctcttcctcgttcacggcattgtccccctcgccaggagacagcggagaggagagagatggcggccgcgtccttcaccgccgccaagttcctggcgccggtggccgcgagatccggcggcgagagggcgcccccgctccccgccggcgcctcgtcctcccccttcgccagggcgctgcgccgcggcggggcgcaccacccgcgcctgcgcaccgctctcgccgtctcctccgacgtgctcgctgggaacaaggccgcgcaggccgcgcccgcgcatccggatgtgacacgggaagaggcactggagttgtacgaggacatggttcttggccgtgtttttgaggacatgtgtgcgcaaatgtactaccgtggcaagatgtttggtttcgtccacctttacaatggccaggaggctgtttccactggctttatcaagcttctaaaccaggctgactgtgttgttagcacatatcgtgatcatgtccatgcgctatccaagggtgtcccagcccgctctgttatggctgagctctttggcaaggccaccggctgctgccgtggacagggtggttccatgcacatgttctctgccccccataacgtccttggaggctttgccttcatcggagagggcatccctgttgccactggtgctgcctttgctgctaagtaccgccatgaggtgctcaaggagtcaggtcccgatgggcttgatgtcacattggctttctttggagatggtacatgtaacaatgggcagttctttgagtgcctgaacatggcacagctttggaagcttcctatcgtgtttgttgtggagaataacctgtgggcaattgggatgtcacaccttagggctacatcagacccaaagatttggaagaaagggccagcatttggaatgcctggggtgcatgttgatggtatggatgtcctgaaggtcagggaggttgctaaggaggcaattgagagggcaaggagaggtgaaggaccaaccctagtggagtgtgaaacctaccggttccgaggtcactctcttgcagaccctgatgagctcaggaagcctgatgagaaaacccactatgctgcaagggatcccattaccgccttgaagaagtacatcattgagcagaacctcggaactgaatctgagttgaagagcattgagaagaagatcgacgatgttgttgaggaggctgttgagtttgccgatgcaagcccacaccctccacggagccaattattggagaatgtgtttgccgaccccaaaggctttggtattggccctgatggaaagtatagatgcgaggatcccaagttcacacaaggcacggctcaagtttgagccttcatggaagatggatctgctctctgtacctcttgttcttcggttctctagttttgttgaacccatgtcatgttaaggatgctgtatgcataaagcagttcattttcattcgtaggcgtatgttcgatattgcggtgtaatttattcgaatgctcaactgatgtcacagcttatgccatgtgttttagctcgacttgttcaggaacagctcattgtccacatatatggggaagtatgtgaaatggtatggaaaaaaaaaaaaaaaaaaaa

SEQ ID NO: 3454 - protein, 428 aa, Panicum virgatum
  misc_feature: Ceres CLONE 1791445
  misc_feature (1)..(305): Pfam Name: E1_dh Pfam Description: Dehydrogenase E1 component
  misc_feature (75)..(402): SWISSPROT Homolog: EC 1.2.4.1 Pyruvate dehydrogenase E1 component subunit alpha
MAAASFTAAKFLAPVAARSGGERAPPLPAGASSSPFARALRRGGAHHPRLRTALAVSSDVLAGNKAAQAAPAHPDVTREEALELYEDMVLGRVFEDMCAQMYYRGKMFGFVHLYNGQEAVSTGFIKLLNQADCVVSTYRDHVHALSKGVPARSVMAELFGKATGCCRGQGGSMHMFSAPHNVLGGFAFIGEGIPVATGAAFAAKYRHEVLKESGPDGLDVTLAFFGDGTCNNGQFFECLNMAQLWKLPIVFVVENNLWAIGMSHLRATSDPKIWKKGPAFGMPGVHVDGMDVLKVREVAKEAIERARRGEGPTLVECETYRFRGHSLADPDELRKPDEKTHYAARDPITALKKYIIEQNLGTESELKSIEKKIDDVVEEAVEFADASPHPPRSQLLENVFADPKGFGIGPDGKYRCEDPKFTQGTAQV

SEQ ID NO: 3455 - DNA, 1478 bp, Panicum virgatum
  misc_feature: Ceres CLONE 1791463
  misc_feature: Encodes the peptide sequence at SEQ ID NO. 3456
ggagccgacagcgctaagagcggccgagagagagaccgagagaggagtggccacccaccaaaatggaggcgcccgcctcgtcgccgtcgccgtcgccggagcagccgctgctccgtgccccgtccccgccgaccaatccccgcgctggagccagctccggcagcccggcctccccttcgccccccgccgcgaggccgagccgcctcgcggcgctcatcgggcgcgcggcggggcgccgcgggccctcgatgctggtgcgcgagacggcggtgctgcagctgcagcagaggcgcgcggactgggcgcactcccgccccgtcgtcgcgctcgacatcgcctggaacgtcgccttcgccgccgccgcggcagccgtgctcgcgtcctccgcccaggagagccccgtcaggccgctccgcctgtggctcgtcgggtacgccgcgcagtgcctggtgcacgtcgcgctcgtctgctctgacacccgccgcgggcaccccaccgcgcgtggctcagcctccgacatcgagtccgcgggcgcggggtcggacagctcggacgccgacggcgaagatgacgaagggacggaagagaggagcagctatacaagtcgttgcgaatctatgaacacgatgatatcgtttctgtggtgggtcattgggttctactggatagtgtcaggcggggaggtgctcgagctcggcgctccacggctgtattggttaaccgttgtgtttctagcctttgatgtgttttttgctgtgctctgcgttgtcgtggcctgcttcattgggattgcattatgttgctgcttgccttgtgttattgctattctctatgctctggctggccaggaaggtgcatcagatgcagatattgctgttcttcccaggtatagatattccgatccaagtgagaacgcagaaaaagggtcagatgagggattgatgatccctatcctgaataatagcggtacatcaagtgagcgtatacttcttcgtgaggatgctgaatgttgtatctgcctctcatcttacgaagatggagcagagttatctgctctcccctgcaaccatcacttccattggacatgtattaccaaatggcttcgaatgcatgctacctgtccactttgcaagtacaatattctcaaaggcagtgacagcacataacggaattatgctgacataacttccgcacctcagagcctgtgtgcatcaacatccaactcataaagcaagcaagccaagcttctcgacgtcttagtgtttctgatctggttgtatgctgatttaagagctgttattttaagtgacaatgatgtgtgctttccttttaggatgtggcagtaaagtgtaaatgaatgaaacctaacttacagtgggctttgctaatatcacctgtaaatatctttcgagttgtgatgcttttttcatatgttttggtaatatattcaatatttacaaaaaaaaaaaaaaaaaaaa

SEQ ID NO: 3456 - protein, 367 aa, Panicum virgatum
  misc_feature: Ceres CLONE 1791463
  misc_feature (1)..(41): Pfam Name: zf-C3HC4 Pfam Description: Zinc finger, C3HC4 type (RING finger)
MEAPASSPSPSPEQPLLRAPSPPTNPRAGASSGSPASPSPPAARPSRLAALIGRAAGRRGPSMLVRETAVLQLQQRRADWAHSRPVVALDIAWNVAFAAAAAAVLASSAQESPVRPLRLWLVGYAAQCLVHVALVCSDTRRGHPTARGSASDIESAGAGSDSSDADGEDDEGTEERSSYTSRCESMNTMISFLWWVIGFYWIVSGGEVLELGAPRLYWLTVVFLAFDVFFAVLCVVVACFIGIALCCCLPCVIAILYALAGQEGASDADIAVLPRYRYSDPSENAEKGSDEGLMIPILNNSGTSSERILLREDAECCICLSSYEDGAELSALPCNHHFHWTCITKWLRMHATCPLCKYNILKGSDST

SEQ ID NO: 3457 - DNA, 2214 bp, Panicum virgatum
  misc_feature: Ceres CLONE 1791482
  misc_feature: Encodes the peptide sequence at SEQ ID NO. 3458
ggacagcccaccacactccactctcccctcccctcccctcccctcccctcccggccccgactcccaccgcccaacaaccgacgggtgccgccgccgctacctgctacgtacgcgcacgtaccaccaacctgcgcgtacccgccgattgatcggacggccagcgtgcgccgctccgccgagccaccgacgtcgtcgtacgcacgggacggcggcggccatccgtcccgggcgccgccggccgggacacgccaacaagttctgcctactgggcacagcagcagcagcagcagcgtcggcagcaacattttagaggcgcggcgatgaggatcacggggagcggcgccgccactgctactgcggcggcggcggaggcggccggcctgtggctccggcccggccggctcggggaggttctcgccgtcgcgctcttcttcgcgtcggcggcgctgtccctggcgggcgccgagtcgccgccgccggcggccgggccggcgtcggcgtcggcgcggcacgactacgaggacgcgctgcgcaagagcctgctctacttcgaggcgcagcggtcggggcggctgccgcacggccagcgcgtggcgtggcgcgaccactccggcctcaccgacggcctcgagcaaggggtggatttggtgggcgggtactacgacgccggcgaccacgtcaagttcggcctgcccatggccttcaccgtcaccatgctctcctggagcctcctcgagtacggcgccgacgtcgccgacgccggcgagctcgcccacgcgctcgagtccatcaagtggggcaccgactacttcatcaaggcgcacacccagcccgacgagctctgggcagaggtgggcgacggcgacacggaccactactgctggcagcggccggaggacatgacgacgtcgcggcaggcgtacaaggtcgaccgcgagcgcccggggtcggacgtcgccggcgagaccgccgccgccatggccgccgcctccatggtgttccgggagcacaacccgcactacgccagcctcctcctgcaccacgccctgcagctgttcgagttcgccgacaagtaccggggcaagtacgacagcagcatcgcggaggtgaagagctactacgcctccgtcagcggctaccacgacgagctcctctgggcggcgctctggctccaccgcgccaccggccgcgccgagttcctcgactacgccgtcgacaacgcccacgccttcggcggcaccggctgggccatcaccgagttcagctgggacgtcaagtacgccggcgtccagatcctcgccgccaggctgctgctgagcggggagcacgcgccgcgccaccgggagacgctggagcggtaccgggccaaggcggagcactacgtgtgcgcgtgcctgggccggaacgctgccggcggcgccgacgccaacgtggagcggagccccggcgggatgctgtacgtgcggcagtggaacaacatgcagtacgtgaccagcgcggcgttcctgctctccgcctactcgggctacctctcgtccgccggggaggccgtggcgtgcgcgggcggcggggcggcgagcgccggcgaggtgttcgctatggcccggtcgcaggtggactacgtgctggggagcaacccgcgcgggatgagctacctggtcgggtacggcgcccggttccccgcccgggtgcaccaccgcgccgcctccatcgtgccgtacaagcacagcaaggagttcatcggctgcgcgcaggggttcgacgactggttcgtccgcaggggcgccaaccccaacgtcgtcgtcggcgccatcgtcggcgggcccgaccgccgcgaccggttcagggaccaccgcgagaactacatgcagacggaggcgtgcacctacaacacggcgcccatggtcggcatgttcgccatgctcaacaggctggcccgggacgaggccgtggcggcggcggcggacccaagtgtaaatagatagtgatacagaggggggatttgtacaattttgcccctattcttttgttcattctttctctagatgtgaagccagatgaagtgaaggcgctcgctcttcacgggaaattatttgtatacgaggaaaaaagagataggcggagggatttggcaaagcaaatgcaaatcccatccccgtaaatataagaggaaaaaagaataatgtcttaggttaaaaaaaaaaaaaaaaaaaa

SEQ ID NO: 3458 - protein, 554 aa, Panicum virgatum
  misc_feature: Ceres CLONE 1791482
  misc_feature: Great-hit functional homolog of the protein sequence given in SEQ ID NO 9633
  misc_feature (1)..(464): Pfam Name: Glyco_hydro_9 Pfam Description: Glycosyl hydrolase family 9
  misc_feature (23)..(543): SWISSPROT Homolog: EC 3.2.1.4 Endoglucanase 16 precursor
  misc_feature (31)..(542): SWISSPROT Homolog: EC 3.2.1.4 Endoglucanase 7 precursor
  misc_feature: Useful for making plants with altered Lignin content
  misc_feature: Useful for making plants with altered cell wall content and/or composition
MRITGSGAATATAAAAEAAGLWLRPGRLGEVLAVALFFASAALSLAGAESPPPAAGPASASARHDYEDALRKSLLYFEAQRSGRLPHGQRVAWRDHSGLTDGLEQGVDLVGGYYDAGDHVKFGLPMAFTVTMLSWSLLEYGADVADAGELAHALESIKWGTDYFIKAHTQPDELWAEVGDGDTDHYCWQRPEDMTTSRQAYKVDRERPGSDVAGETAAAMAAASMVFREHNPHYASLLLHHALQLFEFADKYRGKYDSSIAEVKSYYASVSGYHDELLWAALWLHRATGRAEFLDYAVDNAHAFGGTGWAITEFSWDVKYAGVQILAARLLLSGEHAPRHRETLERYRAKAEHYVCACLGRNAAGGADANVERSPGGMLYVRQWNNMQYVTSAAFLLSAYSGYLSSAGEAVACAGGGAASAGEVFAMARSQVDYVLGSNPRGMSYLVGYGARFPARVHHRAASIVPYKHSKEFIGCAQGFDDWFVRRGANPNVVVGAIVGGPDRRDRFRDHRENYMQTEACTYNTAPMVGMFAMLNRLARDEAVAAAADPSVNR

SEQ ID NO: 3459 - DNA, 1478 bp, Panicum virgatum
  misc_feature: Ceres CLONE 1791493
  misc_feature: Encodes the peptide sequence at SEQ ID NO. 3460
gtctaccagctccgacgagcagccgccagcccccgcccatgagggcacttgcggccgccgcctcgccccctctccgcgccctgtccctcctcctctccccccgcctccctcctccaatcccgcgcccccggttcatcatgaacccttcgccgtcctcctcctctggcggccacaactccagggcccccgccgtcgcttcccagcagccgcgcggcgatggcggcaggaggcgcgggcgcggcggcggatacgggggctaccgcgtcgacgcccttggttcgtcgtcctcttcctctgccggcggctaccactccatggtccccgcttttgattccctgcatttgcggggcggtgccagcgtctggcggggagggcgcggacgcggagacgggagggaccgaatcgacgcccttggttcgtcatcgtcctccccatctgccggctaccactccagggccgacgccttcacttccccgcagcctcgcggcggcggcagcaggaggcgcggcggcggcggcggcgggcggggagggcgtggcgacgcaaacgagagcgaccgcatcggcgctcttggccgcctcctgtcgagggtgctgcgtcacatggcggtggagctgggcctggacatgaggccggacggctacgtgcgggtccgcgaccttctcaggctcaagctgcagtcattcgccaacgtgccactcaggtgccacacggtggacgaaatcagggaggccgtcaggcgggataccaagcagaggtttagtctgttggaggaagatggtgagctattgattcgggcgaaccaggggcacacagtaactactgttacttctgagaatttgctgaagcccattttgtcagctgatgaagtgtcagtctgtgtgcatggaacttaccggagaaaacttcacttgatcttgcaatctggcctaaatcgtatggagaggttacatgtacatttctcaagtggattaccatcagatggagaagtaattagtggtatgcgaccggatgttaacgttttaatacatttggatgtcaggaaggcacttcatgatggaatgaagctctacatttcagacaacaatgtgatcttgactgaaggttttgatggcatcatccctgtgaaatactttgagaaaatcgaaacatggccaggacgagcaccgatactgtttcaaagataaagagaccacagtcgaaactgatgtagtttttacatggcttcttttcacatgctaaaatacatctctcctgttgtatctgtttttttttgcgaggtattgtgttgtatcccttaagacctgtattctgcagcaaatcacatatatggatctgtgtttccctcagttacattagctggtgattgttttgccatgccattttgttatggctcgactctgtaagctgtgccattcagcatctgtaaaatgtcaccatgatacagattcgtgtaccaaaaaaaaaaaaaaaaaaaa

SEQ ID NO: 3460 - protein, 382 aa, Panicum virgatum
  misc_feature: Ceres CLONE 1791493
  misc_feature (2)..(192): Pfam Name: PTS_2-RNA Pfam Description: RNA 2'-phosphotransferase, Tpt1 / KptA family
MRALAAAASPPLRALSLLLSPRLPPPIPRPRFIMNPSPSSSSGGHNSRAPAVASQQPRGDGGRRRGRGGGYGGYRVDALGSSSSSSAGGYHSMVPAFDSLHLRGGASVWRGGRGRGDGRDRIDALGSSSSSPSAGYHSRADAFTSPQPRGGGSRRRGGGGGGRGGRGDANESDRIGALGRLLSRVLRHMAVELGLDMRPDGYVRVRDLLRLKLQSFANVPLRCHTVDEIREAVRRDTKQRFSLLEEDGELLIRANQGHTVTTVTSENLLKPILSADEVSVCVHGTYRRKLHLILQSGLNRMERLHVHFSSGLPSDGEVISGMRPDVNVLIHLDVRKALHDGMKLYISDNNVILTEGFDGIIPVKYFEKIETWPGRAPILFQR

SEQ ID NO: 3461 - DNA, 1532 bp, Panicum virgatum
  misc_feature: Ceres CLONE 1791546
  misc_feature: Encodes the peptide sequence at SEQ ID NO. 3462
gacgaaacgccgcggcgcgccccctcccccccgcgtccactgagattcgcctcgcatcccctccgattccttcccccgctcccgctcccatctcgcggaccccgccgagatcggccgccgtcccgcgggagcccccggctggatctccgcctctcgcagccgccttgatggtcggggagccgacggggcggcggcggcggcggagtaggtagcttgcggcgatgagcaggctcgcgacggggctccaccggctgcggaggtcagcgtcgtcgccgtgggaggtgctgtggtccgcgctcgcgtcatgcggcctcgtgctcttctcgcagctcgccgtggccatggtgccgcggctcttcccctccctctcgctcctcgccatgctccccatcgcgggcctggtgttcatcccggctatcttgctgggtcggctgtggcggaggttcatcggggtggcggcgtccgcgccgctcttcgtgctcttcaacattctcctcctgtggggcgtctacgtcttcgtcatccggagagacacttcttctctgctggacatgttaataaatgcagaatgtgcactgcttctgtggggactttacagaattttgtctggtgatcctggtattgttgcttgtgattcttcatatttagaggaagatggctgcaaggattttgtggaggctatttacccgagtgagaagctcccaatgctctctcgtgtcaggcagtgtaactggtgcaaagcaaatgttaggggctatgaccatcattgccctgcatttggtacttgcataggacagaagaatcatcggctgtttatggcccttttaacaggatttgttgttgctgaatcgacatatacaatgtgctcaacaaaatatattaccagatgcatcaattctggaactctaagatcggagaatcctgtatctctaaacatggtaatcagtacgatgctcttctctatcctccaggtgctctggcagattgtgttcttgatgtggcacatatattgcatctgcttcaacatcaagacagatgagtggataaactggaagaaatatcctgaattccagatgagggaacagcctcaatcagatttggaagtcaaatttgtaaacccgtatgacaaaggcatgctatgtaacattagagaatttctgaagccaaaatgatacgaagccaattttgaagacctgacctgatggaactgaaccatggggaatcagaagtgcatcacgactaagaacaccacccagaattctggaggcctgggttcctagttgctacaatagcatctattgagattcattgttgtgagcttcatttggactctgctgtcttaatttaaggtgcagttagcttctctcttttttttttttttgagaagttgctttctctgggcgtgaaatcgtaggcaagtacacaccttgtagttgtagctgtagaaagttcctataaatattggagttcacatcgcgctccttcaactctgattatgatcttgttgctcccaaaaaaaaaaaaaaaaaaaa

SEQ ID NO: 3462 - protein, 316 aa, Panicum virgatum
  misc_feature: Ceres CLONE 1791546
  misc_feature (20)..(57): Pfam Name: zf-DHHC Pfam Description: DHHC zinc finger domain
MSRLATGLHRLRRSASSPWEVLWSALASCGLVLFSQLAVAMVPRLFPSLSLLAMLPIAGLVFIPAILLGRLWRRFIGVAASAPLFVLFNILLLWGVYVFVIRRDTSSLLDMLINAECALLLWGLYRILSGDPGIVACDSSYLEEDGCKDFVEAIYPSEKLPMLSRVRQCNWCKANVRGYDHHCPAFGTCIGQKNHRLFMALLTGFVVAESTYTMCSTKYITRCINSGTLRSENPVSLNMVISTMLFSILQVLWQIVFLMWHIYCICFNIKTDEWINWKKYPEFQMREQPQSDLEVKFVNPYDKGMLCNIREFLKPK

SEQ ID NO: 3463 - DNA, 1645 bp, Panicum virgatum
  misc_feature: Ceres CLONE 1791571
  misc_feature: Encodes the peptide sequence at SEQ ID NO. 3464
aagccggccatgctgggccttcgcgcttgcggcggcacggcgccggcgtcggtgcccgcgctcgtccgggcgcgcctggcgctgcgcgcctcctccacagcctacgacgccgccaccgtcgccgctgcttgctccgcttcgtccagcctggaaaaactcgccgccgagcgcaaaggtttggcaaaagtagtattaaagaagggcaagacccaaatattcggtgatgggagcccaatggtgtatagtggttccgttgatagaataatcggtcgacctcctccaaaatccggtgatattgttctggtagctgatgggacagagaaatctattggatggggtctctataactctgtgtccatgttttgtgttaggctgatgcagccggaagaagaggcaagaagagatcccacttgtgcacttaatatggaaagactgctcaaagcaaggatttcatctgctgtggatttgcggcgaagtttgggtctcccttcagctaacacaaatgcttatcgccttatcaacagtgaaggagacagattgtctggtctaatagtggatatctttgctgacgttgccgtgattgcttcatctgctgcttgggttgagaaatatagggaagaaatccagtttcttgttagcaaagttaatggcatcaaccatataaagtggaggccatcagcagatattttgaaagaggaaggattggatatatcagaacaaaatgagtatgcttcttcacgctcaactgtgaaggtcatggagaatggcattgtatacatagtctcattagagggtcagaagacaggattttatgcagatcaacgggaaaaccgccattttgtatcattgctctcaaaggaccaaagggtccttgacattttctgctacagtggtggttttgctctacatgcagccaagggtggtgctgataatgtcattggcatcgattcatcgggatcagcactagaccttgccaatgagaatataattctcaatgagttaaatcctggaaggatctcatttgtaaaaggagatgcaactgcattcatgaaaggagctatctcgaaaaatgaactgtgggacttggtaatccttgaccccccaaagctggcacctcgaaagaaggtgctacaaagtgcatccggtatgtatagaagcttgaatgctcttgcgatgcaagtagtgaagccagggggattactcatgacatgttcttgttctggagctatgactcaaagtggcatgttccttaaaaccattcagggtgctgcatcaatggccggcaaaaaggtgacaatcttacgccaagctggggcagcttgtgatcatcccattgaccctgcataccctgagggccagtatctcagcaattacttgctaagagtggcatgaaaaagaaaaaaacggatgtagaagcagcagaagtttatagttgtagcagcctgacaagccttatactgatcacgtctgatttctgaagagcttaagttaatctgtcatagtttagtcatgcaggttagatgcagtcctttatttacgaagaaaaatgcatccattttgtttgatttacataatatccttagaccttaggaacactgtacttgcatgatgggtatttttatcaacatccacaagtagtgactag

SEQ ID NO: 3464 - protein, 460 aa, Panicum virgatum
  misc_feature: Ceres CLONE 1791571
  misc_feature (1)..(55): Pfam Name: Methyltransf_11 Pfam Description: Methyltransferase domain
MLGLRACGGTAPASVPALVRARLALRASSTAYDAATVAAACSASSSLEKLAAERKGLAKVVLKKGKTQIFGDGSPMVYSGSVDRIIGRPPPKSGDIVLVADGTEKSIGWGLYNSVSMFCVRLMQPEEEARRDPTCALNMERLLKARISSAVDLRRSLGLPSANTNAYRLINSEGDRLSGLIVDIFADVAVIASSAAWVEKYREEIQFLVSKVNGINHIKWRPSADILKEEGLDISEQNEYASSRSTVKVMENGIVYIVSLEGQKTGFYADQRENRHFVSLLSKDQRVLDIFCYSGGFALHAAKGGADNVIGIDSSGSALDLANENIILNELNPGRISFVKGDATAFMKGAISKNELWDLVILDPPKLAPRKKVLQSASGMYRSLNALAMQVVKPGGLLMTCSCSGAMTQSGMFLKTIQGAASMAGKKVTILRQAGAACDHPIDPAYPEGQYLSNYLLRVA

SEQ ID NO: 3465 - DNA, 1677 bp, Panicum virgatum
  misc_feature: Ceres CLONE 1791576
  misc_feature: Encodes the peptide sequence at SEQ ID NO. 3466
attactgcgcaatccgaacgcaaccaccgcttcaatccttgttgaattgcgatttgcgagcgagctcgtgccatgatctacgagaacgagagatcgtgaaggaagtaaaggcgggcggcgccgaatccgccgatgaggggaggaggagcagcgatggcgaggctggcggtggccgcgagggccttctcctccgccggcggcggcgtggccatggtgcagggcgcgtcccgggggatcggcctcgagttcgtgcggcagctgctgcggaggagcgaccagggccgcgtcgtcgccacgtgccgcgcgccgggatccgccgccgagctccagaagctcaaggaggagcacgcgccggggcgcgtcaccgtgctgccgctcgacgtcaccgacgagaccaccatagaggccgctgcggcctcgattcaagagacacatggttctcttgacctgctgatcaactccaccggcatcctttctatcccaaacgtgatacaaccagagactacactgagcaaagtccagaagtcgtccctgctgctggcgtatgaagtgaatgcagtcggcccaatcttagtgatcaagcacatgtggccactgctgaagattggtggtcgctccgatactgggagaggattctcattggttgcaaacatgagtgctagagtcagttcgataggagacaatggtctgggaggctggcattcatacagagcttctaaaacggcactgaaccagttgacgaagactgtgtcagtagagtttggcaggaaggacaacatcacctgcatcctgctacatccaggaaccgtggacagtgacctctcacggccctttcagagaaacgtccccaaggataagctcttcacaagagaattctccgtgcagaagctcctctccatcattgacagcgtcaagaaaagcgacaatggcaagttcttcgcatgggatggccaagaaatcccttggtgactcgtgatcactgtttcagccagcagcatacaggtcaacaatgagaacagattttctttttgcaaagtgttgccctgttatggaccgttccacgttatcgctccggatcttccacaagtgcatgcgaccacattcagaagtcagctgttgtagaacaagaagaaccacaagcaaaacatggcgatcggttttccattcactttccggctgcataggaaaagatgtgaatgtttgctgatgagtgatgacgcaaattttgttcaattttatttgagtccttcaattctgggagtttttgtcattcatgatgatgatgatccatcaagctactcttgacatgtgaaggcctcgagagaagtcaatagtattatttggatattactacccacctaatgcgcgtttgacccaaaaggaactggagaagagagaacacgttcgagccacagccaccaacgaagactggtcatactgtgcgcagccttctcagccgccggtgcaatggtcagaatgaaactttgataaataattactctgttaacattctattcgtcgttgtatcttcataaatcataaggatgtgtttttggattcaaatctaatggcaccaactttgtgaactaatactatgtattgataaagtagtaaattgtttgttaaagacttgcattagcgataagccgtgcaagttaaaaaaaaaaaaaaaaaaaa

SEQ ID NO: 3466 - protein, 278 aa, Panicum virgatum
  misc_feature: Ceres CLONE 1791576
  misc_feature (1)..(187): Pfam Name: adh_short Pfam Description: short chain dehydrogenase
MRGGGAAMARLAVAARAFSSAGGGVAMVQGASRGIGLEFVRQLLRRSDQGRVVATCRAPGSAAELQKLKEEHAPGRVTVLPLDVTDETTIEAAAASIQETHGSLDLLINSTGILSIPNVIQPETTLSKVQKSSLLLAYEVNAVGPILVIKHMWPLLKIGGRSDTGRGFSLVANMSARVSSIGDNGLGGWHSYRASKTALNQLTKTVSVEFGRKDNITCILLHPGTVDSDLSRPFQRNVPKDKLFTREFSVQKLLSIIDSVKKSDNGKFFAWDGQEIPW

SEQ ID NO: 3467 - DNA, 1806 bp, Panicum virgatum
  misc_feature: Ceres CLONE 1791577
  misc_feature: Encodes the peptide sequence at SEQ ID NO. 3468
atctcatcagactcctcgcaaagcctccccgccacgcccccctctctcctccccctcccccgccaccccgcaatggccggcctcctccacctccactccacgctgcttccctcggcgtctgcgctccgccgccgcgcgggcgcgccagcgccctcctcgtcccgccgccgatgccgggtcgaggccaagatccgggagatttttatgccggcgctcagctccaccatgaccgagggcaagatcgtctcctggaccgccgccgagggcgaccgcctcgccaagggcgaccccgtggtcgtcgtcgagtccgacaaggcagacatggacgtcgagaccttccacgacggtttcctcgccgccgtcctcgtgcccgccggtgagtccgcgcccgttggctccgccatcgcactcctcgccgagtctgaggaggagatcccggccgcccagtcacaggccgcctccttttcatcctctggagccgccgcctcacctcctccaccgcaagaaaccgccgcccaagaagcttcccctcccacgccaccgcctcctcccccagcaccgatcgcagtctctgctcccgcgccgccctcgccggcagcacaaggcggggcgcgcgtggttgcgtcaccctacgcaaagaagctggcccaggacctcggcgtcgatcttttctctgtcacggggtcaggcccaggtgggcgaattgtggccaaggatgttgaggccgcgcttgctgcacccaagaaggcggcgccagtggctgctgcacggccggatgtgccattgggctccacagtgccattcacgacaatgcaggctgctgtgagcaagaatatggtggagagccttgctgtcccgacattcagagtcgggtacaccatcacgactgatgctcttgatcagctctacaagaaaattaaatcgaagggggtaacaatgtcagcactattggctaaggcaacggcgatggcactagttcagcatcctgtggtgaactccagctgcagggatgggaagagcttcacatacagcagtagcatcaacattgctgtggcagtggccatagatggtgggctgattacgccggtgcttcaggatgctgataaggttgacatttattcgctgtcaaggaaatggaaggagttggtagataaggcgcgagcaaagcagctgcagccccatgagtataactcaggcacatttactctttcaaatcttggcatgtttggagttgatagatttgatgcaatcttgccacctggaactggagcaatcatggctgttggagcatcacaaccaactgttgttggtacaaaagatggtagaattgggatcaagaaccaaatgcaggtcaatgttaccgctgatcatcgagttatttatggagctgatcttgctgcttttctgcaaacgctctccaagattattgaggatcctaaggatcttacgttttagatatacccatggattgtttttccctgaacaatcacaattgggtgtttctcacctgtcagtagatgtgtagaatgtggtctggtcatttggaatagtggatttaagccgtcaccagtgttagcatcaggtaactttctctgctggttaccttctcatcattggcttgttcttcaataaattcttcgttatcttttttttccttaattcaaataggtgtgtaaggatgggtatatttatcattttactggtgctttcacgggtagtccgattttgttgagctcatcaatgtaccataaccttgagatacaaagaatgaaatgtaccttgtaccaaaaaaaaaaaaaaaaaaaa

SEQ ID NO: 3468 - protein, 460 aa, Panicum virgatum
  misc_feature: Ceres CLONE 1791577
  misc_feature: Great-hit functional homolog of the protein sequence given in SEQ ID NO 9186
  misc_feature (1)..(139): Pfam Name: 2-oxoacid_dh Pfam Description: 2- oxoacid dehydrogenases acyltransferase (catalytic domain)
  misc_feature: Useful for making plants with modulated nitrogen use efficiency
MAGLLHLHSTLLPSASALRRRAGAPAPSSSRRRCRVEAKIREIFMPALSSTMTEGKIVSWTAAEGDRLAKGDPVVVVESDKADMDVETFHDGFLAAVLVPAGESAPVGSAIALLAESEEEIPAAQSQAASFSSSGAAASPPPPQETAAQEASPPTPPPPPPAPIAVSAPAPPSPAAQGGARVVASPYAKKLAQDLGVDLFSVTGSGPGGRIVAKDVEAALAAPKKAAPVAAARPDVPLGSTVPFTTMQAAVSKNMVESLAVPTFRVGYTITTDALDQLYKKIKSKGVTMSALLAKATAMALVQHPVVNSSCRDGKSFTYSSSINIAVAVAIDGGLITPVLQDADKVDIYSLSRKWKELVDKARAKQLQPHEYNSGTFTLSNLGMFGVDRFDAILPPGTGAIMAVGASQPTVVGTKDGRIGIKNQMQVNVTADHRVIYGADLAAFLQTLSKIIEDPKDLTF

SEQ ID NO: 3469 - DNA, 1745 bp, Panicum virgatum
  misc_feature: Ceres CLONE 1791587
  misc_feature: Encodes the peptide sequence at SEQ ID NO. 3470
gaatcgcagttaccacttaccactcactcccagctacagtacggcctacgaaaccttcacacccccaaccccgtcgtcctcgtccccgagttccccaaatccacaccccgcaggcgctgcaggatccgggctcctctcggtcggcggccgccgccgcgtcgtccggccccgctcgattgggtcgcgtgtgcgataggaagtatttgtgttgtgtttccaacgtgatagctttcagcggtataaaaaaaaacagtcaagatgggcgcattggatctacaccttgagtctgcttctgctcaacatggacaagccaagctaaatgtggaggaatacaccaagggctctttggagtctggtggaaattacaaaaaagagaagatcaacggttcagatcctgatgattttgagaaatttgagaaaggaataatgcagtatgggtgtcgacactacagaaggagatgctgcatacgagctccttgctgcaatgagatttttgattgccggcactgccacaatgaagttaagaattccattaaagtcgatacactgaggagacatgaacttccacgccaggaagtgcagcaggttatatgctcattatgtggcactgaacaagaggtacgacaagtatgcatcaattgtggagtatgcatggggaagtacttctgtggattgtgcaagctcttcgatgatgatgtttctaaacaacagtatcactgcaatggatgtggaatatgtagaattggagggagggaaaatttcttccactgctcaaaatgcggatgttgttattcaattgtgctgaagaacagtcatgcatgtattgaaggagcaatgcatcatgactgtccaatctgctttgagtacttatttgagtcgacaaatgatgtttctgtcctgccttgcggtcataccattcatgtgaagtgcttgaaagaaatggaggagcactgccagtttgcatgcccactttgctccaagtcagtttgtgacatgtccaaggcatgggagagactcgacatggagctggcgactctgtccaattcttatgatgacaagatggtccgcatattatgcaacgactgcggggcaatatcagaggtgcagttccatttgatcgcgcacaagtgccagaattgcaagtcatacaacacccgccagatctgaagaaagtgattcttacgcggattctgcattcttcaagaagcgtgacgacgcctcttgcgtgagctgctgagctctcgggacgggggtcccatcattgggtgcagcttcaggtcttcagcgaaggcgtaccacttgagattatctatctgtgctgttagctgctgtccttgattgcgcctctttagcctgttagctgttattctaggtgcttccgcctgtttacttcagtcgtctgtggttccggtgtattggttatattcctcgcttcaagattgtgtcctcggaggtcctagctgagataaatgcccaagcttgtagctggaagtcgattcataatgtaggggtctcttttggcaaggatgagagaggtttgtggttgcacggcaaatctatggctctcctagtttttccgtaactttaattctttataagtactagattttgcccttcgtttggattcttggacgaccatgatgctactaaagtggttgtccgaggtttattttagactgtcacatcaaatgttttgatgtgagttagattaaataagttaattataaaaaaaaaaaaaaaaaaaa

SEQ ID NO: 3470 - protein, 302 aa, Panicum virgatum
  misc_feature: Ceres CLONE 1791587
  misc_feature (1)..(43): Pfam Name: zf-C3HC4 Pfam Description: Zinc finger, C3HC4 type (RING finger)
  misc_feature (1)..(84): Pfam Name: zf-CHY Pfam Description: CHY zinc finger
MGALDLHLESASAQHGQAKLNVEEYTKGSLESGGNYKKEKINGSDPDDFEKFEKGIMQYGCRHYRRRCCIRAPCCNEIFDCRHCHNEVKNSIKVDTLRRHELPRQEVQQVICSLCGTEQEVRQVCINCGVCMGKYFCGLCKLFDDDVSKQQYHCNGCGICRIGGRENFFHCSKCGCCYSIVLKNSHACIEGAMHHDCPICFEYLFESTNDVSVLPCGHTIHVKCLKEMEEHCQFACPLCSKSVCDMSKAWERLDMELATLSNSYDDKMVRILCNDCGAISEVQFHLIAHKCQNCKSYNTRQI

SEQ ID NO: 3471 - DNA, 1996 bp, Panicum virgatum
  misc_feature: Ceres CLONE 1791593
  misc_feature: Encodes the peptide sequence at SEQ ID NO. 3472
accctctccaaaccctaaccaagtcagatctccgcctccgccgccgccggcgagagcaccaaatcagatccgccgcgatggcgttccgccgcatcctatccagcgcggtgcgccgccgctcggccatcgccgcggcggcggccgggaacgcgcgcgaggcctccacggccgtcgccgcgggccctggggtcctcgctcccgacgcgcccccgacgcgcgcccccgtgatgccgtacgaccgcatcgcagaggccgtgaacgccaggctccggcggctcgagcacccggacccgcgcttcctccgctacgccaatcccgtaccgacccacgccgaccacacggccatcctcgcggcgccggagacccgcgtcaccacgctgcccaacggcctgcgcgtcgccacggaatcgtccctcgccgcgcgcacagctacggtcggcgtctggatcgacgcgggcagcaggtacgagaacgaggaggcggccggcgtcgcgcatttcgtcgagcacatgctgttcaagggcactggcaagcgcagcgccgcgcagctggagaaggagatcgaggacatgggcggccacctcaatgcctacacgtctcgggagcagacaacctactacgcgaaggtgcttgacaaggacgtatctcgtgcgatggaggtcctcgctgacatcttgcagaactctaatctcgatgaggcccgcattgaacgtgagcgcgaagtgatcttaagagagatggaggaggttgagggacaatccgaggaagttatatttgatcatctccatgcaactgcattccagtatacatcccttggcagaccaatcctgggttcggcagataatgtcaagtcaatcaccaaagaggaccttgagaactacattgcaactcattatacagctcctagaatggttatcactgctgcgggtaatgttaaacacgaagacatcgtgcagcaggcaaataagttgttcaacaagctatcaactgaccctacaacaacaagcatgttggttgctaagaaaccagcctcttttactggctctgaggttcgaatcattgatgatgacatgccccttgctcaatttgctgttgctttcaatggagcatcctgggtagatccagattctgttgcattgatggttatgcaatcaatgcttggttcatggaacaagaatgctggtggaggaaagcacatgggttcacagcttgtgcaaagggctgcgatcaatgacattgctgagagtgtaatggcattcaacacgaattataaggacactggtctgtttggtgtctatgctgttgctaaggctgattgcttggatgatttggcttttgcaattatgcaagagatgagcaagttgtcgtaccgggttacggaagaagatgttgtccgtgctcgtaatcagctgaagtcctcaatccaactccatcttgatggttcgactgctgttgtcgaggacattggccgtcagatgcttacctatggcagaagaattcctattcctgagctctttgcaagaatagatgcagttgatgctagcactgtgaagcgtgttgcaaatcgctttatctttgaccaggatgttgcaattgctgcaatgggaccaatccagggacttccggactacaactggttcagacgccggacgtacttgctccgctactagattgtgtaccggtgtgtaccatgtttacagtctgcaaagacaagataaaattgcgacttttggcgtcagtatattatggcctcagcatagcacattacgtgctggagtggaggaagtttttgagtatgttttatttttgagatcttgtcccaaaccaacaaatctgtcaataatgataggcaggctcaactgacgtggctgactttgagtggccacccgttgcttttttttttttacgatgaattgggaccattaccattccatcttttgttggaagataattttcttgtgtcaaataatttcatgaaaaaaaaaaaaaaaaaaaa

SEQ ID NO: 3472 - protein, 530 aa, Panicum virgatum
  misc_feature: Ceres CLONE 1791593
  misc_feature (1)..(149): Pfam Name: Peptidase_M16 Pfam Description: Insulinase (Peptidase family M16)
  misc_feature (1)..(187): Pfam Name: Peptidase_M16_C Pfam Description: Peptidase M16 inactive domain
  misc_feature (83)..(519): SWISSPROT Homolog: EC 3.4.24.64 Mitochondrial-processing peptidase subunit beta, mitochondrial precursor
MAFRRILSSAVRRRSAIAAAAAGNAREASTAVAAGPGVLAPDAPPTRAPVMPYDRIAEAVNARLRRLEHPDPRFLRYANPVPTHADHTAILAAPETRVTTLPNGLRVATESSLAARTATVGVWIDAGSRYENEEAAGVAHFVEHMLFKGTGKRSAAQLEKEIEDMGGHLNAYTSREQTTYYAKVLDKDVSRAMEVLADILQNSNLDEARIEREREVILREMEEVEGQSEEVIFDHLHATAFQYTSLGRPILGSADNVKSITKEDLENYIATHYTAPRMVITAAGNVKHEDIVQQANKLFNKLSTDPTTTSMLVAKKPASFTGSEVRIIDDDMPLAQFAVAFNGASWVDPDSVALMVMQSMLGSWNKNAGGGKHMGSQLVQRAAINDIAESVMAFNTNYKDTGLFGVYAVAKADCLDDLAFAIMQEMSKLSYRVTEEDVVRARNQLKSSIQLHLDGSTAVVEDIGRQMLTYGRRIPIPELFARIDAVDASTVKRVANRFIFDQDVAIAAMGPIQGLPDYNWFRRRTYLLRY

SEQ ID NO: 3473 - DNA, 3082 bp, Panicum virgatum
  misc_feature: Ceres CLONE 1791616
  misc_feature: Encodes the peptide sequence at SEQ ID NO. 3474
aagctcagagcccacgctgctagctaccaaccacttgcagcagatcgatctcgaccaggtcggagaccccgctgctcagttgcaggcagctcttagctactggatgcctcttaccaattagatagctaggagcctaggaccgatcgagttgtagggccggcagggccggggcaggcagtagcaagcatgatgcacctgaacctgaagcagccactggcggtgctgccggggcaccagggcaatgtcgtcgtcggcccgtcgtcgccggcgccggcggcgggcgccaggagggtcgtcggggcggcgtcctccggccggcggcacgtcatgccgaggataagctgcagcgcgacggaggagatcggcggcgccgtgtcggcgaccaccgtggagaagatgctgaccgtgaaggccacggtggaggcgtcgccggccatcgggcgggtgtacgccgcccgcggcctcgacgacatcggcgacctcctcggcaagacgttgctcctcgagctcgtcagctccgagctcgacccgaagacgggcctggagaaggagcgtgtgagtgtgacggcgttcgcgcaccggacgctggtggagggccggtacgaggcggagttccaggtgccggcgtcgttcgggccggtgggcgctgtgctggtcgagaacgagcaccacaaggagaccttcatccgcgagatcaggctcgtcaccgccggcgaccccagctccgccgtcaccttcgactgcaactcctgggtgcactccaagttcgacaaccccgagaagcgcatcttcttcaccctcaagtcgttcttgccgtcggagacgcccaagggcctggaggagctgaggaagaaggacctcgaggcgctgcgcggcgacgggcgcggcgagcgcaaggccttcgagcgcgtctacgactacgacgtgtacaacgacctcggcgacccggaccggaaccccgcccaccggcgccccgtgctcggcgacagcgccgagttcccctacccgcggcggtgccgcaccggccgcgcccgggccgcgacagacccgcgggcggagcgccgggacggccacaactacgtgccccgcgacgagtggttctcggaggtgaagcagctcaccttcggggccaccacgctgcgctcgggactgcacgcgctgctccccatgctgcgcccgatgctgaccgagaaggagctccggttcccgcacttccccgccatcgacgacctctacagcgacggcctcccgctgccgccggagaccggcttcgacgccatccgcaccgtcgtgccgcgcatggtcaggatggtcgaggacaccaccgaccacgtcctccgcttcgagatccccggcatggtggagagggaccggttctcgtggttcagggacgaggagttcgcgcggcagacgctggcggggctcaacccgctgtgcatccagctgctgaccgaattccccatcaggagcaagctggacccggcggtgtacggcccggcggagtccgccatcaccagggagatcctcgagaagcagatgagcggcaacctcaccgtcgaggaggcgctggcggcgaggcggctcttcatcctcgactaccacgacgtgttcctgccctacgtgcacaaggtgcgggagcagcaggaggccacgctctacggctcccgcaccgtcttcttcctcaccgacctgggcaccctcatgccgctggccatcgagctcacgcggccgcagtcgccgaccgggcagccgcagtggcggcgggtgttcacgcacggccccgacgccaccgactcctggctctggaagctggccaaggcgcacgtgctcagccacgacaccggctaccaccagctcgtcagccactggctgcgcacccactgctgcgtcgaaccctacatcatcgccgccaaccggcagctcagccggctgcaccccgtgtaccggctcctgcacccgcacttccgctacaccatggagatcaacgcgctggcccgggagagcctcatcaacgccgacggcatcatcgagcaggccttctggccgggcaagtactccgtcgagctcagctccgtcgcctacggcgccacgtggcggttcgacatggaggcgctgcccaacgacctcgtccggcgcgggctcgccgtgcgcaggggcggcgacggcggcgagctagaactcaccatcaaggactacccctacgcccacgacgggctcctggtctgggactccatcaggcggtgggcggcggactacgtcgccgtgtactacgagtccgacgaggccgtcgccggcgaccccgagctgcaggcgttctgggaggaggtgcgcacggtggggcacgccgacaagaaggacgagccgtggtggcccgtgctcgacacccgccgcagcctggttgagacgctcaccaccatcatgtgggtcacctccggccaccactccgccgtcaacttcgggcagtaccactacggcggttacttccccaaccgccccaccaccatccggaagaagatgccggtggaggagggccgggacgaggagatgaggaagttcatgtcgcagccggaggcgacgctgctggacatgctgcccacgcagatgcaggccatcacggtgatgaccacgctggacatcctctccgcgcactcccccgacgaggagtacatgggcgagcacgccgagccggcgtggctggcggagcccagggtgaaggcggcgttcgagaagttcgccggcaggatgaaggagatcgagggcgtcgtcgacgagtgcaacagcaacccggagttgaggaaccgctgcggcgccgggatcgtgccgtacgagctgctcaagcccttctccaagccgggggtcaccgggaggggcatcccaaacagcatctccatctgatcgatgatctgatcgagcttcgacgatccagtccagggggagattgcatgcattgagaaataaaatgtgccactactctgtgcacgatatgactgtacaattactattgattattgtacatgatgtatcactgcaagagacgttttttagttacaaaataaaaaaacaaaaaaaaaaaaaaaaaaaa

SEQ ID NO: 3474 - protein, 902 aa, Panicum virgatum
  misc_feature: Ceres CLONE 1791616
  misc_feature (1)..(670): Pfam Name: Lipoxygenase Pfam Description: Lipoxygenase
  misc_feature (25)..(902): SWISSPROT Homolog: EC 1.13.11.12 Lipoxygenase 7, chloroplast precursor
  misc_feature (4)..(902): SWISSPROT Homolog: EC 1.13.11.12 Lipoxygenase 2.3, chloroplast precursor
MMHLNLKQPLAVLPGHQGNVVVGPSSPAPAAGARRVVGAASSGRRHVMPRISCSATEEIGGAVSATTVEKMLTVKATVEASPAIGRVYAARGLDDIGDLLGKTLLLELVSSELDPKTGLEKERVSVTAFAHRTLVEGRYEAEFQVPASFGPVGAVLVENEHHKETFIREIRLVTAGDPSSAVTFDCNSWVHSKFDNPEKRIFFTLKSFLPSETPKGLEELRKKDLEALRGDGRGERKAFERVYDYDVYNDLGDPDRNPAHRRPVLGDSAEFPYPRRCRTGRARAATDPRAERRDGHNYVPRDEWFSEVKQLTFGATTLRSGLHALLPMLRPMLTEKELRFPHFPAIDDLYSDGLPLPPETGFDAIRTVVPRMVRMVEDTTDHVLRFEIPGMVERDRFSWFRDEEFARQTLAGLNPLCIQLLTEFPIRSKLDPAVYGPAESAITREILEKQMSGNLTVEEALAARRLFILDYHDVFLPYVHKVREQQEATLYGSRTVFFLTDLGTLMPLAIELTRPQSPTGQPQWRRVFTHGPDATDSWLWKLAKAHVLSHDTGYHQLVSHWLRTHCCVEPYIIAANRQLSRLHPVYRLLHPHFRYTMEINALARESLINADGIIEQAFWPGKYSVELSSVAYGATWRFDMEALPNDLVRRGLAVRRGGDGGELELTIKDYPYAHDGLLVWDSIRRWAADYVAVYYESDEAVAGDPELQAFWEEVRTVGHADKKDEPWWPVLDTRRSLVETLTTIMWVTSGHHSAVNFGQYHYGGYFPNRPTTIRKKMPVEEGRDEEMRKFMSQPEATLLDMLPTQMQAITVMTTLDILSAHSPDEEYMGEHAEPAWLAEPRVKAAFEKFAGRMKEIEGVVDECNSNPELRNRCGAGIVPYELLKPFSKPGVTGRGIPNSISI

SEQ ID NO: 3475 - DNA, 1170 bp, Panicum virgatum
  misc_feature: Ceres CLONE 1791621
  misc_feature: Encodes the peptide sequence at SEQ ID NO. 3476
atcgatttatcacacgcaacggacactagatcactaggcacgtctagcactatcaccagatggcaaggccggtgcagcaggcagctgctcttctccctcttctcctggcatgcacgcttgctctgctcacgctgcagctgcggccctgcgccggccagcagcagcctccctcccccggatactaccccagcgccacgctccggccgctggccttctccgagggctaccggaccctgtggggcccgcagcaccagacggtctcgccggacggcaggtccctgacgctgtggatggaccgcagctccggcagcgggttcaagtcggcgcgggcgtaccggaacggctacttcggcgcgtcggtcagggtacagccgggctacaccgccggcgtcaacaccgccttctacctgtcgaacagcgaggagtacccagggcaccacgacgagatcgacatggagctgctgggtacggtccccggggagccgtacacgctgcagaccaacgtgtacgtgcgcggcagcggcgacggcaccatcgtcggccgggagatgaggttccacctctggttcgaccccaccgccgacttccaccactacgccatcatctggaaccccgaccagatcctgttcctggtggacgacgtgccgatccggcgatacgagaggaagacggaggccacgttcccggaccgggagatgtgggcgtacggctccatctgggacgcctccgactgggccaccgacggcggccgctaccgcgccgactaccggtaccagccgttcgtgtcgcgcttcgcggacctcaaaatcagcgggtgcgccgcggacgcgcccgccgggggctgccggcccgtgccggcgtcgccgtcggggtcggcggcggcgctcagcccgcagcaggaggccgccatgcggtgggcgcagcggaactccatggtgtactactactgcctcgactcatccagggaccacgcgctctaccccgagtgctgacctgaacctgaacacactgcagagctgagggtcgttgcaatttgcaactgcagctcccattcataaccaaatcaaacgcgtgtctaagcgcaatgcaacttggagtaaaaaataaacagtggaaaaggatgcaaattgcttcaatacgaaagaagggtaaaaaaaaaaaaaaaaaaaa

SEQ ID NO: 3476 - protein, 310 aa, Panicum virgatum
  misc_feature: Ceres CLONE 1791621
  misc_feature: Great-hit functional homolog of the protein sequence encoded by LOCUS At3g44990
  misc_feature (1)..(187): Pfam Name: Glyco_hydro_16 Pfam Description: Glycosyl hydrolases family 16
  misc_feature: Useful for making plants with altered cell wall content and/or composition
MARPVQQAAALLPLLLACTLALLTLQLRPCAGQQQPPSPGYYPSATLRPLAFSEGYRTLWGPQHQTVSPDGRSLTLWMDRSSGSGFKSARAYRNGYFGASVRVQPGYTAGVNTAFYLSNSEEYPGHHDEIDMELLGTVPGEPYTLQTNVYVRGSGDGTIVGREMRFHLWFDPTADFHHYAIIWNPDQILFLVDDVPIRRYERKTEATFPDREMWAYGSIWDASDWATDGGRYRADYRYQPFVSRFADLKISGCAADAPAGGCRPVPASPSGSAAALSPQQEAAMRWAQRNSMVYYYCLDSSRDHALYPEC

SEQ ID NO: 3477 - DNA, 1484 bp, Panicum virgatum
  misc_feature: Ceres CLONE 1791637
  misc_feature: Encodes the peptide sequence at SEQ ID NO. 3478
gccctgctaatctgctactgcttcctcgtcgtccgcaaccgactcgttcgtctcccacccacccaccccagcaaggatcgcagccgcaacccaactccgaacccgactcggcaggggccccgcttgcgcccgtttaatccgacccccacctttgcaaaaaagcaaaccggaccagacgcctcttctcctctgacgcgcgcgcgcccagctcgcaagcacccgcggcgcagcgagctcttctccttgtcggcggcgggcggcggccgtggaggtggaacagacatggaggtcgagtaccacgaggagtacgtgcggaactcgaggggcgtgcagctcttcacctgcggctggctgcccgccgcggcggcgcccaaggcgctcgtcttcctctgccacggctacggcatggagtgcagtggcttcatgagagaatgcggcgtgcggctggcggcggccgggtacggcgtgttcgggatcgactacgagggccacggcaagtcaatgggcgcccgctgctacatccgcagcttccgccgcctcgtcgacgactgccaccacttcttcaagtccatctgcgagcttgaagagtaccggagtaagagccggttcctgtacggcgagtccatgggcggcgcggtggcgttgctgctgcacatgaaggaccccgccttctgggacggcgccgtcctcgtcgcgcccatgtgcaagatatcggagaaggtgaagccgcacccgctggtgatcacgctcctgacgcaggtggaggacgtgatccccaagtggaagattgtgcccaccaaggacgtcatcgatgccgccttcaaggaccccgtcaagcgtgaaaagatcaggaagaacaagctcatctaccaggacaaaccgcggctcaagaccgcgctggagatgctcagaatcagcatgtacatagaagacagcttgtcacaggtgaagctgccgttcttcgtcctgcacggcgaggcagacacggtgacggacccggagatcagccgcgcgctgtacgagcgcgcggccagcgcggacaagaccatcaagctctacccggagatgtggcacggcctcaccgccggcgagcccgacgagaacgtggaggccatcttctccgacatcgtcgcctggctcaacgagcgcagacgcagctggaccatggaggaccgcctcaggaagatgacgccggcgcccggaaagttggttgatggcgacaaccgcggtgaggcgtcggctcgcgagcggcctcagcgacagcgccgaggcttcctctgcgggctcaccggcaggacgcatcaccacgctgagatgtgaaagatagaactgccagcactgatcaaatgtgcacctgccggcacagctgcgctcccgtatatacgaatacgaattgtgaatctggttgggaaagagagctgaaatatattgggaaagagagctggtggtggacgcaattatacgaaaaaaaaaaaaaaaaaaaa

SEQ ID NO: 3478 - protein, 345 aa, Panicum virgatum
  misc_feature: Ceres CLONE 1791637
  misc_feature (1)..(225): Pfam Name: Abhydrolase_1 Pfam Description: alpha/beta hydrolase fold
MEVEYHEEYVRNSRGVQLFTCGWLPAAAAPKALVFLCHGYGMECSGFMRECGVRLAAAGYGVFGIDYEGHGKSMGARCYIRSFRRLVDDCHHFFKSICELEEYRSKSRFLYGESMGGAVALLLHMKDPAFWDGAVLVAPMCKISEKVKPHPLVITLLTQVEDVIPKWKIVPTKDVIDAAFKDPVKREKIRKNKLIYQDKPRLKTALEMLRISMYIEDSLSQVKLPFFVLHGEADTVTDPEISRALYERAASADKTIKLYPEMWHGLTAGEPDENVEAIFSDIVAWLNERRRSWTMEDRLRKMTPAPGKLVDGDNRGEASARERPQRQRRGFLCGLTGRTHHHAEM

SEQ ID NO: 3479 - DNA, 1455 bp, Panicum virgatum
  misc_feature: Ceres CLONE 1791639
  misc_feature: Encodes the peptide sequence at SEQ ID NO. 3480
aaagcctcgccttttccctctccctcgtcttccctcgctcgcctccccctcccctccaaatccccccctccctcgccttccagtcctccacattcttcctgctctgcagctagctgcttttggctggggatcggaaatggcaatcgacgacgaatcgccgccgctcagggtcaacaccagaggcggcgccatgggaggaggggagtgcggcggggcggagaatcagcggtggccgccgtggctcaagccgctgctgggcacgagcttcttcggtcaatgcaagctgcacgcggacgcgcacaagagcgagtgcaacatgtactgcctcgactgcatgaacggcgcgctctgctcccagtgcctcgcctaccactgcgaccaccacgccatccaaatacggaggtcctcctaccacgacgtgatccgggtgtcggagattcagaaggtgctggacatcaccggcgtgcagacgtacatcatcaacagcgcgcgcgtggtgttcctgaacgagcgcccgcagccgaggcccggcaagggcgtcaccaacacctgcgaggtctgcgagcgcagcctgctcgacaccttccgcttctgctccctcggctgcaagatcgtcggcacctccggcgagttccgcatccggaagaagcactccgccatcaagaggaagaagaggccgcagcacaaggtcggcgcggcggcgtcggactcggagggcgactcgtccacgagcacgagcggcgggagcgacaagagcagcgtggtgcagagcttcaccccatcgaccccgccggcgaccgccaacagcttccgcgccgggaagcggcgcaagggtgtgccgcaccggtcgccgttcggcagcctcatggtggagctctagtcttctagagcagcagcagcgccaagccaatgccgccgtcgccaagaaccatgggtacaccactgtagcatacgcgcccctacataccatccataggtagctgtcggatcgaccgatctgcataccatagccagccaaaaggagctagtaagcaataacgaagggccccattgcacgcctgcgcttctggacgaggaggccggtgcggtgaggcgcagcggttactttcatggtagtttttactcttcactgtgctatagtaacaacggtttgagtttggtgccagcctccgaaaggcaacgaggttgttgtagcagttactctcctccctctcgtcatcagccgctactggagtaagttttgcaagcttttactatagcgagtaagtttctctagcttttttttaccggtgcttgatatagtagtggtagatgtacatatacatatatactgtcacagatgggggaatggttcggagtgtagctccggtgttcatattcgtgtgtaataagaaaaaaaggataagaatgctgctcctggatggccttcgttgcgaaaaaaaaaaaaaaaaaaaa

SEQ ID NO: 3480 - protein, 247 aa, Panicum virgatum
  misc_feature: Ceres CLONE 1791639
  misc_feature (1)..(112): Pfam Name: PLATZ Pfam Description: PLATZ transcription factor
MAIDDESPPLRVNTRGGAMGGGECGGAENQRWPPWLKPLLGTSFFGQCKLHADAHKSECNMYCLDCMNGALCSQCLAYHCDHHAIQIRRSSYHDVIRVSEIQKVLDITGVQTYIINSARVVFLNERPQPRPGKGVTNTCEVCERSLLDTFRFCSLGCKIVGTSGEFRIRKKHSAIKRKKRPQHKVGAAASDSEGDSSTSTSGGSDKSSVVQSFTPSTPPATANSFRAGKRRKGVPHRSPFGSLMVEL

SEQ ID NO: 3481 - DNA, 2106 bp, Panicum virgatum
  misc_feature: Ceres CLONE 1791659
  misc_feature: Encodes the peptide sequence at SEQ ID NO. 3482
gcgccccccgtccccccttcgccattagagagcgcgcgcagcggcgaagctcctgaggttcgagatgaaggtgatcgagaagatccagcaggccgcggcggatggccggacggcgttctcgttcgagtacttcccgcccaagaccgatgagggcgtcgagaacctcttcgagcggatggaccgcatggtggcgcacggcccgtccttctgcgacatcacctggggcgccgggggttccaccgccgacctcaccctcgaaatcgccaaccgcatgcagaacatggtgtgtgtggaaactatgatgcatctgacatgtacaaatatgccagttgagaaaattgaccatgctttggaaaccatcaaatccaatgggattcaaaatgttttggcacttagaggggatcctcctcacgggcaagacaaatttgtgcaagttgaaggtggatttgcttgtgctcttgatctggtacagcatattagagccaagtatggtgattattttggcataactgtagctggttatccagaggcacaccctgatgcgatacaaggcgaaggaggtgctacattggaagcatataccaatgatcttgcttatttgaagagaaaggttgatgctggcgctgaccttattgtcacacaacttttctatgataccgacatctttctcaagtttgtgaatgactgtcgtcaaatcggtattacttgtcccattgttccgggcataatgccgataaataactacaaaggtttcgtgcgcatgactggattctgtaaaactaagatacctgctgaaatcactgctgcactggatcctattaaagataatgaggaggccgtcaaagcatatggaatccaccttggaactgagatgtgcaagaaaattctagctagtggcatcaagactttgcacctttacacactaaacatggagaagtctgcgttaacaattttgatgaatcttggattaattgaggagtccaaggtttcaaggccattaccatggaggccgccaactaatgttttccgtgttaaagaggatgttcgacctatattctgggctaacagaccaaagagctatattacaaggactctaggttgggatcagtatccacatggacggtggggtgattcccgaaacccatcatatggagcacttactgaccaccagttcacaagaccgcgtgggcgtggtaaaaagctccaagaggaatgggctgttccactgaaatctgtggaggacattagtgagcgctttacaaacttctgtgaagggaaacttacaagcagcccatggtcagagttggatggtcttcaaccagagacaaagattattgatgaccagctggtgaagattaaccagaagggtttccttaccatcaacagccaacctgctgtaaatggggagaaatctgactcgcctaccgttggttggggcggtccaggaggttatgtttatcagaaggcctaccttgaattgttctgcgcgaaggataagttggaccaactagttgagaagatcaaagcattccctgctctcacatacattgctgtgaacaaggatggggaatcattctccaatattcctgcgaacgccgtgaatgctgtcacatggggtgttttccctggcaaggagattatccagcctacagttgttgattcagcaagttttatggtttggaaggacgaggcatttgaaatctggacgaggggatggggctgtctattccccgagggtgactcctctagggagctactagagaaggttcagaagagctactacctggtgagccttgttgacaacgactacatccacggggatctgtttgccgccttcaaggagctctgatgatcctcggggatctgtttgccgccttcaaggagctctgatgatcctcttattgtctgtattgttgttgtatggttaaatccgacaaatattcttgcttccccgaccagtgtccgatcgccactaaagcttctgctcattttacctcggaggaatcccctagcctgatttttcctgatttctttcgctcatgcgaaccatacgatatcaataagatccaagatgtgttctctatctaaaaaaaaaaaaaaaaaaaa

SEQ ID NO: 3482 - protein, 594 aa, Panicum virgatum
  misc_feature: Ceres CLONE 1791659
  misc_feature (1)..(296): Pfam Name: MTHFR Pfam Description: Methylenetetrahydrofolate reductase
  misc_feature (1)..(592): SWISSPROT Homolog: EC 1.5.1.20 Methylenetetrahydrofolate reductase 1
  misc_feature (1)..(594): SWISSPROT Homolog: EC 1.5.1.20 Methylenetetrahydrofolate reductase 2
MKVIEKIQQAAADGRTAFSFEYFPPKTDEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYTNDLAYLKRKVDAGADLIVTQLFYDTDIFLKFVNDCRQIGITCPIVPGIMPINNYKGFVRMTGFCKTKIPAEITAALDPIKDNEEAVKAYGIHLGTEMCKKILASGIKTLHLYTLNMEKSALTILMNLGLIEESKVSRPLPWRPPTNVFRVKEDVRPIFWANRPKSYITRTLGWDQYPHGRWGDSRNPSYGALTDHQFTRPRGRGKKLQEEWAVPLKSVEDISERFTNFCEGKLTSSPWSELDGLQPETKIIDDQLVKINQKGFLTINSQPAVNGEKSDSPTVGWGGPGGYVYQKAYLELFCAKDKLDQLVEKIKAFPALTYIAVNKDGESFSNIPANAVNAVTWGVFPGKEIIQPTVVDSASFMVWKDEAFEIWTRGWGCLFPEGDSSRELLEKVQKSYYLVSLVDNDYIHGDLFAAFKEL

SEQ ID NO: 3483 - DNA, 1650 bp, Panicum virgatum
  misc_feature: Ceres CLONE 1791663
  misc_feature: Encodes the peptide sequence at SEQ ID NO. 3484
accccttgctccgttactggtgatcgagtgactggagccctccaaagcccagcactatttcttctccccctcctcgcgcctctccccctctcatcacgccactcgcctctccccctccaccccctcactctctctcgccactgctactcccaaggctctagctgctagctcgtactagaacgagcactgtctcacttgctcgcctcaaggaactgcccagtgccgggttaagtaccacgccgtacggttagctctagtgcccgcgatggcgtcggagtgggaaatggccatgggggtcgagctcggcatgggcatgggcacgtaccacgcccaccaccacaacgcctccagcatcaccgccgcgccgatgagcagccaccacagtggtgccgccaccttcgccgcgccgcaccaccaccattactacgggatgccgcccatgggcgacgccatgcgggtcgacgagctcctcgacctctccaccggcgccggcgccggcgcccacgacttcttccccaccgccgccgccgcggcggccacggacaacgggcatcactcggcggtcatgggtgagccgtcgcccaccgccaactcgtcggatcaccagacgtcgctcctctccttcgcagacgagttttacatacccagcgaggaagctgcggagctggagtggctatccaagttcgtggacgactcctactccgacatgccgaattactcgtcggcggcgcatgccgcaatggcggcggctgccgccgctaacgcggccggcaacggtggtggcaactcggccggtcaggacagctgcgtcacggccgcgcccgggcgcggcgcgcgtagcaagaggtcccgcgcgaccgccgtggctgccgcggcgtggcactccctcgtgccgcgcccgccgtcgcagtcgtcgccatcgtcatcatcctgctcgtcctcggacttcccgtcgtcgaacaagcctgcgcgtccgaacggcgccagcggcagccgcggcaagaagagcccgggccccggcggggccgcgccggaggtgggcatggagggcggcgtgcggcggtgcacgcactgcgcgtcggagaagacgccgcagtggcggaccgggccgctgggccccaagaccctgtgcaacgcgtgcggcgtgcggttcaagtccgggcgtctgatgccggagtaccggccggcggccagccccacgttcgtgctgacgcaccactccaactcgcaccgcaaggtcatggagcttcgccgccagaaggagctgatcctgatccgcggcagccaccgcgacgcggccgcggcggcggcagggtccgccgggccgaggccggagctcatgttccgcgactatggcgtgtgttgatagctagccagccggccggagagaggcccgggccggggagctggccgtgcattgcatgcgcggagccctctagatccttttgcgaacgaaattctgccgccgtttcttcttttctttcttcgatcgccatgcgtattccagatatttttttcctttctccttttgttaattacaattaaattgttggtacctactactccccgcttccaagctctatgagagatcaatgaattctgttggtataattgtggtcgttttgtgagcaaaaaaaaaaaaaaaaaaaa

SEQ ID NO: 3484 - protein, 366 aa, Panicum virgatum
  misc_feature: Ceres CLONE 1791663
  misc_feature (1)..(36): Pfam Name: GATA Pfam Description: GATA zinc finger
  misc_feature: The sequence is a functional homolog of  SEQ ID NO 146 in the  10/225,068 US patent application
  misc_feature: The sequence is a functional homolog of  SEQ ID NO 475 in the  11/479,226 US patent application
  misc_feature: The sequence is a functional homolog of  SEQ ID NO 58 in the  10/374,780 US patent application
  misc_feature: The sequence is a functional homolog of  SEQ ID NO 607 in the  10/374,780 US patent application
  misc_feature: The sequence is a functional homolog of  SEQ ID NO 710 in the  10/225,066 US patent application
  misc_feature: Useful for making plants with modulated growth and phenotype characteristics
MASEWEMAMGVELGMGMGTYHAHHHNASSITAAPMSSHHSGAATFAAPHHHHYYGMPPMGDAMRVDELLDLSTGAGAGAHDFFPTAAAAAATDNGHHSAVMGEPSPTANSSDHQTSLLSFADEFYIPSEEAAELEWLSKFVDDSYSDMPNYSSAAHAAMAAAAAANAAGNGGGNSAGQDSCVTAAPGRGARSKRSRATAVAAAAWHSLVPRPPSQSSPSSSSCSSSDFPSSNKPARPNGASGSRGKKSPGPGGAAPEVGMEGGVRRCTHCASEKTPQWRTGPLGPKTLCNACGVRFKSGRLMPEYRPAASPTFVLTHHSNSHRKVMELRRQKELILIRGSHRDAAAAAAGSAGPRPELMFRDYGVC

SEQ ID NO: 3485 - DNA, 1722 bp, Panicum virgatum
  misc_feature: Ceres CLONE 1791686
  misc_feature: Encodes the peptide sequence at SEQ ID NO. 3486
acacaggcagtgacaccaccgtgcgcgcggcgcggcggcatggcgagcgcggccgctccgagtcccctccccgtggcttccctctccgcgccccgcgcggtcgcggccgcgggcacccacccgctttggttcccgaggcgtctcaaaccctccacgggagtctcgccgcgctccagcctgcgcgtcgtggcctccggctccagggtggacccggtcgaggagagagctcccgtcgcgccgctcacgggcgtccctgttccggccggcgcgtccccgccgggctcgtcgctggagcctcagccccaagtaagcaccggcacatggaaatggaggggctacaacattcgctaccagcaggccgggacttcgggccctgcattggttctgatccatgggtttggggcgaacagtgatcattggcggaaaaatgttcctgttcttgccatggcaaatagggtgtatgcaatagatctaattggttatggctattctgataagcctaatccgcgtgagattggagagaacttttatacttttgagacatggggagagcagctgaatatgttttgtgctgaagtggtcaagagtgaagctttcttcatatgcaattcaattggagggcttgttggtcttcaggcagccgttatggaacctcagaaatgcaagggaattgttttattggatatttcactaagaatgcttcatatcaagaagcagccgtggtttggaaagcctttcatcaaatctttccaaagtctcctaaggaacactattgttgggaagctattttttaatgctgtcgctacaccagaatctgtgaaaaatatactttgccagtgctatcatgacacatctgcagtgacagatgagctagttcagattattctacagccagggcttgatccaggcgcagtggatgtattccttgagttcatctgctactctggaggacctctacctgaagagttgcttccattggtgaagcgtccagttttggtagcatggggggagaaggacccatgggagcctgtggagcttggaagagcatatgcatcttttgatacagttgaagattttgttgtcttgccagatgttggacactgccctcaggatgaagcacctgagcttgtaaatccacttgtccaatcatttgttgagcgtcatagttagcacaggggtgagcctgctttctatgtttcttgatgcccttctccactagaccactagggcctgtatttcctgggaaggcaacgcatggttatgttgttttgggataacaaatgggcccttctgttataggccatgtacttgcatcttagtgccgttggcaaacatcatttggcaaatcattattcaagtataggaaatcacaaggaaatatctgattttgttacagcaaaaaggaagaacatgtctcctcagagcagagaggttagtaccagcaggcagcagcacagtggttctattctagtcgaagttattgtgaaaattgttacaaaaccagtatttgatctcatcaaatgcatcaagaatggagttagagcaatatgtaacagtcaaggagtgaatgccatggtaacagctatggttaaagacttattgctgttgttacaaagagtcactaattcctagaattagtgatcaagtaatctccctatatatatgtgtaatcctgagatgaataaagtttcagcttttcattaaaaaaaaaaaaaaaaaaaa

SEQ ID NO: 3486 - protein, 376 aa, Panicum virgatum
  misc_feature: Ceres CLONE 1791686
  misc_feature (1)..(234): Pfam Name: Abhydrolase_1 Pfam Description: alpha/beta hydrolase fold
MASAAAPSPLPVASLSAPRAVAAAGTHPLWFPRRLKPSTGVSPRSSLRVVASGSRVDPVEERAPVAPLTGVPVPAGASPPGSSLEPQPQVSTGTWKWRGYNIRYQQAGTSGPALVLIHGFGANSDHWRKNVPVLAMANRVYAIDLIGYGYSDKPNPREIGENFYTFETWGEQLNMFCAEVVKSEAFFICNSIGGLVGLQAAVMEPQKCKGIVLLDISLRMLHIKKQPWFGKPFIKSFQSLLRNTIVGKLFFNAVATPESVKNILCQCYHDTSAVTDELVQIILQPGLDPGAVDVFLEFICYSGGPLPEELLPLVKRPVLVAWGEKDPWEPVELGRAYASFDTVEDFVVLPDVGHCPQDEAPELVNPLVQSFVERHS

SEQ ID NO: 3487 - DNA, 1966 bp, Panicum virgatum
  misc_feature: Ceres CLONE 1791705
  misc_feature: Encodes the peptide sequence at SEQ ID NO. 3488
atccatcctctgctgccccaccctctgttcccccttttctctttctcccgttcacctctctctctctctttctcgcctttcttccttgcggcgacgactgggcgagcgccgccgcccgccaccaggtcttcgccggcgatgagcagccatcaggcttgtcaaacataaataagcaagtagcgtctgcacgtgattggcaaaattagtcaagacgggtgctctttgctgtgtggccgctaggccacatgggacaaagtctattccagctagcagagattgttccatggatcctactgagcctcactggcggataaactcaagcttctctcctccaacgtcaaggaggtgggactgccgttattcatcagatggattgcctcacagagttcatgatgcttctcatgatcacccaccttatgtgtcatcattatcatctcatagtaaaggaagcagaagtgcatttggcagtgatcagtatctcaatcaccatcattctatatctgatggggcaccttcttattttgggagtccatctgacagccttcaggctccacgctggacaccgtctcttcaaagatttgatctcggtgaattctctacccctgcaggaggatcaagaccagaaacttctgactatcctcagtcaagtgagaggcaactgactaccacaagcagtttcagttctgcatccccattctcagaatcaagtcagctaacatcgtctagtaaacaaccagccccatatctacctcgcaatcaaatgggtaggcgatctttcatgtcaaaaccagtctacccacttgtctaccggaatccagtgtcagaaacagaagcgtccaggatgcctgaggttactaatgctgggcgaacaacaccaagtgatgatagccaggcttctcctctgtggcgtcgcagcatggcgagtccagagctcaagttccataatgcactgagtgagcttgggaagatggaggcttcacctgaaccgaacacaagctcaagaagggaaggattcagatggagcaatgctagtagttatgattttggatatgatggagatgccattgacatttcagatcatatcagcatcgagtcccagagatcacccacaaattcggtgagattccttaagtgtgggctgtgcgagagattcctgcgccagaaatcaccctggacctcaaaccgtattgttcgaaacaccgacatgccagtagcagcggtccttccatgccgacatgtcttccatgcagattgcttggaggaaagcactcccaaggcagaagtccatgaaccaccctgccccctgtgcacgcgagccgctgatgatgaagggcatgtgtcattctcagaaccactacatgttgcactccgatctgctcgcaggaacctttcattgggtggtggtgctggtggtagtagcagcagtgcaaaccctccttgcagtgatcacggcttgaagaggaaccattctgctatcgttccgagacacagtggcagctcactgttccgcaaccgcttcaaaaggcagttccccttcaaagcgaggattggaaaggacctctttggcagtagggttttcaataaggttggatcatcttcattgtcaggtcaacagggtgatcatcagcaaccatcagcagcaaagcatgaccaatcaatgaagtagcttgaacttagtggcacagagtatattttgtgtgccctgctaatattttaatccatgttatcgtattcggtataacctatcatagcagaagctcggcatccatgcgcagtagtcatccaggacagggtttcctttggaggctgcttgtgttgcattgcatgtggcacccaccattggctaactgttggctaactatgaggtgtattatgaatccttacagtaagaatcgatgcctatgtttaatatattctgcctgatcttactcattgttgaattgagcaaaaaaaaaaaaaaaaaaaa

SEQ ID NO: 3488 - protein, 460 aa, Panicum virgatum
  misc_feature: Ceres CLONE 1791705
  misc_feature (1)..(59): Pfam Name: zf-C3HC4 Pfam Description: Zinc finger, C3HC4 type (RING finger)
MDPTEPHWRINSSFSPPTSRRWDCRYSSDGLPHRVHDASHDHPPYVSSLSSHSKGSRSAFGSDQYLNHHHSISDGAPSYFGSPSDSLQAPRWTPSLQRFDLGEFSTPAGGSRPETSDYPQSSERQLTTTSSFSSASPFSESSQLTSSSKQPAPYLPRNQMGRRSFMSKPVYPLVYRNPVSETEASRMPEVTNAGRTTPSDDSQASPLWRRSMASPELKFHNALSELGKMEASPEPNTSSRREGFRWSNASSYDFGYDGDAIDISDHISIESQRSPTNSVRFLKCGLCERFLRQKSPWTSNRIVRNTDMPVAAVLPCRHVFHADCLEESTPKAEVHEPPCPLCTRAADDEGHVSFSEPLHVALRSARRNLSLGGGAGGSSSSANPPCSDHGLKRNHSAIVPRHSGSSLFRNRFKRQFPFKARIGKDLFGSRVFNKVGSSSLSGQQGDHQQPSAAKHDQSMK

SEQ ID NO: 3489 - DNA, 2150 bp, Panicum virgatum
  misc_feature: Ceres CLONE 1791709
  misc_feature: Encodes the peptide sequence at SEQ ID NO. 3490
agcctaaaaacttccaactctgccgagcgcctgagcccgcctccagctccccgccccttggcaccacactagcgcctactagctcgcttgctcctccctgttgtccgcaggagcagagccaaaagccgtcagctcggggcgccgaggcggcaagaacggccatgaagtacgtggtggtgaccggaggggtggtgagcggcctcggcaagggcgtgacggccagcagcatcggcgtcgtgctcaaggcctgcggcctccgcgtcaccaccatcaagatcgacccctacctcaacactgatgctgggaccatgtctccatttgagcatggcgaggtctttgttttggatgatggtggagaggtggacctggaccttggaaattatgaacgttttctggatatcaaattgacccgtgacaacaatataaccacaggaaaaatctatcaggctgtcattaacaaagaaagaagaggtgactacctgggaaaaaccgtccaggttgtgccacatattacagatgaaatacaagattggattgaatgcgttgcaatgaatccagttgacggcaaagaaggacctcctgatgtttgtgtcattgaacttggcggcactataggggatattgagtcaatgcctttcattgaagcattaggtcaattttcatatcgtgttggacctggaaacttctgtttggttcatgtcagtcttgttcctgtcctaaatgtagttggtgaacagaaaacaaagcctacacaacatagtgttcgagggcttagaggacttgggttggcaccagatgttctagcatgtcgcagtactgagccattggaagagcatgtgaaagtcaagctctcacaattttgtcatgttccgatctcaaatattgtgaacctccatgacgtgacaaacatttggcacatccctttgttgctaagggaccagaaggcccatgaatctattctgaaagttttagaacttcagtatgctggaaaggtacctagggaacctaagttggcggaatggacagaaagggccaccaaatttgacaatctgaagactccggtaggattcattagtcattattcttccagggtcaatattgccatggttggaaaatatactggcctatcagattcgtacctgtctgttctaaaggctcttttgcatgcatcagttgctatggaaagaaagcttatagtcgactgggttccttcatgtgatctggaagattcttcagctagagagaacccagaagcccacaaaaaagcatggaagctgctcaagggggcagatggtatactcgtccctggaggctttggagataggggagttcagggcaaaattcttgctgcgaaatatgcacgcgaaaacaatgttccttatctcggcatttgcttgggaatgcaaattgcagtgattgagtttgcccgttcggtcttgaaattatgtggtgcaaatagcacagaatttgacccatctgcaacatcaccctgcgtcattttcatgccagagggctcaaaaacccatatgggcgcgacaatgagacttggatcaaggagaacttatttccatgtcaatggctgcaaatctgcaaggctgtatggtaatgccacctctgtagatgaaaggcatcgccacagatacgaggtgaaccctgatatggtcccagactttgagagggccgggcttcaatttgtgggcaaggatgaaagtggaagacgcatggagatcattgaactgccctctcacaagttcttcatcggcgcacaattccatcctgaatttaagtcaagaccaggaaagccgtctccacttttcttaggtctgatagcagcggcatctggacaactagaacctttgcttcaacgcagctgcagcaatctgacaaagacacatctgaacaacggtaaagtccagatacggaaactgtaccaaactgtacctatgaagagtccattaaacagcttggtaaatgggtactacccaaatggcacgggcattcacacctagaagcataaatactaagtcaagacttgattgatatttgctcctacagttttccttgtaccccttttcatcttcctttttggtttgtatttgtctctgatcaactgagaaggctaagattcggaaaaaaaaaaaaaaaaaaaa

SEQ ID NO: 3490 - protein, 615 aa, Panicum virgatum
  misc_feature: Ceres CLONE 1791709
  misc_feature (1)..(238): Pfam Name: GATase Pfam Description: Glutamine amidotransferase class-I
  misc_feature (1)..(287): Pfam Name: CTP_synth_N Pfam Description: CTP synthase N-terminus
  misc_feature (1)..(571): SWISSPROT Homolog: EC 6.3.4.2 CTP synthase 1
  misc_feature (1)..(571): SWISSPROT Homolog: EC 6.3.4.2 CTP synthase 2
MKYVVVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIECVAMNPVDGKEGPPDVCVIELGGTIGDIESMPFIEALGQFSYRVGPGNFCLVHVSLVPVLNVVGEQKTKPTQHSVRGLRGLGLAPDVLACRSTEPLEEHVKVKLSQFCHVPISNIVNLHDVTNIWHIPLLLRDQKAHESILKVLELQYAGKVPREPKLAEWTERATKFDNLKTPVGFISHYSSRVNIAMVGKYTGLSDSYLSVLKALLHASVAMERKLIVDWVPSCDLEDSSARENPEAHKKAWKLLKGADGILVPGGFGDRGVQGKILAAKYARENNVPYLGICLGMQIAVIEFARSVLKLCGANSTEFDPSATSPCVIFMPEGSKTHMGATMRLGSRRTYFHVNGCKSARLYGNATSVDERHRHRYEVNPDMVPDFERAGLQFVGKDESGRRMEIIELPSHKFFIGAQFHPEFKSRPGKPSPLFLGLIAAASGQLEPLLQRSCSNLTKTHLNNGKVQIRKLYQTVPMKSPLNSLVNGYYPNGTGIHT

SEQ ID NO: 3491 - DNA, 1730 bp, Panicum virgatum
  misc_feature: Ceres CLONE 1791714
  misc_feature: Encodes the peptide sequence at SEQ ID NO. 3492
ccgatccgaccagatccgatccgacggcgggctcccccggcgcccgcgccgcgcctgcccggggcgtcctataaatcggccggcgcgcggcccagctcggcgtgcgctgcggccgggtcggatctgagacgagcgaccattcctccaacttattaccatctcgccccccggtttcctcctctcacccccgccgccggatcggatcggatcggatccgccgaccaccccgcgccgccgccgccgcagctgcagcagatcagagaagatggccgcagttgacaccttcctcttcacctccgagtccgtgaacgagggacaccctgacaagctctgcgatcaggtctcagatgctgtgctcgatgcttgccttgctgaggaccccgacagcaaggttgcttgcgagacctgcaccaagactaacatggtcatggtctttggtgagatcaccaccaaggccaatgtcaactacgagaagattgtcagggagacttgccgcaacattggtttcgtgtcagcagatgtcgggcttgatgctgaccactgcaaggtgctcgtgaacattgagcagcagtcccctgatattgctcagggtgtgcatggccacttcacaaagcgccctgaggagattggagctggtgaccagggacacatgtttgggtatgctactgatgaaacccctgagctgatgcccctcagccatgtccttgccaccaagcttggtgctcgtctcactgaggtgcgcaagaacgggacctgcccctggctcaggcctgatggaaagacccaggtgactgttgagtaccgcaatgatggtggtgccatggtgcccatccgagtccacactgtcctcatctctacccagcacgacgagacagtcaccaacgatgagattgccgctgacctcaaggagcatgtcatcaaacctgtcatccctgagcagtaccttgatgagaagaccatcttccaccttaacccatctggtcgctttgtcatcggtggacctcatgatgatgctggtctcactggccggaagatcatcattgatacctatggtggctggggagcccacggtggtggtgctttctctggcaaggacccaaccaaggttgaccgcagtggagcctacgttgctaggcaggctgccaagagcattgtcgctaacggccttgctcgccgcgccatcgtccaggtctcctatgccattggtgtgcctgagccgctctccgtgtttgttgacacatacggcactggcacgatccccgacaaggagatcctcaagattgtgaaggagaacttcgacttcaggcctggcatgatcatcatcaacctcgacctcaagaaaggtggcaacgggcgctaccttaagacagcagcctacggtcactttggaagggatgaccctgacttcacctgggaggtggtgaagcccctcaagtgggagaagccttctgcctaaggcgcccttttggaagaagcttttggtctgccacgcttatcatgttttgtggctcctgtgttgtgattcttgatctgccccttgctgtcatttgtattgtactgtcctaataagtggtacttgtgagggtattactgtgtctggttatttacttagaggaggatttattgtctaatgtttcaggtttttctacatatgtaatggtgaatctacaggttactttgagaagaaatggaacctgctgctttctggtcaaaaaaaaaaaaaaaaaaaa

SEQ ID NO: 3492 - protein, 396 aa, Panicum virgatum
  misc_feature: Ceres CLONE 1791714
  misc_feature: Great-hit functional homolog of the protein sequence given in SEQ ID NO 9521
  misc_feature (1)..(143): Pfam Name: S-AdoMet_synt_C Pfam Description: S-adenosylmethionine synthetase, C-terminal domain
  misc_feature (1)..(396): SWISSPROT Homolog: EC 2.5.1.6 S-adenosylmethionine synthetase 1
  misc_feature (5)..(396): SWISSPROT Homolog: EC 2.5.1.6 S-adenosylmethionine synthetase
  misc_feature: Useful for making plants with modulated biomass
  misc_feature: The plant is abnormally small.
MAAVDTFLFTSESVNEGHPDKLCDQVSDAVLDACLAEDPDSKVACETCTKTNMVMVFGEITTKANVNYEKIVRETCRNIGFVSADVGLDADHCKVLVNIEQQSPDIAQGVHGHFTKRPEEIGAGDQGHMFGYATDETPELMPLSHVLATKLGARLTEVRKNGTCPWLRPDGKTQVTVEYRNDGGAMVPIRVHTVLISTQHDETVTNDEIAADLKEHVIKPVIPEQYLDEKTIFHLNPSGRFVIGGPHDDAGLTGRKIIIDTYGGWGAHGGGAFSGKDPTKVDRSGAYVARQAAKSIVANGLARRAIVQVSYAIGVPEPLSVFVDTYGTGTIPDKEILKIVKENFDFRPGMIIINLDLKKGGNGRYLKTAAYGHFGRDDPDFTWEVVKPLKWEKPSA

SEQ ID NO: 3493 - DNA, 2580 bp, Panicum virgatum
  misc_feature: Ceres CLONE 1791757
  misc_feature: Encodes the peptide sequence at SEQ ID NO. 3494
gaaatggagcagccgctcaccctcactggcgccggaccaagtgaagtgaagctgctttcttgagctccagctactactagcacccagcagaggaggtcgggagagaagctgtgatttgcttgcttccgtccgctacagtagtcgatcgatcggtcgaggagccgcgcgctgggcatggacgcctacgaggccaccaaggtggtgttctcgcggatccaggcgctggacccggaccacgccgccaagatcatgggcttcctgctcatccaggaccacggcgagaaggagatgatacgccttgccttcggcccggaggcgctgctccacaccgtcatggccaaggcgcgcaaggacctcggcctgctcccagcgtccggcccggccacgccaacctccgccgcgcactcgccgttcctgctctcgcgccagaactcgggccgctgcggtggcgccgccggcaccgcgccctcgccgctctcggtgtcgtcgccctcgtcgtgggcgccgccgctcgtgttctccaggagcaacagcgtcagcaatggcgcggcggaggagctgggcggcgccggggaggacctgatgagcccggcgaacgggaacggcccgccgtcgcccttcttcccctcgcccgccggggacacgctcctcgacgagctccagctgcaggagcagctcgcgttcctcaacggcgcaggcgcgggggccgggcaccagctgcccctgctggacggcaccgagtgccggagccccggggacggcgacggcggcggcttcttcccctacgggggccgcctcggttggggcagcgggcatcgccgcagctcgtcggtgagcgagctctgcctcggcggggccgacgggctcggctggaagccgtgcctgtactacgcccgcgggtactgcaagaacgggagcgcttgccgcttcgtgcacggcggcgggctccccgacgacgccacagctctcgccggcgcaaagatggaccccgccgccagcatggagcaggacatgctcctactccgctccaagtcccagcgccttggtgccgccgccttcccctactccccaaccggctcgctcccggggtccccgtctgcggccagcaagtgcctgagcttgctgttgcagcagcagcagaacgagaagcagagggcggcggcagctgcagcggccgccgcagcgctgatgctgggcggcggcgacgaggcgcacaagttgatgatggggcgggcgcgcagcgagctggcgagcatgatgaaccccgggtcgcggcagatttacctcaccttcccggcggacagcacgttccgcgaagaggacgtctccaactacttcagcatctacggccccgtccacgacgtgcgcatcccgtaccagcagaagcgcatgttcggcttcgtcaccttcgtctacccggagacggtgaagctgatcctggccaagggcaacccgcacttcatctgcgacgcgcgcgtcctcgtcaagccatacaaggagaagggcaaggtccccgacaagtacaggaagcagcagctgctgctgcaaggtgagagggtggtggatttctccaacagcttactagacgccagagactccttggatctgcaccatctcggtgcgaggatgctgcagcactccaacagcgccaacgagatgctgctgaggaggaagctggaggagcagcagcaggcagccgagctgcagcaggccatggagctccagagccggcgcctcatgggcttgcagctgctaaacctcaagacacgctggtcgccgagccccatcggcatgcccttccgtgctgtcgcctccccaaccgtcgagtcgccgcctgattccgtcgatcaaggaggcaagggcagcagcttccttcttccccagaggcggccggtcaacggaggcgataaggaggaatctagcggcgaggcgagcccgaacgcagacagtgaccaaagcagcagcgccgagcacaacctgccggacagccctttcgcgtcgccgaccaagtccgccgcagcatttgctcatgatcctttcacacccacggagtcggagatcgcctctcccgggcgcaacgccgcctcctttgccggcatcaacaatggtggcctgactagccatttcaggccctctgccctggacataccttcgccaaagccatacttcttcccggccatgtccaggctgtcctccgatcacggcgccggcgctatcgggatgtaaagttgtcctcaatgggagggagtatgatagaatacttactagaagcaaagaaagaagatagtggagtataggaaaaagaatggagaagttgcagcatagtttagttcagttcccttttttcttttttactttcatgagttgatgatatagactttaagaaacaaaccacaatgcaagtaggagaagatgccagccatgaccacaagctgggaagcagctagcagcaacagattagtgctctcctatccacattaccatctgcattactactaattactaccattagtgtacttactattagtaccaccaccagtattcagcatccagttgatgtaaaaaaaaaaaaaaaaaaaa

SEQ ID NO: 3494 - protein, 683 aa, Panicum virgatum
  misc_feature: Ceres CLONE 1791757
  misc_feature (1)..(26): Pfam Name: zf-CCCH Pfam Description: Zinc finger C-x8-C-x5-C-x3-H type (and similar)
MDAYEATKVVFSRIQALDPDHAAKIMGFLLIQDHGEKEMIRLAFGPEALLHTVMAKARKDLGLLPASGPATPTSAAHSPFLLSRQNSGRCGGAAGTAPSPLSVSSPSSWAPPLVFSRSNSVSNGAAEELGGAGEDLMSPANGNGPPSPFFPSPAGDTLLDELQLQEQLAFLNGAGAGAGHQLPLLDGTECRSPGDGDGGGFFPYGGRLGWGSGHRRSSSVSELCLGGADGLGWKPCLYYARGYCKNGSACRFVHGGGLPDDATALAGAKMDPAASMEQDMLLLRSKSQRLGAAAFPYSPTGSLPGSPSAASKCLSLLLQQQQNEKQRAAAAAAAAAALMLGGGDEAHKLMMGRARSELASMMNPGSRQIYLTFPADSTFREEDVSNYFSIYGPVHDVRIPYQQKRMFGFVTFVYPETVKLILAKGNPHFICDARVLVKPYKEKGKVPDKYRKQQLLLQGERVVDFSNSLLDARDSLDLHHLGARMLQHSNSANEMLLRRKLEEQQQAAELQQAMELQSRRLMGLQLLNLKTRWSPSPIGMPFRAVASPTVESPPDSVDQGGKGSSFLLPQRRPVNGGDKEESSGEASPNADSDQSSSAEHNLPDSPFASPTKSAAAFAHDPFTPTESEIASPGRNAASFAGINNGGLTSHFRPSALDIPSPKPYFFPAMSRLSSDHGAGAIGM

SEQ ID NO: 3495 - DNA, 1910 bp, Panicum virgatum
  misc_feature: Ceres CLONE 1791758
  misc_feature: Encodes the peptide sequence at SEQ ID NO. 3496
gaaaccagccgacgccaccgccccccacctcctcccctcccctcccaccgcgtctccccgatccgcgccgccctcgccgacccggagcccggcggatggtcggcgcgggaatgcgggttcctcgcgcggcgattgattgatcgatcgattcggtggtggtggtggtggtggtggtggtagccgcgcgccaggcggcgatgggctgcttcccgtgcttcggcccggcgcgcgaggaggagctcgagtactacggcgccaagggcggcggcaatggcagtgcggccgcgtcctcgtccgccgccgctggcgggggcggcgcggaggcggcggcgctgtgcgccgagaggatccctgcaggggcagacaagtcgcgggccaaaggcaatgccggctcgaagaaggagctcgcggttctcaaggacgccaacggcaatgccatctctgcgcagaccttcaccttccgccagcttgcagccgcgacgaagaacttcagggatgaatgcttcattggggagggagggttcggccgcgtttacaagggccgtctggacggcacaggccaggttgttgctatcaaacagcttaatagggatggtaatcaaggaaacaaagaatttctagtggaagttctcatgctcagcttgcttcatcatcaaaaccttgtcagtttggttggctattgtgctgatggagatcaacgccttctcgtgtatgaatacatgccacttggatcattggaagaccatctgcatgatctccctcctggcaaggagcccttggattggaacactaggatgaaaattgcagcaggtgctgctaaagggctggagtaccttcatgacaagacacagccaccagttatatacagggacttcaagtcatcaaatattctattgggagaggggttccatgccaagctatccgactttggtcttgctaagttgggtcctgttggtgataagtctcacgtttcaacacgtgttatgggaacatatggttattgtgcccctgaatatgctatgacaggacaacttacagttaagtcagatgtttatagctttggagttgtcttgcttgagttgattactggccggaaggccattgacagcactagaccaaccgcagagcaaaaccttgtttcatgggcacggcctcttttcaatgacaggcggaagctcccaaagatggctgacccagggctggaggggcgattccctacgcgtggactttaccaggcacttgcggtggcatcaatgtgcatccagtctgaggctgcgtcccgcccactcattgccgacgttgtgactgctctttcctaccttgcgaaccagatttatgatcctagtccagccaacaccaccaagaagggcagcggcgaccagagcagggtcggcgacagcgaaagggtggtttccaggaatgaggacacaggcagctctggccataggtctccgagcaaggaccgggacgactctcccagggagcatgccacggggaccgcgaacaagggcctggaaagggagaggatggtggccgaggcaaagatgtggggcgagaactggcgggagaagcggcgtgccactcagggtagcctggattctccaaaaggaggtgggtaacgccactcaccaagggctgttttgcctgtgcgtgtcctctgtctcagacggtgtttttgcctttgtgtggttggttatgaagaagacagaattgggtttctggtgttgttaggtgtacattcgtaggggtaaaacaaaacaaaaacgtgggtgaaaaaagcacagaagggaagcattgggtgctttgctctggatgtggtctgagtcgtgcctgtaaattctcggaaaattttgcaacggtggagggcaagtgtgaacctcattctgtctcaaaaaaaaaaaaaaaaaaaa

SEQ ID NO: 3496 - protein, 473 aa, Panicum virgatum
  misc_feature: Ceres CLONE 1791758
  misc_feature (1)..(472): SWISSPROT Homolog: EC 2.7.11.1 Serine/threonine-protein kinase PBS1
MGCFPCFGPAREEELEYYGAKGGGNGSAAASSSAAAGGGGAEAAALCAERIPAGADKSRAKGNAGSKKELAVLKDANGNAISAQTFTFRQLAAATKNFRDECFIGEGGFGRVYKGRLDGTGQVVAIKQLNRDGNQGNKEFLVEVLMLSLLHHQNLVSLVGYCADGDQRLLVYEYMPLGSLEDHLHDLPPGKEPLDWNTRMKIAAGAAKGLEYLHDKTQPPVIYRDFKSSNILLGEGFHAKLSDFGLAKLGPVGDKSHVSTRVMGTYGYCAPEYAMTGQLTVKSDVYSFGVVLLELITGRKAIDSTRPTAEQNLVSWARPLFNDRRKLPKMADPGLEGRFPTRGLYQALAVASMCIQSEAASRPLIADVVTALSYLANQIYDPSPANTTKKGSGDQSRVGDSERVVSRNEDTGSSGHRSPSKDRDDSPREHATGTANKGLERERMVAEAKMWGENWREKRRATQGSLDSPKGGG

SEQ ID NO: 3497 - DNA, 1413 bp, Panicum virgatum
  misc_feature: Ceres CLONE 1791760
  misc_feature: Encodes the peptide sequence at SEQ ID NO. 3498
aggttacactgccactcaccagtcaccattcaccagtagaggagctggccatggcgcccttctgcgctcctgcgcccactgcagctccccatgccactccaacccctctcaccagctcacggaagcatatcgccatgtgcctctcccccaagctaggcggcggcggccagagggcgcggcctgtgagttcagcagctcctcaggtgcgcgcgttgtcgccggcgacggcggcggaagaagcggcgggttccttccccgcccccgtcaacgtggagtacctggccgctgagttcgccggccacggcgtgggcttcgagcccgttggcgctagctgcgccgtcaagatggcgctgcgcaacggcagcgtggcgcacctgctgctccccagcgggctcgtcacgtcctacaagcccgccatgtggcacggcaccgtcacggaggtgctccacacgaacgtcgccgagggccccggcggccgggccgccatccgcggcggcgtgtccgtggacctccgctgcgccggcggcgacggcgggcggtcgccgagcggggcgtggtcgctccgcgacgtccgggggaaccccacgacctccatcgagatcgagctcgtgtcggcggcgccggggggcgcggccgcggcgaggtgcgtggtaacgctacacccggaggcgctggccacggagctcgcggtgaccaacaccgcgccggcgccgatggcgctgtcgtgcggcgtgtcgaaccacctgcgcgtgagcaccccggacgccacctatgcgctggggctccagggctccgactaccgcagcgtcgagcccgcgctgtcggagttcagcatcatcccgccggactacagggccgccgcagggtcggcccggcaccgatgggcgaacaggggcttcgacatgatcctcgcgggcggcggctgggaccgcggcgcagcggacgacgaccagcccgacggcgaggaggacgacgactacaagcacatgacggacgcgatgtgccgcatctacagccacgcgcccagggacttcaccatcattgacaggggcaggaggaactccgtccgcttgcacaggaggggcttcgaggagctgtacgtgttcagcccagggtcccagtaccagtggtacggcaagtacgcctacgtgaccgtagggcctgccatgctggagcccgtggtgctggggcccggggacacgtggcagggggctcaatacctgcgcaaccccaatgcctaggctcaccatcgttcaccggggcaacaaatgtgaaacgacagacgaggatactggaaatagatgctgtcaatatgctgattacaatgatcaaaagtagaattattatttgatgttgattaatgacaatgccaggttgcaatgttgtcactgacaaaaaaaaaaaaaaaaaaaa

SEQ ID NO: 3498 - protein, 396 aa, Panicum virgatum
  misc_feature: Ceres CLONE 1791760
  misc_feature (1)..(307): Pfam Name: Aldose_epim Pfam Description: Aldose 1-epimerase
MAPFCAPAPTAAPHATPTPLTSSRKHIAMCLSPKLGGGGQRARPVSSAAPQVRALSPATAAEEAAGSFPAPVNVEYLAAEFAGHGVGFEPVGASCAVKMALRNGSVAHLLLPSGLVTSYKPAMWHGTVTEVLHTNVAEGPGGRAAIRGGVSVDLRCAGGDGGRSPSGAWSLRDVRGNPTTSIEIELVSAAPGGAAAARCVVTLHPEALATELAVTNTAPAPMALSCGVSNHLRVSTPDATYALGLQGSDYRSVEPALSEFSIIPPDYRAAAGSARHRWANRGFDMILAGGGWDRGAADDDQPDGEEDDDYKHMTDAMCRIYSHAPRDFTIIDRGRRNSVRLHRRGFEELYVFSPGSQYQWYGKYAYVTVGPAMLEPVVLGPGDTWQGAQYLRNPNA

SEQ ID NO: 3499 - DNA, 2039 bp, Panicum virgatum
  misc_feature: Ceres CLONE 1791772
  misc_feature: Encodes the peptide sequence at SEQ ID NO. 3500
gtgacagcactgcagcgggcagcggtcgcttaaacccgcaagccactcgagggtagagccaaatttcttcgatcgaatcatccccccagttccacctaacggctagaccccgccatgcttttcgccctcctctgcctcctcgccctcgccggcgccgcggcggcggcggcgccaccgccgaacgcgcgcccctgcgcgtcgccggactcggcgagcgcctacccgttctgcgacgcctcgctctccatcccggcccgcccgcgctcgctcgtctcgctcctcaccctcgatgagaagatcgcgcagctgtccaacacggtggacggggtcccgcgcctgggcgtcccgccctaccagtggtggtccgagtccctccacgggctcgccgacaacgggcccgtccgcgccgccaccgccttcccgcaggtcatcctctccaccgccgccttcaaccgctcgctgtggcgcgcggtggccggggccgtagccaccgaggccctcggcatgcacagcgccggccaggcggggctcacgtactgggcgcccaacatcaacatctttcgcgacccgcgctggggccgcggccaggagacgtctggggaggaccccgccgtcgccgccgcctactccctcgagtacgtcaagggcttccagtgggactacggggaggaaggcaggattagactttcggcctgctgtaagcactatacaggctatacagcgtatgacatggagaagtgggagggcttctcgaggtacaccttcaatgccaaggtaactgcacaagatttggaggacacataccagcctcctttcaagacctgcatccaggaggctcgcgccagctgcttgatgtgcgcatataaccaagtaaatggtgtgccgatgtgtgctcgcaaagatcttctgcagaagaccagggatgagtggggcttcaaggggtacattacatctgattgtgatgctgtggcaattatccacgaaaatcagacatacactacttcagatgaggattcaatagcaattgttcttaaggcaggaatggatctcaattgcggttcgttcctagttcgtcatacaaagtcagcaatcgagaaagggaaggttcaagaacaagatatcgatcgtgccctttttaatctattctttgttcaatttcgtcttgggatatttgataagttcaacgacaaccgattggggcccagtaatgtgtgcacggcagaacatagagaacttgcagcagaagctgtaaaacagggtgctgtccttttgaagaacgacaatggttttttgcctctgaagagaagcgaagttaggcatgttgctgttattggaccatctgcaaatgatgcatacgcaatgggtggaaactatacaggtgttccctgcaatcctacaaccttccttaaaggcatgcaagcctatgttgcacaaacaacctttgcttctggatgcaaggatgtttcctgtaactcaacagatttgttcagcgaagccattgaagcagctaaagcagccgatattgttgttgtagttgctgggttgaacctgacagaagagcgtgaagactttgatagagtgagccttctccttccaggcaagcagatgaacctcatacatactgttgctagtgtaacaaagaaaccccttgtattggttctcttgggtggtggtcctgttgacgtttcttttgcaaagcacgatccacgaattgcaagcattctttggcttggatatcctggcgaggttggtgggcaagtccttccagaaattctttttggaaagtacaacccaggaggaaagctggctatgacttggtaccctgaatccttcacggctattccgatgactgatttgatgaacttgtaaagaaacatgctgtaaagattcatcattgagctggatgcaagtacagtaaacatgttgtgaagagacatcataggattagatgcaagtgcagttgttattgcagcataaactgtaagaaataccagagaaatacatccagcacaccattctaaaaaaaaaaaaaaaaaaaa

SEQ ID NO: 3500 - protein, 584 aa, Panicum virgatum
  misc_feature: Ceres CLONE 1791772
  misc_feature (3)..(252): Pfam Name: Glyco_hydro_3 Pfam Description: Glycosyl hydrolase family 3 N terminal domain
  misc_feature (2)..(201): Pfam Name: Glyco_hydro_3_C Pfam Description: Glycosyl hydrolase family 3 C terminal domain
MLFALLCLLALAGAAAAAAPPPNARPCASPDSASAYPFCDASLSIPARPRSLVSLLTLDEKIAQLSNTVDGVPRLGVPPYQWWSESLHGLADNGPVRAATAFPQVILSTAAFNRSLWRAVAGAVATEALGMHSAGQAGLTYWAPNINIFRDPRWGRGQETSGEDPAVAAAYSLEYVKGFQWDYGEEGRIRLSACCKHYTGYTAYDMEKWEGFSRYTFNAKVTAQDLEDTYQPPFKTCIQEARASCLMCAYNQVNGVPMCARKDLLQKTRDEWGFKGYITSDCDAVAIIHENQTYTTSDEDSIAIVLKAGMDLNCGSFLVRHTKSAIEKGKVQEQDIDRALFNLFFVQFRLGIFDKFNDNRLGPSNVCTAEHRELAAEAVKQGAVLLKNDNGFLPLKRSEVRHVAVIGPSANDAYAMGGNYTGVPCNPTTFLKGMQAYVAQTTFASGCKDVSCNSTDLFSEAIEAAKAADIVVVVAGLNLTEEREDFDRVSLLLPGKQMNLIHTVASVTKKPLVLVLLGGGPVDVSFAKHDPRIASILWLGYPGEVGGQVLPEILFGKYNPGGKLAMTWYPESFTAIPMTDLMNL

SEQ ID NO: 3501 - DNA, 1612 bp, Panicum virgatum
  misc_feature: Ceres CLONE 1791775
  misc_feature: Encodes the peptide sequence at SEQ ID NO. 3502
agtatgcacgatgcctgcgtgcgcatcacagctctcgcgcttggacgcttgcctttttgtgactggccggtcgcctggtcccatctgccgccgtggatgcttaaccacggtgatcgctgatttcttcttgcaccatgagtcagtcgaacaccatcccaggtaacctgaccaacccgagctcccccttctccagtctcctcacccttctgcgctcgtctttttagcacacagttcttgcgccccggaaatagtaaccggaaagagcgaagaaaaaacccctcactccactccagactctccagtacacactcacgcacacagagagagcaaggcgatcatgagaaacctcaggaacatcccaagtagctctcagtcgtactaggaggcgcttggatcggagctggggaagaagacaaggcaaccgtggtgatggtcctgggtggtggccacagcaagacggacgagaaccatcaccggaggcgccaccaccgcctctccccgtcaccctttccccgactgcccctcccctgatcgaaaaccctctgtgatccttccttccccttggctcgggatcagaccagccttcttttcttggaatctctgaggatttcgcgtgaagtcgagcgactcggcatgaagagaccgagcggctccgtgtccggcggcagcggcggcggcggcagtcccggcctccttccggttgttcacagtgatgacggctttggcggcgtcggggtggaggaggccgacgaggacatggtgctgtgcggcggcggcggcgggggtgggggcggggagaagaagcggcggctgagcacggatcaggtgcgcgcgctggagcggagcttcgagacggagaacaagctggagccggagcggaaggcgcggctggcgctggacctcggcctgcagccgcgccaggtcgccgtctggttccagaaccgccgcgcgcgctggaagaccaagcagctggagcgcgactacgccgcgctgcgccactcctacgacgcgctccgcgccgaccacgacgccctccggcgcgacaaggacacgctcctcgcggagatcaaggagctgaaggcgaagctgggcgacgaggacgcggcggcgagcttctcgtccgtgaaggaggagccggcggcgtccggcgtcgagccccccgccgcggcggcgcagggctcgtccgacagcgactcgagcggggtggtgaacgacgcggagatgacggcggcgccggagaaggccagcgtccaccccccggcggccgccgccgccgctgccggggcggaggccgaggccgtggtgcccggcgcggcgctccaccacggcgtggtgttcttccacgggcacccgctgaaggtggaggacgacgaggcggcgttcctgggcgacgacgacgccgcgtgcgggggcttcttcgccgacctgcagccgccgccgtcgctgccgtggtggaccgagcccacggagcactgggcctagagccgagccgagccaggccggaccgggccggtccaggccatcgcaagcggttgggttggaataaagaactcgtcagggaagcgggggcgtttctgcaagttttgtaaaataaaaaaaaaaaaaaaaaaaa

SEQ ID NO: 3502 - protein, 282 aa, Panicum virgatum
  misc_feature: Ceres CLONE 1791775
  misc_feature (1)..(55): Pfam Name: Homeobox Pfam Description: Homeobox domain
MKRPSGSVSGGSGGGGSPGLLPVVHSDDGFGGVGVEEADEDMVLCGGGGGGGGGEKKRRLSTDQVRALERSFETENKLEPERKARLALDLGLQPRQVAVWFQNRRARWKTKQLERDYAALRHSYDALRADHDALRRDKDTLLAEIKELKAKLGDEDAAASFSSVKEEPAASGVEPPAAAAQGSSDSDSSGVVNDAEMTAAPEKASVHPPAAAAAAAGAEAEAVVPGAALHHGVVFFHGHPLKVEDDEAAFLGDDDAACGGFFADLQPPPSLPWWTEPTEHWA

SEQ ID NO: 3503 - DNA, 1563 bp, Panicum virgatum
  misc_feature: Ceres CLONE 1791778
  misc_feature: Encodes the peptide sequence at SEQ ID NO. 3504
cagacgaccgcctcctctccacagactactctcgcgcacgccaccgccgaccagcgccgcccaagccgcctccgttcgtctgcccggccgccgaggccgagcgcggccgtcaggccagcttccaccggtgcttcgccgcctcgaattccagcctactactagcaggctccctccccctcagctctatcgcgatggcgtcgagcggggatgcgcccggatctactgatgagaagaaaaccccaaaacctgaaggatcatccaacgagcgccaaggggttcctccagcaggcttttcgaatcctttcgactttgcttctatgcaaagtttgctcaatgatccatctattaaggagatggcagatcaaattgcaaaggatcctgcattcaaccagatggctgagcagctacagaaaggcgctcagagtgcaggagagcagggaatgcctccattggaccctcaacagtacatggaaacaatgcaaaaggtcatggaaaacccccagtttatgacaatggctgagcgtctggggaatgctcttatgcaggatcctgctatgtccagtatgctggaaacctttagtagtccatcacacaaggagcagatggaagagcgtatgtcccgcattaaggaagatccagctttgaaatcaattcttgatgagttagagaatgggggtcctgctgcaatgatgaagtactggaacgaccccgatactcttcaaaagattggtcaggcaatgggaggtagcttcccatttggtgctggttcttctgctgaaccttctggtgccgaagaaactgaggaaggtggagatgaagatgaatccatcgtccatcacacagccagtgttggtgatgatgagggtctcaagaaggcactggatggtggagcagacaaggatgaagaagactccgagggaagaagggccttacattttgcatgtggatatggtgagttgaagtgtgcccaagtccttcttgaggccggtgcagcagtggacgctttggacaagaacaagaacaccccgctgcattacgctgctggctatgggcgcaaggagtgcgtcgatcttctcttgaagcatggtgctgccgtcacactccaaaacctggatgggaagacgcccagcgacgtcgccaagctcaacaaccaggacgaggtcctcaagttgctcgagaaggacgccttcctttaaatcccatggctcttgtaaacacatagacagttggttccagtatggtcatgtttcacatctgtcgactttgttttgctcggatggtcaatactcgtatcagcatttatctgttctgtaagatttgctatctggtctagctggctgctagccttctgcgattcgtgatacagtaaagggggcagctattagaactactgccctgttatgttgtcacggtggcttgtgtgcccctttatttctgttgttttcatgatagaaatcgggattgttaatattactctgttatatatgtttcttgccctcactagcagaaaaaaaaaaaaaaaaaaaaaaaaaaaaaaaaaaacaaaaaaaaaaaaaaaaaaaa

SEQ ID NO: 3504 - protein, 334 aa, Panicum virgatum
  misc_feature: Ceres CLONE 1791778
  misc_feature: The sequence is a functional homolog of  SEQ ID NO 1839 in the  10/374,780 US patent application
  misc_feature: Useful for making plants with modulated growth and phenotype characteristics
MASSGDAPGSTDEKKTPKPEGSSNERQGVPPAGFSNPFDFASMQSLLNDPSIKEMADQIAKDPAFNQMAEQLQKGAQSAGEQGMPPLDPQQYMETMQKVMENPQFMTMAERLGNALMQDPAMSSMLETFSSPSHKEQMEERMSRIKEDPALKSILDELENGGPAAMMKYWNDPDTLQKIGQAMGGSFPFGAGSSAEPSGAEETEEGGDEDESIVHHTASVGDDEGLKKALDGGADKDEEDSEGRRALHFACGYGELKCAQVLLEAGAAVDALDKNKNTPLHYAAGYGRKECVDLLLKHGAAVTLQNLDGKTPSDVAKLNNQDEVLKLLEKDAFL

SEQ ID NO: 3505 - DNA, 1658 bp, Panicum virgatum
  misc_feature: Ceres CLONE 1791783
  misc_feature: Encodes the peptide sequence at SEQ ID NO. 3506
atcaggctccctggccggtcagcatctccccatccgtcccccttgcccttcgtcttcgccttgttcttggcttcctcggggcagggaagggaagaggggaaggaggaggcgagaccctgatttgatctgcttgcttttggttgccgagaagaggagaggggttggtgcagttggaggcgtgcctctgtgtctgtgtgcgcggagatggaccccaagttccccacacccccaccgctaaacaaaacggagcctaccaccgcgacgaccaccaccaccacctcctcgaccgcgcagcagcagcatcagcagctggatcccaaggactaccagcatcagcagccggcgcagcaccaggagcagcaccaccaccacctgcaaatccaaatccgccagccgccacagcaggacgggggcggcggcggcgccaaggagcagcagctgcaggtggcggcgccggcaggggagcggaaggtggcgctcgcgcccaagcggagctccaacaaggaccgccacaccaaggtcgatggccggggccgccggatccggatgcccgcgctctgcgccgcgcggatcttccagctcaccagggagctcggccacaagtccaacggcgagacggtccagtggctgctgcagcaggccgagccggccatcgtcgccgccaccggcacgggcaccataccggcgtccgcgctcgcctccgtcgcgccctcgctcccgtcgcccaactcagggctcgccaggccgcaccaccaccacgcgccccacatgtgggcgccgcccaccgcttcagccggcttctcctcgccggccttcttgaattccgccggcgccggcgccggcgacgccgctggtatcggcggcctcatgcagcggatggggctccccgctggcctcgagatgcccgccgggggcgccgccggagggaccctcggcgccggcggccacatcggcttcgcgcccatgttcgccggacacgccatgccggggctcgagcttgggctctcgcaggatggccacatcggcgtgctcgcggcgcacgcgcagtcgatcagccagttctaccaccaggtcggagctgcgggggccagcggccagctgcagcaccagcatcaccatcaccagcagcaggaggacggtgaggacgaggacgctgagtccgatgaagagtccggccagtagtgtaaccgttcaaccttgcgtttctgggtggttccttgaagaggagaggagaggaaggagagaaaaagtgtatgcacgccgcacgcaggccacgggatgcttctgctactcttgggttattattgttcgtcgagttgtgatgaatttttatgttcatttttttcttgcgtgatatcaaactcaatggaggccttttgctctgaggacttgttggatcaagatcatcccatggttcttcccactattctgtggatgatcacccagagccctctctccgacttccaggtgtataatagctgaaagctggatgaattggatcaatcgcccttgagtgagtgccttatttgtcattgcaaagtgtgtagatattcaggtaattttgctgttagaggtgttctttttatcggagtgatgatccacttattaaaaacaattgaagtagtggccggcaatttgaaaaaaaaaaaaaaaaaaaa

SEQ ID NO: 3506 - protein, 325 aa, Panicum virgatum
  misc_feature: Ceres CLONE 1791783
  misc_feature: The sequence is a functional homolog of  SEQ ID NO 316 in the  10/666,642 US patent application
  misc_feature: Useful for making plants with modulated growth and phenotype characteristics
MDPKFPTPPPLNKTEPTTATTTTTTSSTAQQQHQQLDPKDYQHQQPAQHQEQHHHHLQIQIRQPPQQDGGGGGAKEQQLQVAAPAGERKVALAPKRSSNKDRHTKVDGRGRRIRMPALCAARIFQLTRELGHKSNGETVQWLLQQAEPAIVAATGTGTIPASALASVAPSLPSPNSGLARPHHHHAPHMWAPPTASAGFSSPAFLNSAGAGAGDAAGIGGLMQRMGLPAGLEMPAGGAAGGTLGAGGHIGFAPMFAGHAMPGLELGLSQDGHIGVLAAHAQSISQFYHQVGAAGASGQLQHQHHHHQQQEDGEDEDAESDEESGQ

SEQ ID NO: 3507 - DNA, 3047 bp, Panicum virgatum
  misc_feature: Ceres CLONE 1791790
  misc_feature: Encodes the peptide sequence at SEQ ID NO. 3508
gccactgaagaaagccgctgagcagcagcaagccgcctctcagttgccactgaagaaagccgctcctagcaataattgtattgttggattgttgcatcagatcgatcgagcagctacctatagctagctatagctatctttgcttgcttggataattaattatatatattagacacacaccatctcgttctcgtcagtcagttggatcgatggctttcaaaggacttccacgcgactcccgtggatctttggaagtcttcaatccagacgcgcccaccttgatccgcccaccgaggcgggatcagcccacctccccgttcctcccgagcttcaccatcaccacggatgacgatgaggtgcaggcggaggaagacaaggatgctgccgtgggccgcgccgcgcaaagggccgcggagtggggcctcatcctccagaccgacgagcacaccgaccggccgcagggggtcaccgcccgcccctctggctccggccacgctagcgagagtggaaactccctcgacgagaccgccagggtgctacctcgggtgtcggaggagctccgcgccgcgctctccgcgttccagcagaccttcgtggtgtccgacgccacccgccccgatcaccccatcctctacgctagcgctggattcttcaatatgaccggctactcctccaatgaggtcatcggaaggaactgccgcttcctccagggctccgggacggaccctgccgagatcgccaagatcaggcaggcgctctcagctggctcaaactactgcggccgtcttctcaactacaagaaggacggcacaccattctggaatctcttgacggttgcccccatcaaggatgaggatggcagggtcctcaagttcattgggatgcaggtagaagtcagcaagtacacggaagggagcaaggatacggccgtgcgcccgaatggattgccagaatcacttatcaaatacgatgcaagacagaaggatcaggcccgtagctcagtctctgggcttctgcttgccctcaagaatcctagatcactatctgaatcaagaaactgcaccttcaaaagaaaatcacaggaagcggactgtgtgttttcgactcaagttcctggcaagagaacctccgaaagtcgaatgagaagctctctgcagaaaatcagtgaagtaccccaaggagggaatagaattagtagaaaatccggcttgcgttcacttataggttttcttggtatgggccatggaaataatgtagagaagaacatgctgaaaccaagagaagatccgctaattgacagtgatgatgaaagacccgaaagttttgatgatgatttcaggaggaaagaaatgagaaggggtatagacttggctaccacacttgaacgtattgaaaagaattttgtcatcaccgatccgaggttacctgataatccgattatatttgcatcggatagctttctgcgactgacagagtatagccgtgaagaaatattgggaagaaactgcaggtttcttcaaggacctgaaactgaccgtgggacagtaaagaaaataagagatgccatagataaccaaatagaggtcactgttcagctgataaattacacaaaaagtggtaaaaaattctggaacctctttcacctgcagccaatgcgtgatcaaaagggtgatgttcaatacttcattggggttcagttagatggaactgaacgtgttcaaaatgctgctgcaaaagatggtgccatgctggttaagaaaactgcagacaacattgatgaggctgcaaaggaactaccagatgctaatttgagtctggaggatctattggctaatcactcaaaaccagtcctaccaaagccacatatgaaggatactgcatcatggagagccatccaaaaagttcttgagaatggtgaaagcattgatttaaaacatttcaagccagtaaaacctttaggatctggtgacactggcagtgtccatttggtcgagttgcttggtacaggtgaatactttgcaatgaaagctatggataaaagtgtcatgcttaaccgaaacaaggtccatagagtgacggttgaacgacaaatccttgatatgttggaccacccattccttcccacgttatatgcatcatttcagaccaagacccatatatgtcttattacggactactgctctggtggggaactttttatgctcctcgataggcaacctatgaaggttctaaaggaagatgcagtaaggttttatgctgcagaagtggtcacagcgcttgaatacttgcattgccaaggtataatctaccaagacttgaagccagaaaacattttacttcatagagatgggcacatttccctaacagactttgatttgtcttgcttgacatcttgtgtaccacaggtgtttcttccagaagacaatgataagaagaaaggaaggaggaagagtaggggttctcccatattctttgctgaaccaatgcgagcatcaaattcatttgttggtacagaggagtacattgcgcctgagatcattattggtgctgggcatacaagtgctgtagattggtgggctctaggaattcttctatatgaaatgttgtatggttacacaccatttagaggaaaaacaagacaaaggacctttgcaaatattctgcacaaggacatcaaatttcctacgagtatagaggtcagcttggcggcaaggcagctgatgtatcggctgctgcatcgtgaccctgcaaacaggctggggtcctacgagggtgcttcggagatcaagcaacacaccttcttccgtggcatcaattgggctcttgttcgaactgtcgtgccgcccaagctagaggtggaggatgcaactgcggctactgttagtcacatggatatgttctaaaggagatatataatgttgaaatatatagtagtgtgttagtattatgtcatataagcattgttcgtgtacatggtcgtttagctcgtgtacacgccgtgtacacactatagtggcttaccgtgtcaaaaaaaaaaaaaaaaaaaa

SEQ ID NO: 3508 - protein, 897 aa, Panicum virgatum
  misc_feature: Ceres CLONE 1791790
  misc_feature (11)..(882): SWISSPROT Homolog: EC 2.7.11.1 Phototropin-2
  misc_feature (110)..(882): SWISSPROT Homolog: EC 2.7.11.1 Phototropin-1
MAFKGLPRDSRGSLEVFNPDAPTLIRPPRRDQPTSPFLPSFTITTDDDEVQAEEDKDAAVGRAAQRAAEWGLILQTDEHTDRPQGVTARPSGSGHASESGNSLDETARVLPRVSEELRAALSAFQQTFVVSDATRPDHPILYASAGFFNMTGYSSNEVIGRNCRFLQGSGTDPAEIAKIRQALSAGSNYCGRLLNYKKDGTPFWNLLTVAPIKDEDGRVLKFIGMQVEVSKYTEGSKDTAVRPNGLPESLIKYDARQKDQARSSVSGLLLALKNPRSLSESRNCTFKRKSQEADCVFSTQVPGKRTSESRMRSSLQKISEVPQGGNRISRKSGLRSLIGFLGMGHGNNVEKNMLKPREDPLIDSDDERPESFDDDFRRKEMRRGIDLATTLERIEKNFVITDPRLPDNPIIFASDSFLRLTEYSREEILGRNCRFLQGPETDRGTVKKIRDAIDNQIEVTVQLINYTKSGKKFWNLFHLQPMRDQKGDVQYFIGVQLDGTERVQNAAAKDGAMLVKKTADNIDEAAKELPDANLSLEDLLANHSKPVLPKPHMKDTASWRAIQKVLENGESIDLKHFKPVKPLGSGDTGSVHLVELLGTGEYFAMKAMDKSVMLNRNKVHRVTVERQILDMLDHPFLPTLYASFQTKTHICLITDYCSGGELFMLLDRQPMKVLKEDAVRFYAAEVVTALEYLHCQGIIYQDLKPENILLHRDGHISLTDFDLSCLTSCVPQVFLPEDNDKKKGRRKSRGSPIFFAEPMRASNSFVGTEEYIAPEIIIGAGHTSAVDWWALGILLYEMLYGYTPFRGKTRQRTFANILHKDIKFPTSIEVSLAARQLMYRLLHRDPANRLGSYEGASEIKQHTFFRGINWALVRTVVPPKLEVEDATAATVSHMDMF

SEQ ID NO: 3509 - DNA, 2511 bp, Panicum virgatum
  misc_feature: Ceres CLONE 1791793
  misc_feature: Encodes the peptide sequence at SEQ ID NO. 3510
acgccgtcctctcaaacccttcttcctcccgcggccgtctcgcccccgccccctcccgctcctcccgcgcgccgccatgggctctgtagctggcgacgccgcccgcctcgcgtacccgccggcccgccgcgacgattccgtcgtcgacgactaccacggtgttcaggttcccgatccctatcgctggctggaggacccggactcggaggagacgaaggatttcgtggcgaaacaggcggaactggctgagacggtgctcgccgggtgccccgacagggagaacctgcgccgcgaggtaacgcggctgttcgaccacccgcgctacgccgcgccgttccgccgcgggaacaagtacttccacttccacaattctggcctccaggcccagagcgtactctacatgcaggatgaattggatggaaaggcagaggttcttttggatccaaatactctaagcaaggatgggacagttgctctttcaacatattcaattagtgaggatggaaactacattgcttacgggttaagtaaaagtggtagtgattgggtctctattcatgtgatgaatgttactaaccagcaacctatgcctgacaaactgtcttgggtaaagttctcttctatcagttggactcatgatgggaaagggtttttctatagccggtatccagcacctagagaaggaggggaactggatgctggaactgagacaaacatcaaccttaatcatcagatctattaccatgttttgggaaccaatcagtcagaggacatactgtgctggaaagatcctgaacaccctaagtactcctttggtgcctcagtcactgaagatgggaagtacatcatattgaccgtctatgaaggttgcgaccctgtcaacaagttatactattgcgaaatttcttctcttcctcaaggaatagagggcttcagagagagacaggaaatgcttccatttgtcaagcttattgacaattttgatgctcaatatcaagttgtggccaatgatggcgatgaatttacatttttgaccaataaaagcgcccctaggaataagctggtgagggtaaatatcaagaacccagaactgtggactgatgttcttcctgagcatgaaaaagatgtgcttgagtcagctgacgctgttaacaataaccaattgttggtgtgttatatgtcagatgttaagcatattctgcagttaagagatcttagaactggaaatctaattcatcagttgcctctagagattggttctgtttcagatatctcctgcaaacgggaagataaggaagtatttattggcttcacgagctttctttctccaggtattatttacaggtgtaatttagcacctgcaatccctgaaatgaagatgtttcgagaaatttcagtccctggatttgatcgcacaagttttcaggttaagcaggtttttgtccctagtaaggatggagccagaattcccatgttcataatgtctaagaaagatatcaatctcgatggatcgcacccaactttgctatatggttatggaggattcaacataagcttaactccttcattcagcgttggtcgtcttgtgctatgcaagaacatgggttttgttgtctgtgtagcaaacattcgtggcggtggagaatatggggaggagtggcacaaagctggagcacttgcaatgaaacaaaattgttttgatgactttgctgcttgtgctgaattcctcatttctaatggttacaccagttccagccgactatgtattgaaggtggaagcaatggtggtcttctgattgctgcttccattaatcagcggcctgatctctttgggtgtgctcttgctcacattggtgttatggacatgctccgctttcacaagttcacaattggtcatgcctggactacagactatggttgttcagataaggaagaagagttccaatggctcatcaaatattctccccttcataatgtgcggagaccttgggagcaaagctctggtagccaatgccagtatccagcaaccatgttgttgacagctgatcatgacgatcgtgttgtgccattgcattcactaaagttattagcaacattgcagcatgttctgtgtaccgaggactccccacaaacaaatccaataattggtcgcattgaccgcaagtcagggcatggagctggcaggccaactcaaaaattgattgaggaagctgcagacagatatagctttatggctaagatgttaggcgctcgatggactgaatagtttatttaatccatcttaatgtggagatggtgagcaagatcacccaatgcactgcggagttcatgcttcaggttgatacaaggattcatggaacatagtcgcccccaggagtttgggtgtggcatggtgtgacatcatttaatatatcatttggttcgaaagaatgataatagataatggtagtaatgattctttaagttgtagtgggagaacttgtttggaggcaaaaaaaaaaaaaaaaaaaa

SEQ ID NO: 3510 - protein, 729 aa, Panicum virgatum
  misc_feature: Ceres CLONE 1791793
  misc_feature (1)..(424): Pfam Name: Peptidase_S9_N Pfam Description: Prolyl oligopeptidase, N-terminal beta-propeller domain
  misc_feature (1)..(232): Pfam Name: Peptidase_S9 Pfam Description: Prolyl oligopeptidase family
  misc_feature (13)..(727): SWISSPROT Homolog: EC 3.4.21.26 Prolyl endopeptidase
  misc_feature (13)..(729): SWISSPROT Homolog: EC 3.4.21.26 Prolyl endopeptidase
MGSVAGDAARLAYPPARRDDSVVDDYHGVQVPDPYRWLEDPDSEETKDFVAKQAELAETVLAGCPDRENLRREVTRLFDHPRYAAPFRRGNKYFHFHNSGLQAQSVLYMQDELDGKAEVLLDPNTLSKDGTVALSTYSISEDGNYIAYGLSKSGSDWVSIHVMNVTNQQPMPDKLSWVKFSSISWTHDGKGFFYSRYPAPREGGELDAGTETNINLNHQIYYHVLGTNQSEDILCWKDPEHPKYSFGASVTEDGKYIILTVYEGCDPVNKLYYCEISSLPQGIEGFRERQEMLPFVKLIDNFDAQYQVVANDGDEFTFLTNKSAPRNKLVRVNIKNPELWTDVLPEHEKDVLESADAVNNNQLLVCYMSDVKHILQLRDLRTGNLIHQLPLEIGSVSDISCKREDKEVFIGFTSFLSPGIIYRCNLAPAIPEMKMFREISVPGFDRTSFQVKQVFVPSKDGARIPMFIMSKKDINLDGSHPTLLYGYGGFNISLTPSFSVGRLVLCKNMGFVVCVANIRGGGEYGEEWHKAGALAMKQNCFDDFAACAEFLISNGYTSSSRLCIEGGSNGGLLIAASINQRPDLFGCALAHIGVMDMLRFHKFTIGHAWTTDYGCSDKEEEFQWLIKYSPLHNVRRPWEQSSGSQCQYPATMLLTADHDDRVVPLHSLKLLATLQHVLCTEDSPQTNPIIGRIDRKSGHGAGRPTQKLIEEAADRYSFMAKMLGARWTE

SEQ ID NO: 3511 - DNA, 1937 bp, Panicum virgatum
  misc_feature: Ceres CLONE 1791803
  misc_feature: Encodes the peptide sequence at SEQ ID NO. 3512
accgtgctgcaaaaatcatcgaacgacaccatcaggagttcaggacgagtcgaactcgtttcttcaccgcccgacgccctcctcccgcgcgcccgccgctcgaccgcgcttccatcgctggatctgcgtcaagccatcaccggtgaagagcaggcaccagcggcaggaaagggtgtttcgattgtttgtgcgttggattcgttctctccctcgagtaaaggatcctagaatcctctctgcggatctctagccgtctcgtgtcatctccgagtcggaggaagaagcggatggcatgaagcaacctgccaagaatgaaagcctgggttacccctggtacaagtagaaggacaccatcaactgagccacagggaggaggaggggaaggaagatagggagatgggcaactgcggcacgcgtgaggagaatgccgtcgtcgctgcgcacgcgcaagttcagcagctccacttattacaacatcctgccaagaatgccatcgccgataggaagcacacctgtacctcatcagatttaagtgatccttcaacacctaggaaaattgaagatgccaagaacatttccatatacaatgatgtgattgccttcacattgtttgagctcgagacaatcacaaagagcttccgtgctgattatgttcttggtgaaggaggatttgggaccgtttacaagggttacatcgatgagaatgtcagggttgggctgaagtcacttcctgttgcagtcaaggtgctcaacaaagatggacatcaagggcacagagaatggcttaccgaggttaacttcctggggcaattaaggcacccgaatttggtgaagttgattggatattgttgtgaagatgaccaccggctgcttgtctacgagttcatgtttcgaggaagtctagaaaaccacttattccgaaagacagctatgccattaccctggggtactaggatgtcaatcgcactgggagctgctaaagggcttgcttgcctccacaatgctcaaaggcctgtcatctacagagatttcaagacttcaaatattctgctggactctgattatacagctaaactgtccgactttggcctggcaaaagctggccctgaaggtgatgagactcatgtatcaacacgggtgatgggaacctatggttatgctgctcctgaatatgtcatgactggtcacttgactgccagaagtgatgtctacagctttggtgttgtccttctggagctcttgacagggcgcaagtcaattgacaagtcacggcccagcagggagcagagcctggttgactgggctctcccgaagctcaatgacaagaggaggcttctccaaataattgacccgaaactggagggacagtattcagtcagagctgctcacaaagcctgcagccttgcattctactgcttgagccacaaccccaaggcaaggccgcttatgagtgatgtcgttgaaaccctggagccattgcagggcagtggtggaagtgatggatccggtcaatcttctggccttcctgactatagagctcgtcgcaggctaaccgggaacagtgtccactttagggccatcccaaaccccaagtgctcccctgctgtcccagcatgcagagtgaggtgatggcgatgtttaaattgctgttggaataggttcagttgtatattacgaggtctaaaccgcgggtggtgtgggtgcatgtgtgcacctgttctgtggtgttgtgtgtgtgtgtttcgggttttggccagcgttttgatgtgtaaatttgatctgcatactgctgcttgtaaggccctctaattttcacagtggtcttccttgactgagccctgccaaaacaggcgggttcaggattaaccctagacatgaaaggctgaatggagagaggttggatggttgctatggcagaaaaaaaaaaaaaaaaaaaa

SEQ ID NO: 3512 - protein, 410 aa, Panicum virgatum
  misc_feature: Ceres CLONE 1791803
  misc_feature (46)..(397): SWISSPROT Homolog: EC 2.7.11.1 Protein kinase APK1B, chloroplast precursor
  misc_feature (68)..(384): SWISSPROT Homolog: EC 2.7.11.1 Protein kinase APK1A, chloroplast precursor
MGNCGTREENAVVAAHAQVQQLHLLQHPAKNAIADRKHTCTSSDLSDPSTPRKIEDAKNISIYNDVIAFTLFELETITKSFRADYVLGEGGFGTVYKGYIDENVRVGLKSLPVAVKVLNKDGHQGHREWLTEVNFLGQLRHPNLVKLIGYCCEDDHRLLVYEFMFRGSLENHLFRKTAMPLPWGTRMSIALGAAKGLACLHNAQRPVIYRDFKTSNILLDSDYTAKLSDFGLAKAGPEGDETHVSTRVMGTYGYAAPEYVMTGHLTARSDVYSFGVVLLELLTGRKSIDKSRPSREQSLVDWALPKLNDKRRLLQIIDPKLEGQYSVRAAHKACSLAFYCLSHNPKARPLMSDVVETLEPLQGSGGSDGSGQSSGLPDYRARRRLTGNSVHFRAIPNPKCSPAVPACRVR

SEQ ID NO: 3513 - DNA, 2110 bp, Panicum virgatum
  misc_feature: Ceres CLONE 1791836
  misc_feature: Encodes the peptide sequence at SEQ ID NO. 3514
aatttcggcagccgcagctcttcccttcgcttcgcttgctggtgtccgagagcctcagcttcgccttgctgtcggtctcactccctcggctcttctaccccgcactgtcgccggcgccgggggcgggaactagtcggcgggcgggggcggcgcgcggcgccgggcgcggatcggccgcgggtgcatggtggaggccgccgcggggcgccggtcgggcaccagccgtcggcggcctagcggcagcggaggggagcaccagcgcctggtcgcggtcgccgtcgccgcgcgcgtcgtcatggtcaccacccgctccgcggggccagctgcagctgcaagggaaatggaagggggtggcagcggcggcggcctgtgcgtggaggacttcttccactgccttctcggtgtgctcggagccctcggcgtcacgtggggggcgtccgcgcggccccagaggcagccgcgcccgccgctgccgcgcggagttggcgcggcgcccgcgcccgcggacgcccggcgcttcgcggcggagctcagggcgaccccaggccggatcgccggcaatggcgcctgcgccgtcgcgtctctgtacacgctgcagggcaagaagggcgtcaaccaggatgccatgatcttctgggagaacttctgttcgagagatgatacaatcttctgtggtgtgtttgatggtcatggaccttacggccatttggttgctaagagagtaagagatctcctgcctgtaaagttaggagcagatttggcaatggaagatggtagagaaacatcctctagcaacattaagagcaacacaaatgaagtacgttcaccagaacacatagacagaggagatactgtcatttcctctgaagctgagcagaatggagagtatgcagagatcttcccagcattgagaacttcattcttgaaggccttccatgtaatggatagggatctcaagttacataaaaatattgattgcttcttcagtgggactacagcagtggcagtgatcaagcagggccacaatcttataatcggcaacttgggggattcaagagctgtcttgggcaccagagatgaaaatgatcagcttgttgctatccaattgacagttgacctcaagccgaacattccaagtgaagcgcagagaatcaggcaacgcaggggcagaatatttgcactccctgaggaaccagaggtagctcgtgtttggcttccaaagtacaactcacctggattggccatggctagggcatttggagacttctgtctgaaggatcatggtgtaatttccatgcctgatgtttcctatcaccgcatcacagaaaaggatgaatttattgtgctggctacggatggggtgtgggacgtcctgtcaaatgatgaagttgttagtattgtcagccgagctacatcccaggcctctgcagcacgttttcttgttgaatcagctcaccgtgcctggcgaactcggttccccacatctaaaatcgatgactgtgccgttgtctgcctattcctgaacacagatgaagcaagtaaatcttccagttccatgcccaacaatttggcaaatgctgtagaagttagcaatgatcagcactccacgactgtccagcttagtactggagtgtctgccgatcttgtaactgcactggtaaaagatggaaatgaggtttctgttgtcgaaacagttgcaaggccggtcaccctcgtggatctgccgaaggatggttgaggcacaaagcaaggcatcatcaagtgagattggatgctgcctgtgattgggatctgctgcacaatcagtggttcaggcacagagcgaaggcaactggtacatgctgtgcctgtgattttggcatctgtcagaccgaagatatagcacgtcggggagttgctgcttgctattttttatgcacgcaagtgtgactaggatttgcagttttgccttgtgtaaggtacagcgtcagtttcgcgtccagttctttgtaataattttgttcatgttcatcgtcaagaggttgagatcatagtatcatgtaggaatgagcctattgagttttgttatttcttgtaagtattcatcattcaaaaaaaaaaaaaaaaaaaa

SEQ ID NO: 3514 - protein, 517 aa, Panicum virgatum
  misc_feature: Ceres CLONE 1791836
  misc_feature (1)..(295): Pfam Name: PP2C Pfam Description: Protein phosphatase 2C
MVEAAAGRRSGTSRRRPSGSGGEHQRLVAVAVAARVVMVTTRSAGPAAAAREMEGGGSGGGLCVEDFFHCLLGVLGALGVTWGASARPQRQPRPPLPRGVGAAPAPADARRFAAELRATPGRIAGNGACAVASLYTLQGKKGVNQDAMIFWENFCSRDDTIFCGVFDGHGPYGHLVAKRVRDLLPVKLGADLAMEDGRETSSSNIKSNTNEVRSPEHIDRGDTVISSEAEQNGEYAEIFPALRTSFLKAFHVMDRDLKLHKNIDCFFSGTTAVAVIKQGHNLIIGNLGDSRAVLGTRDENDQLVAIQLTVDLKPNIPSEAQRIRQRRGRIFALPEEPEVARVWLPKYNSPGLAMARAFGDFCLKDHGVISMPDVSYHRITEKDEFIVLATDGVWDVLSNDEVVSIVSRATSQASAARFLVESAHRAWRTRFPTSKIDDCAVVCLFLNTDEASKSSSSMPNNLANAVEVSNDQHSTTVQLSTGVSADLVTALVKDGNEVSVVETVARPVTLVDLPKDG

SEQ ID NO: 3515 - DNA, 2079 bp, Panicum virgatum
  misc_feature: Ceres CLONE 1791885
  misc_feature: Encodes the peptide sequence at SEQ ID NO. 3516
aatccgcgtgtcgccgtctccccgtcggcggacccgaccgctggtttggaagccctcgcattccagaagcatatgccgctcgcgcaccggagcagattcatttgccacgataattaagagcgagcagcgagcataggagggggcactcgccatccgccgatccaccgaggagaagaggggaaccgcaccgcacgcgccgccgcccccccagatctgacccggagcgccgccggcgaggatgcattcgacgaacctgctgctcgaggagcccatccggatggcctccatcctggagccatccaagacgagcttcttccccgcgatgacgaagatcgtcgggacgctggggcccaagtcgcgctccgtcgacaccatctccgcctgcctcaaggccggcatgtcggttgcgcggttcgatttctcgtggggggacgccgcgtaccaccaggagacgctcgagaacctcaagctcgccatcaagacgaccaagaagctatgcgccgtcatgctcgataccgttggcccggagctgcaggtggtgaacaagagcgagaccccgatctcccttgaggagaacgggaccgttgttctaacgcctcatcagggccaagaagcctcctccagcttgctgcccatcaacttctctgggctcgccaaggctgtgacaccaggtacaacaatatttgtggggcaatacttattcaccggcagtgagactacttcagtttggttagaggtttctgaagttaaaggagatgatgtggtttgtataatcaagaacacagctaccttggctgggtcactgttcacactacattgctcccagattcatattgacttacccactctgtctgatgatgataaggatgttatcagaaaatggggtgctccgaataagattgacttcctctctttgtcttacacaagacatgcagaagatgtgcggcaggcacgggagttcctctcgaaattgggtgatcttagccagactcagatctttgccaaaattgagaatgttgagggcctgaatcattttgacgaaatactggccgaggcggatggtatcattctatcaagaggaaaccttggaattgatcttccaccagagaaggtcttcttgtttcaaaagtctgctctacacaagtgcaacatggctggaaagcctgctgttgtcactcgtgttgtggacagtatgaccgacaacctcaggcctactcgtgcggaggcaactgatgttgcaaatgctgttcttgatgggagtgatgccattctccttggtgctgagactctccgcggtttatatccagttgagactatttcaacagtgggaagaatttgtgctgaggctgagaaggtcttcaatcaagatttatactacaagcgaactgtgaaatatgttggggagcctatgacccacttggagtccattgcttcttctgcggtacgggctgctatcaaagttaaagcttctgtcatcatttgcttcacctcttctggacgtgctgcaaggttaatctccaagtacaggccctccatgcctgttctctctgtggtcattccccgtctaaagacaaaccaactgaggtggagtttcaccggtgcatttgaagcaagacaatcactcatagttagaggcctctttccaatgcttgccgatccacggcatccagctgaatctaccagcgctacaaatgagtcagttctgaaggttgctcttgaccacggcaaagcttctggtgtaatcaagtcccatgatcgtgttgtcgtttgccagaaggtgggagattcatcggttgtgaagattatcgagctggacgattagacaagcaccctatgtgcctatgcttgtctactatgggcatgttttgccgattttcgactgggcctaaacttgttggcttttgtgtagtcgtatagctttgcaaaatgagcaccttcccatggtgtcatcataggatttgctttgcatttttaaactcctatggtgctgtttggaagttgccagattattataccacctacgtggcagatggaataatgaaatcgtactgtacccttcaaaaaaaaaaaaaaaaaaaa

SEQ ID NO: 3516 - protein, 527 aa, Panicum virgatum
  misc_feature: Ceres CLONE 1791885
  misc_feature (1)..(350): Pfam Name: PK Pfam Description: Pyruvate kinase, barrel domain
MHSTNLLLEEPIRMASILEPSKTSFFPAMTKIVGTLGPKSRSVDTISACLKAGMSVARFDFSWGDAAYHQETLENLKLAIKTTKKLCAVMLDTVGPELQVVNKSETPISLEENGTVVLTPHQGQEASSSLLPINFSGLAKAVTPGTTIFVGQYLFTGSETTSVWLEVSEVKGDDVVCIIKNTATLAGSLFTLHCSQIHIDLPTLSDDDKDVIRKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLISKYRPSMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 3517 - DNA, 2057 bp, Panicum virgatum
  misc_feature: Ceres CLONE 1791886
  misc_feature: Encodes the peptide sequence at SEQ ID NO. 3518
gccagccggcggcacctacccatctgcatctgcatcggtcacggctaccaacccctcctcctcctccggccgccaataaataccggccgctcgccgcctccgtttcctcagaggagacgctttgccccccgcacgactcctcccaaagcctacctacccctcgccagcctcgcaatcgcaaatggcgctcgccaccaactccgcggccgccgccgccgccgcagcggccgtatccggcggcgcggcgtcccagccgcgccgcgcgaccgcgttcctcccgctgaagaggcgcaccatctcggccatccacgccgccgacccgtcgaagaacaacgggcctgccgtccccgcggcggccgcctccaaggcctcgtcctcggcggtggcgacgccggagaagaagccggcggcgcaggggaagtgggcgatcgacagctggaagtcgaagaaggcgctgcagctccccgagtacccgaaccaggaggagctggacgccgtgctcaagacgatcgagacgttcccgccggtggtgttcgccggggaggctcgccacctcgaggagcgcctggcggaggccgccatgggccgcgccttcgtcctccagggcggagactgcgccgagagcttcaaggagttccacgccaacaacatccgtgacaccttccgtatcctgctccagatgggggccgtgctcatgttcggcggtcaggtgccggtcgttaaggtggggaggatggctggccagttcgccaagccaaggtccgagccattcgaggagagggacggcgttaagctgccgagctacaggggcgacaacgtgaacggagacgatttcaccgagaagagccgtgtgccggacccgcagaggatgatccgcgcctacgcgcagtcggtggccactctcaacctgctccgcgcgttcgcgactggagggtacgctgctatgcagcgcgtcacacagtggaatctcgacttcatggatcacagcgagcaaggtgataggtaccgtgaattggctcatagggtggatgaggctcttggattcatgactgcagcggggcttacagttgatcacccgataatgacgactactgacttctggacctcccacgagtgccttctcttaccatacgagcaggctcttacccgtgaggactccaccagcggccttttctatgattgttcagcccacatgttatgggttggtgagcgaactcgccaacttgatggtgctcatgttgaattcctcagaggtgttgccaaccctcttggcataaaggtgagcgacaaaatgaaccccagtgacttggtgaagctgattgagattttgaacccttcaaacaagcctggaaggataaccataattacaaggatgggggcagagaacatgagagtgaagctgcctcatctcatccgtgctgtccgcaatgctggcctgattgtcacatggattactgatcctatgcatggaaacacaatcaaggccccttgtggtttgaagacacgtccatttgactctattctggctgaagtgcgtgcattcttcgacgtgcatgaccaagaagggagccacccaggaggtatccacctggagatgacagggcagaacgtgaccgagtgcattggtggatcacggaccgtgaccttcgatgacttgagcgaccgctaccacacccactgtgacccaaggctgaatgcctcccagtccgtggagcttgccttcatcattgccgagaggctcaggaagaggaggatgcggtcaggactcaacaacagtctgccgctgccaccactggctctctaaatggctgatgctgaatagagagggtaggaatagttgcgacgacttgaaagcggtggccgatgcctatttattcgttggagggtgctcttagcgttaagttacatgctcgtgagctataggtgtaaaactatgtttttgtttgatgctttgggtgtgagacttgccgacttagctgtttctgttgttttgaccttggtaaggagaaaataaagagagaatgagattgcaacgccaaaaaaaaaaaaaaaaaaaa

SEQ ID NO: 3518 - protein, 540 aa, Panicum virgatum
  misc_feature: Ceres CLONE 1791886
  misc_feature (1)..(438): Pfam Name: DAHP_synth_2 Pfam Description: Class-II DAHP synthetase family
  misc_feature (1)..(539): SWISSPROT Homolog: EC 2.5.1.54 Phospho-2-dehydro-3-deoxyheptonate aldolase 2, chloroplast precursor
  misc_feature (1)..(540): SWISSPROT Homolog: EC 2.5.1.54 Phospho-2-dehydro-3-deoxyheptonate aldolase 1, chloroplast precursor
MALATNSAAAAAAAAAVSGGAASQPRRATAFLPLKRRTISAIHAADPSKNNGPAVPAAAASKASSSAVATPEKKPAAQGKWAIDSWKSKKALQLPEYPNQEELDAVLKTIETFPPVVFAGEARHLEERLAEAAMGRAFVLQGGDCAESFKEFHANNIRDTFRILLQMGAVLMFGGQVPVVKVGRMAGQFAKPRSEPFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSVELAFIIAERLRKRRMRSGLNNSLPLPPLAL

SEQ ID NO: 3519 - DNA, 633 bp, Panicum virgatum
  misc_feature: Ceres CLONE 1791900
  misc_feature: Encodes the peptide sequence at SEQ ID NO. 3520
acagaagcacctatggatacgccgatggctgagagtcagacatcaggagaggattcacagcctccagctgagacaggaatcaacccttccgatctgccccaagaagaacccaagttcttctgtgcttgccggcggcctgccctgaaacggacctccggcacagctcggaatcctgggaggcgcttcttcacctgctattccgggaaagacatttgcaaagtctgggtctgggaagacctccttcagcagtatgttgagaagatggtggattacaacaaatcaacaacacgtgacatggcgatccaagaattagcaatagtcagggaggagcagatctgcgcgctgaaggatgttggccccaagtagcttccctaaagaaggcctggaacagagggagcaactgtatctcaaaacttaaatcgaaaaaggcgtgtatcgccacgaaggattggtaccgagacattcaccctagcttgagctggcttttgctgtagtaaactcaagtgcagtgattgctgggcgtggcatcgtatctgactatcattatctgtggttacatttgggaccctgtattttctatggttttatgccctctgcttagtatcaataataaatattggtttggaacggttg

SEQ ID NO: 3520 - protein, 117 aa, Panicum virgatum
  misc_feature: Ceres CLONE 1791900
  misc_feature (3)..(39): Pfam Name: zf-GRF Pfam Description: GRF zinc finger
MDTPMAESQTSGEDSQPPAETGINPSDLPQEEPKFFCACRRPALKRTSGTARNPGRRFFTCYSGKDICKVWVWEDLLQQYVEKMVDYNKSTTRDMAIQELAIVREEQICALKDVGPK

SEQ ID NO: 3521 - DNA, 1705 bp, Panicum virgatum
  misc_feature: Ceres CLONE 1791913
  misc_feature: Encodes the peptide sequence at SEQ ID NO. 3522
gcagactactccaccaagcacgcgagatcggaagcaaactaagcttcgtcgtcgtcgttcccctttccccgcgtcctaagcaacccaaacaaattccgccctcggattcgatggagagtcaagagagagcaagctgctgcccatcctagctgcttgcattgtcctgtttcgtcgcgagcagcagcttgagatcaggcacggtgagagcagccgccgccatggatcagtgcgacccccacggcaacgggaagacgaagccgccgccgccgaggcgccgggggtggtggcagtgcagcacgacggcggtcacgctgctcatgttcctgctcaccaacaccgtctccatcgtcgtctcctcgagctccgggccctccctcctccgccgctaccggcccgccaccctccgcctctgggacggctccgcggcgctgctcgccgacctcaacgccacgcaggccgcgctcgacgccagccgcgacgagctcgcggggctccacgcccgcgtcggcaccgccaacgagctcctccgcacgctcctccacgccatggcggcgccggacggcgccgccgcggagcagcagcgggaggagctcctggcggcagccggcgggtggaggcgcgagctcgccggggagctcaagctggccgtcgggccactgcactcgctgacgaacgccaccggcggcgacgaggcggcggccgtgttcccggctctgggccacgcgtgcgtccgcgtccaggacgacctggagcgctacatggcctacacgcccggcggggagtgcccggccgacgaggcgctggcgcaccggctcatgctcggcggctgcgagcccctgccgcgacgccggtgccacgcgccgtcgcccaaggggtacgcgcacccgctgccgctgccggcgagcctctgggccacgccgccggacaccagcgtcgtctgggacgcgtacccgtgcaagaactactcgtgcctgcagcaggcgagcacctcctcctcacccggcgtggccggctgcgacggctgcttcgacctgcgcaaggcccggtgggcgcgcgacgacggcgcgctgtcctactccatcgccgccgtgctcgcggcccggcccagcggcacggtgagagtcggcctggacctcggcggcggcggcggcacgttcgcggcgcggatgctggagcgcggggtgaccgtggtgaccgcggccgtgagcgccggcgcgccgctcaacagcttcatcgcgtcgcgggggctcgtctccgtgcacgtcaccgccgcgcaccggctccccttcttcgaccgcgcgctcgacgtcgtgcgcgcgggggcggggggcctcggcggcggcgtgatgctggagttcgcgctgttcgacgtctacagggtgctgaggcccggcagcctcctctggctggaccagttcccctgcccccgcgcgcaggtcaacgcgacgctcgcgccgatgctcggtcgcgtcgggttcaagaagctccggtggaacaccggcccggggaaggagaagaaccagtggtacgtctcggcgctgttggagaagcccatggcataaggaatttgtggttgtcataatcctattatgtaatcttgatttctccttgcctctcacactttgcacgaaatcatattgttctcttcattttttgcttcatatatatttttttaattcgctctcaaaaaaaaaaaaaaaaaaaa

SEQ ID NO: 3522 - protein, 447 aa, Panicum virgatum
  misc_feature: Ceres CLONE 1791913
  misc_feature (1)..(95): Pfam Name: Methyltransf_11 Pfam Description: Methyltransferase domain
MDQCDPHGNGKTKPPPPRRRGWWQCSTTAVTLLMFLLTNTVSIVVSSSSGPSLLRRYRPATLRLWDGSAALLADLNATQAALDASRDELAGLHARVGTANELLRTLLHAMAAPDGAAAEQQREELLAAAGGWRRELAGELKLAVGPLHSLTNATGGDEAAAVFPALGHACVRVQDDLERYMAYTPGGECPADEALAHRLMLGGCEPLPRRRCHAPSPKGYAHPLPLPASLWATPPDTSVVWDAYPCKNYSCLQQASTSSSPGVAGCDGCFDLRKARWARDDGALSYSIAAVLAARPSGTVRVGLDLGGGGGTFAARMLERGVTVVTAAVSAGAPLNSFIASRGLVSVHVTAAHRLPFFDRALDVVRAGAGGLGGGVMLEFALFDVYRVLRPGSLLWLDQFPCPRAQVNATLAPMLGRVGFKKLRWNTGPGKEKNQWYVSALLEKPMA

SEQ ID NO: 3523 - DNA, 1537 bp, Panicum virgatum
  misc_feature: Ceres CLONE 1791988
  misc_feature: Encodes the peptide sequence at SEQ ID NO. 3524
aatccagatcctccagtcgcccacccacccacccacccaccgctttctcctctcccttccttccttcctacctttccctgttcgtgttcgtctcggcttccggtcgctgattccgcggcggagattctgtggtggcggtgctcgttcgctctcgcgcttggggttcgcgtgtgcatggggctcgacgtggcggagatcgggatgggcctggacctggggctcgacctcaggctcttcgccgcgcggagcgccgtcgggatggcggcggccgcggccaagggcgcgcccgcggggatcgaggcctgcatcaggagcctcgaggaggagcgccgcaagatcgaggtcttcaggcgcgagctcccgctctgcgtccgcctcctcgccgacgtgatcgaggagttgaaggaagaggccgcgaggaaaggcggcgatttggagttaaggccggacgacggcgacaagaggaaatggatgagcaccgcgcagctttgggtggactccgacgccacatccaagtccgagaaagagcaaccaagtgagatgacctcgccggagcccaagttgctcggtggccccatgccgatacgggctgttccggtggtgccgccgccgcctccaccgggcttcaggagggatgacaacgctgccggaactgcgaggctgcccggtctgtcgttgctgccaccggctgcaaagacatcggtctctccggtccctgccgttgatgaacaccggcagaacgccgccgcaagattgtctgccaccatgtcaccatctggctctggactcaacctgcatactcagactcaacagcagcaacagctggcgaggaagacaaggcggtgctggtcgccggagcttcaccggcagtttgttgctgccttgcatcaactcggcggccctcaagttgctactccgaagcagatcagagaggtgatgcaagtggacgggcttacaaacgacgaagtgaaaagccatctccagaagtaccggctgcacaacagaagatcgcccggcatggctcccgtgagccagtcgattgtgctggtgggtggcctctggagttctcaggagcaaagcagctcacagtcacagtcagggtctcctcagggcccccttcagttctctgggtcagggatggccgtctctgcagccaccgtcggcggcgacagcagcagcagcgacgaagatgacaagtccgatgaaggctacagccggaaatgattgcaaggctgcgtttgcagaagatcggttgagagtgtagaggtagcatcgcggctttgcgcatcggtggcaataacaggttcatcagtcagggagaggctgtagtgcagccaggccatgcacgcagggagattgggcggtgagtgctcaagagatgaactgatcatgagtttggttgttggttgtcatgtacatgaaaagctgataccagttttcatgaggcttcttgactttagttcccgggcagatccaaattttcgccctgagaattatatacatgcaagattattcacaaaaaaaaaaaaaaaaaaaa

SEQ ID NO: 3524 - protein, 349 aa, Panicum virgatum
  misc_feature: Ceres CLONE 1791988
  misc_feature: Great-hit functional homolog of the protein sequence given in SEQ ID NO 9398
  misc_feature (1)..(52): Pfam Name: Myb_DNA-binding Pfam Description: Myb-like DNA-binding domain
  misc_feature: The sequence is a functional homolog of  SEQ ID NO 132 in the  10/666,642 US patent application
  misc_feature: Useful for making plants with altered Lignin content
  misc_feature: Useful for making plants with modulated growth and phenotype characteristics
MGLDVAEIGMGLDLGLDLRLFAARSAVGMAAAAAKGAPAGIEACIRSLEEERRKIEVFRRELPLCVRLLADVIEELKEEAARKGGDLELRPDDGDKRKWMSTAQLWVDSDATSKSEKEQPSEMTSPEPKLLGGPMPIRAVPVVPPPPPPGFRRDDNAAGTARLPGLSLLPPAAKTSVSPVPAVDEHRQNAAARLSATMSPSGSGLNLHTQTQQQQQLARKTRRCWSPELHRQFVAALHQLGGPQVATPKQIREVMQVDGLTNDEVKSHLQKYRLHNRRSPGMAPVSQSIVLVGGLWSSQEQSSSQSQSGSPQGPLQFSGSGMAVSAATVGGDSSSSDEDDKSDEGYSRK

SEQ ID NO: 3525 - DNA, 1951 bp, Panicum virgatum
  misc_feature: Ceres CLONE 1791992
  misc_feature: Encodes the peptide sequence at SEQ ID NO. 3526
gcatggctgttgcagtcagcaacagctctcgtctttaaatcacagcacacgaggcccccccccggccctcgtcctcttctcgtcgtcgcagcgagcgccccccagtccccagagcaaccgagtagagcgcggcgggcgatggggagcgaggtgaacggcggcggcggcgcggaccggccggcggcggatgtggaggcggagaagaagagcggggcgccgccgttcgaggtgccggaggtcaggttcaccaagctcttcatcaacggctgcttcgtcgacgccgtctcgggccggacgttcgagaccagggatccgcgctcgggggacgtcatcgctagcgtcgccgaaggtgacagggaggacgtcgacttggccgtgaaggcggcgagggacgccttcgaccatggcgagtggcctcgcatgtccggatccgagcgcggccggatcatgacgaggttcgccgagctggtggagcggcacgcggacgcgctggcggcgctggagagcctggacggcggcaagctcccggccgtgaccaaggcggtggacatcggcaacgccgccggcagcctgcgctacttcgccggcgcggccgacaagatccacggcgagacgctcaagatgcggggccagttccagggctgcaccctgcgcgagccgctcggcgtcgcggggctcatcatcccctggaacttccccaccaccatgttcgccatcaaggtggcccccgcgctggccgccggctgcaccgtggtcgtcaagcccgccgagcagacgcccctcagcgccctcttcctcgccgacctggccaagcaggcggggatccccgacggggtgatcaatgtcgtgccaggcttcggcccaacggcaggagctgcgatcgcgtcccacatggacgttgacacggtcagtttcaccgggtcgacggaggtggggcgcctcataatggaggcctcggcgaggagcaacctgaagccggtgtccctggagctgggcggcaagtccccgctcatcatcttcgacgacgccgacctcgacatggccgtcgagctcgccatcagcgcaaacttcttcaacaagggggaagcctgcgtcgccgcgagccgcgtctacgtgcaggagagcgcctacgaccggttcgagaagaagctggcggagaggatgaggagctgggtggtgggagaccctctgaacgatcctcgtgtcgaccagggccctcaggtggacaaggctcagtacgagagggtgctgagctacattgagcatggcaagagagagggcgccacccttctgacaggaggaagaccctgtggccagaaaggctactacatccagccggcagttttcaccaacgtcaaggaggacatggtcatagcaaaagaggagatcttcggacccgtcatgtgcctgatgaagttcaagacggtggaggaggcgatcgcgagggcgaacgcgacccggtacgggctgggcgcgggggtggtgacgcgggacatggacgtggcgagccgggtggtgcggtcggtgcgcgccgggctggtgtgggtgaactgctacttcgccctctccaacgactgccccttcggcgggcgcgggatgagcggcttcggcggggacgagggcatgcaggcgctcgacaagtacctcgccgtcaagtgcgtcgtcgccccgctccgcggctcgccgtggatgtgattccgatcgccgggccgcgtcgtgcggtgcaacgccgcgccgccggctgttaagaagtacgagtcctggtagggttgaagaagaagaataaagtgatgggaaaaaaaactgagatctgtatatgttggtaccaattggtgcgttctgcgttcatgtacagggattcttcttctttctcgttttagacctccattcggaacaggggatttatttccgttaaaaaatgtttatgctcgaaaaaaaaaaaaaaaaaaaa

SEQ ID NO: 3526 - protein, 518 aa, Panicum virgatum
  misc_feature: Ceres CLONE 1791992
  misc_feature (3)..(464): Pfam Name: Aldedh Pfam Description: Aldehyde dehydrogenase family
  misc_feature (10)..(518): SWISSPROT Homolog: EC 1.2.1.3 Aldehyde dehydrogenase 2B7, mitochondrial precursor
  misc_feature (18)..(518): SWISSPROT Homolog: EC 1.2.1.3 Aldehyde dehydrogenase 2C4, cytosolic
MGSEVNGGGGADRPAADVEAEKKSGAPPFEVPEVRFTKLFINGCFVDAVSGRTFETRDPRSGDVIASVAEGDREDVDLAVKAARDAFDHGEWPRMSGSERGRIMTRFAELVERHADALAALESLDGGKLPAVTKAVDIGNAAGSLRYFAGAADKIHGETLKMRGQFQGCTLREPLGVAGLIIPWNFPTTMFAIKVAPALAAGCTVVVKPAEQTPLSALFLADLAKQAGIPDGVINVVPGFGPTAGAAIASHMDVDTVSFTGSTEVGRLIMEASARSNLKPVSLELGGKSPLIIFDDADLDMAVELAISANFFNKGEACVAASRVYVQESAYDRFEKKLAERMRSWVVGDPLNDPRVDQGPQVDKAQYERVLSYIEHGKREGATLLTGGRPCGQKGYYIQPAVFTNVKEDMVIAKEEIFGPVMCLMKFKTVEEAIARANATRYGLGAGVVTRDMDVASRVVRSVRAGLVWVNCYFALSNDCPFGGRGMSGFGGDEGMQALDKYLAVKCVVAPLRGSPWM

SEQ ID NO: 3527 - DNA, 1771 bp, Panicum virgatum
  misc_feature: Ceres CLONE 1791997
  misc_feature: Encodes the peptide sequence at SEQ ID NO. 3528
gccgagctctgcaggtcgatccatcgatccggagacagacgaaatctcgttccgacagagcgatcgctcctgccgcggctgcttgcttccctcttccttgcagctacgatgcggtagaaaaatatactgctgcaagaaaattccaagaacgcaggcagagaaacggagttcccagctgttcgtgagagtggtggagtgggagggcgctgagatggcggagtgcagagtcggaggaggcggcggggattgcttgattaagctgttcggaaagaccatcccggtgccggaggtcgtcgccgccgccgccgccgccgtgggcgaggctgacaaggacatccaacaaagcggcagcagcacgtctgaactgaaaggacaagagaacacccttcaggactctacgggctcgcctctgcagcatgaggttgcagacactgaagattcatcagctgccaagaactcgtcaggagaccagcagcagggcgagacggccaaccagaaggagaagctgaaaaagcctgacaagatcttgccgtgcccccggtgcaacagcatggacaccaagttctgctactacaacaactacaacatcaatcagccgcgctacttctgcaagaactgccagaggtactggacggccggcggtgccatgcgcaacgtgcctgtgggtgcaggacggcgcaagagcaagagtgcgtcggccgcttcccacttccttcagagggtcagggccgcgttgcccatcgatcctctttgcacggcagccaagactaatggcacagtgctcagctttggctccgacatgtcctctttagacctctcagaacagatgaagcacctaaaggagaaacttgtcccaataacgcggatcaagagcagcgatgaccgatcagttggttcttgcactgaaggatctgcaaagggagaagactcgaaccaaatgaaccaaaaggagaaagttacagcagataaatctgcaaatgttgttcagcatccatgcatgaacggggtaaccatgtggccatttagctgtgcaccaccacctgcctgttacacatcaggcatcgcaattccgttctacccagcagctgctgcctactggggctgcatagttccaggagcttggaacgccccatggccgcctcactcccagtctgagtctgcttcatcgcttagcactgcttctccagcatccacaaagtccaattgcctcacgccaggaaagcgctctagagactctgatgaggaaggagacaccaaaggaaatggcaaggtgtgggtgccgaagacgatccggatagatgacgcagacgaggtggccaggagttccatcttgtcactaattgggatcaatggcgataaggtgggcaaagatggcagagggtgcaagctttcaagagtttttgagcagaaggaagaggcaaagacagcaactcacgcagtgatcaacagcttgccattcttgcaagggaacccagctgcactctcacgttcactgaccttccaggaaggatcttgagtatcaccttagcctcaaagatataaagaccaaccatttatcatggtacagttgaaattttgtacattagaggattgtaaactaggtatggacagtggagtgtatgacatagctcatagctgcaagcggaccttgtaactacaatagatatttgtagatagctatataggttggggagggatagggagagcaagttcccttatatgtggataaataatataataattttggttacaaaaaaaaaaaaaaaaaaaa

SEQ ID NO: 3528 - protein, 434 aa, Panicum virgatum
  misc_feature: Ceres CLONE 1791997
  misc_feature (1)..(63): Pfam Name: zf-Dof Pfam Description: Dof domain, zinc finger
  misc_feature: The sequence is a functional homolog of  SEQ ID NO 112 in the  10/666,642 US patent application
  misc_feature: The sequence is a functional homolog of  SEQ ID NO 1131 in the  10/374,780 US patent application
  misc_feature: The sequence is a functional homolog of  SEQ ID NO 1132 in the  10/374,780 US patent application
  misc_feature: The sequence is a functional homolog of  SEQ ID NO 1133 in the  10/374,780 US patent application
  misc_feature: The sequence is a functional homolog of  SEQ ID NO 1330 in the  10/412,699 US patent application
  misc_feature: The sequence is a functional homolog of  SEQ ID NO 1331 in the  10/412,699 US patent application
  misc_feature: The sequence is a functional homolog of  SEQ ID NO 2352 in the  10/374,780 US patent application
  misc_feature: The sequence is a functional homolog of  SEQ ID NO 724 in the  10/225,066 US patent application
  misc_feature: Useful for making plants with modulated growth and phenotype characteristics
MAECRVGGGGGDCLIKLFGKTIPVPEVVAAAAAAVGEADKDIQQSGSSTSELKGQENTLQDSTGSPLQHEVADTEDSSAAKNSSGDQQQGETANQKEKLKKPDKILPCPRCNSMDTKFCYYNNYNINQPRYFCKNCQRYWTAGGAMRNVPVGAGRRKSKSASAASHFLQRVRAALPIDPLCTAAKTNGTVLSFGSDMSSLDLSEQMKHLKEKLVPITRIKSSDDRSVGSCTEGSAKGEDSNQMNQKEKVTADKSANVVQHPCMNGVTMWPFSCAPPPACYTSGIAIPFYPAAAAYWGCIVPGAWNAPWPPHSQSESASSLSTASPASTKSNCLTPGKRSRDSDEEGDTKGNGKVWVPKTIRIDDADEVARSSILSLIGINGDKVGKDGRGCKLSRVFEQKEEAKTATHAVINSLPFLQGNPAALSRSLTFQEGS

SEQ ID NO: 3529 - DNA, 2512 bp, Panicum virgatum
  misc_feature: Ceres CLONE 1791998
  misc_feature: Encodes the peptide sequence at SEQ ID NO. 3530
tccccgaaagtttcctctcccccttccgagttccgacctcgtcgtcccggctccagttcttcccattcattccctcgcaccgaagcaacaacgactccgcgcgcacgccaaaaccctaggcccagatcccgcgctcgcccgcctcctcctccgcctctaacccttgctggatcccgctcgccgtcccccggcgcccaggcgacggcgacggcgcccgcggcggccattgcctctcgccgcattggggagctcacggtgccgccttcgctcgcggggcggagatccgggtcgaggaggaggtgattggccgcggggcgcaggggatggggcgggggcggcgggccccggggatccgcgcgctggcgctggtgctgctcgcggttgcggcagccgcgggagtcgccgcgggggatcccgatcccgacgagctcgagcgcgcgtttccaatagtggagccagaccatggacacactaaacttcgtctctcagaacaaggtctagatgcaattcgcaggattgaaaatcctattgctgtcgttggtgtcattggtccctatcgatctggaaaatcttttctcctcaaccagcttctctccttgtcatgtgataaaggttttggagttggtcatatgcgtgatactaaaaccaaaggtatatggatttggggtactcctgttgagatggatgttgatggttccaaagtttctgtcctttatctagacacagaaggatttgaaagtgttgggaaatcaaatgtatatgatgacaggatatttgctttggcaactgtcttaagttcggtgcttatctacaatcttcctgagacggtgcgtgaagctgatatttctaggctttcatttgctgttgaaattgctgaagaattctatggaagagtgaaggggcaagatgtggcttttgagcctgcaaagcttctctggcttatccagagagatttcctccaaggaaaatctgtacagcaaatggttaatgaagccctccaacgggtgcctaatgataatggggacaaatatatcgatgaggtcaatcaaattagagattctttggcagttatgggtgacaacagcactgcttttagcttgcctcagcctcatctgcaaagaacaaaattatgtgatatggaggacaaagagcttgaaccgttatatgtaaaacggcgcgaacaattaaagcatctggttgcatccatcataaaaccgaaaatcgtgcaggggaaaactctgaacggaaaggactttgtgtctttcctgcagcagattctagaggctttgaataaaggtgaaattccatcaacaggatcccttgttgaaatttttaataaagccattcttgagcgctgtctgaaggtgtatagggagaaaatggatggcttaggcctaccagtacctgtagaaaaactgcagcaagttcatgagatggcaaatgatgaagccagaattatctttgataagcagcactttggtaaacatcatgcggctcagtcggtcctcaagcttgaagacgagattaaaaaggtgtacagaaatttccttctagctaatgagtatcaatcatcaaagctttgtgaagctcgcttttctgagtgtgaagataagatggatcaccttcaagtattgaaacttccttcaatggcaaaattcaatgcaggctttactcactgcaaccaaagttttgtaagggaatgcgttggacctgcaaaagaaagctatgaacgtagaatgtcaaagatgcttgtcaaggctcgtgctcttttcatcaaagaatacaataacaagcttttcaattggttggtgaccttctccttggtcatggtggtcatcgggcgctttgttatcaagttcttcttacttgaaattgttgcttgggtgatgtttatcttcctagagacctacacgagaatgttctggtcagcagagtcgctgtactacaatccagcttggcacatcattgtttcttcctgggagaccatcgtgtacagccctattcttgatctggacagatggggtatccccattgtcataatgctgtcatttgggattctttactggagatgctttggtggtaaaaggaaacggggcaggggttccatcctaccagtgtacaagaactcatacaagaactcaactcgcccaagatcagactagtgatatcaaatgattgtttttttttctttttgaagaatggtacaaaatataaacttatatagaagagaagcaaactgcccattgtgcatcatctatccgtgctgttggatgggcatgtttgacagtgctctgccaatgcatctccgattctttttggtcgatgaagagaggcagtgaaactacaggctttggggcacttgcgcaagcttctgttgtaattcagacaccaggatataatatccatcttctgtagctagtctgttcttacgacctctccattcattgattattgtttacatccactgcaatggttacaagaattttgttcttaaaaaaaaaaaaaaaaaaaa

SEQ ID NO: 3530 - protein, 612 aa, Panicum virgatum
  misc_feature: Ceres CLONE 1791998
  misc_feature (1)..(131): Pfam Name: GBP Pfam Description: Guanylate-binding protein, N-terminal domain
MGRGRRAPGIRALALVLLAVAAAAGVAAGDPDPDELERAFPIVEPDHGHTKLRLSEQGLDAIRRIENPIAVVGVIGPYRSGKSFLLNQLLSLSCDKGFGVGHMRDTKTKGIWIWGTPVEMDVDGSKVSVLYLDTEGFESVGKSNVYDDRIFALATVLSSVLIYNLPETVREADISRLSFAVEIAEEFYGRVKGQDVAFEPAKLLWLIQRDFLQGKSVQQMVNEALQRVPNDNGDKYIDEVNQIRDSLAVMGDNSTAFSLPQPHLQRTKLCDMEDKELEPLYVKRREQLKHLVASIIKPKIVQGKTLNGKDFVSFLQQILEALNKGEIPSTGSLVEIFNKAILERCLKVYREKMDGLGLPVPVEKLQQVHEMANDEARIIFDKQHFGKHHAAQSVLKLEDEIKKVYRNFLLANEYQSSKLCEARFSECEDKMDHLQVLKLPSMAKFNAGFTHCNQSFVRECVGPAKESYERRMSKMLVKARALFIKEYNNKLFNWLVTFSLVMVVIGRFVIKFFLLEIVAWVMFIFLETYTRMFWSAESLYYNPAWHIIVSSWETIVYSPILDLDRWGIPIVIMLSFGILYWRCFGGKRKRGRGSILPVYKNSYKNSTRPRSD

SEQ ID NO: 3531 - DNA, 1304 bp, Panicum virgatum
  misc_feature: Ceres CLONE 1792015
  misc_feature: Encodes the peptide sequence at SEQ ID NO. 3532
aaaccaacccgtgcgaaccatttctcaactacacgtagtacgtcatggtacaaatggcctcctcgaagctcatcgcagtagcttttctctcctctcttgtggctgctccaacgatgaccactgcagcaaactccaacctcttcagagactacatcggcgccatcttcaatggcgtcaggttcaccgacgtgcccatcaaccccggcgtccggttcgacttcatcctcgccttcgtcatcgactacaccaccgcgacggagccgcccaccccgaccgacggccggttcaacatcttctggcagagctcggtgctgagcgcctccgcggtggcctccatcaagcagagcaaccccaacgtgcgggtcgccgtcagcctcggcggcgccaccgtgaacggccgcccggtgttcttcaacatcacctccgtcgactcgtgggtccagaacgccgtcgcctccctcaccggcatcgtccaggagtacaacctcgacggcatcgacatcgactacgagcagttccaggtcgacccggccaccttcgccgagtgcgtcggccgcctggtgacggcgctcaagagcaacggcgtgatcaagttcgcgtccatcgcgccgttcgacaacgccgacgtgcagcgccattaccaggcgctgtgggcgggctacgggagcgtgatcgactacgtcaacttccagttctacgcgtacagcgccagcacgacggaggcgcagtacgtgagccacttcgacgaccagatcgccaactaccccggggggaacatcctggcgagcttcaccacggcgccgacgaccacctcagtgcccatcaacacgtcgctgaacgcctgccggacgctgcagtcgcaggggaagctctacggcatcttcatctgggctgcggatcattccaggagccaagggttcagattcgacacgcaggcgcaggcgctgctcgccaacgcccccagctactagccaccttgcttcattttgttccagtttgattttccatcagggggctatatatttagtggattaataatattgttggagcaagaatggggaataaaatttcaattgtaatgcagctatgctttatttaaataaactgttagcagagctctccgaatttcgctgaataaactgttgtagtttgtgtgcttcgtttactctgccttttattttcctattgtaatgcagctgtgctttgagaatcatttgttttttgctaggtccagactaattgaataatacaaaaccaaatactattatttggtactattcattcaaaaaaaaaaaaaaaaaaaa

SEQ ID NO: 3532 - protein, 308 aa, Panicum virgatum
  misc_feature: Ceres CLONE 1792015
  misc_feature (1)..(246): Pfam Name: Glyco_hydro_18 Pfam Description: Glycosyl hydrolases family 18
  misc_feature (2)..(307): SWISSPROT Homolog: EC 3.2.1.14 Chitinase 1 precursor
  misc_feature (32)..(304): SWISSPROT Homolog: EC 3.2.1.14 Chitinase 2
MVQMASSKLIAVAFLSSLVAAPTMTTAANSNLFRDYIGAIFNGVRFTDVPINPGVRFDFILAFVIDYTTATEPPTPTDGRFNIFWQSSVLSASAVASIKQSNPNVRVAVSLGGATVNGRPVFFNITSVDSWVQNAVASLTGIVQEYNLDGIDIDYEQFQVDPATFAECVGRLVTALKSNGVIKFASIAPFDNADVQRHYQALWAGYGSVIDYVNFQFYAYSASTTEAQYVSHFDDQIANYPGGNILASFTTAPTTTSVPINTSLNACRTLQSQGKLYGIFIWAADHSRSQGFRFDTQAQALLANAPSY

SEQ ID NO: 3533 - DNA, 1790 bp, Panicum virgatum
  misc_feature: Ceres CLONE 1792057
  misc_feature: Encodes the peptide sequence at SEQ ID NO. 3534
gacccgacccgcacccgccgcctcctctcctctgctactcgcgccgaagcaggcggcggcagcggcggcggcggcgcagcgaccatcaccgcggggactccgggagaaggcccacgtagaggtgttgcgagtttcattcgttggagtcgtggctcgcgcgtgaatcaaccatccaccacccccgccatggcgttctggggttggtggatgcaggggtcgaggtgaagcccgggaagccctacacccacacctaccaggctgaccatggccgcctccgtatctgccaggctacacttagcaattgtgatgcttctggaaggactgtcctgcaatgcaatgttggcaacaagattcccatcaaactttgtagtttaaatccaaaattggcggagatgtgccatctagagattgagttagaggaggttgatgatgttgtcttctcagtaattggtcagagttccattcatctctccggatattatgtccgtgcaagcagcaggtctaatgcgggagatgatgaatcagaatcttatggggaagatattggacagtctgacacggatgaggagcatgatgccaatgaggacagctatgaatctgactttattgatgatcgtgatgttataactgttagtgatgatgaatgctcctctccacgccgcggcaaacaagcttctggaaaacagattcgtaaggctgaaagacggcagcgcttgaagaagcatcaagtagatagcacagatgatgatgattctccagtgatgaagcctgctgtcaaggacaatgcttgtgcaatatttgatagtggcagtgatgaagataatgtgcctatatctgttgcattgggcaagaaagacagtgctaaggttgctgtcaagcacaatgctcgttcaatatttgataggtgcagtgatgaagaagataatgattttgcattgagtaagaaagacagtactaaagtttctgaggaaaccaacctccaaaatggacagacaaatgatggaaccaaaaaaaatagtgatgacaagaaaagaaaaagttctgtcatcagtgaggatcctgcatcgtcaatggatatggcagatgctaatgcaccatctgttacaaagcaaggttctgatgtaaaaaagaaatcaaagaaaaagatgaaaaagcaatcaggtggaaaagatgagaaacagtccaatataagaacattggatgatgggttgctggtagaagatctgtctacaggaaacatagatgcaaaagtggcttctgatggctgcaaggtttatatcaaatatgttggcatgttgaaggatggggaaattgttgaatctaatcttagtgaaaaaccttacaagttcaagcttggtgctggaaaagttatccgtggatgggatgttggtattcgtggtatgcgtgttggggagaaaaggaggctgacagtcccaccttctatgtgctctggtggtaaatcagttgtagaagtacccaaaaattcttcagtcatctacgaaattgagttggtgaaagtgaaatagagaggaaacccacatgccaggattttgcacgtcgcctttgctgacagctgcaattaggaatagatggattttgttgtgctgtgaatggcatacgtttatattgtgtttcacctggtttatggttaatctcagttttgtttaggtggaattactgtgcacctctatctgaagccagagtactaaaatgatttgtcgcacggtggggcatttaatgctactgaacctttggcctgtggtcacctccaaaaaaaaaaaaaaaaaaaa

SEQ ID NO: 3534 - protein, 377 aa, Panicum virgatum
  misc_feature: Ceres CLONE 1792057
  misc_feature (1)..(78): Pfam Name: FKBP_C Pfam Description: FKBP-type peptidyl-prolyl cis-trans isomerase
MCHLEIELEEVDDVVFSVIGQSSIHLSGYYVRASSRSNAGDDESESYGEDIGQSDTDEEHDANEDSYESDFIDDRDVITVSDDECSSPRRGKQASGKQIRKAERRQRLKKHQVDSTDDDDSPVMKPAVKDNACAIFDSGSDEDNVPISVALGKKDSAKVAVKHNARSIFDRCSDEEDNDFALSKKDSTKVSEETNLQNGQTNDGTKKNSDDKKRKSSVISEDPASSMDMADANAPSVTKQGSDVKKKSKKKMKKQSGGKDEKQSNIRTLDDGLLVEDLSTGNIDAKVASDGCKVYIKYVGMLKDGEIVESNLSEKPYKFKLGAGKVIRGWDVGIRGMRVGEKRRLTVPPSMCSGGKSVVEVPKNSSVIYEIELVKVK

SEQ ID NO: 3535 - DNA, 1777 bp, Panicum virgatum
  misc_feature: Ceres CLONE 1792061
  misc_feature: Encodes the peptide sequence at SEQ ID NO. 3536
cacccacgcaagctcgtttacgttctcagcccaggccaaagctcaaaaccactaagaaagaaagccaaaacattctcctggaaacatggtgacaatggagaacggtgtatccaatggctcagcggcgcgcctcccacatgtcgtgatgctggcaacgccgggtatgggccacctcatcccgcttgccgagctagcgaagcgcctagctgcccggcatggtgttacggccacgctcattgccttggcctccacagtatccgtaacgcagcgcgccttcctggcctccctcccgccatcaatcacctcactccacctcccgcccgttgacctctctgatctgccgcacggcacagccattgagacgttcatgtccgaggagtgtgcccgctccatccctgccctcacgcaggttctcaccaagctgaaggagactaaccgtctcgttgccttcatcaccgacttcttcggcatggactcgttcgatgccgcgtccaatgctggtgttgaaaggaggtacctgttcatccccaccaacctccacatgctgatgctattgcttcacctacctgagctcgacctttcaatccccggcgagttccgggaccttgccgagccactccagctgccaggatgcgtgccaattcctgggatggacattctgtcaccgctgcaggacagggccaacccatgctaccggtggatggtccaccacgcttcacgcaccaaggaagctgatgccatccttgtcaattccttcgatgccgtagagccggaggccgccgcggtgctccaccaacaggagcttggccacccacccgtgtacaatatcggcccgctcatactaaccaggagcaaatccaccggtgttatgagcacggcgcctccagcctcgtcgcgtgcggagtgtcttgactggctcgacctacagccagccagatcggtgacctttgtctccttcggctctggtggtgcgctgcctactgagcagatgcgagaacttgcgctcgggctagagctgagtgggcagcgattcctgtgggttgtgaggagcccaagtgatgaggggacagtgagcgacaactactatgatgccgagagcaagaaggacccttttgtgttcctgccggaagggttcattgaaaggaccagagatgttggcttcctggtgtcctcatgggccccacagatagatgtattgagccatgaagccacaggaggtttcctaacacactgtgggtggaactctaccttagagagccttatccatggagtgccgatggtggcatggcctctatacgctgagcagcatcaaaatgcagtgatgctagatgagggtataggggccgtgatacggttgcctgagccaaaggggaaggatatgatcgctcgggtagtgaaggagcttatggtaggggaagggaagggtgcagcagtgcgaaccacggtagcaaagcttcaggagaacgcattacagggcctaacagagggtggtgctgccgcgactgcattagccgagctggtagagaagtgggaagttggggagaactagtccgtgccccttcgaatcatttgctactctttgctatgcatatcactctcgaacttgattttaaatgacacatgtctcatattgtaatttcttagaactattccattgccactactttgctttgcttgtactaagggaacaatgtgctttccttcccttcacatttgtaatttaagcttttgaataaagggaacaatgtggattgtataaaaaaaaaaaaaaaaaaaa

SEQ ID NO: 3536 - protein, 487 aa, Panicum virgatum
  misc_feature: Ceres CLONE 1792061
  misc_feature (1)..(148): Pfam Name: UDPGT Pfam Description: UDP-glucoronosyl and UDP-glucosyl transferase
MVTMENGVSNGSAARLPHVVMLATPGMGHLIPLAELAKRLAARHGVTATLIALASTVSVTQRAFLASLPPSITSLHLPPVDLSDLPHGTAIETFMSEECARSIPALTQVLTKLKETNRLVAFITDFFGMDSFDAASNAGVERRYLFIPTNLHMLMLLLHLPELDLSIPGEFRDLAEPLQLPGCVPIPGMDILSPLQDRANPCYRWMVHHASRTKEADAILVNSFDAVEPEAAAVLHQQELGHPPVYNIGPLILTRSKSTGVMSTAPPASSRAECLDWLDLQPARSVTFVSFGSGGALPTEQMRELALGLELSGQRFLWVVRSPSDEGTVSDNYYDAESKKDPFVFLPEGFIERTRDVGFLVSSWAPQIDVLSHEATGGFLTHCGWNSTLESLIHGVPMVAWPLYAEQHQNAVMLDEGIGAVIRLPEPKGKDMIARVVKELMVGEGKGAAVRTTVAKLQENALQGLTEGGAAATALAELVEKWEVGEN

SEQ ID NO: 3537 - DNA, 2083 bp, Panicum virgatum
  misc_feature: Ceres CLONE 1792087
  misc_feature: Encodes the peptide sequence at SEQ ID NO. 3538
attttcttttcagttcacatgtgtcacgccacacaccgaagctgctgacggacgcgacggcgccgctcgtcgtttctataaacaccagcgagccgccgaccccgccgccccgcccttcccaccgcccgcaatccatcgtccccgtccccgctccccggcctcgcctcccacagccccacctcgagccgtcacgtcgcatcggccaagcgccgcgcccgcagacgagagctgaacacgacccccaagatccgacgggcgcggaggagcgggaggaatggcgggcgcggcggcgcgcaagaagcgggtggggaggtacgaggtgggacgcaccatcgggcagggcaccttcgccaaggtcaagttcgccgtcgacgccgacaccggcgccgccgtcgccatgaaggtgctcgacaaggagaccatcctctcccaccgcatgctccaccagataaaaagggaaatatcagtaatgaagatcgtaagacatcccaacatagttaggcttaatgaggtgttggcagggaagacaaagatatacataatcttggaacttatcactggaggtgaactgtttgataaaatagctcgccatgggaagcttcgcgagaatgaagcccggaaatacttccagcagcttattgatgccattgattattgccacagcaaaggagtttatcatagggatttgaagcctgagaatctgctgcttgacgcacgtggaaacttaaaagtttctgattttgggcttagcacactgtgtcagaatggagtaggtcttcttcacacaacatgtggaactccgaattatgttgctcctgaggtgctaggcaaaaatagatatgacggatctgcagcagacatttggtcatgtggtgttattctctatgttttaatggctggttaccttccctttgaggaaaatgaccttccaagcttgtatgagaagataactgcagctaagtattcatgcccatattggttctctccgggagccacatcattgatccggagaatacttgatccaaatcctagaactcgtatcactattgaagaaataagggaaaacccatggtttaagaagaactatgtagctattaggcgtggtgaagataaaaatgtcagcctggatgatgtccaggcagtttttgacaatattcaggaccagtatgtatctgaggaggttactaacaaggatggtgatcctcttatgatgaatgcctttgagatgattacactatctcaaggtttggatctctcggcattgtttgataggcaacaggagtttgtcaagcgccaaacccgttttgtctcaagaaaaccagctaagactatagtagctacaattgaagttgttgctgagtctatgggtctcaaggtccattcccagaattacaagctacggctcgaaggcacgtcatacaacaggatgagccaatttgctgttgttctagagatttttgaagttgctccttctctgtacatggtcgatgttcgaaaggttgccggtgacactctggaataccacaggttctacaagaacttatgcagcaagcttgacagcataatctggaagccaattgaagtttctgcgaaatccacacttctgaggacgaccacttgctagcccggcaccgccactgatgggagttgcacccagaacaacgtgatttctggctttcgatgacatgagctgctgttaaatatggcaatgctcttgaagatgggatttcgtgatggtttttaaagctgggagtcgtgatggttcctgaagctgcttctgcaggcgacatatgtaccatagctgagtctttagtagatgaaacgagggagcttgcagcaccagatgattgaattgtagtgatgctagtgtagatagcctgcattttcaaaaaaaaagagagtagtgtagatagtctgtatagcgccagttgtgcagcctgtacgtaatagggacctgaatgcccgttagaatcgattccttgtgtgcttgttggaggatccaagactctgatccgttgagggacatcaaaagattctgctgactcagctggaatgacttgcggaaaaaaaaaaaaaaaaaaaa

SEQ ID NO: 3538 - protein, 449 aa, Panicum virgatum
  misc_feature: Ceres CLONE 1792087
  misc_feature: Great-hit functional homolog of the protein sequence given in SEQ ID NO 9702
  misc_feature (7)..(448): SWISSPROT Homolog: EC 2.7.11.1 CBL-interacting serine/threonine-protein kinase 24
  misc_feature (8)..(433): SWISSPROT Homolog: EC 2.7.11.1 CIPK-like protein 1
  misc_feature: Useful for making plants with modulated salt sensitivity
MAGAAARKKRVGRYEVGRTIGQGTFAKVKFAVDADTGAAVAMKVLDKETILSHRMLHQIKREISVMKIVRHPNIVRLNEVLAGKTKIYIILELITGGELFDKIARHGKLRENEARKYFQQLIDAIDYCHSKGVYHRDLKPENLLLDARGNLKVSDFGLSTLCQNGVGLLHTTCGTPNYVAPEVLGKNRYDGSAADIWSCGVILYVLMAGYLPFEENDLPSLYEKITAAKYSCPYWFSPGATSLIRRILDPNPRTRITIEEIRENPWFKKNYVAIRRGEDKNVSLDDVQAVFDNIQDQYVSEEVTNKDGDPLMMNAFEMITLSQGLDLSALFDRQQEFVKRQTRFVSRKPAKTIVATIEVVAESMGLKVHSQNYKLRLEGTSYNRMSQFAVVLEIFEVAPSLYMVDVRKVAGDTLEYHRFYKNLCSKLDSIIWKPIEVSAKSTLLRTTTC

SEQ ID NO: 3539 - DNA, 1995 bp, Panicum virgatum
  misc_feature: Ceres CLONE 1792117
  misc_feature: Encodes the peptide sequence at SEQ ID NO. 3540
ccccaccaaccacttcgccaccccgccgctcgccatctgctcccctgcggctgcgacttcgagacatggcagcgcaaacttcggcggcctcgacccttgccttcgggcaccacaaaaccctagccgccgccgcggtgcccaaaatcctgccggccgcggcctccgtctccttcccggccacccagccggcgtgcctcctctccgcgtccgccgcccgccgccgggatgtcgccgccatggtctcggcgccgccggccgtcggcaccgccatgccgtcgctcgacttcgagaccaccgtcttcaagaaggagaaggtctcgctcgccggccacgaggagtatattgtcaggggcgggaggaacctgttcccgctgctcccggaggcgttcaagggggtcaagcagatcggtgtcattggatggggctcgcagggtcctgcacaagcccagaacctgagagattcactggccgaagcaaagtcagacattgttgtgaagattggtctccggaaaggttccaaatcttttgaggaagcacgtgctgctggattcactgaagagagtggaaccttgggcgatatttgggagactgtttcaggcagcgatctcgtgttattgttgatatcagatgctgcacaggcagacaactatgagaagatcttctcttacatgaaaccaaatagcattcttggtttatctcatggatttcttctgggacatttgcaatcgcttgggcttgatttcccaaagaacatcagtgtgattgctgtatgccccaagggaatgggtccatccgtccgtaggctttatgttcagggcaaggaagtaaatggagctggcatcaactctagctttgccgtgcaccaggacgttgatggaagggcaactgatgttgctctagcatggtcaattgcacttggctctcccttcacatttgctaccactttggaacaggagtacaagagtgatatctttggagagcggggcattttgctgggtgctgtacatggcattgtggaggctctgtttaggaggtacacggaacagggaatggatgaagagtcagcctacaaaaacactgtcgagggcattactgggattatctcgaaaacaatctcaaagaaggggatgcttgaagtctacaactctttgagcgaggaaggtaagaaggagttcaacaaggcttacagtgcctcattttatccttgcatggatatactcttcgagtgctatgaagatgtggcctccggaagtgaaatccggagcgtggtgttggctgggcggaggttttatgagaaagagggactaccagcatttccaatgggcaacattgatcaaactcgcatgtggaaggttggtgaaaaggtgcgctcgacacgtccagagggcgatcttggcccactgcatcccttcactgctggagtgtacattgctctgatgatggctcagattgagatcctgaggaagaaggggcactcctactcggagatcatcaacgagagcgtgatcgagtcagtggattcgctgaaccccttcatgcatgcccgcggcgtggccttcatggtggacaactgctccacgacggctcgcctaggatccaggaagtgggcgccgcgcttcgactacatcctgacgcagcaggcctttgtgacggtggacaaggatgccccgatcaaccaggacctcatcagcaacttcatgtccgaccccgtgcacggtgccattgaggtctgcgcagagctgaggcccaccgttgacatctccgtccctgccaacgcagactttgtgcgcccggagctccggcagtcttcctagattgaggtggtgcgcagagagaaagagagaaagtttgcctccggagttaagagtgggtggtgtatgtgttgagcgactgcttgaagtcctgaacgtgtgtgagctgctagacctgaggaagtttgggtatttgtttccggaataaaataggcccttcatcgaaaaaaaaaaaaaaaaaaaa

SEQ ID NO: 3540 - protein, 582 aa, Panicum virgatum
  misc_feature: Ceres CLONE 1792117
  misc_feature (1)..(582): SWISSPROT Homolog: EC 1.1.1.86 Ketol-acid reductoisomerase, chloroplast precursor
  misc_feature (5)..(582): SWISSPROT Homolog: EC 1.1.1.86 Ketol-acid reductoisomerase, chloroplast precursor
MAAQTSAASTLAFGHHKTLAAAAVPKILPAAASVSFPATQPACLLSASAARRRDVAAMVSAPPAVGTAMPSLDFETTVFKKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSGSDLVLLLISDAAQADNYEKIFSYMKPNSILGLSHGFLLGHLQSLGLDFPKNISVIAVCPKGMGPSVRRLYVQGKEVNGAGINSSFAVHQDVDGRATDVALAWSIALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILFECYEDVASGSEIRSVVLAGRRFYEKEGLPAFPMGNIDQTRMWKVGEKVRSTRPEGDLGPLHPFTAGVYIALMMAQIEILRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSS

SEQ ID NO: 3541 - DNA, 1574 bp, Panicum virgatum
  misc_feature: Ceres CLONE 1792120
  misc_feature: Encodes the peptide sequence at SEQ ID NO. 3542
aaccgcgccgagaagagaggagaccgacgaacgagagcgagcttggccgcccgcgcacacaaccgcgacgtttcccgacccctcactccaccacctactcggccggcgccgctgcagtgcagagtcgcgcgcctcctttttcttcttcgtcccctacccgtcacacccactcgtataaacgactccctacggtccaggaagccagccactcgcgagctacacaaccaggagccggccggagacagacgccacgccagtcgcgtaccaggcctccaaatctggtcatccaccgggacccggcagagaggcgtgcaagattccttcctcgccggggatcgattaaatctgccgccggcggagctcgatcgatccagcttccgcggagagtcgcggcgcttcttcttggtcccgattcgcttgcggaagcttttctgggagcttctggtgcgccggtgaggagagcgagagcgatcgagcaaacatggcggcggccacttccgcttctaccatgtccctgctcccgatctcccagctgaagcagcagcagcagcacggcgccggcgccgtggtcgtgttccggcggcggccccgggacgcgcggcggaggcgatacgtcgtgccgacggcgaggctgttcgggccggcgatcttcgaggcgtcaaagctgaaggtgctgttcctgggcgtggacgaggagagcgggaggcagcagcagggccagcctgggcaggggaagccgccggtgctgccgcggacgtacacgctgacgcacagcgacgtgacggcgagcctgacgctggccgtgtcccacaccatcaacggcgcgcagctgcaggggtggtacaaccggctgcagcgcgacgaggtggtggccgagtggaacaaggtgcgcggccggatgtcgctgcacgtccactgccacatctccggcggccacttcctgctcgacctcatcgccggcctccgctactacatcttccgcaaggagctccccgtggttttgaaggcgttcgtgcacggcgacggcgacctgttcagccggcacccggagctggaggaggccacggtgtgggtctacttccactccaacctgccgcgcttcaaccgcgtcgagtgctggggcccgctccgcgacgccgccgcgcccgccgccggggacgacggctccccggccgccgaggcgacggcggcgatgcccgtgggcgagtggccgcgccggtgcccccagcagtgcgactgctgcttcccgccgcacagcctcatcccctggccgaacgagcacgacatggccgccgacgcccccgccgccggccaggcccagcagcagtagtgaggctggccgccaatgtaagccgtagctaaacactagcgcctattctttaattggtagctttagctcagctctactcctgcaaagctcgttgtctctaggcttagcttggttgaggtcaggggatgaactcatgaacatggtggcgccttgtacatagctagtagtgtgtagaacgcctggtctggatggcaaaacttgctaaaggatgtgcacgttactgcaaaaaaaaaaaaaaaaaaaa

SEQ ID NO: 3542 - protein, 282 aa, Panicum virgatum
  misc_feature: Ceres CLONE 1792120
  misc_feature: Great-hit functional homolog of the protein sequence given in SEQ ID NO 9681
  misc_feature: Useful for making plants with modulated time to senescence
MAAATSASTMSLLPISQLKQQQQHGAGAVVVFRRRPRDARRRRYVVPTARLFGPAIFEASKLKVLFLGVDEESGRQQQGQPGQGKPPVLPRTYTLTHSDVTASLTLAVSHTINGAQLQGWYNRLQRDEVVAEWNKVRGRMSLHVHCHISGGHFLLDLIAGLRYYIFRKELPVVLKAFVHGDGDLFSRHPELEEATVWVYFHSNLPRFNRVECWGPLRDAAAPAAGDDGSPAAEATAAMPVGEWPRRCPQQCDCCFPPHSLIPWPNEHDMAADAPAAGQAQQQ

SEQ ID NO: 3543 - DNA, 1910 bp, Panicum virgatum
  misc_feature: Ceres CLONE 1792133
  misc_feature: Encodes the peptide sequence at SEQ ID NO. 3544
aagacgaggcggagcagcccgaatccccccaccacaccccaccgggagcggccgaggaagcaggcagccaccagtcatgtcgtgcggcgggtgcgggtgcgaggcgccggcggggacgggggcgacggcgtcggaggcgtacctgagcggcgagccggtgcgggaagcgcgggagctggtggcggagctctgccgccacttctacgcgcaggggtgggtcaccggcaccggcggcagcatcaccgtcaaggtcaacgaccccgccgtgccgctcgccgaccgcctcatcgtcatgtcgccctccggtgtgcagaaggagaggatggtggcagaggacatgtatgtgatggctgcagatgggaaagtgctctctgcaccagcagcaaagccatggccaaacaaacctccaaagtgtacggactgtgctcctctgttcatgaaggcctatttgatgagaggagctggggctgtcattcacagccatggaatggagacttgcatagcaacaatgcttaaccctggtgcaaaggagttcaggatgactcatatggagatgattaaaggaatcaaaggtcatggctaccgtgatgaattggttattcctattatcgagaatactccttatgagtatgagctcactgactccctaagtgaggcgattgcagcatacccaaaggcaactgctgtccttgtacggaaccatggaatatatgtgtggggtgactcttggatcaatgccaagacacaggctgaatgctaccattatcttttagatgcttgcatcaagctctatcaactaggaattgattggacaactcctgaacatggtccgttaaacagtgcaaagagactgcgcagcattttgagccctgaaattcctaatggacatcatgctgctgaagcatcaaagtgtgttgtacttgacattgagggcacaacgactccaatatcatttgtgactgatgttatgtttccttatgcctgtaacaatgtgcgaaagcatctaatttctacgtttgattctgaagaaaccaaagaagacatcaatttactgcgcatccaaattgaagatgatttaagaaatggaattgctggggctgttccagttccacccgatgaggctggcaaagaagaggtcatcaattcattggtggccaatgttgaatcaatgattaaagcagaccggaagattacgtcactgaaacaacttcagggtcatatatggaggactggatttgaaaagaaagaactatatggagttgtctttgaggatgttccagtggcactaaagaactggcatgctagtggcataaaggtctacatatactcgagtggaagtcgagaggcacaaaggcttctatttggcaatacaacgattggtgacctgcgaaagttcctgtgtgggtattttgatacaacaactggtaacaaaagagaaaccaagagttattttgagatctctcagtcacttggtgttgacagtccatctcaaatcttattcgtcactgacgtctaccaagaagccattgctgccaaaaatgcaggttttgatgtgataatctccattcgcccgggaaatgctccacttccggagaaccatggtttccgcactatcaagtcattcagcgagatctgacgaatgcagacttgtggatgtgtaatggcataggatttgtgtgtaattcacaagtgctttctgggctaatattagcccgccgatcagtccatgcaatagcagcagtatagcgcctcagcatggcagaatgaggtgacgcaacaataaaccgtaatggcaaaataaaattgtacatgctggtccgttatgtttttgtagctccgctacaaccagagaactatatttttgtgcttggcatctgcaggttgtttatcaaaaaaaaaaaaaaaaaaaa

SEQ ID NO: 3544 - protein, 519 aa, Panicum virgatum
  misc_feature: Ceres CLONE 1792133
  misc_feature (3)..(223): Pfam Name: Hydrolase Pfam Description: haloacid dehalogenase-like hydrolase
  misc_feature (1)..(218): Pfam Name: Aldolase_II Pfam Description: Class II Aldolase and Adducin N-terminal domain
MSCGGCGCEAPAGTGATASEAYLSGEPVREARELVAELCRHFYAQGWVTGTGGSITVKVNDPAVPLADRLIVMSPSGVQKERMVAEDMYVMAADGKVLSAPAAKPWPNKPPKCTDCAPLFMKAYLMRGAGAVIHSHGMETCIATMLNPGAKEFRMTHMEMIKGIKGHGYRDELVIPIIENTPYEYELTDSLSEAIAAYPKATAVLVRNHGIYVWGDSWINAKTQAECYHYLLDACIKLYQLGIDWTTPEHGPLNSAKRLRSILSPEIPNGHHAAEASKCVVLDIEGTTTPISFVTDVMFPYACNNVRKHLISTFDSEETKEDINLLRIQIEDDLRNGIAGAVPVPPDEAGKEEVINSLVANVESMIKADRKITSLKQLQGHIWRTGFEKKELYGVVFEDVPVALKNWHASGIKVYIYSSGSREAQRLLFGNTTIGDLRKFLCGYFDTTTGNKRETKSYFEISQSLGVDSPSQILFVTDVYQEAIAAKNAGFDVIISIRPGNAPLPENHGFRTIKSFSEI

SEQ ID NO: 3545 - DNA, 1941 bp, Panicum virgatum
  misc_feature: Ceres CLONE 1792142
  misc_feature: Encodes the peptide sequence at SEQ ID NO. 3546
cacccgctccacgcttatgcgctcgcgtccccctctcgccgcccacctccgccgcctcttcctcctccacccaactaacccatcgcgccgccatggcctcctccaccgccgccgtcgcgcgggcaggtgctgtgccggcggcggagtacgaggaggcgctggggcgcctctcctcgctcatcacgcagaaggtgcgcgcgcacagcggcaaccgaggcaaccagtgggacctcatggcacactacgtcaagattctggagctggaggagccgatcgcgcggatgaaggtcatccacgtcgcagggaccaagggcaagggttcgacatgcacatttactgagtcaatcctgcgatcgtgtggcttccacactgggctcttcacctcaccacatttgatggatgtcagggagcgattccggctagatggagttgatatttctgaagagaaatttttgaactacttttggtggtgctggaataagttgaaggagaagactgacgatgatattcccatgccagcctatttcaggttcctggcgttgctcgcattcaagatattttctgctgagcaggtagatgttgctgttctcgaggttggccttggagggaagtttgatgcaactaatgtggttgaagcacctgtagtttgtggggtatcttcgcttggatatgatcatatggaaattcttgggcatacgcttggagaaatcgcaggggagaaggctgggatcttcaagaaaggagttccagcctatactgctccacaacaagaagaggcaatggttgctctcaaacaaagagcttcggagttgggtatacctctccaagttgctgatcctctggtgccgtatcacttaaaaggtcaacatcttggactgaatggtgaacaccaatacataaatgctggccttgcagttgctttggctagtacatggcttgagaagcaggggcataaggacaggataccactcaatcgtactgaccccctaccagattttattagaggtctatcaaatgcttgtttgcaagggcgagcacagattgttccagattcacaagtgaattcaggagcggcaagaaattcttctttggttttctatttggatggggctcacagtcctgaaagtatggaaatatgtgccaagtggttttcccatgtcactaatgatgataaaagaataccatcttccacagagcagtctcagagttcgaagtctctaaagatccttctgttcaattgcatgtccgtgagagatcctatgagactgcttccgcatctcctggatgcctcaactcaaaatggagtccactttgatctggccctatttgtaccaaatcaatcgcaatacaacaagcttggttctagtacatcagcacctgctgagcctgaacaaatcgatttgtcatggcagttgtcactccaaacagtgtgggagaagttacttcaggataaaggaatagatagtgcaaattccagtgacaatagtaaagtttttgcatctcttccacttgcgatcgagtggctaaggaagaatgcccaagaaaacggatctacttcttttcagaaccaggtcttggttactggctccctgcatcttgttggtgatgtcttgaggcttattaagaagtgatctatttggaagtgatatacagtttgaagttcatagtggaagcaatatttgatgtgtcccggggctaacatgattagcaagggcagaaatctcaacggcttgattatgatgctaaccaagctgcgaggttcttgacttgtacattctgtgttttctggctacggttcgcaacctacagtcagggaatttgtgtgcccactgttgtagctcagaatgtaaactcaggaataaggtgattttgatcaggccatcattgaactagtttaagaaaatcagaaaacttggaatggaaaaaaaaaaaaaaaaaaaa

SEQ ID NO: 3546 - protein, 512 aa, Panicum virgatum
  misc_feature: Ceres CLONE 1792142
  misc_feature (1)..(211): Pfam Name: Mur_ligase_M Pfam Description: Mur ligase middle domain
MASSTAAVARAGAVPAAEYEEALGRLSSLITQKVRAHSGNRGNQWDLMAHYVKILELEEPIARMKVIHVAGTKGKGSTCTFTESILRSCGFHTGLFTSPHLMDVRERFRLDGVDISEEKFLNYFWWCWNKLKEKTDDDIPMPAYFRFLALLAFKIFSAEQVDVAVLEVGLGGKFDATNVVEAPVVCGVSSLGYDHMEILGHTLGEIAGEKAGIFKKGVPAYTAPQQEEAMVALKQRASELGIPLQVADPLVPYHLKGQHLGLNGEHQYINAGLAVALASTWLEKQGHKDRIPLNRTDPLPDFIRGLSNACLQGRAQIVPDSQVNSGAARNSSLVFYLDGAHSPESMEICAKWFSHVTNDDKRIPSSTEQSQSSKSLKILLFNCMSVRDPMRLLPHLLDASTQNGVHFDLALFVPNQSQYNKLGSSTSAPAEPEQIDLSWQLSLQTVWEKLLQDKGIDSANSSDNSKVFASLPLAIEWLRKNAQENGSTSFQNQVLVTGSLHLVGDVLRLIKK

SEQ ID NO: 3547 - DNA, 1587 bp, Panicum virgatum
  misc_feature: Ceres CLONE 1792163
  misc_feature: Encodes the peptide sequence at SEQ ID NO. 3548
acagtgtgctggccgtggcctcggatttttttcttgcgacgaaggatggaagggaagggaagaaaggaaatgcgcggccaggacatctgctctgaatctccgatcagcagataaaatcagcacgatcgcgacgagcgaagattttttttcctttcttcccaaaattgttttttttttctggtactactagttgcattgcggagcagtaaatcagcacaagttacctgctgggcttgattaattcggctcttggccgcccgtacgtctccgcccgccgtctttctcatcctccgcgggcggtggctgcgagcgcgtgcgtgccttaccttgccttgctctcgattcatgggcatggcggcttcgccggcttgtgctccgggcctcatctccggccccacgctccctccccagcccgttgccttccgctgctgctgggccccaaagccttcctcgtcgtcgtccacctccaggcgcccgcggggcaggcgcgtactcgtgcttgcagctgcctccgcccgcgcctcccctgcggccgctcggggcctcgacgccgacgacttccgccacccgctcgacaagcagaacactttgctgctaagagcgatccccggccttaacgacgtgggcaaggctttgctagggccagtctctgagcaagttatggtcctccagaacatcgggtcgtctgttcttgtctctccaaaccagctgccagatcttcaccagctcctggaagaggctgccaaactcttgaacacagaagctcctgacttgtacataaggcagaatcctgttcctaatgcttacaccttagcaatcaatggcaaaaagccatttatagttgtccatacgagcctcgtggagcttcttactagaaaagaattgcaggctgttttggctcatgagttgggtcacctaaagtgcgatcatggcgtgtggcttacctttgccaacatactaacgatgggagcatatactgtccctggttttggcatggttgctggcttcatggaagagcagctgtacagatggctgcgagctgcagagctgacttgcgacagagcagctcttcttgtggtgcaagacccaaaagttgtcatctctgttctgatgaaactggccggaggatgcccatctcttgctgatcaactaaatgtggatgccttcttggagcaagctcgttcgtatgacaaagctacatcgaacccagttgggtggtacatccggaatgctcaaaccagagagctttcacaccctttgcctgtgatgcgagctcgtgagatcgatgagtggtcaaggagtcaggagtataagaccctaatgcaaaaatggcttcagatggggctaaacagagtatagctaatgtgagacatgaaaaaaggactatgaaacggaatgtttggattggagaaagctggtgctgccgaataacatacacaaacatggacatatactgtatatatttgcgcttgaaattagttttcttgtatatgatctctttttctttccttctgtgactggtgcactcttgtaattagaactagagttaataaaagttcattgaattaaaaaaaaaaaaaaaaaaaa

SEQ ID NO: 3548 - protein, 337 aa, Panicum virgatum
  misc_feature: Ceres CLONE 1792163
  misc_feature (1)..(190): Pfam Name: Peptidase_M48 Pfam Description: Peptidase family M48
MGMAASPACAPGLISGPTLPPQPVAFRCCWAPKPSSSSSTSRRPRGRRVLVLAAASARASPAAARGLDADDFRHPLDKQNTLLLRAIPGLNDVGKALLGPVSEQVMVLQNIGSSVLVSPNQLPDLHQLLEEAAKLLNTEAPDLYIRQNPVPNAYTLAINGKKPFIVVHTSLVELLTRKELQAVLAHELGHLKCDHGVWLTFANILTMGAYTVPGFGMVAGFMEEQLYRWLRAAELTCDRAALLVVQDPKVVISVLMKLAGGCPSLADQLNVDAFLEQARSYDKATSNPVGWYIRNAQTRELSHPLPVMRAREIDEWSRSQEYKTLMQKWLQMGLNRV

SEQ ID NO: 3549 - DNA, 1672 bp, Panicum virgatum
  misc_feature: Ceres CLONE 1792174
  misc_feature: Encodes the peptide sequence at SEQ ID NO. 3550
ggaggacaaacagaagggcgaagggtttggaagacaccgaccccaaggctccatggcgacgaggatggcggcgctcctcttcaggcgccgggcagccgcggctgctccaaagccgctacaacattacgtcgccggtctatccaccgcagcgggacacgatgttctagacgacggaggttgcagtggcggtggggaggggaacaggaagcggtggctggagctccctccctacaccccgctcgatgccaacaccgccgcgcgagccatttctcgagggggagggggagaaggtgcgtgctccaacgccacggcgatcaggtgggtccggcgctgctgcccgcacatgccggcgtcgctggtgcagaagctgttccgcctccgcaaggttaagaggaatcttctgactgctggtacctcttcaactgatggcattactgaacaactccggttaagaagggtttcagcgaaagatgaacttgtgcctggtgatattctctttctaccagttaacattcaagaatcttctgttgctgagaagaccaagaaatttggtaacaagaatgagattgactttttacgcagccttgagatctacaaggataggaacatcatcgtgctcaataaaccacctggaatgccagtgcaaggtggtgttggcataaaaaatagtattgatatgctgtccctgatgtttgaggatggttcttctgaagcacctcgactggtccacaggcttgatagggattgcagtggtgtccttgttctgggaagaacccaacttagcgcttccattatgcatgctatattccgtgagaaaactgctgatgctttagctaatggtactcaacaagtactgcagagaaaatatgttgcgcttgttatgggaagacctaggcatcccaagggtttactgtcagctccacttgcgaaggttgtattacaagatggcaagtcggagcgtctgactgtttgttctggttcaaattccacctctgttcaagatgctttgacagagtaccgagtgattgaatcttgcccgcaaggctactcttggttagaactatttcctcgtacaggaaggaaacatcagctccgtgtccattgtgcggaggttcttggaacaccaattgttggggattacaagtacggacggcaagcacaccagaactggtcgcctcttcccctgccacatgcaatcgatgaggaaatgcttaataaaaggaagcttccctttgggcttgctttgggtggtggaagtgtagctgaggagcagcctcagctgcatctacactgcaagcagatgatccttcctgacatctcagaggccatgcaacgcctgcagtcttcagatgctgaccatgatttttctgatcttgagaagctcagctttgttgctccattgccgttgcatatgcggttgagctgggagattttgaagtccttaggcaagtaatattgtacttttagtcttttatctgttggtcatgaagtccttaggcaagtaacgcaaaagcttcgcttggacaaccttaataccaatgctagtgctgaccaagttgtggtcctctagagatgcgataagcagagaaacaatgtttgtgtagtttacattgttcttttttttccccttcagagaaaacctgctttatatcaaaaaaaaaaaaaaaaaaaa

SEQ ID NO: 3550 - protein, 466 aa, Panicum virgatum
  misc_feature: Ceres CLONE 1792174
  misc_feature (2)..(162): Pfam Name: PseudoU_synth_2 Pfam Description: RNA pseudouridylate synthase
MATRMAALLFRRRAAAAAPKPLQHYVAGLSTAAGHDVLDDGGCSGGGEGNRKRWLELPPYTPLDANTAARAISRGGGGEGACSNATAIRWVRRCCPHMPASLVQKLFRLRKVKRNLLTAGTSSTDGITEQLRLRRVSAKDELVPGDILFLPVNIQESSVAEKTKKFGNKNEIDFLRSLEIYKDRNIIVLNKPPGMPVQGGVGIKNSIDMLSLMFEDGSSEAPRLVHRLDRDCSGVLVLGRTQLSASIMHAIFREKTADALANGTQQVLQRKYVALVMGRPRHPKGLLSAPLAKVVLQDGKSERLTVCSGSNSTSVQDALTEYRVIESCPQGYSWLELFPRTGRKHQLRVHCAEVLGTPIVGDYKYGRQAHQNWSPLPLPHAIDEEMLNKRKLPFGLALGGGSVAEEQPQLHLHCKQMILPDISEAMQRLQSSDADHDFSDLEKLSFVAPLPLHMRLSWEILKSLGK

SEQ ID NO: 3551 - DNA, 1698 bp, Panicum virgatum
  misc_feature: Ceres CLONE 1792188
  misc_feature: Encodes the peptide sequence at SEQ ID NO. 3552
gcgcgcgcgcgcgaaccacacatcccaccacacgactcccccaaccgagcggagcggagcgcctcgctcacccatgcttctcctcgctcccgccccgccggcggcggccgcttgccggcgagccgccgcccgatggccccccgtccgctgctcgagcgtgcacgagctggagcggtcccctccagcccgcccgggcgcgtcgctcccgccgctgcgggcggcgaagcgggtggcgctggtgcggcacgggcagagcacgtggaacgcggagggccgcatccaggggagctccgacgcctccgtgctcacgcccaagggtgaggcccaggccgcgacctcccgccagatgctcctcgccgacgccttcgacgcctgcttcaccagcccgctcgcgcgctcccgccgcacggccgagatcatctgggaaggccgcgacgacggcggcctcatcccggactcggacctccgcgagatcgatctctactctttccagggactgctgaagcatgaagggaaggagaggtacggggttgtgtaccggcagtggcagaagaacgcggccaacttcagcatcgacgggcactaccaggtgcgggagctgtggggccgcgcgcggagctgctgggagaggattttagcacacgagggcaagtcggtgcttgtggtggcacacaatgcagtgaaccaggcgctcgtcgccacttctttgggacttggtgccgagtactttcgggttctgctccagagcaattgtggcgttagtgtgctggatttcaccccaaagactggcggaggtcctccaaatgtttgtcttaaccgcttaaatcagaccccaaattctcctgttgctgctggaagttctggtggaagaaagactagcaaaaggatcattctggcttgtcaaggaactacacagagcagttctgagattagtctaggtggaatgggatatgcaccactgaacatgcttgggactatacagcctcagaagactgcagaactacttctagatctgaaggtgaacagtattatctgtagcccacaagttgcatctgttgatactgcaactgctatatgcgaggtccaagaggcggcagattgcttaggtgctgattgtgtgcctcgttatgtggaaatgaagaatttgctagaacttgaaactgatgatgcctttcaagcaaagcaaaagagctttggggatatagttcaatcgggctggatgggcagcatggaatacaaaacactagagcaactgtgggctcagtccaaggatgcgtggcaagccttgctaaatgaattgccgggtgatagtgagtcggatcgagttgttgtggccgtaggccatccagccatacaccttgctctgctctgtcggtgccttgatttgccaatggagtacatgtcatctttccatctagacgatggaagcatcagcgtgatcgatttcccggatggacctaaaggaagaggcgttgtcagatgcacaaattacacagcccatctcggtagatggtcaatacccattacgcggccaactgaaaatgatgaggagttctaacattcttgaaggtaacgttttccgtgttaatgtatagcatccttcagaaacacacacgtgtaaatatcttacattgatgtacatatatcttaatctcaatataacaacatctgtttacataaaaaaaaaaaaaaaaaaaa

SEQ ID NO: 3552 - protein, 494 aa, Panicum virgatum
  misc_feature: Ceres CLONE 1792188
  misc_feature (1)..(155): Pfam Name: PGAM Pfam Description: Phosphoglycerate mutase family
MLLLAPAPPAAAACRRAAARWPPVRCSSVHELERSPPARPGASLPPLRAAKRVALVRHGQSTWNAEGRIQGSSDASVLTPKGEAQAATSRQMLLADAFDACFTSPLARSRRTAEIIWEGRDDGGLIPDSDLREIDLYSFQGLLKHEGKERYGVVYRQWQKNAANFSIDGHYQVRELWGRARSCWERILAHEGKSVLVVAHNAVNQALVATSLGLGAEYFRVLLQSNCGVSVLDFTPKTGGGPPNVCLNRLNQTPNSPVAAGSSGGRKTSKRIILACQGTTQSSSEISLGGMGYAPLNMLGTIQPQKTAELLLDLKVNSIICSPQVASVDTATAICEVQEAADCLGADCVPRYVEMKNLLELETDDAFQAKQKSFGDIVQSGWMGSMEYKTLEQLWAQSKDAWQALLNELPGDSESDRVVVAVGHPAIHLALLCRCLDLPMEYMSSFHLDDGSISVIDFPDGPKGRGVVRCTNYTAHLGRWSIPITRPTENDEEF

SEQ ID NO: 3553 - DNA, 2135 bp, Panicum virgatum
  misc_feature: Ceres CLONE 1792192
  misc_feature: Encodes the peptide sequence at SEQ ID NO. 3554
atccgccgcgtcctccctccctaaacccatggcgatggccggcgccaccgccgccgccggtcgctgcctcctgctctcccgcccgtcgcccctccgcctccgcctcctccgcgccgccctctccaccaccgcccccaccctcatccccacctccactcccgctccccctccgcggcacgagctcctcctcgagcgcctccgtctgcggcacctcaaggacgcctcgtcccccggctccccgaaccttaccccgcgggggaaggcgaggggcggggagcgggcctcgcagcacccgccgcaggggaagagggtcgaggccgtggagagcttcgaggagctcgggctcggggaggaggtgatggccgcgctcggggagatgggcatttccaagcctacggagatccagtgcgtcggcgtgccggcggttctggacggcaccagcgtcgtgctcggctcccacaccggctccgggaagacgctcgcctacctgctccctcttgttcagctacttcggcgtgatgaagcaatgttggggatgtcaatgaagccaaggcggccaagagcagtagtactctgccccacaagggagctaaccgagcaggtctatcgtgttgcaaaatccatcagccatcatgcacgtttccggtcaacgatggttagtggaggcacccgcataagaccccaagaagattctttgaacatgcctgttgacatggttgttggtactcctggaaggatcctggatcatatcaaggatggtaacatggtttacggtgatatcaagtatctggttctggatgaagcagatacaatgtttgatcaaggctttggaccagacatacggaagttccttgctccattgaagaatcgtgcttcaaagcctggtgatcaggggttccaaactgtattagttactgctaccatgacgaaggctgtacaaaagttaattgatgaggaatttgaaggtattgtccatttgcggatgtcaacatttcaaaagagagttgcaacggcacgacatgactttatcaaacttactggcgcagaaaacaaacttgaggctctcctgcaggttcttgagccaagcttggcaaagggaaacaaagttatggtgttctgtaatactttaaattcaagtcgcgcggtggaccattttctgactgagaatcagatatatactgttaactatcatggagaggttcctgctgaagagagagttgagaacctaaacaaattccgtaaagaagagggggattgtccaacattggtatgcactgatctggcagctagaggtctggacttggatgttgaccatgtcatcatgtttgacttcccatcgaattcgattgattaccttcacagaactggacgaactgcacgcatgggagccaaagggaaagttacaagcctcgtggctaagaaagatgtggctttagctactcggatagaagaggccatcaagaaaaatgagagcttggaagctctaacgactgacaatgtcagaagagctaccaacccacagagtgcgagcaccaaaggaaggagctcgaagtcggttaagacttcaagtgcccttaaagttgtgaatcagaagggtagaaggggagttgtgctatctagcaagtcatcgaggactcccaaggacacaacatcaacccgaaggcgctcaccaccaaagatccagccaaaagcgacaaaatcggcagcccctcgcaaagccaaggtggtgaaacccgctaagaacagtgtgaaggtttcaaagagcaaagcaaaacctgagggccgaaaggcgaagggtgatgttctgaacaagctgggaactaagctcagtgtggttggattcagaggtcgcagctcgggcaaatctgtgcaatcttcataagaggcctggagaaattgtttatttcccctgcttaagaaaggctggagtttttggataatgcatcctgtaaatatttgagacttcatctcttcaatcttttttccattgcggtgcaggcttacaagttaattaaagagtagaatcgagatcttaacacagcacatccatgtaatacttacgcataatgttggaataatatgttgtattaccagtacccacgaattttgtcgagtaaaaaaaaaaaaaaaaaaaa

SEQ ID NO: 3554 - protein, 617 aa, Panicum virgatum
  misc_feature: Ceres CLONE 1792192
  misc_feature (1)..(184): Pfam Name: DEAD Pfam Description: DEAD/DEAH box helicase
  misc_feature (1)..(78): Pfam Name: Helicase_C Pfam Description: Helicase conserved C-terminal domain
MAMAGATAAAGRCLLLSRPSPLRLRLLRAALSTTAPTLIPTSTPAPPPRHELLLERLRLRHLKDASSPGSPNLTPRGKARGGERASQHPPQGKRVEAVESFEELGLGEEVMAALGEMGISKPTEIQCVGVPAVLDGTSVVLGSHTGSGKTLAYLLPLVQLLRRDEAMLGMSMKPRRPRAVVLCPTRELTEQVYRVAKSISHHARFRSTMVSGGTRIRPQEDSLNMPVDMVVGTPGRILDHIKDGNMVYGDIKYLVLDEADTMFDQGFGPDIRKFLAPLKNRASKPGDQGFQTVLVTATMTKAVQKLIDEEFEGIVHLRMSTFQKRVATARHDFIKLTGAENKLEALLQVLEPSLAKGNKVMVFCNTLNSSRAVDHFLTENQIYTVNYHGEVPAEERVENLNKFRKEEGDCPTLVCTDLAARGLDLDVDHVIMFDFPSNSIDYLHRTGRTARMGAKGKVTSLVAKKDVALATRIEEAIKKNESLEALTTDNVRRATNPQSASTKGRSSKSVKTSSALKVVNQKGRRGVVLSSKSSRTPKDTTSTRRRSPPKIQPKATKSAAPRKAKVVKPAKNSVKVSKSKAKPEGRKAKGDVLNKLGTKLSVVGFRGRSSGKSVQSS

SEQ ID NO: 3555 - DNA, 1866 bp, Panicum virgatum
  misc_feature: Ceres CLONE 1792206
  misc_feature: Encodes the peptide sequence at SEQ ID NO. 3556
gccgtctcctcccctcctcccattcccccactcccaatccaatccgcgagctctcccgcccgctgcaatggcgctctccgtggagaagacctcgtcggggcgggagtacaaggtcaaggacctgtcccaggccgacttcggccgcctcgagatcgagctggccgaggtcgagatgcccggactcatggcgtgccgcgccgagttcggcccatccaagcccttcgccggcgccaggatctcgggctccctccacatgaccatccagaccgccgtcctcatcgagaccctcaccgcgctcggcgccgaggtccgctggtgctcctgcaacatcttctccacgcaggaccacgccgccgccgccatcgcgcgggactccgccgcggtcttcgcgtggaagggggagacgctcgaggagtactggtggtgcaccgagcgctgcctcgactggggcgagggcggcggccccgacctcatcgtcgacgacggtggcgacgccacgctcctcatccacgagggcgtcaaggccgaggaggagtacgagaagaccggcaaggtccccgatccggagtccaccgacaacgccgagttcaagatcgtgctcaccatcatccgcgacgggatcaaggctgaccccaagaagtaccgcaagatgaaggataggctcgttggagtctcggaggagaccactaccggagttaagaggctctaccagatgcaggagaccggcactctcctcttccccgccatcaacgtcaacgactccgtcaccaagagcaagttcgacaacctgtatggttgccgccactcccttcctgatggtctgatgagggccaccgatgttatgattgctggcaaggttgcggtagtatgcggttatggtgatgttggcaagggctgtgctgctgccctcaagcaggctggtgcccgtgtcatcgtcactgagattgatcccatctgtgcccttcaagccctgatggagggtcttcaggtccttaccttggaggatgtcgtttctgaagctgacatctttgtgaccaccactggcaacaaggacatcatcatggttgaccacatgaggaagatgaagaacaatgcaattgtctgcaacatcggtcactttgacaatgagattgacatgcatggtcttgagacctaccctggtgtgaaacgcatcaccatcaagcctcaaacggaccgctgggtgttccctgagaccaagactggcatcattgtccttgctgagggtcgtctgatgaaccttggatgcgctactggtcaccccagctttgtcatgtcctgctcattcactaaccaggtcattgctcagcttgagctgtggaaggagaagagctctggcaagtatgagaagaaggtgtacgtgctccccaagcaccttgatgagaaggttgctgctctccacttgggcaagcttggtgccaagctcaccaagctcaccaagtctcaggccgactacatcagcgtcccgattgagggtccctacaagcccgctcactaccggtactaggctgcccagcacaactagaacaccactttgctggctggctgtgttatgtgcccattcgaagttagccacatcgggttatcttttgaatgctcacatgcgcctttgcctagaaggaatttttatggtcattgcttgagcggtttagtttggttgagtgggggagaggttggaagagctgtttgcttttgcggaagaataatggtgtaattggttgtaggctgaggcggtgtgcgttgccagaaactacatagtttctgattatcatttgcaagcgatttgctcaagttatgtgtctttcatgaataacttgctttcttgaagagcatatttagtctggtcct

SEQ ID NO: 3556 - protein, 485 aa, Panicum virgatum
  misc_feature: Ceres CLONE 1792206
  misc_feature (4)..(475): Pfam Name: AdoHcyase Pfam Description: S-adenosyl-L-homocysteine hydrolase
  misc_feature (1)..(485): SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKVPDPESTDNAEFKIVLTIIRDGIKADPKKYRKMKDRLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 3557 - DNA, 1796 bp, Panicum virgatum
  misc_feature: Ceres CLONE 1792223
  misc_feature: Encodes the peptide sequence at SEQ ID NO. 3558
cctcctccccactccagtgcgcacgcacagtcgcagcaggtcgagggaacaacaaccaaggaaaggaaaggaaaggaaaggaacaacaatggcggtccgccgccgcagcacgtgcagcgcccgggcgccaagcctaccggtagcggcggtggtcttccagttcctcctcctggcggccgcgccggcgtgccttgaggccgggggcccgatcaagacggtggtggtggtggtgatggagaaccgttccttcgaccacatgctggggtggatgaagcggctgaacccagagatcgacggcgtgacgggcgcggagtggaacccggccaacacgacggacccggcggcggggcgcgtctacttcggggagggggcgcagtacgtggacccggacccggggcactcgttccaggagatccggcagcagatcttcggctccgacgacgcgtccggccccgcccggatggacggcttcgtgcagcaggcgcgctcgctggggggcaacatgaccgacgccgtcatgcacggcttcgcgcccgacagcgtcgccgtctaccgcgagctcgtcgcccagttcgccgtctgcgaccgctggttcgcctccgtgccctcgtccacgcagcccaaccggctgttcgtccactccggcacatccggcggcgccaccagcaacaacccgcagctgctggccaagggttaccctcagcggaccatcttcgacaacatccacgacgcgggcctgtcgttcggcgtctacttccaggacgtgccggcggtgctcttctaccgcaacctgcgcaagctcaagtacctgctcgacttccaccccttccaccccagcttccgcgaccacgccagccggggatccctccccaactacgccgtcatcgagcagcactacctcgactccaagctcgacccggccaacgacgaccacccctcccacgacgtctaccagggccagatgttcgtcaaggagatctacgagacgctgcgcgcaagcccgcagtggaacgagacgctcatggtcctcacctacgacgagcacgggggcttcttcgaccacgtccccacgcccgtccacggcgtccccagccccgacggcatcgtcggaccgccgccctacaacttcaccttcgaccgcctcggagtgcgcgtcccggccatcctcatctccccatggatcgaaaagggaacagttatccatgggccgaatggaccgacgccaacgtcgcagtacgagcactcgtcgatccctgccacggtgaagaagctcttcgacctgccgcaggatttcctgacgaaaagagacgcgtgggcaggcaccttcgagagcgtcgtgcagacaagaaccgagcccaggacggactgcccagagcagctcccgatgccgacgaggatccggcagacggaggcgaacgaggaggccaagctgagcgagttccagcaagagatcatccagctcgcgtcggtgctcaacggggaccatgagctcaccagcctgcaggacaggatccgggacaagatgaacgtcagggaaggcatcgcctacatgcggggcgccgtgaagcgcttcttcgaggccggcatgtcggccaagcggatgggcgtcgacgacgagcagatcgtcaagatgaggccttccctcaccaccaggattgaacgtccatagacacagtagtgtgacaaaaaattaaaagcacatatatattactgtagaaattaagttgccgatatatggcaaagattacattacaaatatatatatatattagctccaaaaaaaaaaaaaaaaaaaa

SEQ ID NO: 3558 - protein, 526 aa, Panicum virgatum
  misc_feature: Ceres CLONE 1792223
  misc_feature (1)..(362): Pfam Name: Phosphoesterase Pfam Description: Phosphoesterase family
MAVRRRSTCSARAPSLPVAAVVFQFLLLAAAPACLEAGGPIKTVVVVVMENRSFDHMLGWMKRLNPEIDGVTGAEWNPANTTDPAAGRVYFGEGAQYVDPDPGHSFQEIRQQIFGSDDASGPARMDGFVQQARSLGGNMTDAVMHGFAPDSVAVYRELVAQFAVCDRWFASVPSSTQPNRLFVHSGTSGGATSNNPQLLAKGYPQRTIFDNIHDAGLSFGVYFQDVPAVLFYRNLRKLKYLLDFHPFHPSFRDHASRGSLPNYAVIEQHYLDSKLDPANDDHPSHDVYQGQMFVKEIYETLRASPQWNETLMVLTYDEHGGFFDHVPTPVHGVPSPDGIVGPPPYNFTFDRLGVRVPAILISPWIEKGTVIHGPNGPTPTSQYEHSSIPATVKKLFDLPQDFLTKRDAWAGTFESVVQTRTEPRTDCPEQLPMPTRIRQTEANEEAKLSEFQQEIIQLASVLNGDHELTSLQDRIRDKMNVREGIAYMRGAVKRFFEAGMSAKRMGVDDEQIVKMRPSLTTRIERP

SEQ ID NO: 3559 - DNA, 1861 bp, Panicum virgatum
  misc_feature: Ceres CLONE 1792224
  misc_feature: Encodes the peptide sequence at SEQ ID NO. 3560
ctgcccagcccagctcccgctgcccagccctgccaagccaagcccgtcggccaccgcacatcccggggaacccaatcccatcgcgaacgcagaagatcccgtgccagcgggctgcggcggcggcggcggcgacggtggtggactggacggactactagtagccataacccgtagccaatagcccgtccattccatccagccagagccagacctcccacccgcatcctcctccccgccgccggcaatggcccggctcgtgctctccgagtgctgcggcctcgcgccgctgcgcctgcgcgccggccggggcgccattgcggcgccggcgccccccgccgcgctctccgccgcggcgctgccgcgcgggcccgcggccgcggccatccaccgcgactgggcgctccgcgtctccgcgcccacgcgcctcgcgtcggccgtcgacgaggggggcaggaggagcgccccgctcggggaggaggagaaggccgccgcgggcggggacttcgaccccggggcgccgccgccgttcgggctggcggagatccgcgccgccatccccaagcactgctgggtcaaggacccctggcgctccatgagctacgtcctccgcgacgtcgtcgtcgtcctggggctcgccgccaccgccgcgcgcctcgacagctggctcgtctggccgctgtactgggccgcgcagggcaccatgttctgggcgctcttcgtcctaggccacgactgtggacacgggagcttctcaaacaaccccaagctcaacagcgtggtcggccacatactccattcctccattcttgtcccatacaacggatggaggattagccacaggacgcaccatcagaaccacggccacgtcgagaatgacgagtcctggcatccgctaccagagaggctgtacaatagcctggactttatgactaagaagttgcggttcaccatgccgttccccttgctcgcattcccgttatacttgttcaaacggagtccagggaagacaggatcacacttcaacccaagcagtgacttgttccaacctaatgaaaagaaggacatcataacgtcaaccgcatcctggcttgctatggttggtcttctggctggtctcacctttgtgatgggtcctattcagatgctaaagctctacgctgtcccatacttggtatttgttgcttggctggatatggtcacttacttgcaccatcacggccatgaagacaagcttccttggtaccgtggaaaggaatggagttatctgcgtggaggactgacgacgctcgatcgggactatggattgatcaacaatatccatcatgacattggaactcatgtcatccatcaccttttcccccaaatcccgcattaccatctcattgaggcgactgaggcagcaaaaccagtgcttggcaagtactacaaagaaccaaagaagtcaggtcctctaccgttgcatctatttggggtgctgtcagaaagcttaaagcaagaccactatgttagcgatacgggagacgtagtctactaccaaattgacaagatgatgaacacctctgcacaaaattcagattgacataaaccatagctagtagcctattcttcatttttctcaggggactgtgcctgaagacgcgtccagcctcctgggacctctgattggtgtgcgaatccattgatatttcgattcaagaatgtaagttggcgaaacattaatcatgcagaaaagagggtaaatgtaattctttccaatgatggaagacggaggctgctgcctcctatgtaacaaaacaaacatgtgattctttggacaagaggtatattacagtaaagagcggaaaaaaaaaaaaaaaaaaaa

SEQ ID NO: 3560 - protein, 444 aa, Panicum virgatum
  misc_feature: Ceres CLONE 1792224
  misc_feature (1)..(245): Pfam Name: FA_desaturase Pfam Description: Fatty acid desaturase
MARLVLSECCGLAPLRLRAGRGAIAAPAPPAALSAAALPRGPAAAAIHRDWALRVSAPTRLASAVDEGGRRSAPLGEEEKAAAGGDFDPGAPPPFGLAEIRAAIPKHCWVKDPWRSMSYVLRDVVVVLGLAATAARLDSWLVWPLYWAAQGTMFWALFVLGHDCGHGSFSNNPKLNSVVGHILHSSILVPYNGWRISHRTHHQNHGHVENDESWHPLPERLYNSLDFMTKKLRFTMPFPLLAFPLYLFKRSPGKTGSHFNPSSDLFQPNEKKDIITSTASWLAMVGLLAGLTFVMGPIQMLKLYAVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGPLPLHLFGVLSESLKQDHYVSDTGDVVYYQIDKMMNTSAQNSD

SEQ ID NO: 3561 - DNA, 1307 bp, Panicum virgatum
  misc_feature: Ceres CLONE 1792242
  misc_feature: Encodes the peptide sequence at SEQ ID NO. 3562
aaaaaagccacgcgataaaaaacggggccgcagcgatgctccaggttcgcgcgtcgcccagcttcctcccctccaccacctcctcctcgccatcatcctcgtcgcaggcgccggcgccctcggcgtccttcgggaggggcagccaccggcgcggcgggctggtcccattggccgcgtcggcgtcaccgcggcgcggcgcggcgaggcgctccgtgatggccgcggcgggggcggccaagctcgaggacgccgacgcgctcatcgactccgtggagaccttcatcttcgactgcgacggtgtgatctggaagggagacaagctgatcgacggcgtgccggagacgctcgacttgctccgatcgaagggcaagaggctggtgttcgtcaccaacaactccaccaagtcgaggaagcagtacggcaagaagttcgagacgctggggctgagtgtcgacgaggaagagatcttcgcttcatccttcgcagctgcagcctacctgcagtccatcgatttccccaaggacaagaaggtgtatgtcatcggagaggaagggattctcaaggagctggagctggctgggtttcagtacctcggcggacccacagatggagataagaagatagagctgaagcctggtttttacatggagcatgacaaagatgtgggagcagttgttgtcggattcgatcgctactttaactactacaaggttcagtacgggacactttgcatccgtgagaacccaggttgccttttcattgcaacgaacagggacgctgtcactcatcttactgatgcccaagaatgggcaggtggtgggtcaatggtcggcgcaattcttggttccactaaacaagaaccactcgttgtcgggaagccatccactttcatgatggactacctggcaaagaagttcggaatcacaacatctcagatatgcatggtgggtgaccggttggatacggatatcctgtttggccaaaatggaggctgcaagactctccttgttctatcaggtgtgacttccctgcagacacttcagagccccgacaactcgatccagccagatttctacacaaaccagattccggattttctcaccctcaaagcagcaactatctgaagggcgagcccaccttacatttgcataggcagcatcggctatttttcagcaaataagaaaacacaaaggatggttttgtttttcaaattattatgtaatcctgagacatgttcatatgtaacaactgaagcacatctcaaaagatggcacgaattactcctcgaaaaaaaaaaaaaaaaaaaa

SEQ ID NO: 3562 - protein, 362 aa, Panicum virgatum
  misc_feature: Ceres CLONE 1792242
  misc_feature (1)..(250): Pfam Name: Hydrolase Pfam Description: haloacid dehalogenase-like hydrolase
MLQVRASPSFLPSTTSSSPSSSSQAPAPSASFGRGSHRRGGLVPLAASASPRRGAARRSVMAAAGAAKLEDADALIDSVETFIFDCDGVIWKGDKLIDGVPETLDLLRSKGKRLVFVTNNSTKSRKQYGKKFETLGLSVDEEEIFASSFAAAAYLQSIDFPKDKKVYVIGEEGILKELELAGFQYLGGPTDGDKKIELKPGFYMEHDKDVGAVVVGFDRYFNYYKVQYGTLCIRENPGCLFIATNRDAVTHLTDAQEWAGGGSMVGAILGSTKQEPLVVGKPSTFMMDYLAKKFGITTSQICMVGDRLDTDILFGQNGGCKTLLVLSGVTSLQTLQSPDNSIQPDFYTNQIPDFLTLKAATI

SEQ ID NO: 3563 - DNA, 1514 bp, Panicum virgatum
  misc_feature: Ceres CLONE 1792253
  misc_feature: Encodes the peptide sequence at SEQ ID NO. 3564
attggcctcccaccactgaccaccccgcccgtccacttcccctgcgccgcaagcccttcggctgctgctgctgctgctgacggcggccgccgtcccatagcgagtgcggccggcgagtcgaaggaaggaaggcaaggcaggcgaggaagaagaagaggaggtgatggcggcaatgccggcggtgttggtgctcctcctggtggccgcgctggccgctcccgccgccgcccgcattcccggcgtgtacggcggcggcaactggcagagcgcgcacgccacgttctacggcggcagcgacgcctcgggcaccatgggcggcgcgtgcgggtacggcaacctgtacagccaggggtacggcgtgaaaaacgcggcgctgagcacggcgctgttcaacgaggggctgagctgcggcgcctgcttcgagatcaagtgcgagaaccagcccgggtggcggtggtgccgccccgggagcccctccatcctggtgacggccaccaacttctgcccgcccaactacgcgctcccctccgacaacggcggctggtgcaacccgccgcgcccccacttcgacctcgccatgcccatgttcctccacatcgccgagtaccgcgccggcatcgtacccgtctcctaccgccgggtgccgtgccggaagtccggcggcgtgcggttcaccatcaacggcttccgctacttcaaccttgtgctcatcaccaacgtggccggcgccggcgacatcgtgcgcgcgagcgtgaagagctccagcaccgggtggctgcccatgtcccggaactggggccagaactggcagtccaacgccatcctcgtcggcgacgcgctctccttccgcgtcaccggcagcgatcgccgcacctccacctcctggaacgtcgccccgcgcaactggcagttcggccagaccttcgagggaaagaacttcagggtctgatggtggccgtgaacatcaacgtcttcctcttcgccgccggcgtgcgattcggattaagctacaagtgagaaaaaaagaagctaatgtcttctcatacgtaattagtatagtcattaagcgtgtgttagggtgggaatgcccgttcaagttcgcgccttctcgccttaatccgtgttccaggtcctctgtgaaaggaagctttttcttctgagcaagggggcaaaaggagggtaaagtctagagtcggttagggtaaatttgtcgtcacaagtcacaactagtccctagtactctattgcaatggtgtgcttgtgactaccaagtgtggttatggatcttgtttgtggttaagccttgcttttggggtgctttctgtcggagcagtggctgaagtggctgccaagctgcagagctcaaagctgggagcggtgagtgtagcccgcagttgcttgttcctcctccatcccgtgtcatctatctccatggcacgacgtattggtatctcttatcatgaacttgattttaaagtaaggtgattggacttgaaaaaaaaaaaaaaaaaaaa

SEQ ID NO: 3564 - protein, 261 aa, Panicum virgatum
  misc_feature: Ceres CLONE 1792253
  misc_feature: Great-hit functional homolog of the protein sequence encoded by LOCUS At2g28950
  misc_feature: Great-hit functional homolog of the protein sequence encoded by LOCUS At2g39700
  misc_feature: Great-hit functional homolog of the protein sequence encoded by LOCUS At3g55500
  misc_feature: Useful for making plants with altered cell wall content and/or composition
MAAMPAVLVLLLVAALAAPAAARIPGVYGGGNWQSAHATFYGGSDASGTMGGACGYGNLYSQGYGVKNAALSTALFNEGLSCGACFEIKCENQPGWRWCRPGSPSILVTATNFCPPNYALPSDNGGWCNPPRPHFDLAMPMFLHIAEYRAGIVPVSYRRVPCRKSGGVRFTINGFRYFNLVLITNVAGAGDIVRASVKSSSTGWLPMSRNWGQNWQSNAILVGDALSFRVTGSDRRTSTSWNVAPRNWQFGQTFEGKNFRV

SEQ ID NO: 3565 - DNA, 1580 bp, Panicum virgatum
  misc_feature: Ceres CLONE 1792254
  misc_feature: Encodes the peptide sequence at SEQ ID NO. 3566
gtgcgcggtggccacgagcacccggcttaaaaagcgacgccggcccatttgatcgagagcgagcgagcgagggagagcaaccggaaccggaaggcaccatcgccagtacaccaccaccaaccacacagagccaagaagaactccaagatcgccttgccagtagcaacatctagcgcccaggctcaatccatgatgtgggatggaggcgtcgagcacggcagccaggaggcggcgcaccagctgctcccgtggctcggcgcggcgccgttcgccgagccggccgtggcggggttcggcgccatgggggcctacggcgcctgcgacggcggcgtgggcgtcgccggcgggctcgggctcgggcacggcggagtgttcgggttcggcttcgacgcggtgcatcatcatcatcagcagcagcagcagcgcgcggcggaggggagcggcaagcaggcggtggtgtccgggctgctggggagcctgcaggcggagctggggcggatgacggcgcgcgagatgacggacgccaaggcgctggcggcgtcgcggagccacagcgaggccgagcgccggcgccggcagcggatcaacggccacttcgccaggctccgcagcctcctccccaacaccactaagacggacaaggcgtcgctgctggccgaggtgctggaccacgtcaaggagctgaagcggcagacctcggcgatgatggtggccgcggccgccgccgtcgcgggcggcggcggcgacgacgaaggcgacgccgggccggcgcagatgctgcctacggaggccgacgagctggccgtggacgcggcggccgacagggccgggcggctcgtggtgcgcgcgtcgctctgctgcgaggaccgcccggacctcatcccggacatcgtccgggcgctcgccacgctccggatgcgcgcgcgccgggccgagatcaccacgctgggcggccgcgtccggagcgtgctcctcatcaccgcggacgagggagcggaagatgatcatcagggctacgacgaagacgaggacgacgacgggcgctgcccgaacggcggccacgggcgcgcggcgtcgcaccggaggcacgagtgcatcgcgtcggtgcaggaggccctgcgcgacgtgatggaccgccggacggcgagcagcgacacgtcgtcctccggcggtggcggcgggagcatcaagaggcagcgcgtgaactacagcgtgcaggagcagtgcgtgtagtctagcttcttgtgctagcttgcttcgttcatcatgctgtttgttatgcttttgcatggatgcacgcatgggaatgcagagttatttagcatagctagtggtaccagtttagcagtcgtttcaagctttgttgctgtggtttaatttctttagggtataatggtggcgtgggtgcatcagtgcatgcctctgcaagcatgatgggaaagggagattcaggagggagcgttttatgtatccctttgtatgttcatgtatgtaaccatgctctcatggtacctgattactgaattggcatgtcctggggaaaaggtgatatgggtgtacaaaaaaaaaaaaaaaaaaaa

SEQ ID NO: 3566 - protein, 347 aa, Panicum virgatum
  misc_feature: Ceres CLONE 1792254
  misc_feature: Great-hit functional homolog of the protein sequence given in SEQ ID NO 9725
  misc_feature (1)..(50): Pfam Name: HLH Pfam Description: Helix-loop-helix DNA-binding domain
  misc_feature: The sequence is a functional homolog of  SEQ ID NO 1897 in the  10/374,780 US patent application
  misc_feature: The sequence is a functional homolog of  SEQ ID NO 1898 in the  10/374,780 US patent application
  misc_feature: The sequence is a functional homolog of  SEQ ID NO 1899 in the  10/374,780 US patent application
  misc_feature: The sequence is a functional homolog of  SEQ ID NO 1901 in the  10/374,780 US patent application
  misc_feature: Useful for making plants with modulated biomass
  misc_feature: The plant is abnormally small.
  misc_feature: Useful for making plants with modulated growth and phenotype characteristics
MMWDGGVEHGSQEAAHQLLPWLGAAPFAEPAVAGFGAMGAYGACDGGVGVAGGLGLGHGGVFGFGFDAVHHHHQQQQQRAAEGSGKQAVVSGLLGSLQAELGRMTAREMTDAKALAASRSHSEAERRRRQRINGHFARLRSLLPNTTKTDKASLLAEVLDHVKELKRQTSAMMVAAAAAVAGGGGDDEGDAGPAQMLPTEADELAVDAAADRAGRLVVRASLCCEDRPDLIPDIVRALATLRMRARRAEITTLGGRVRSVLLITADEGAEDDHQGYDEDEDDDGRCPNGGHGRAASHRRHECIASVQEALRDVMDRRTASSDTSSSGGGGGSIKRQRVNYSVQEQCV

SEQ ID NO: 3567 - DNA, 1047 bp, Panicum virgatum
  misc_feature: Ceres CLONE 1792258
  misc_feature: Encodes the peptide sequence at SEQ ID NO. 3568
tgcacatcaagaatccagcgccagcagaagagcaccaagctggtacctagcaataatcaggcgatcggcgcagatagatacaactaacccggcccatggcggcggcgtcgcacctcgccgcagtgcttctgatgctcgccgccgccgtcctgtctaccgccccggtggcgcgcggccaggcggcctcggcgccggcgccggcccctgcagcgccgaagacgatcacggccgtcctgaccaaggccgggcagttcaccaagttcctccagctgctgcagtcgacgcgggaggcggagcagatcaccaaccagctcaagggcaagtcgtcgagcggcgggctcacggtgttcgcgccgccggacaacgccttcacggcgctccccgtcggcacgctcaactccctctccgaccagcagaagacgtcgctggtgcagttccacgtcgtgtccatggtgatgccggcctcgcagctcgagaccgtcagcaacccgctgcggacgcaggccggggacaccggccccggcaagtacccgctcaacatcacggcggacggcaccaacgtcaacgtctccaccggggtcgtcaacgccacgctcgacggcacgccgctctacgccggggacaggctcgtcgtgtaccaggtcaacaaggtgctgctgccctgggcgctctacggcccggcgctgccccccgcgccggcgccggcgccggcggagagcaagaagaagaagaaggacgcgccggacgcggcggcggatgcgccggcggcggacaccgcggcggggacgacggcgtcggaggccgcgcggggggtccagggcgtcggagctggatcctgcgtggcggtcgccgtggcagcggctatgtggtgggccatgtgaccacagtaagaatgcatgagtgggtgttgtctcctgattgctttttgaaagtctccctgagatgtggttcgaattcataagttcttttgtttacattttgtattgtggatgtatttgccttcgataacgtttatgttgtactttgcaaaaaaaaaaaaaaaaaaaa

SEQ ID NO: 3568 - protein, 261 aa, Panicum virgatum
  misc_feature: Ceres CLONE 1792258
  misc_feature: Great-hit functional homolog of the protein sequence encoded by LOCUS At5g60490
  misc_feature: Useful for making plants with altered cell wall content and/or composition
MAAASHLAAVLLMLAAAVLSTAPVARGQAASAPAPAPAAPKTITAVLTKAGQFTKFLQLLQSTREAEQITNQLKGKSSSGGLTVFAPPDNAFTALPVGTLNSLSDQQKTSLVQFHVVSMVMPASQLETVSNPLRTQAGDTGPGKYPLNITADGTNVNVSTGVVNATLDGTPLYAGDRLVVYQVNKVLLPWALYGPALPPAPAPAPAESKKKKKDAPDAAADAPAADTAAGTTASEAARGVQGVGAGSCVAVAVAAAMWWAM

SEQ ID NO: 3569 - DNA, 3417 bp, Panicum virgatum
  misc_feature: Ceres CLONE 1792286
  misc_feature: Encodes the peptide sequence at SEQ ID NO. 3570
agcgaacaccgagagccttcctccccgctcgtctcccccccccctccgcgctcgcttcgcgttgctctctctctctcgatctcgcgcgctcccgcccgtctgctccagctagctagatcccccctgggcagccgatcggtggggttccgggcggtggtggtggcggcggaggagagggaagcggcgggggcctggagagcggcgcggatggctctgctgcgccggcgccgacggggccggtgacgcccgccgtggcggtcgcctgaggtgagcgggccggggatcggaaccgccgtgtgtcggggtggacgggggagcgaggcggcgaggacggtggggttggattggattggattaggttgcgcgccgtctgctgaggagggacttcttagggggcggtatttgattattttggagctgtgaggttctgcactaaacagtccactcttcggtctgggtccatctaagcaaagtatcggaacttcaagctcacttaaacccagacacttattatgccatgtttttctactgtgctggtaggttacagtaagtgtttggccttagcagagttgaagataaggacgggggctaggattaaactctgctgacttggtttttgcgtgcaacagatcaacttcagttttcagtagagtaacgacaattggatcaattcaagtaggtgagtggaattgatccttctgaagattctgatccaagttcaattcacgagtatattcgtgaatacgataggttttctcgtggaaattgaacactaatttggctgctcttttggggccggtgcacaaatttgaaatattgggagtgctggaatgatatagaggtctaggaggagatatgaggtactatttgcgtcaggtccagtgtttggttggagatatggaaggaggagctctcttgtttatagatgacctcaactccaagtgaccaagcgagcagctgttgaacaattcccttctatttctgtttctttttcctggatttggagatggaggtgaattcctctggtgaggaaatggtggtaaaggtaagaaagccgtacacaataacaaagcagcgcgagcggtggactgaggcagagcacaaacgcttccttgaagccttgaaactttatggcagagcatggcagcgcatagaagagcatgttgggacaaagacggctgtgcagattagaagtcacgctcaaaagttcttcaccaagttggaaaaggaagctatgaacaatggtacttctccggggcaagctcatgacattgacatacctccaccacggcctaaaaggaagcctaacagtccgtatcctcgaaaaagtggtctgagctctgagacaccatcgaaggaagttccaaatgataaatcaacaaaatcaaatattacagtgggcaatggcaatgtacaaatggcaggcgatgcatctctgcagaaatttcagaggaaggaggtgtctgaaaaaggaagctgctcggaagttcttaatctcttccgagatgccccatctgcatcattttcttcagttaacaaaagctcttcgaataatggtgtactcagggggatcgaactaaccaaaaaagaaatccgagatatgactaccatggaaaagaattcaattaatcccaccatgcaagaggatgtcaaagagataaatgatcaggaaatgggaagggttaatggaatccacgtcagttctaaatgtgaccattctaatgaagaatatttggacttctcaatgcaacaaatgaagctacatccaaagtctttggagacaacatatgtggacaaacaaactgcaagaacttcacacaccctggcggagagaaatggcgcaactagcattcctgtcactggaactgaaggaactcatcctgatcaaacaagcgatcaagtgggagtcaatggaagtatgaatccatgcatccatccgatgctttctatggatctgaaatttgatagcagtgccacaccacagtcttttcctcataattatgctgcctttgctccggtgatgcagtgcaactgcaaccaagatacctacagatcattcgtgaacatgtcatccaccttctccagcatgcttgtttccacattgttgtcaaaccctgccgtccatgcagctgctaggctcgcagcatcatactggccagcagcagaaggtaacactcatgttgatccaaatcaagaaaatcctgcggagggtgttcaaggaagaaacttaggctctcctccaagcatggcttctattgtagcagctacagttgctgcagcatctgcatggtgggcaacacaaggtcttctcccttttttggctccccccatggcttttccatttgtaccagctcctagtgctgcctttcccacagcagatcttccacgaccttcagagaaagacagagattgcctggttgaaaatgcacaaaaggaatgccaagaagctcagaaacaaggccagtctgaagctttgagagttgttgcatcttcggagtctggtgggagtagaaaaggcgacatgtctatccatactgaattaaagatatctcatgtcctgaatgctgaggccacacctaccacaggagctgacacaagtgatgcattgaggaataagaaaaagcaggatcgctcttcatgcggctccaacacgccttcaagtagtgatgtagaggcagaaaatgttcctgagaaggaagacaaggctaacgacaaggcaaagcaagcctcctgcagtaactcttcagctggtgacactaatcaccgcaggtttagaagcagtggaagcacaagtgattcgtggaaggaagtttctgaagagggtcgtctggctttcgatgcactgttcagtagagaaaagcttccacaaagcttttctcccccacaggcagaagaatcaaaggaggttgccaatgaggaggaagatgaagtgaccacagttacggttgacctcaacaagaacgtcacaagcattgatcatgagctcgacatgatggatgaaccaagaacttccttccccaatgaattgtcacacctgaagcttaaatcacgcaaaacaggcttcaaaccatacaagagatgttctgtcgaagcgaaggagaacagggcgccagctagcgacgaggttggtaccaagaggatccgtcttgagagtgaagcatcaacctgatttgcttcctacatggctgccggccaagcctcttcatggactgtgtcaaaagttatatttacacctaagctattataggacttcagaccttgcaatgcaatgcttcactaaactcaatttattgtgtgttgtattttaatgcttgccaagcagcccgtccagactgcttttaaaccttatctcgtagactctgaattaagcattaagcgactcttgaacttcttggttaaaaaaaaaaaaaaaaaaaa

SEQ ID NO: 3570 - protein, 720 aa, Panicum virgatum
  misc_feature: Ceres CLONE 1792286
  misc_feature (1)..(46): Pfam Name: Myb_DNA-binding Pfam Description: Myb-like DNA-binding domain
  misc_feature: The sequence is a functional homolog of  SEQ ID NO 1067 in the  11/479,226 US patent application
  misc_feature: The sequence is a functional homolog of  SEQ ID NO 146 in the  10/374,780 US patent application
  misc_feature: The sequence is a functional homolog of  SEQ ID NO 1806 in the  10/412,699 US patent application
  misc_feature: The sequence is a functional homolog of  SEQ ID NO 254 in the  11/375,241 US patent application
  misc_feature: The sequence is a functional homolog of  SEQ ID NO 464 in the  10/412,699 US patent application
  misc_feature: The sequence is a functional homolog of  SEQ ID NO 794 in the  10/225,066 US patent application
  misc_feature: Useful for making plants with modulated growth and phenotype characteristics
MEVNSSGEEMVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSGLSSETPSKEVPNDKSTKSNITVGNGNVQMAGDASLQKFQRKEVSEKGSCSEVLNLFRDAPSASFSSVNKSSSNNGVLRGIELTKKEIRDMTTMEKNSINPTMQEDVKEINDQEMGRVNGIHVSSKCDHSNEEYLDFSMQQMKLHPKSLETTYVDKQTARTSHTLAERNGATSIPVTGTEGTHPDQTSDQVGVNGSMNPCIHPMLSMDLKFDSSATPQSFPHNYAAFAPVMQCNCNQDTYRSFVNMSSTFSSMLVSTLLSNPAVHAAARLAASYWPAAEGNTHVDPNQENPAEGVQGRNLGSPPSMASIVAATVAAASAWWATQGLLPFLAPPMAFPFVPAPSAAFPTADLPRPSEKDRDCLVENAQKECQEAQKQGQSEALRVVASSESGGSRKGDMSIHTELKISHVLNAEATPTTGADTSDALRNKKKQDRSSCGSNTPSSSDVEAENVPEKEDKANDKAKQASCSNSSAGDTNHRRFRSSGSTSDSWKEVSEEGRLAFDALFSREKLPQSFSPPQAEESKEVANEEEDEVTTVTVDLNKNVTSIDHELDMMDEPRTSFPNELSHLKLKSRKTGFKPYKRCSVEAKENRAPASDEVGTKRIRLESEAST

SEQ ID NO: 3571 - DNA, 1685 bp, Panicum virgatum
  misc_feature: Ceres CLONE 1792299
  misc_feature: Encodes the peptide sequence at SEQ ID NO. 3572
atccgcttcactccgtctcctgcctcccagcgctcatccatccaccaccgcccctgtaataaaagcctccgaatccgggggcctcgtgtgccccgtcctcctcgtcgccggcggagccacctccgcccaccgcagctcgctgacctctcgccggggaaggagcaccgcggcgagcttctccaccgccgccttccacctgaccccaccctccgagattggaagcggcggcggcggcggcggctgccggccatggcgatcccgctcgtgctagtcgtgctccccctcggcctgctcttcctcctctccggcctcatcgtcaacaccatccaggccattctatttgtgacaataaggcccttctcaaagagcttctatcggcgaatcaacagattcctggccgagctgctgtggcttcagctggtttgggttgtggactggtgggcaggcgttaaggtacaacttcatgctgatgaggaaacttaccgatcaatgggtaaagagcatgcactcatcatatcaaatcatcggagtgatatcgattggcttattggatggatattggcacagcgctcaggatgccttggaagtgcgcttgctatgatgaagaagtcatcaaagttccttccagttattggctggtccatgtggtttgcagaatacctctttttggagaggagctgggcaaaggatgaaaagacactaaagtggggcctccaaaggctgaaagacttccccagaccattttggctagcccttttcgttgagggtactcgctttactccagcaaagcttctcgcagctcaggagtatgcagcttcacagggattgccagctccgcgaaatgtacttattccacgcaccaagggatttgtatctgctgtgagtattatgcgggattttgttccagccatttatgatacaactgtaatagttccaaaagactctcctcaaccaacaatgctgcggattttgaaagggcaaccatcagtgatacatgttcgcatgaaacgccatgcaatgagtgagatgccaaagtcagatgaggatgtttcaaagtggtgcaaagatatatttgtagcaaaggatgccttgctggataagcatttggcaacaggcacatttaatgaggagattagaccaattggtcgcccggtgaaatcattgctggtgaccttgttttgggcatgtctcctcctattcggcgccatccagttcttcaagtggacgcaactcctatcgacatggagaggcgtagcgttcaccgctgccgggatggccctagtaacgggggtcatgcatgtgtttatcatgttcacccaggcggagcggtcgagctccgcaagggcagcacgcaaccgggtgaagaaagaatgataggatgacggtattccgggtctggtaaaaggcaatccactgaatggctgcagattcaattcatagacaccaaatttgagggtctctgggccagacaccaaacttgttgtactcaacaggaagcgcatagcgctattcttgtattctgtattctggaagggagttgttttctttgttttccttttgtcagcggaactgtaggatatggattcgttggtaattttacccctgccgccgtgccgcgttatgtggaagtcttcagtgatttatggattagctaagctttccatcaaaaaaaaaaaaaaaaaaaa

SEQ ID NO: 3572 - protein, 374 aa, Panicum virgatum
  misc_feature: Ceres CLONE 1792299
  misc_feature (1)..(158): Pfam Name: Acyltransferase Pfam Description: Acyltransferase
  misc_feature (1)..(374): SWISSPROT Homolog: EC 2.3.1.51 1-acyl-sn-glycerol-3-phosphate acyltransferase PLS1
  misc_feature (8)..(372): SWISSPROT Homolog: EC 2.3.1.51 1-acyl-sn-glycerol-3-phosphate acyltransferase 2
MAIPLVLVVLPLGLLFLLSGLIVNTIQAILFVTIRPFSKSFYRRINRFLAELLWLQLVWVVDWWAGVKVQLHADEETYRSMGKEHALIISNHRSDIDWLIGWILAQRSGCLGSALAMMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQPSVIHVRMKRHAMSEMPKSDEDVSKWCKDIFVAKDALLDKHLATGTFNEEIRPIGRPVKSLLVTLFWACLLLFGAIQFFKWTQLLSTWRGVAFTAAGMALVTGVMHVFIMFTQAERSSSARAARNRVKKE

SEQ ID NO: 3573 - DNA, 1616 bp, Panicum virgatum
  misc_feature: Ceres CLONE 1792303
  misc_feature: Encodes the peptide sequence at SEQ ID NO. 3574
gaacaagagaatccaaaccgttcgaactctccctcccaccgtccagtccagccacccgcctcccatgcccatgccgtcggcttccctccgcctcgccgtcatcggcgcgggtgcggcggggctagccgccgcccgcgagctccgccgcgagggccacgcgcccgtcgtcttcgagcgcgccgccgccgtggggggcacctggctctacgcgccccccgcggcgtcctccgacccgctcggcgccgccgcgacgcactccagcctctacgcctcgctccgcaccaacctgccccgcgagaccatgggcttcctcgacttccccttcgccgcggaggcgcccggctccgccgacctccgcaggttcccgggccacgaggaggtgctccggtacctggaggcgttcgcgcggctgttcgatctactccggctcgtccggttcgagacggaggtgctcagggtgcggagggaggaccgcgggggatgggcggtgacgtctaggaagcttggggacaagggaagcggcgaggaggaggtgtacgacgccgtcgtggtttgcaacgggcactacacggagccgcgcatcgccgtcattccaggtgtagacgcttggccagggaagcagatgcatagccacaattaccgtgtgcccgagccattccttgatcaagtagtgatcataatcggggcttcagcaagcgcagttgacatttcaagagacattgcaagcactgcaaaagaggtccatattgctgataggtcagcaccagttcgcacctgtgagaagcaacctggcaacaataatctgtggcttcattccatgattgaccgtaccgaggaggatggtagtgtggtgttccaggatggcagctcaatcaaagccgatgtcatcatgcactgcactggctacttgtatgactttccattccttggagatgacagtactatcactgtggatgacaaccgcatcgatccactatacaagcatgttttcccaccggaagtggctcctcaactgtccttcattggattgccatggaaggttattccttttccactctttgaactccaaagtaagtgggtcgctagagttctatcggggcggatcatgcttccatccaaagaagaaatgatggaagatgtgaaagctttctactcgaaactagaagcacgtggatggcctaagagatacacccataacttttcaaactaccagtttgagtatgatgattggcttgctgagcaatgcagccatacaccaattgaagaatggaggaagcagatgtacaattttaatgggattaacaaggcagttcgtcctgagagttatcgtgatgagtgggacgatgaccatctcgtggctgaagcaaatgaatatttcaagaaatacctgtagaatccttttcgttattatcatcccctattcaataaatgtgcttgagactgatctgcactgcaataaggatgattgtgtaaatatttacctagtgtggattggccatacatgtgggattagcattccattgatcactcgatgtatatatgagactgatcttcattgaatcattgccttatgaattacagagcaaacaattttgcaaaaaaaaaaaaaaaaaaaa

SEQ ID NO: 3574 - protein, 442 aa, Panicum virgatum
  misc_feature: Ceres CLONE 1792303
  misc_feature (1)..(307): Pfam Name: FMO-like Pfam Description: Flavin-binding monooxygenase-like
  misc_feature (2)..(36): Pfam Name: DAO Pfam Description: FAD dependent oxidoreductase
  misc_feature (1)..(37): Pfam Name: Pyr_redox_2 Pfam Description: Pyridine nucleotide-disulphide oxidoreductase
MPMPSASLRLAVIGAGAAGLAAARELRREGHAPVVFERAAAVGGTWLYAPPAASSDPLGAAATHSSLYASLRTNLPRETMGFLDFPFAAEAPGSADLRRFPGHEEVLRYLEAFARLFDLLRLVRFETEVLRVRREDRGGWAVTSRKLGDKGSGEEEVYDAVVVCNGHYTEPRIAVIPGVDAWPGKQMHSHNYRVPEPFLDQVVIIIGASASAVDISRDIASTAKEVHIADRSAPVRTCEKQPGNNNLWLHSMIDRTEEDGSVVFQDGSSIKADVIMHCTGYLYDFPFLGDDSTITVDDNRIDPLYKHVFPPEVAPQLSFIGLPWKVIPFPLFELQSKWVARVLSGRIMLPSKEEMMEDVKAFYSKLEARGWPKRYTHNFSNYQFEYDDWLAEQCSHTPIEEWRKQMYNFNGINKAVRPESYRDEWDDDHLVAEANEYFKKYL

SEQ ID NO: 3575 - DNA, 1598 bp, Panicum virgatum
  misc_feature: Ceres CLONE 1792311
  misc_feature: Encodes the peptide sequence at SEQ ID NO. 3576
aagcaaatccccccaccgtgggcgtaggaagagaggagaggagaggagaggaaccatcccaaaaccaagagcaggcagcagctcgttcatctcgtgactgctggcctgccgcctcagcgaccacatccatccattcccccatccaccaagccatttccttccccaccctcgcccgcggcggcggcggctccccccttcgagttcggccgacgcatcgcaggaatggggcagatggggggtcccgacggcgacggacgcggcggcgcccacccccaccaccagtaccaggcgctcctcgccgcggtgcagaaccccgcccagggcctgcaccactttcccctccccttccacgtcccgctacaccaaggaccacccgccgccgggccaggaccagcagctgatacagccgcctccacgcacaatgctgctccccactctcagcacccaagagggcttgccgactggagcgattccagcagcagtgccttcgcgtctgtttccgcgcagccagcccctgctaccaccaacgcaccacccgtcccttacaacctctcccagtcttacgcgctatggtcccattacatgcttaacaagaacgccgtgccctactcttcttatcctgcaccacatgaggagaacccccacccactgcgccatactcacatcccaccgcacaaggatccaggttctacatattctatggaaacagcaggttctgcatccagccttgggtttgactctttcactacaatgtcccttggaccaaacatatgcgcccacatgtctgccatggaagcatctctacctgccaaagaagctgagaattcagaggatttgcctacagtggttagaaacagtgacgaaatggacactataaacagtgaggaagtccatcatgacacagctgccactatccctgagtcgaagcctagtcatgaaagctgcaccacgaagttcaactctggagagtaccaagtcgttttgcgcaaagagttgacaaagagcgatgttgcaaatgtcgggcaaattgtgcttcccaagaaggatgctgaggctagtcttccaccattggtgcaaggtgatcctctgatactgcagatggatgacatggtgcttcctgtcacatggaaatttaagtatagattctggccaaacaacaaaagcagaatgtatattctggaagctgcaggtgaatttgtgaagacacatggtctccaggcaggggatgcgctcattatctacaagaactccgtgcccggcaaatttattatccgtgcggagaaggccattcagcagacaaacccctaaacccaacttgatgatgtgggtgtagcagcgccaaaaatggcttttgaggatatgaattcaccataagttcagaactgaaggcattatcaactttcatgactgggttaccatcacaagatgattagtctaacttgttgattcctggtggatggagacgagaaattttgggagaacattggaagtgctgccaatgagcctacatctgagcaggacaagtagtttgcaaaaaaaaaatttcccttctaattcggttgtatttggatgctcgagttctgcattgcattctgaac

SEQ ID NO: 3576 - protein, 361 aa, Panicum virgatum
  misc_feature: Ceres CLONE 1792311
  misc_feature (1)..(104): Pfam Name: B3 Pfam Description: B3 DNA binding domain
MGQMGGPDGDGRGGAHPHHQYQALLAAVQNPAQGLHHFPLPFHVPLHQGPPAAGPGPAADTAASTHNAAPHSQHPRGLADWSDSSSSAFASVSAQPAPATTNAPPVPYNLSQSYALWSHYMLNKNAVPYSSYPAPHEENPHPLRHTHIPPHKDPGSTYSMETAGSASSLGFDSFTTMSLGPNICAHMSAMEASLPAKEAENSEDLPTVVRNSDEMDTINSEEVHHDTAATIPESKPSHESCTTKFNSGEYQVVLRKELTKSDVANVGQIVLPKKDAEASLPPLVQGDPLILQMDDMVLPVTWKFKYRFWPNNKSRMYILEAAGEFVKTHGLQAGDALIIYKNSVPGKFIIRAEKAIQQTNP

SEQ ID NO: 3577 - DNA, 2033 bp, Panicum virgatum
  misc_feature: Ceres CLONE 1792321
  misc_feature: Encodes the peptide sequence at SEQ ID NO. 3578
ctctttctcaccttcctccctcctccgctcgcctacctccgctccggctccgggtctccgtctcgagccttccccagtctccgcacccactcccacgcccccccgttcctcttcctccccatctgctgcgcgcgttcgcctctcacctccacctctctcgcccgccccgacccccgtcctccccgattcacctctctcttctctcccggtcttccttttcccggcggcgacgactgggcttcggcacgtcttcgccggcgacgaacccacaaggaacaaatcgtccactgcttctgtgtaggcacacccaaaagcagcaatctcctctggggtggcgtgatctccactgttccataagtggagccaccaggaaggctgttggataccttccctgctatatattcgcaggctaagcccccaaggttcttgtaggccttacagctctgttccggttggcgtagatgtcgtttcgcagcattgttcgtgatgttcgggacggttttggtagcctgtcgaggcggagctttgaggtgaccatagctggcctttccggactcaccgggcatcacaggggcaaatctcagagcacggtgcatgagctccgtgatacagatctcataatccaggagagccattgggctaatctccctcccgagctcctccgggatgtgatccggaggctggaatccagtgagagaacctggccaaatcgcaagaatgttgtatcctgcgctgctgtttgtcgggcatggagggagatgtgccgggagatcgtgctcagcccggagttctgtgggaagcttaccttcccagtttctttaaagcagcccggtcatcgagatggaatgattcaatgtttcataaagcgagataaatcaaagtctacatatcatctatacttgtgcctgagcactgctgtacttacggagaatggcaagttcctcttatcagctaaaaggaaccgcaaaacaacctgcacagagtatgttatctcgatggatgctgacaacatctcgagatcgagcagcacatatattggaaaaattaggtccaacttcctaggcacaaaatttatgatctatgacacacagcccccttataatggggctattgtccctcacgctggacggaccagccggagattcaactccaagaaagtctcccctaaggtgccaactggtagctacaacatagctcaggtgacgtacgagctaaatgtccttggcacaaggggccctaggcggatgcactgtgtcatgcactccatacctgcctctgcagttgagcctggcggcatagtccctggacagcccgagcagattctgcctcgagcattagaggagtcttttcgcagcaccacctctttctccaagtcatccatcatggaccggtccatggatttcagcagctcccgcgacttcagcagtgtccgtgacttcagcagcgcccgcttttccgacattgccggaggtgccagagttggagatgaagagggacaaaataaggagaggtcgcttgtgcttcgcaacaaggcgcccaggtggcatgaacagctgcaatgctggtgccttaacttccgcggccgtgtaaccattgcctcggtgaagaatttccagctgatcgccgcatcaagccagcccccagctgctggggctccaaccccatcgcaacctgctccaccggaccaggacaaggtcatcctgcagtttggtaaggtggcgaaagatatgttcaccatggactaccgctacccgctctcagccttccaggctttcgcaatctgtttgagtagcttcgacaccaaattagcctgtgagtagatagacatgatggacgtggagctggaaatgcacaaaagaagagatgcatttggccctaggattcaagatgatgcttttgcagttgttgtgttctctaatggttgtattgtgttgtgcttcatgttgtagccttggaaccaaacttctgaccatgtacgtttcacctgccggcatcatggtgggtggctttcgcaaaaaaaaaaaaaaaaaaaa

SEQ ID NO: 3578 - protein, 452 aa, Panicum virgatum
  misc_feature: Ceres CLONE 1792321
  misc_feature: The sequence is a functional homolog of  SEQ ID NO 130 in the  10/225,068 US patent application
  misc_feature: The sequence is a functional homolog of  SEQ ID NO 2896 in the  10/374,780 US patent application
  misc_feature: The sequence is a functional homolog of  SEQ ID NO 458 in the  10/666,642 US patent application
  misc_feature: Useful for making plants with modulated growth and phenotype characteristics
MSFRSIVRDVRDGFGSLSRRSFEVTIAGLSGLTGHHRGKSQSTVHELRDTDLIIQESHWANLPPELLRDVIRRLESSERTWPNRKNVVSCAAVCRAWREMCREIVLSPEFCGKLTFPVSLKQPGHRDGMIQCFIKRDKSKSTYHLYLCLSTAVLTENGKFLLSAKRNRKTTCTEYVISMDADNISRSSSTYIGKIRSNFLGTKFMIYDTQPPYNGAIVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFSSVRDFSSARFSDIAGGARVGDEEGQNKERSLVLRNKAPRWHEQLQCWCLNFRGRVTIASVKNFQLIAASSQPPAAGAPTPSQPAPPDQDKVILQFGKVAKDMFTMDYRYPLSAFQAFAICLSSFDTKLACE

SEQ ID NO: 3579 - DNA, 1605 bp, Panicum virgatum
  misc_feature: Ceres CLONE 1792322
  misc_feature: Encodes the peptide sequence at SEQ ID NO. 3580
acacacggacacacacaccctctggaaacccaggcctccatcggatgcggtgcctgacctgcgccgcgtccaccaccgcgccggccgcgcgcggcgctgtcaggagcgtcagccgccggagggttgtcgtcgagggcgccgcctcggcaacccactgcggcgaggaagcgcctccgaggtcatcgagaacaacatgtgatcttggtgaaatatcaagcaaagccttgtttcttgtgtcaaagaggcagcttatcgccttgtcagccttttgttttagcttacattcttcaaggtacttatcagcacttgctttgggtgaaccatctgtcaaaattgaggatgtgactcctaagattttcccatctgctccattatttccaactgagaaacggatcgctgaacttttcgaaacaaatacttactcagtcgtcaatatttttgatgcaacactacggccacagcttaatgtaactggcgttgtggagatccctgaaggaaatggttctggtgtagtgtgggatgattctggacatattgttacaaattatcatgtggttggcagtgctctttcaaaaaatcccaagcctggtgaagtcgttgcacgtgtcaacattcttgctgctgaggggatacagaaaaatttcgaaggcaaattggttggtgcagatcgtgctaaagatcttgctgttcttaaggtcgatgctcctacagatctcttgaagccaattaatgtggggcaatcatcagccctaagagttggtcagcaatgcttagcaattggaaatccttttggttttgaccatactctaactgttggtgttatcagtggtttaaatcgagacattttcagtcaagctggggtgacaattgggggtggaattcaaacagatgcagctattaaccctggtaacagtggtggtcctttgcttgactcaaaggggcatatgattggtattaacacagcaatttttacacagacaggaacatctgcaggtgttggctttgccatcccatcatcaactgtacttaaaattgctcctcaactaattcagtttggaaaagtacgccgtgctggcttgaatgtggacttcgctccggatcccattgcgtatcagcttaatgttcgcaacggagctcttatactgaaggttcctgcgggcagcgcagcagccaaagcaggtctggctcctaccggcaggggtttcgctggcaacattgttctcggagatgtcgtcaccgcggtggacggcaaacctgtgaagggcaaatccgacctgctgagggttctggacgactacggcgtcggagatgaggtgaccctgacggtccggcgaggcgacggaaccctcgaggtaaccttgcccttggaagaggcaaacatctgacgcgtctctggagacaacaacaaaaaaaaagtccatgtatccgagccgtcgcagtgtaaccgtgtaagtttgtagcacggaccaaggtgggcacgcgcccatttggagcgatcttggctaggaacgagtcccggggctcctcttcgccataggggttcactgcacacgtattgatgttatgatgtacgtgtaccttccccaaaaaaaaaaaaaaaaaaaa

SEQ ID NO: 3580 - protein, 446 aa, Panicum virgatum
  misc_feature: Ceres CLONE 1792322
  misc_feature (1)..(190): Pfam Name: Trypsin Pfam Description: Trypsin
MRCLTCAASTTAPAARGAVRSVSRRRVVVEGAASATHCGEEAPPRSSRTTCDLGEISSKALFLVSKRQLIALSAFCFSLHSSRYLSALALGEPSVKIEDVTPKIFPSAPLFPTEKRIAELFETNTYSVVNIFDATLRPQLNVTGVVEIPEGNGSGVVWDDSGHIVTNYHVVGSALSKNPKPGEVVARVNILAAEGIQKNFEGKLVGADRAKDLAVLKVDAPTDLLKPINVGQSSALRVGQQCLAIGNPFGFDHTLTVGVISGLNRDIFSQAGVTIGGGIQTDAAINPGNSGGPLLDSKGHMIGINTAIFTQTGTSAGVGFAIPSSTVLKIAPQLIQFGKVRRAGLNVDFAPDPIAYQLNVRNGALILKVPAGSAAAKAGLAPTGRGFAGNIVLGDVVTAVDGKPVKGKSDLLRVLDDYGVGDEVTLTVRRGDGTLEVTLPLEEANI

SEQ ID NO: 3581 - DNA, 1838 bp, Panicum virgatum
  misc_feature: Ceres CLONE 1792333
  misc_feature: Encodes the peptide sequence at SEQ ID NO. 3582
actctccaccaacagctcgctcgccccaccgcctcactctcgcttgccacagcctgacagccatcagccaatcagcctcgctcgctagctagcttccaggagcaacagctttgtcgtgtacccaacgtggtttcttggctcgcatcgcaatgccggccatggtggaggaggtccgggcggcggcggaggcgggggcggccgggccgcacttcctggtagtgacctacccggcgcagggccacatcaacccggcgcgccacctcgcgcgccgcctgctccgcgccacgggggcgcgcgtcaccatctccaccgccgcgtccgcgttccgcaagatgttcccgggcgacgaggagggggcggcggccggcgagtgccaccgcgacgccgcggaggtgtggtacgtgccctactccgacggctacgacgccgggttcgaccgcgccgtgcacgaccacacgcactacatgagccaggtcagggtcgtcggctcccgcacgctcggggccgtcctcgaacgcctccgcgccgcggggaggcccgtcacgctcgtcgtctacacgctgctgctctcgtgggtcgccgacgtggcccgcggccacggcgtgcccgccgcgctctactggatccagccggccaccgtgctcgccgcgtacctgcacttcttccgcggcaccgacggcgtggacagggccatcgccgcggcgggcggcgaccccatggccaccgtccgcgtcccgggcctcccgccgctccgcatccgcgacctgccgtcgttcatcgccaacacctccgaggacgacccgtacgcgttcgtcgccgacatgttccgcgagctcgtcgacatgctcggccgcgaggacagccccagcgtgctcaccaacacgttcgacgccatggagcccgaggcggtggcgtcgctgcgcgagcacggcgtcgacatcgtccccgtcggccccgtgctctccttcctcgacgaggcgccgggggccgggtgcgtgtccgtcgcgaaaaacggcggcaacgacctgttcaagcaggacggcacgggctgcctcgagtggctggacgcgcaggcgcccgcctcggtggtgtacatctcgttcgggagcctgtcgatgatgagcaagcggcagatcgaggaggtggcgcgcggcatggcggcgagcgggcggccgttcctgtgggtgctgcgggaggacaaccgcagcagcgagggcgccggcgacgcggcgtcgctcggcggcgagcgcggcatggtggtggagtggtgcgaccaggtgcgggtgctgtcgcacccggccgtggggtgcttcgtcacgcactgcggctggaactcgacgctggagagcgtggcgtgcggcgtgcccaccgtgggggtgccccagtggacggaccagggcaccaacgcgtggctggtggagcggctcggtgccggggtcagggccgccgtcagcgacaaggacggcgtgctggaggccgacgagctgcggaggtgcctcgacttcgccacgtccgagatggtgcgcgccaaggccgccgtgtggagggagaaggcgcacgccgcggcggcggagggcggctcgtcggagcggaacctcagggcgttcgtcgggaagcagctcggcggcggcaactaggctgtcctcgctctctcggtcgcgtcgatgcattgctctatgccaacaaggatggcatagtaggatggatggagcctacaagtacctagaagacaccgacctatatattacacctaatatactgtacttttacattgctgtatccggttcttgggaaatactatcaaacatcggtgtgttcaaaaaaaaaaaaaaaaaaaa

SEQ ID NO: 3582 - protein, 495 aa, Panicum virgatum
  misc_feature: Ceres CLONE 1792333
  misc_feature (1)..(129): Pfam Name: UDPGT Pfam Description: UDP-glucoronosyl and UDP-glucosyl transferase
MPAMVEEVRAAAEAGAAGPHFLVVTYPAQGHINPARHLARRLLRATGARVTISTAASAFRKMFPGDEEGAAAGECHRDAAEVWYVPYSDGYDAGFDRAVHDHTHYMSQVRVVGSRTLGAVLERLRAAGRPVTLVVYTLLLSWVADVARGHGVPAALYWIQPATVLAAYLHFFRGTDGVDRAIAAAGGDPMATVRVPGLPPLRIRDLPSFIANTSEDDPYAFVADMFRELVDMLGREDSPSVLTNTFDAMEPEAVASLREHGVDIVPVGPVLSFLDEAPGAGCVSVAKNGGNDLFKQDGTGCLEWLDAQAPASVVYISFGSLSMMSKRQIEEVARGMAASGRPFLWVLREDNRSSEGAGDAASLGGERGMVVEWCDQVRVLSHPAVGCFVTHCGWNSTLESVACGVPTVGVPQWTDQGTNAWLVERLGAGVRAAVSDKDGVLEADELRRCLDFATSEMVRAKAAVWREKAHAAAAEGGSSERNLRAFVGKQLGGGN

SEQ ID NO: 3583 - DNA, 1806 bp, Panicum virgatum
  misc_feature: Ceres CLONE 1792341
  misc_feature: Encodes the peptide sequence at SEQ ID NO. 3584
agttaatcggctgctccagatcggatcgtacccgtcctacatcatcactgcccagtcgcagatcttgtgctctctctctctctctctgttggtggggttgctgctgccgcggcctgggagatgacggagatggtggtggccgcgcgggcgtcggcgccggcggcggggaggtggggcgcggcgccgccgcaggagctgctggagaggctcaaggactacggccaggagggcgccttcgccttctgggacgagctcggccccgaggagcgcgaccacctcatcagggacatcgagagcctagatcttcctaggatcgatcggatcatccggtgctcgctcagatcacaaggtgctcctgtgccgactgtcgagcctgtgccagagtcaagtgtctcgacggtggacgacagaactcctgaggacaaggaaaggtggtggagaaggggcttgagagccatttcagaggggaagttggctgttgtcctgttggctggtggccaggggactcggcttggcagttctgaccctaagggatgtttcagtattgggcttccatctaggaagtcacttttccaactacaagctgaacggattttgtgtattcagaagctggctgctcaatgcactgatgctccaggtagcacagtgcaaattcactggtatataatgactagtccctttactgatgaagccacacgaaaattctttgaaacccacagatattttggcttagagcctaatcaagtgacttttttccagcaaggtactattccgtgtgtctctcctgatggaagatttattatggagacaccctataaggtagcaaaggctcctgatggcaacggtggagtatatgctgctctaaaatctaaacggttgctggatgatatggcgtcaaaaggtgtgaagtatgtagattgttatggagttgataatgtattggtccgtgttgcagatccaacattccttggatacttcattgacagaggcgtatctgctgctgctaaggttgtaaggaaggcatatccacaagagaaagttggagtatttgttcagcgtggaaggggtggacctctctctgtggtcgaatacagtgaaatggatgcagctatgactaccgaaatcaatcaaactactgggcgccttcgttattgttggagcaatgtttgcctgcatatgttcactttggattttctgaaccaagtaacgaacagtcttgaaaaagatagcatttatcatctggcagagaagagaattccgtcagtccacgggtatacatcaggcttaaagcttgaacagtttatattcgatgtgttcaactattctccatcaacagcgctttttgagattttgcgtgaggaggaatttgcgccagtgaagaatgctaatggtgcaacttatgacactcctgatagtgccagattaatgctgcttcggcttcatagccgatgggttgttgctgcaggtggcttcttgacacattccgtgcccttgtatatgacaggcgttgaagtttctccactttgttcttatgctggagagaatctagaagccatatgccgaggaaggacattccatgcaccaagtgagatttcattctaggcatagtagttgttggaagcaacaatcagaatacaggaagatgagatctgcccaatttttatttcaacatgacaactatattgcaaataggatgtttatattagtcaactcttgactattgtatgttatgcaagcaccgattattgtaatgcagcacttgaagttgcctcctttctcccctggcaaaaaaaaaaaaaaaaaaaa

SEQ ID NO: 3584 - protein, 493 aa, Panicum virgatum
  misc_feature: Ceres CLONE 1792341
  misc_feature (1)..(396): Pfam Name: UDPGP Pfam Description: UTP--glucose-1-phosphate uridylyltransferase
MTEMVVAARASAPAAGRWGAAPPQELLERLKDYGQEGAFAFWDELGPEERDHLIRDIESLDLPRIDRIIRCSLRSQGAPVPTVEPVPESSVSTVDDRTPEDKERWWRRGLRAISEGKLAVVLLAGGQGTRLGSSDPKGCFSIGLPSRKSLFQLQAERILCIQKLAAQCTDAPGSTVQIHWYIMTSPFTDEATRKFFETHRYFGLEPNQVTFFQQGTIPCVSPDGRFIMETPYKVAKAPDGNGGVYAALKSKRLLDDMASKGVKYVDCYGVDNVLVRVADPTFLGYFIDRGVSAAAKVVRKAYPQEKVGVFVQRGRGGPLSVVEYSEMDAAMTTEINQTTGRLRYCWSNVCLHMFTLDFLNQVTNSLEKDSIYHLAEKRIPSVHGYTSGLKLEQFIFDVFNYSPSTALFEILREEEFAPVKNANGATYDTPDSARLMLLRLHSRWVVAAGGFLTHSVPLYMTGVEVSPLCSYAGENLEAICRGRTFHAPSEISF

SEQ ID NO: 3585 - DNA, 2010 bp, Panicum virgatum
  misc_feature: Ceres CLONE 1792344
  misc_feature: Encodes the peptide sequence at SEQ ID NO. 3586
aagctgtcatgcactggcattgtgtgccgtttctcctcgctcgtcactagctgcaatggccaccgtcaccacttcttcgccggccactctgcagtcatgcaagcacgctagccacggcgtggtgcggtactgccctcctctcccgtggaggaggaggagctacagccaggtgtcgacaagagccacggcgagctcacatggtcagccctcggcgatgacaggcggccgggtagaggcgcccgttggcatcgccgcggaggcgggggagaagggcgacagtatccggaggctgcagaacgggccggacgtgcggggcgtggcgctggagggggagaagggccggccagtggacctcacgcctctggcggtcgaggttgtcgcggagagcttcggggagtggctgcgtgaggagctccaacggccggagggcgaggagctgcgggtgtctgtcgggtgcgacccacggctgtcgggcgcaaggctcagcgccgcgctcttcgcggggctcgcgagggcggggtgctccgtgttcgacatgggcctcgccaccacgccagcgtgcttcatgagcaccatactgcctgggttcaactatgacgcgtctattatgatgacggcgtcacacctgccctacacccgcaacggcctcaagttcttcaccaagcgcggcgggttgacctccgtggacgtcgagaagatctgtaatcgcgcggcgcaaaagtacgtggcccggaagatgggcctcggcagcaggggcacgccgccggtggtaatgcgcgtcgacctcatgagcgcctactcccagcacctccgtgacatcatcaagcagcgcgtcgcgcacccgacgcactacgacaccccgctgaagggcttcaaggtcatcgtgaacgccggcaacggctgcggtggcttcttcacgtgggatgtcttggagaagctcggcgccgacacaacgggtagcctgcacctggagcccgacggcatgttccccaaccacatgcccaacccggaggatgccactgccatgtcgctcacccgcgacgccgtgatggcccacggtgcggacctgggggtcgtcttcgataccgacgtggaccgcagcggcgtggtcgacgacactggcgcagctattaacggcgataggctcatcgcgctcatgtcggccatcgtgctggacgagcacccgggcacaatggttgtcaccgacgcgcgcgccagcgatgggctcacgcggttcatcgcctccaggggaggccaccactgcctataccgcgtgggctaccgcaacgtcatcgacaagggcgtccagctcaacaatgacggcgtagagacgcacctgatgatggagaccaccggccacggcgcgctcaaggagaactacttcctcgatgatggtgcgtacatggtggtgaaaattgtcatcgagatggtccggatgaaactggaaggattggagggaggcatagggagcctcatcatggatctcgaggagcctgccgagtcagttttgttgaggatgaacatactaggtgaacccaagcatgcaaggcaaaggggtacaatggccgttgaggctttcaagaattacatccaggaggacaaactttccggttgggtgctcgatgattgcggggattgctcagttggcgagggatgcctcgtggacacaaatgatcatcctatcgatgttgatgcatacatgtacagagcaaaattttacaacgagaatatgagaccattgggcatggtccacgttcgtcaaagtgttcataatcccaatatagcattgaatatgcaatcctatcttcctggtggttgcaaatccatggcaagggatcttcacgaaaggtttttgttggcaagtggagtaaatgagttccttgacactagagaagtagagaaatttgtgaagtagagctttgtaatcaatagatttgtataatgtacatatagatcctaggtggaagaaaaaagtcaccatatatagttggaaaaaaaaaaaaaaaaaaa

SEQ ID NO: 3586 - protein, 619 aa, Panicum virgatum
  misc_feature: Ceres CLONE 1792344
  misc_feature (1)..(113): Pfam Name: PGM_PMM_II Pfam Description: Phosphoglucomutase/phosphomannomutase, alpha/beta/alpha domain II
  misc_feature (1)..(154): Pfam Name: PGM_PMM_I Pfam Description: Phosphoglucomutase/phosphomannomutase, alpha/beta/alpha domain I
MATVTTSSPATLQSCKHASHGVVRYCPPLPWRRRSYSQVSTRATASSHGQPSAMTGGRVEAPVGIAAEAGEKGDSIRRLQNGPDVRGVALEGEKGRPVDLTPLAVEVVAESFGEWLREELQRPEGEELRVSVGCDPRLSGARLSAALFAGLARAGCSVFDMGLATTPACFMSTILPGFNYDASIMMTASHLPYTRNGLKFFTKRGGLTSVDVEKICNRAAQKYVARKMGLGSRGTPPVVMRVDLMSAYSQHLRDIIKQRVAHPTHYDTPLKGFKVIVNAGNGCGGFFTWDVLEKLGADTTGSLHLEPDGMFPNHMPNPEDATAMSLTRDAVMAHGADLGVVFDTDVDRSGVVDDTGAAINGDRLIALMSAIVLDEHPGTMVVTDARASDGLTRFIASRGGHHCLYRVGYRNVIDKGVQLNNDGVETHLMMETTGHGALKENYFLDDGAYMVVKIVIEMVRMKLEGLEGGIGSLIMDLEEPAESVLLRMNILGEPKHARQRGTMAVEAFKNYIQEDKLSGWVLDDCGDCSVGEGCLVDTNDHPIDVDAYMYRAKFYNENMRPLGMVHVRQSVHNPNIALNMQSYLPGGCKSMARDLHERFLLASGVNEFLDTREVEKFVK

SEQ ID NO: 3587 - DNA, 1382 bp, Panicum virgatum
  misc_feature: Ceres CLONE 1792358
  misc_feature: Encodes the peptide sequence at SEQ ID NO. 3588
acaatcaaacagcaaccgatcgttagtgatcaagaagatggcttcgtcttctgctcgtctgatgagcaagctctccctcgccgccgtcctcctgctgtgcgccggcgcgtggctgctggcggaggctcgcccccacggcgacatcgacagcgacttctactccatcgtggggtacgcgccggaggaccttggcagccatgaccggctgatcaagctgttcgaggagtgggtggcccagtaccgcaaggcgtacgcgagcttcgaggagaagctgcggcggttcgaggtgttcaaggacaacctgaagcacatcgacgagatcaacaagaaggtgagcagctactggctgggcctgaacgagttcgccgacctgacgcacgacgagttcaaggccacctacctcgggctcaaccggcggccgaggaacgccgccggtggcggctccttcaggtacgggggcgtgggcgccggcgacgtgcccaaggaggtggactggcgccagaagggcgcggtgacggaggtgaagaaccaggggcagtgcggcagctgctgggccttctcgacggtggcggcggtggagggcatcaaccagatcgtgacgggcaacctgacgtcgctgtcggagcaggagctgatcgactgcagcacggacgggaacaacggctgcaacggcggcatcatggactacgccttctcctacatcgccggcagcggcgggctgcacacggaggaggcgtacccgtacctgatggaggagggtgactgcgaccagaaggccggcgacgagcaggtggtcaccatctccgggtacgaggacgtgccggccaacgacgagcaggccctggtcaaggccctcgcgcaccagcccgtcagcgtcgccatcgaggcgtccggcaggcacttccagttctacaaagggggcgtgttcgatggcccgtgcggcgcggagctggatcacggcgtggcggcggtgggctacggcacgatcaaggggcaggactacatcatcgtgaagaactcgtggggcccgcactggggcgagaaggggtacatccgcatgaagaggggcaccggcaagccggagggcctctgcggcatcaacaagatggcatcctacccaaccaaggaccagtagtgcccggcatcagcatcacttttcactactgtgtgcatgaacatcaaagatcgatcatagcctctctcttttatttttacttctcatcatgttttatgtcttctttcccttttgtgttgagcgtgtttaatttctcgattatattgatcgaggagcaaaaggcactcatgcacgacctgctcggttgaaatgatggatggaataaactttcacctttaatttgttttaaaaaaaaaaaaaaaaaaaa

SEQ ID NO: 3588 - protein, 365 aa, Panicum virgatum
  misc_feature: Ceres CLONE 1792358
  misc_feature (1)..(215): Pfam Name: Peptidase_C1 Pfam Description: Papain family cysteine protease
  misc_feature (33)..(364): SWISSPROT Homolog: EC 3.4.22.30 Caricain precursor
  misc_feature (38)..(363): SWISSPROT Homolog: EC 3.4.22.6 Chymopapain precursor
MASSSARLMSKLSLAAVLLLCAGAWLLAEARPHGDIDSDFYSIVGYAPEDLGSHDRLIKLFEEWVAQYRKAYASFEEKLRRFEVFKDNLKHIDEINKKVSSYWLGLNEFADLTHDEFKATYLGLNRRPRNAAGGGSFRYGGVGAGDVPKEVDWRQKGAVTEVKNQGQCGSCWAFSTVAAVEGINQIVTGNLTSLSEQELIDCSTDGNNGCNGGIMDYAFSYIAGSGGLHTEEAYPYLMEEGDCDQKAGDEQVVTISGYEDVPANDEQALVKALAHQPVSVAIEASGRHFQFYKGGVFDGPCGAELDHGVAAVGYGTIKGQDYIIVKNSWGPHWGEKGYIRMKRGTGKPEGLCGINKMASYPTKDQ

SEQ ID NO: 3589 - DNA, 2382 bp, Panicum virgatum
  misc_feature: Ceres CLONE 1792375
  misc_feature: Encodes the peptide sequence at SEQ ID NO. 3590
atccccatccacggccgcacttgggtgttcgcccgtcggcggaggaagaagggggagtggccgagtgggagccgaactgtaaaagccgtcgggtgggggagcccgcactcggcctcacctcaaaatcgcagaaacccacaggccacggcctgaaaaacccctgctcaaagcctcagattttgcagccgccgccgaagctggggttcgcgtaggaggctgcgccctctgtcctggatccatccgggtaagccatggctgtgaaggcgagctccgtcgacaacaggaccaggagcacggtgtccctatgcatagtcattggcatgtgctgcttcttctacatccttggagcatggcagaagagcgggtttggcaagggagacagcatcgcgctggagatcacaaagcgcacggactgcaccgtcttgccgaacctcagcttcgacacacaccattctaaagctggcagcagctccagtgatcttgtttcaccggtgaagaagttcaagccgtgccctgatcggtacacggattataccccttgtcaagatcagaacagggcgatgaagttccctagggagaacatgaactacagagagaggcactgcccgccacagaaggaaaagctgcactgtttgataccgccgccgaagggatatgtggctccgttcccatggccgaagagtcgggactatgttcctttcgcgaattgcccatacaagagcttgacagttgagaaagccatccagaactgggttcaatatgagggcaatgtgttcagattccctggtggagggacacaatttcctcaaggagcggataagtacattgatcagctggcatcagtcattccgatcgctaatggaactgtcaggactgcacttgacactggttgcggggtagccagttggggagcatatttgttgaaaaggaatgtcttggccatgtcatttgcaccaagagattcgcatgaggcacaagtgcagtttgccctggagagaggtgtccctgctgttattggtgttcttggtacaataaaacttccttatccatcgagggcctttgacatggcacattgttccaggtgtttgattccttggggagcaaatgatgggatgtacttgatggaagttgatagggttctaaggcctggtggctactgggttctgtctggtcctccaattaattggaaggtgaactataagggttggcagcgcacaaagaaggatcttgaagcagagcagaacagaatagaggaaatagctgaccttctatgttgggaaaaagtctcagagaaggatgagatggcgatatggaggaaaagggtgaacaccgagtcttgtccttctaggcaagatgtatccactgtgcagatgtgtgaatcaacaaacccagatgatgtctggtacaagaagatgaaggcctgtgtgacaccccttccagatgtaaaagatgatagtgaagtagctggaggagcaatcaagcccttcccagacaggcttcatgcagttcctccaagaattgctaatggttttattccaggggtttcatctgaggcctttcaaaaagacaataaaatgtggaagaagcatgtgaaggcttatagcactgtgaacaaatatttacttactggtagatacagaaatattatggacatgaatgcaggttttgggggattcgctgccgcgatagagtccccgaaatcttgggtgatgaatgttgtgccaaccattgcgaagatgtctaccttgggggctgtgtatgagcgaggattgatcggcatataccatgactggtgcgaggctttctctacttatccaaggacatatgatcttatccatgctagtggtcttttcaccttgtataagaacaagtgcagcatggaagacattatcttggaaatggaccgcatcttgaggccagaaggtgccgtcataatacgggatgatgtcgacgtcttgattaaggtgaatagccttgctcagggcatgaggtggaacacaaagatggtcgatcatgaggacggccccctcatgcgtgagaagatcttgtatgctgtaaagcagtattgggttggtggaaatgagacggctgtagcttgaagcaaggacgtttccaagcttctaacacgagaaaatctgcaatccaaccttacctgaccagcaattagcatagggagtcatcctgtgtaagggaaatgacccactgtaggggggtggcactgaagcagccaagataccaagcttgctggagatagctgccgccatataatgttgtaacaattttgtaatttttcgaagccctcatgtgaactggatactctgttcaaaagcttgcccatctcagaaaatttcttacggatcccaaaaaaaaaaaaaaaaaaaa

SEQ ID NO: 3590 - protein, 615 aa, Panicum virgatum
  misc_feature: Ceres CLONE 1792375
  misc_feature (1)..(96): Pfam Name: Methyltransf_11 Pfam Description: Methyltransferase domain
MAVKASSVDNRTRSTVSLCIVIGMCCFFYILGAWQKSGFGKGDSIALEITKRTDCTVLPNLSFDTHHSKAGSSSSDLVSPVKKFKPCPDRYTDYTPCQDQNRAMKFPRENMNYRERHCPPQKEKLHCLIPPPKGYVAPFPWPKSRDYVPFANCPYKSLTVEKAIQNWVQYEGNVFRFPGGGTQFPQGADKYIDQLASVIPIANGTVRTALDTGCGVASWGAYLLKRNVLAMSFAPRDSHEAQVQFALERGVPAVIGVLGTIKLPYPSRAFDMAHCSRCLIPWGANDGMYLMEVDRVLRPGGYWVLSGPPINWKVNYKGWQRTKKDLEAEQNRIEEIADLLCWEKVSEKDEMAIWRKRVNTESCPSRQDVSTVQMCESTNPDDVWYKKMKACVTPLPDVKDDSEVAGGAIKPFPDRLHAVPPRIANGFIPGVSSEAFQKDNKMWKKHVKAYSTVNKYLLTGRYRNIMDMNAGFGGFAAAIESPKSWVMNVVPTIAKMSTLGAVYERGLIGIYHDWCEAFSTYPRTYDLIHASGLFTLYKNKCSMEDIILEMDRILRPEGAVIIRDDVDVLIKVNSLAQGMRWNTKMVDHEDGPLMREKILYAVKQYWVGGNETAVA

SEQ ID NO: 3591 - DNA, 1737 bp, Panicum virgatum
  misc_feature: Ceres CLONE 1792377
  misc_feature: Encodes the peptide sequence at SEQ ID NO. 3592
gcaccagcgagccagttatttgcagcaacaatgtactcgtacatgcactgagagtgcagcagcactgagctacctgggcatagtagcatggctcagccgcgcctccaggtgctcgccgccgcggccctggtcctggcgctggcggccggcggcggcgccaccgcgttcgagttcgaggaggccaccgtggacgccatccagctgggcttcaggaacggcagcctcacctcggcggcgctcgtccggttctacctggaccggatcgcccgcctcaaccagcagctccgcgccgtcatcgaggtgaacccggacgcgcccgcgcaggcggcgcgcgccgacgccgagcgcgcggcgtcgggcgggcgctgcgccgcggggctgcacggcgtccccgtcctgctcaaggacaacatcgccacgcgcgaccgcctcaacaccaccgccggctccctcgcgctgctcggctccgtcgtccgccgcgacgccggcgtggccgcccgcctccgccgcgccggcgccgtcatcctcggcaaggccaacccctccgagtggtccggcttccgaccggtcgatcccggctggagcgcccgcggcggccagacgaagaatccgtacgtgctgtcggtgacgccgtgcgggtcgagcgccgggcctggcgtcgcggcggcggcgaacatggcggccgtgacgctgggatcggagacggccggctccataatctgcccgtcggtgctcaactccgtggttgggatcaaaccaactgtcgggctggccagccggtccggcgtcatccccatcacgcctcgccaagacaccatcgggccgatgtgccggacggtgtccgatgccgtccatgtgctggacgccattgtcggctacgatgcgctcgatgctgaggctactggagcagcttccaagtacatcccgcatgggggttacaagcagttcctgaggatcgatggactaaggggcaagaggattggtgtcctcaaagggttctttgagcagtatgaacctgagccccggaaggtctatgagaagcatctcagcacgatgaggcatcacggtgccatcgtgataaaggatcttgaccccgcagggaattggagcgatctcggggaccaaatgggccttctgatgaatgcagagttcaagttgagcctgaatgcttatctgaagaatctgctgtactctccggtccgctccctcgcacaagtcatagcattcaacaatgcacatccagtagaggagaggcttaaagattttgggcaggccgatctcatcgcggccgagaagaccagcggcatcggcgcagcggagagggctgcgctccggcggctcaacgagctgtccacggtcggcctggagaagacgtttaaagagcaccggctggacgccgtcgtggtggtcaacaacgacctctccgccgtccttgccatcggcggctatcccggcatcgccgtgccggctgggtacagcgaggagggagtcccctttgggatagtcttcggcgggctcaggggctacgagcccaggctgatcgagatggcctacgcgttcgagcaggctaccaaaatcagaaggccgccggctttcaggcattagcctaaaaatagccagtagtggcttgccgcaagaaattgggaaaattccctggccttagaagaaatgacgctctcttctatggctctgaaaagttcagcctccttttttgaccaaaaaaaaaaaaaaaaaaaa

SEQ ID NO: 3592 - protein, 505 aa, Panicum virgatum
  misc_feature: Ceres CLONE 1792377
  misc_feature (2)..(448): Pfam Name: Amidase Pfam Description: Amidase
MAQPRLQVLAAAALVLALAAGGGATAFEFEEATVDAIQLGFRNGSLTSAALVRFYLDRIARLNQQLRAVIEVNPDAPAQAARADAERAASGGRCAAGLHGVPVLLKDNIATRDRLNTTAGSLALLGSVVRRDAGVAARLRRAGAVILGKANPSEWSGFRPVDPGWSARGGQTKNPYVLSVTPCGSSAGPGVAAAANMAAVTLGSETAGSIICPSVLNSVVGIKPTVGLASRSGVIPITPRQDTIGPMCRTVSDAVHVLDAIVGYDALDAEATGAASKYIPHGGYKQFLRIDGLRGKRIGVLKGFFEQYEPEPRKVYEKHLSTMRHHGAIVIKDLDPAGNWSDLGDQMGLLMNAEFKLSLNAYLKNLLYSPVRSLAQVIAFNNAHPVEERLKDFGQADLIAAEKTSGIGAAERAALRRLNELSTVGLEKTFKEHRLDAVVVVNNDLSAVLAIGGYPGIAVPAGYSEEGVPFGIVFGGLRGYEPRLIEMAYAFEQATKIRRPPAFRH

SEQ ID NO: 3593 - DNA, 1404 bp, Panicum virgatum
  misc_feature: Ceres CLONE 1792380
  misc_feature: Encodes the peptide sequence at SEQ ID NO. 3594
gccagccacccacccagctcccggccgcgccggtaagctcgtgtcccgctcgctctgcactgcgcgatcactagctacttcagctagctagctagccagccagccgaacgaagagggagggtaggcagcgagcgcggcggcggcggcggcggcgagatggaccacacggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcgaagctcatcggactcgccggcgagaccaacgtccagggagaggagcagaagaagctggacgtgctgtccaacgaggtgttcgtcaaggccctcgtcagcagcggccgcacctgcatacttgtgtcggaggaggacgaggaggcaaccttcgtggatcctgcgctgcgtgggaagtactgcgtctgctttgatccgcttgatggctcctccaacatcgactgtggcgtttcaatcggaacgatctttgggatttacatgatcaaggacaaggacaatgtgacgctggaggacgtgctccagcctggaacgaacatgcttgctgcgggatactgcatgtatggcagttcttgcacgcttgttctgagcactgggagtggtgtcaatggcttcacacttgacccatcacttggcgagttcatactgactcatccagacatcaagatacctaagaagggaaagatttattcagtcaatgaagggaatgccaaaaattgggatgcggctgttgcgaagtttgtggagaagtgtaaataccccaaagatggttcgccacctaaatctttgagatacattggaagtatggttgctgatgttcaccgtaccttgctctatgggggtgtatttttgtaccctgctgacaagaagagcccgaatggaaagctccgtgttctgtacgaagttttccccatgtcattcctcatggagcaggctggaggtcagtccttcacaggcaaagaacgggctcttgatctggtcccaaccaagatccacgagagatccccggtattcctcggcagctacgacgacgtggaagagatcaaagcattgtacgccgaactagcaaagacaagctcggcttgatcagggcatcatacgaggtgtaaatcgacttcctggccttgctgtaacttgattcagacatttcttacctttgtgtcgtcttaagcttgtaagattcagtataatagtatggaggccttgaacatcttcacaagcaactaaaaaggcctccttacaagttacaacatgacgctaatacatacatgtatacatctctaaaaaaaaaaaaaaaaaaaa

SEQ ID NO: 3594 - protein, 343 aa, Panicum virgatum
  misc_feature: Ceres CLONE 1792380
  misc_feature: Great-hit functional homolog of the protein sequence given in SEQ ID NO 9305
  misc_feature (1)..(324): Pfam Name: FBPase Pfam Description: Fructose-1-6-bisphosphatase
  misc_feature (1)..(339): SWISSPROT Homolog: EC 3.1.3.11 Fructose-1,6-bisphosphatase, cytosolic
  misc_feature (1)..(343): SWISSPROT Homolog: EC 3.1.3.11 Fructose-1,6-bisphosphatase, cytosolic
  misc_feature: Useful for making plants with modulated biomass
MDHTADAHRTDLMTITRHVLNEQSRNPESRGDFTILLSHIVLGCKFVASAVNKAGLAKLIGLAGETNVQGEEQKKLDVLSNEVFVKALVSSGRTCILVSEEDEEATFVDPALRGKYCVCFDPLDGSSNIDCGVSIGTIFGIYMIKDKDNVTLEDVLQPGTNMLAAGYCMYGSSCTLVLSTGSGVNGFTLDPSLGEFILTHPDIKIPKKGKIYSVNEGNAKNWDAAVAKFVEKCKYPKDGSPPKSLRYIGSMVADVHRTLLYGGVFLYPADKKSPNGKLRVLYEVFPMSFLMEQAGGQSFTGKERALDLVPTKIHERSPVFLGSYDDVEEIKALYAELAKTSSA

SEQ ID NO: 3595 - DNA, 2067 bp, Panicum virgatum
  misc_feature: Ceres CLONE 1792391
  misc_feature: Encodes the peptide sequence at SEQ ID NO. 3596
gttcccgtgcccgccattcctctcaccaccgccgcggacccaatccccatcccgcgctgcgcccatggcgccccacctgcacctcctcaccccgccggccctcaccattacggccaccgccgccgcccgaggccgccgcggcggcgccggatgggcgggcccgcgggcgccacccagggcccgcgcgcacaactccacctccgtctcctgcatgagggggcggaggtggcggaggctcagcgtcgcggcggcggcggcggaaggcgcggacccgggcgcgatcgggcccgcgggggcgatgcggctcaacgagtacttggtcgccgtcgaccgccccctcggcgtccgcttcgcgctcggcgtcgacggccgcgtcttcgtccactcgctcaggaaaggggggaacgcggagaagtcgaggatcatcatggttggcgacacgctcaagaaggccggcgccggcgaacagggcctcgtcaccatcaaagacctaggtgacacggagcttgcgctgagggacaagtcaggaccattcagccttgtccttgagagaccttttgctcctttcccgatccatcagttacaccaaaataaagattaccacttcctatttaacagagggcgggttcctgttgcttcctggaacagtgctcttttgtccccaaaactgaatgagtcttccaagggagacggaaaatctggttttgctatattctccccgaggttactaagttctcaaggatggtcttttctgtctagtgagaaaggtggactcaatcagaggagcactaacctttcaaatgatcgcataagtgagattgttggtttatattctgatgaagatgattctaatgctgaatgggcgcacggtagctttcctttggaggagtacattaaagcactagaccgtgctaaaggtgaactatactacaatcattcacttggtatgcaattcagtaagattactgaacaaatatttgttggatcatgcatacaaacagagagagatgtgaagatgttgtcagaaacagtgggtattactgctgttctgaatttccaaagtgaaagtgagcgcgttaattggggaatcaattctgaggcaatcaacaattcttgtcgcgagaataacatcttgatggttaactatcctatacgagaggtggattcaatggaccttaggaagaagcttcctttctgtgttggtcttctgttgcgccttataaggaagaactaccgtatatatgtgacttgtaccaccggatatgatagatcaccagcatgtgtgatatcatacttacactgggttcaagatacacctctccatattgctcataagttcatcaccggtttgcactcttgtagacctgacagagctgcaattgtttgggcaacttgggatcttattgctttagttgaaaatggaaggcacgatggtagtcccacacattcagtatgttttgtttggattagtggtcgggagggtgaggatgtagaattggttggggattttacaagtaactggaaagacaaaataaagtgcagccacaagggtgggtcaaggtatgaggctgaagttcgacttcgacatggaaagtactactacaagttcatagttgggggccagtggaggcattcgactgcattgccatcagaaacagatgagcatgggaatgtcaacaacgtgatcagagttggtgatattgcacgtattcgtcctgctccgagccagctacatataagggacccaaccgttgtcaaggtaatagaaagggcgctaactgaggacgagcgattttcattggcatttgctgcacgccgcatggcatttgcaatctgcccaatcagattgtccccgaagcagtaaactttttcagccctttgccagcgagccagatagccaatcatcgagaatttagcaattttatgggtacagaaaacttatgtaacaacagagactgcaacgttgataagtggatcagcaatgagcacaatgtacaccgctttgtaattctatggactgtactgaaataaacgtccctttagagttaaaaaaaaaaaaaaaaaaaa

SEQ ID NO: 3596 - protein, 599 aa, Panicum virgatum
  misc_feature: Ceres CLONE 1792391
  misc_feature (1)..(157): Pfam Name: DSPc Pfam Description: Dual specificity phosphatase, catalytic domain
MAPHLHLLTPPALTITATAAARGRRGGAGWAGPRAPPRARAHNSTSVSCMRGRRWRRLSVAAAAAEGADPGAIGPAGAMRLNEYLVAVDRPLGVRFALGVDGRVFVHSLRKGGNAEKSRIIMVGDTLKKAGAGEQGLVTIKDLGDTELALRDKSGPFSLVLERPFAPFPIHQLHQNKDYHFLFNRGRVPVASWNSALLSPKLNESSKGDGKSGFAIFSPRLLSSQGWSFLSSEKGGLNQRSTNLSNDRISEIVGLYSDEDDSNAEWAHGSFPLEEYIKALDRAKGELYYNHSLGMQFSKITEQIFVGSCIQTERDVKMLSETVGITAVLNFQSESERVNWGINSEAINNSCRENNILMVNYPIREVDSMDLRKKLPFCVGLLLRLIRKNYRIYVTCTTGYDRSPACVISYLHWVQDTPLHIAHKFITGLHSCRPDRAAIVWATWDLIALVENGRHDGSPTHSVCFVWISGREGEDVELVGDFTSNWKDKIKCSHKGGSRYEAEVRLRHGKYYYKFIVGGQWRHSTALPSETDEHGNVNNVIRVGDIARIRPAPSQLHIRDPTVVKVIERALTEDERFSLAFAARRMAFAICPIRLSPKQ

SEQ ID NO: 3597 - DNA, 1535 bp, Panicum virgatum
  misc_feature: Ceres CLONE 1792403
  misc_feature: Encodes the peptide sequence at SEQ ID NO. 3598
gtccacgtggccatcagccccctcctcccaagcctgcaagaaccccctgcccaccccgctccaaatccccccaccacctacctccgcccccgcctcccagatccgactcctcctcctccctcctcagatctcgcccccgctcccgcgcgaaatccaccgcctccgcccgcgccccctcgccggaggagccggtgcgaaccgggggcagcggtggccgggcagaagccagccatggggaaggagggcgccggcagcggcggcggcgactccggcatgtcggagtcggtgatccgcaaggtgctcgtctcgtacatgtacgtggcggtgtggatcttcctctccttcgccgtcatcgtctacaacaagtacatcctcgaccccaagatgtacaactggcccttccccatctcgctcaccatggtgcacatggccttctgctcctccctcgccgtcgcgctcgtccgcgtcctccgcgtcgtcgacctgccctcctcgcccgccatgacgccgcagctctacgtcgcctccgtgctccccatcggcgcgctctactcgctctcgctctggttctcaaactcggcctacatctacctatccgtctccttcatccagatgctcaaggcgctcatgcccgtcgccgtctactccatcggggtgctcttcaagaaggagaccttcaagtcctcctccatgctcaacatgctctccatctccttcggcgtcgccatcgccgcctacggcgaggcgcgcttcgacgtccgcggcgtcgcgctgcagctcgccgccgtcgcgttcgaggccacgcgcctcgtcctaatccagatcctcctcacctccaagggcatctcgctcaaccccatcacctcgctctactacgtcgccccctgctgcctcgccttcctcgtcgtgccctgggtcttcgtcgagctgcccaggctgcgcgccgtcggcaccttccagccggacctcttcgtcttcggcaccaactcgctctgcgccttcgcgctcaacctcgccgtcttcctgctcgtcggcaagacgtccgcgctcaccatgaacgtcgccggcgtcgtcaaggactggctgctcatcgcattctcctggtccgtcatccgcgacaccgtcacccccatcaacctcttcggctacgggattgccttcctcggcgtgggttactacaaccacgtcaagctgcaggcgctcaaggccaaggaggcgcagaagaaggcggcgcaggccgacgaggaggccgggtcgctgctgcaggagcgcgactcgcacgccgaccgcaagactgacaaccaggcgtagcgagtgtgacggatctgatgatccaaccgttctcgcccgattcggtcggttctgaatccagtccccccctctagtgtactgtatgatccgatcttacaagtttgatgcaaaatttgttcatttcttgtcttggtctggtggtagcaaggcaaataagcacgggaaagatgcaagctttgtgtcgaacatgtgaaaatatatgagcaattcttgtctttttgacc

SEQ ID NO: 3598 - protein, 359 aa, Panicum virgatum
  misc_feature: Ceres CLONE 1792403
  misc_feature (1)..(141): Pfam Name: TPT Pfam Description: Triose-phosphate Transporter family
MGKEGAGSGGGDSGMSESVIRKVLVSYMYVAVWIFLSFAVIVYNKYILDPKMYNWPFPISLTMVHMAFCSSLAVALVRVLRVVDLPSSPAMTPQLYVASVLPIGALYSLSLWFSNSAYIYLSVSFIQMLKALMPVAVYSIGVLFKKETFKSSSMLNMLSISFGVAIAAYGEARFDVRGVALQLAAVAFEATRLVLIQILLTSKGISLNPITSLYYVAPCCLAFLVVPWVFVELPRLRAVGTFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHADRKTDNQA

SEQ ID NO: 3599 - DNA, 1035 bp, Panicum virgatum
  misc_feature: Ceres CLONE 1792409
  misc_feature: Encodes the peptide sequence at SEQ ID NO. 3600
gctggttccagtcaaccaccgcttcgtctcccccagccccacaccgctcgccccctcctccggattcccatcttctcccgagcttctcacctcacgtctataaataaggcgccccgcggcgcccatcaattcgcgtcaccgcgtcccgagagcgcgaatcattccgcgcgccgcaaaaaccctagcccagccactgatctcctctcatggcggccaccaccagccaggcgagcctcctcctccagaagcagctcagagatctcgccaagcacccggtggatgggttctcggctgggctggtcgacgacatcaatgttttcgagtggcaggtcaccatcatcggcccgcctgacaccctatatgatggagggtactttaacgcgataatgagcttcccacaaaattacccaaacagcccgccgtcagtcagatttacctctgaaatgtggcatccaaatgtgtatccagatggcagggtgtgtatttctattcttcatccacctggtgaagatcccaacggctatgagctcgcgagtgagcgttggacacctgtgcacaccgttgaaagtatagttctgagcattatttcaatgctctctagtccaaatgacgagtctccagcaaatattgaagcagctaaggaatggagggagaagagggaggacttcaagaaaaaggttaggcgcattgtccgtaaatcacaggaaatgctctgaagaaagtaagagtaccgtggaagctaaccatgccatcaggctgcaagattttgctgtcgagctcccgaatgttcatttgataccagcatcttgtatattttccatttagcgtctgaccattggtgatagtggtattgtcaccagaaatgcactgggacgtgtcgcctactctaaaggtccggttgtatcgtgtggcttgggctaccaatgttgataaacttgaaatgctgcaatttatcataactttggtggtgaacctggtataaacagacgccattcatgtcaccttagtgttgagcgaaaaaaaaaaaaaaaaaaa

SEQ ID NO: 3600 - protein, 169 aa, Panicum virgatum
  misc_feature: Ceres CLONE 1792409
  misc_feature (6)..(168): SWISSPROT Homolog: EC 6.3.2.19 Ubiquitin-conjugating enzyme E2 13
  misc_feature (6)..(168): SWISSPROT Homolog: EC 6.3.2.19 Ubiquitin-conjugating enzyme E2 7
MAATTSQASLLLQKQLRDLAKHPVDGFSAGLVDDINVFEWQVTIIGPPDTLYDGGYFNAIMSFPQNYPNSPPSVRFTSEMWHPNVYPDGRVCISILHPPGEDPNGYELASERWTPVHTVESIVLSIISMLSSPNDESPANIEAAKEWREKREDFKKKVRRIVRKSQEML

SEQ ID NO: 3601 - DNA, 2263 bp, Panicum virgatum
  misc_feature: Ceres CLONE 1792458
  misc_feature: Encodes the peptide sequence at SEQ ID NO. 3602
gcacctggctctctctccctctcgctctacaagaaagcgacccccaccgcgctgcaccaccgagagtcaactggcgagtgatagagtgctgacgggaagcttcgatccctgaccagagttcggaggaggaggaggagatgaacgtcgacttcggcgcgcccaaggagctcgcggggggcctgcagcagcgcagggccctctaccagccccgcctcccgccgtgcctccagggcccgacggtgcgggcggagtacggcgacgcgaccaccaccatcgaccccagctgcgctaacgtcgtcgcgcaggccttcccgaacaccttcagccagccgctcgtcagcttcgtcgcgccggccgacgccgccgccgccgccgccgccgccgccgccgccgccgcggaggagcgccctgcgatcagggtgggcgtggtgttctccgggaggcagtcgccgggagggcacaacgtcgtctggggtctgcatgacgctctcaaagcctacaatcctcagagcgtgctctacggatttgttggtggcacagaggggctgtttgcaaacaagacactggagatcactgacgatgttcttacttcctacaagaaccaaggtggtttcgatttgctcggcaggagtatcgatcagatccgcacaactaagcaagtcaactctgcaatggcaacatgccgcagtctgaacttggatgggctggtcatcattggaggagtgacctccaattcagatgctgcacagcttgcagagatccttatccaaaataactgtaagaccaaggttgttggtgtgccagtttcattgaatggtgatctcaagaaccagtttgttgaaacaaccgttggatttgatacagtttgcaaggtaaattcacagcttgtaagcaatgtttgcctcgatgcaatctcagctggaaagtactattatttcgttcgtctgatgggacgaaaagcatcccatgttgccttcgaatgtgcacttcagtcacacccaaacatgctcatcttaggagaggaggtggcattgtcaaaactcactctaatggagattataaacaagatatgtgatggagtgcaagcaagagcagaattagggaaataccatggtgtgctagttattccagaaggactaatagaaagcattccagaaatgtatgctctcattcaggaaatcaatatccttcacaacaataatgttcctgtggctgagatgtcatcgcaattgtctccatgggcagctgctctgttccagttcctgccacccttcatcagaagagagcttcttctccaccaagaatcagataactctgcacagttgtcccagattgacacagagcaactattagctcacttagtggaaacagaaatgataaagagaacaaaagaaggtagatacaagggaaggaagttcagttccgtctgtcatttcttcggatatcaggctcgaggatcaataccatcaaattttgactgcgactatgcttatgctcttggacgtatctccctgcatatgattgcagctggattgactgggtacatggcaactgtggctaatctaaaggaccctgtagacaaatggagatgtgctgctgctcctttaactgcgatgatgactgtcaagaggcatttacgtggccctggagcaatccctataggaaggccttccatccatccttctccgattgacctgaaagggaaggcttatgagttactgcgagagaaggcttcaagcttcctcctggatgacttctaccgaacccctggaggcattcagttcgaagggcctggttcagatgcaaaacccatcacacttaccattgagaaccaggactacatgggtgatattgagattctgaaagactgtctcagcaaggtgaggaccatggtgaagccagggtgctcccgggagatcctcaaggcggcaattagttccatgttgtcggtgacggacgtgctgatggtgatgtcccaccccctcaacgctgagctgcctctctaccatttcaagtgagcgtcgatgtcagcctgcctgcgtctgggttgttgtagagtgattccagtttgtaacagcagcagattctggttcttgggctgccggtattcggtagcttccttgttttgttttccctttctgactgagaagcactggggttattcatgccaataaacacgggaacagcacttgacaccgaaactggattggaaagatacaggttttcagccttgtttgcctgacaaaaaaaaaaaaaaaaaaaa

SEQ ID NO: 3602 - protein, 626 aa, Panicum virgatum
  misc_feature: Ceres CLONE 1792458
  misc_feature (1)..(277): Pfam Name: PFK Pfam Description: Phosphofructokinase
  misc_feature (1)..(621): SWISSPROT Homolog: EC 2.7.1.90 Pyrophosphate- -fructose 6-phosphate 1-phosphotransferase alpha subunit
  misc_feature (1)..(622): SWISSPROT Homolog: EC 2.7.1.90 Pyrophosphate- -fructose 6-phosphate 1-phosphotransferase alpha subunit
MNVDFGAPKELAGGLQQRRALYQPRLPPCLQGPTVRAEYGDATTTIDPSCANVVAQAFPNTFSQPLVSFVAPADAAAAAAAAAAAAAEERPAIRVGVVFSGRQSPGGHNVVWGLHDALKAYNPQSVLYGFVGGTEGLFANKTLEITDDVLTSYKNQGGFDLLGRSIDQIRTTKQVNSAMATCRSLNLDGLVIIGGVTSNSDAAQLAEILIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIINKICDGVQARAELGKYHGVLVIPEGLIESIPEMYALIQEINILHNNNVPVAEMSSQLSPWAAALFQFLPPFIRRELLLHQESDNSAQLSQIDTEQLLAHLVETEMIKRTKEGRYKGRKFSSVCHFFGYQARGSIPSNFDCDYAYALGRISLHMIAAGLTGYMATVANLKDPVDKWRCAAAPLTAMMTVKRHLRGPGAIPIGRPSIHPSPIDLKGKAYELLREKASSFLLDDFYRTPGGIQFEGPGSDAKPITLTIENQDYMGDIEILKDCLSKVRTMVKPGCSREILKAAISSMLSVTDVLMVMSHPLNAELPLYHFK

SEQ ID NO: 3603 - DNA, 1619 bp, Panicum virgatum
  misc_feature: Ceres CLONE 1792463
  misc_feature: Encodes the peptide sequence at SEQ ID NO. 3604
agccagccagcccgcccgctcccagagagagacccgacccgacccccggtaacggcaacccccggccgccggcgacatggtgttcgagcaggaggaggaggtggcgccgggggccgtgcacgggcaccggctgtccacggtggtgccgagctcggtgacgggggaggtggactacgcgctggcggacgccgacctcgccttcaagctgcactacctccgcggggcctactactacccgcccggcgacgtggcgcgcggcctcaccaccaaggtgctcaaggaccccatgttcccgtggctcgacgactacttccccgtcgccggccgcgtccgccgcgccgaggagggggcgccggcgccggcggggggccagcccgaggccgccgcgcgccgcccctacatcaagtgcaacgactgcggggtgcgcatcgtggaggccaagtgcgaccgcgacatggccgactggctccgcgacgacgcgcccgaccgcgtccggcagctctgctacgacaaggtgctcggcccggagctctttttctcgccgctgctctacgtccagatcacaaacttcaaatgcggcgggctggcgctcggcttcagctgggcgcacctcatcggcgacgtattctcggccgccacctgcttcaacaagtgggcgcagatcctgagcggcaagaagccggaagccaccgtcctcaccccggagaacaagccgctgcagggccactctccagctggcgccgccgccgcgccgcgctccgtcaagcaggtcgggcccatcgaggaccactggctggtccccccgggccgcgacatggcgtgctactccttccacgttacggaggcaaccctgaagaagctccagcagcaggggcgccatgcgggcaccttcgagctcgtcgccgcgctgctgtggcagacggtggccaagatcaggcgcagcgtggacaccgtgaccgtggtcaggaccgacgcggccgcccggagcggcagggccctggcgaacgagatgaaaatcgggtacgtggaggcgtcgggctcgtcgccggcgaagacggacgtggctgagctggcggcgctgctggccaagggcgtggtcgacgagaccgccgcggtggcggcgttcccgggggacgtgctcgtgtacggcggcgcccacctgacgctcgtggacatggagcaggtagacgtgtacgggctggagatcaaggggctgcgcccggtccacgtggagtacggcatggacggcgtcggcgaggagggcgcggtgctggtgcagcccgacgccgacgggcgtggccggcttgtcaccgcggtgctgcccagggacgagatcgagagcttccgcgccgcgctcgggagcgcgctgccggccgccgcctgaacgcgagcaccgcgccgcggcgtccgtctgaaagctctagtgtggtgatggctacgttactgttacggtttggtgagcttagtttctgcaatcgatttgagaagtgttctgtactggatgatgctccctaataatttgctcgaatagcttatgcagaatgtaccaagatttacacaggaaacttcgaaaaataatagtttgagagttgagacagcaaaaaaaaaaaaaaaaaaaa

SEQ ID NO: 3604 - protein, 435 aa, Panicum virgatum
  misc_feature: Ceres CLONE 1792463
  misc_feature (1)..(119): Pfam Name: Transferase Pfam Description: Transferase family
MVFEQEEEVAPGAVHGHRLSTVVPSSVTGEVDYALADADLAFKLHYLRGAYYYPPGDVARGLTTKVLKDPMFPWLDDYFPVAGRVRRAEEGAPAPAGGQPEAAARRPYIKCNDCGVRIVEAKCDRDMADWLRDDAPDRVRQLCYDKVLGPELFFSPLLYVQITNFKCGGLALGFSWAHLIGDVFSAATCFNKWAQILSGKKPEATVLTPENKPLQGHSPAGAAAAPRSVKQVGPIEDHWLVPPGRDMACYSFHVTEATLKKLQQQGRHAGTFELVAALLWQTVAKIRRSVDTVTVVRTDAAARSGRALANEMKIGYVEASGSSPAKTDVAELAALLAKGVVDETAAVAAFPGDVLVYGGAHLTLVDMEQVDVYGLEIKGLRPVHVEYGMDGVGEEGAVLVQPDADGRGRLVTAVLPRDEIESFRAALGSALPAAA

SEQ ID NO: 3605 - DNA, 1711 bp, Panicum virgatum
  misc_feature: Ceres CLONE 1792470
  misc_feature: Encodes the peptide sequence at SEQ ID NO. 3606
acacttgcgctgcgcataaaacttctgacgagagcggctcccacaccctgtccatccacgaggaatcccccagcgcgcgcgcgggcaccaagccaccaccaaccatggcggccgcctcgctcaagctggcctcccccaaacccctcgcccccgcgccgctcctccgcgggcgcggcgcggcccaggcgcgtcccatccccgcgcgccgcggcccgcttcccgcccgcgtcgccgtgcatccccccgccgcgccggccgccccgcgcatcggctccttcgacaaggtgctggaggcgctgatcggcgggaccgacttctcggaggatgacgcggaggccacgctgcggctgctgctggaggagaagaacgaggcgcgcatcgccgccttcctcgtcctcctcagggccaagggcgagacctaccaagagatagtggggctggcgaaggcgatgctgagctgctgcgtccgggtcgacgggctggacgacgccgtagacattgtcgggactggcggcgacggcgctgacaccgtcaacatctccaccggttccaccatcatcgccgccgccgccggcgccaaggtcgctaagcaagggagcaggtccagctcgtcggcgtgcggcagcgccgatgtgctggaggcgctgggcgtcaacatcgagcttgggcccgagggtattaaacggtgtgtcaatgaggtgggtgtcggattcatgatgtctgcaaattatcatcctgcaatgaaaattgtcagacctgtgaggaagaatctgaaaataaagacagtgttcaatatccttggtcctctactgaatccagcaagggtgcctcatgctgttattggtgtttaccatgagaacatagttaccaagatggctaagtctgcacagaaatttggaatgaagagagcattggttgtccattcaaagggtttggacgaaataagcccactaggtcctggatatatacttgatgttactccagaaaagattgaaaaaatgctcttcgatccattggattttggcattcctcgctgcacattggaagatctgaaaggaggcgatccagcatttaatgcaaaagttcttcaggatgttcttgctggtcaaagagggtcgattgcagatgcccttgttctgaatgccgcggcctcgctccttgtcagtggtaaagtaaagaatttacatgaaggtgttgcactagcacaggagacacatcggtccggaaaggccattaatacacttgagtcttggataaaggtttcgaacagttccaagtgaccgagcaacattgattagcaacatatggatttctggaataaggcgtgaggaatggtggcaaataagtgtaacagcccatgggacagatgggccgggccaaattcggagttaccgtagcagctactgtagcagcgcgaatttagtcccgtactaggagttgagttgagtccagaccagtttaaataccaggcccagggaagctaaataattctggttgcaattttttgcgcaaagcgaggacgaaagcacaagagagttatttagtaggtgtgatttactcaacgtgtagagtagatcttagccgttatcccggttcaggtccttaataaggactcattaagtccatccgtcatccgtgtattattgggttcttcttctccctttttgttcatgatatgtcgtgtcacaaccaaaaaaaaaaaaaaaaaaaa

SEQ ID NO: 3606 - protein, 391 aa, Panicum virgatum
  misc_feature: Ceres CLONE 1792470
  misc_feature (1)..(252): Pfam Name: Glycos_transf_3 Pfam Description: Glycosyl transferase family, a/b domain
  misc_feature (36)..(388): SWISSPROT Homolog: EC 2.4.2.18 Anthranilate phosphoribosyltransferase, chloroplast precursor
MAAASLKLASPKPLAPAPLLRGRGAAQARPIPARRGPLPARVAVHPPAAPAAPRIGSFDKVLEALIGGTDFSEDDAEATLRLLLEEKNEARIAAFLVLLRAKGETYQEIVGLAKAMLSCCVRVDGLDDAVDIVGTGGDGADTVNISTGSTIIAAAAGAKVAKQGSRSSSSACGSADVLEALGVNIELGPEGIKRCVNEVGVGFMMSANYHPAMKIVRPVRKNLKIKTVFNILGPLLNPARVPHAVIGVYHENIVTKMAKSAQKFGMKRALVVHSKGLDEISPLGPGYILDVTPEKIEKMLFDPLDFGIPRCTLEDLKGGDPAFNAKVLQDVLAGQRGSIADALVLNAAASLLVSGKVKNLHEGVALAQETHRSGKAINTLESWIKVSNSSK

SEQ ID NO: 3607 - DNA, 1194 bp, Panicum virgatum
  misc_feature: Ceres CLONE 1792485
  misc_feature: Encodes the peptide sequence at SEQ ID NO. 3608
aagaacgcagtccgtccctcccttcctctcccccttcccgtaccgtcttgttgcccgctcctctcccgtttctcccccactttctctgggctcggagaaccggagagaggcgcgcgcggccatggcgtccgtcgcctcccggttcatcaagtgcgtcacggtcggcgacggcgcagttggcaagacctgtatgctcatctgctacaccagcaacaagttccccaccgactacatacctactgtgttcgacaatttcagcgcaaacgtagttgtggatggcaccacggtgaacttaggcctttgggatactgcggggcaggaagattacaaccgactgaggcctctaagctaccgtggtgctgatgttttcgtgcttgccttctcacttgtgagccgagctagctacgagaacatcatgaagaagtggataccggagcttcagcattatgcacctggggtgcccattgttttggcaggcacgaaattggatcttcgtgaagacaagcactacttgatggaccatcctgggttggtgcctgttaccacagtgcagggggaggaacttcgtagacaaattggtgctatgtattatattgagtgcagctcaaagacacagcagaatgtcaaagctgtgtttgatgctgccatcaaggtagtaatccagcctccaactaaactaagagaaaagaagaaaaagaaatcacgcaaaggatgttccatgatggacgttttctgtggaaggaaaatgctatgcttcaaatcctgaatgattgaagaggagggtctatacatgacgaaatatcaggagaatgaccacaagtttgggaagcttgaagtctgaatgtgcttgttgcacatgtgtatatctgcacctttggttaatcacaagatgtagatgattgaaactagtctgcttaagcatcgtgcactgctggtgcggttagctctccctctgaattaggcagttcgatggaggccaaagagacattgagattttgttctgtcatggcgaagtcacagcatttgtgaatctgatctcgtcgtattttctgttagctagtagcttatccctcattccatgtcagaatccatagcaacattcgagtttttgcttgtcttgagcatatcagcatatgtgatattctagtcgtaacagagatactttcaagcaatcaaaaaaaaaaaaaaaaaaaa

SEQ ID NO: 3608 - protein, 214 aa, Panicum virgatum
  misc_feature: Ceres CLONE 1792485
  misc_feature: Great-hit functional homolog of the protein sequence given in SEQ ID NO 9499
  misc_feature: Useful for making plants with modulated nitrogen use efficiency
MASVASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPIVLAGTKLDLREDKHYLMDHPGLVPVTTVQGEELRRQIGAMYYIECSSKTQQNVKAVFDAAIKVVIQPPTKLREKKKKKSRKGCSMMDVFCGRKMLCFKS

SEQ ID NO: 3609 - DNA, 2744 bp, Panicum virgatum
  misc_feature: Ceres CLONE 1792490
  misc_feature: Encodes the peptide sequence at SEQ ID NO. 3610
aaaaaaaaaacaaataaaccaaaccaaaataaattaaaaaaactaaatcataaacaacccaaaccttaaaattatatttttccatatccaaaattttacacaattataaacaaaaaacaattccacaaaaaaaaaaacaaaacccacaaaaacaccaaaaacaaaaaaaacccccacaaaaaaaaaaaaaaaaaaaaaatccaaccacaaaascggtggcggccgctctagaacwagwrrgatcccccgssgctgcaggaattcgagtgagcttagcggagctgaaaaaaaaaaaaaaaaaaaaaaaaaaaaaaaaaaaaaaaaaaaaaaaaaaaaaaagaagagtagacctctccctcccgcaaaactttccccaatcccctccctccaatccaatctcctctacaaccctagcagcagcaggcacgcgcatgacccacccctcctcctccgccccgcctccggcggccgcggaggccacctccctcgcgccgggcttccgcttccaccccacggacgaggagctcgtctcctactacctcaagcgcaaggtcctcggccgcccactcaaggtcgacgccatcgccgaggtcgacctctacaagctcgagccctgggacctccccgcccgctcccgcctccgctcccgcgactcccagtggtacttcttcagccgcctcgaccgcaagcacgccaaccgcgcccgcaccaaccgcgccacatccggggggtactggaagaccaccggcaaggacagggaggtgcgccatgggcccaggatcgtggggatgaagaagacgctcgtcttccacgccggacgcgcgcccaagggcgagcgcaccaactgggtaatgcacgagtaccgactcgagggcgaagaggcctcggggatcccgcaggactcctttgtggtgtgccggatcttccagaaagctggcccaggtccacagaacggggcacagtatggagcacccttcgtcgaggaggaatgggaggaggatgacgaagatgtcggtttgcttccggtcgagggtgatgctgttgttgaccatgaggtgccccccgctcctaaggagatccctggtactttggagaaaggctaccttcaaatgagcgatctcattcagggtttgggtgatcaaaatgggaatggtacaattggtttgccagtttctgatacctcaaataatagcaaccattctgaagatgtagatggaaattctggggacattttaagtgacccgaaccttgcctctaattttcttcagtatgttgagcctggggagcaaaatagcttaatgcttaatggaaatatgatatcaaatgccaatgctggatattttcttaataatttcagccccagtgatggattcctagagctgaaggattttgcagatgctgcaaatctagattgccctgtaggcaatgaatccaccgtctgtccttcggatggttgggcatggaaaacacccgattctttggaaactgtaaatggagctaacaatgatattcctccactccctgatgaccagattttccagcctgatgagctggaacagttgttgcagtcaatacaagaagattcccattttggctcaagtgtcattgatcctccacattcttctataacaaattcagttatgccagaggatgattctttgatgttctatgatgcacccttcgattccaccatgtgtgatgatgggtttaggcaggtgaatggaattcttaattcccctgcaaccaatctatcaggtattggcatggtggatgatggtatgccatattatgatgcaatggatgataatttattcaatgatattctgggcaacatacagcagtcagctggtagttcccatgcttttaatggtccagttctcacccaagaggtcaacaataccatgtatacatatagtccaactcaaaaggttttagaacctaattttgtagttggtgctccatcatctgctaggttacctgaggctggtagtcagttaaattgtgttgttttaccagatgggcaagctaagagtagttccatcggaaagcggatattggattccatctccgctccaccagcttttgcatcggagttcccggcacacctccgcaaatccttagctcctatttctggagcacgccccaacaccttccatgtctctgctgaagtgatcagtataggtagtttagctgtagcttctgggcctgataagtggtccctgcaaaagaatcaaggcatggagctgctcatcacagattttgagcctggtacccgtatacactgtggctgcagcacgattaccacggtgctgcgtggtggcttctgccttgtcttcttttcggcaataatgctcttggtgagctacgaggtgggcatgtgcatctatggcaaatagcagcctggtattggagtaagataatctcatgacacttaggttaatccgctgtgttttgaggcagccgcaacttgggcatccgcttaagtgtattgcattgcatgacatggacctgtggagtttagcaatagcagtagcgtcttgcagcccgagagctaatggtgtatggctgagtatgaattcctccagtgctgttgttataagtgtgcgtactgcttatcatcacatcgggatgtgacgatgctatttgtcatgcttctggctgcaacggacaatgttagtgcagaatcctgtatatatatttcagatcagattcaccgtggctgaatcatgatgcttttgcggtac

SEQ ID NO: 3610 - protein, 654 aa, Panicum virgatum
  misc_feature: Ceres CLONE 1792490
  misc_feature: Great-hit functional homolog of the protein sequence given in SEQ ID NO 9542
  misc_feature: Useful for making plants with altered alkaloid content
MTHPSSSAPPPAAAEATSLAPGFRFHPTDEELVSYYLKRKVLGRPLKVDAIAEVDLYKLEPWDLPARSRLRSRDSQWYFFSRLDRKHANRARTNRATSGGYWKTTGKDREVRHGPRIVGMKKTLVFHAGRAPKGERTNWVMHEYRLEGEEASGIPQDSFVVCRIFQKAGPGPQNGAQYGAPFVEEEWEEDDEDVGLLPVEGDAVVDHEVPPAPKEIPGTLEKGYLQMSDLIQGLGDQNGNGTIGLPVSDTSNNSNHSEDVDGNSGDILSDPNLASNFLQYVEPGEQNSLMLNGNMISNANAGYFLNNFSPSDGFLELKDFADAANLDCPVGNESTVCPSDGWAWKTPDSLETVNGANNDIPPLPDDQIFQPDELEQLLQSIQEDSHFGSSVIDPPHSSITNSVMPEDDSLMFYDAPFDSTMCDDGFRQVNGILNSPATNLSGIGMVDDGMPYYDAMDDNLFNDILGNIQQSAGSSHAFNGPVLTQEVNNTMYTYSPTQKVLEPNFVVGAPSSARLPEAGSQLNCVVLPDGQAKSSSIGKRILDSISAPPAFASEFPAHLRKSLAPISGARPNTFHVSAEVISIGSLAVASGPDKWSLQKNQGMELLITDFEPGTRIHCGCSTITTVLRGGFCLVFFSAIMLLVSYEVGMCIYGK

SEQ ID NO: 3611 - DNA, 2071 bp, Panicum virgatum
  misc_feature: Ceres CLONE 1792495
  misc_feature: Encodes the peptide sequence at SEQ ID NO. 3612
cttcttccccactccgccgccgccgtggtttgtcttccgtcccttggcctcccgcagcggccagcggccctccgccccctccaaatcacacccagacccctagcatttaaactattccctaatccaacccctgtccccctcctccatctcgctgctcgtctgacaacgccgcctcctctcgtcctctataagggcgccgccggggagagagagcggcaatgacttcagctctccggcggaaggcggcggagatggcttcggcggcggcttcggcggcgcagtgcttcagctcctactcctcgtccccggccacgtgggctctgcggcagcgcggtggcgcccgggtgcttcagctctcttcccggcggagcttctgcgtctccgcggcagccggcggattcgacaaccagaaccgcgagtatgtgatcgtcggcggagggaacgcggcggggtacgcggccaggacgttcgtcgagcatggcatggctgatggccgcctctgcatcgtctccaaggagccagttccaccatatgagcggccagcattgaccaaaggctatctctttcctccggacaagaagccggcacgcctacctggttttcatacatgtgttggatctggtggacagcgacagactgctgaatggtacaaggagaatggtatagaggtgttgtatgaggatccagttgtagcatttgatggcaaaacacagaccttgaaaacttcgtcagggaaaattctgaagtatggctcacttattatttctactggctgcgaagcttcaagattacctgagaaaattggagggaaattaccaggagttcactacatacgtgatgttgctgatgctgattctctagtatcctcactgggaagtgcaaaaaaagttcttgtcattggcggaggttatattggcatggaggtagctgcagcagcttgtggttggaatcttgacacaactattgtattcccagaggaccacattatgccaagattatttacaccttcccttgctaagaagtatgaggatctgtatcagcaaaatggtgtcaaattcattaagggagctctaatcgacaaacttgaagctggctctgatggaagggtgtcttctgctgtacttaaggatggatctgtagttgaagcagatacagtaattgttggcataggagcaaaaccagttgttgggccctttgaagctgttggagtcaaccctgaagttggtggaatagaggttgattccttgttcagaactagcggacctggcatctttgctatcggagatgtagcagcatttcccctgaagatgtacaatagaattgctcgagtggagcatgtggatcatgctcggaaatctgcacaccactgtgttgaaacacttctaacatcccagacaaaagcgtatgattaccttccatatttctactcaagagtttttgagtatgaaggaagttcaagaaaagtttggtggcagttttatggcgataacgttggtgaaacagttgaagtagggaactttgatccaaaggttgctactttctggattgactcagatagtcgactgaagggtgttttccttgagagtggaacctcagaggaattctcgcttcttccacaactcgccaagtctcagcccattgttgacaaatctaagctccaggccggggcttctgttgaagatgcattagagatcgcaagaagctctcttcagtctggtgcttcggtttagctctcgacatctaggaactacttcttggcctgcgtcctggcgctgtcatattttgaatcatcaagaccacatcatcaataacaattccgtagcattcatttccacgggattgtgatattcttactgtacctgtaattgccatttccatcttgaaataaacttgatcaccctttgaggggttgatgaggatgatagaatgaaaccttcatgccacttctctttgattcattttctgatctgtaacgtggttactacctgatatacactgttcatgtgatagtaaatcaagaaccaggcctgtcatattatccattgatctttaaaaaaaaaaaaaaaaaaaa

SEQ ID NO: 3612 - protein, 503 aa, Panicum virgatum
  misc_feature: Ceres CLONE 1792495
  misc_feature (1)..(296): Pfam Name: Pyr_redox_2 Pfam Description: Pyridine nucleotide-disulphide oxidoreductase
  misc_feature (3)..(499): SWISSPROT Homolog: EC 1.6.5.4 Monodehydroascorbate reductase, chloroplast precursor
MTSALRRKAAEMASAAASAAQCFSSYSSSPATWALRQRGGARVLQLSSRRSFCVSAAAGGFDNQNREYVIVGGGNAAGYAARTFVEHGMADGRLCIVSKEPVPPYERPALTKGYLFPPDKKPARLPGFHTCVGSGGQRQTAEWYKENGIEVLYEDPVVAFDGKTQTLKTSSGKILKYGSLIISTGCEASRLPEKIGGKLPGVHYIRDVADADSLVSSLGSAKKVLVIGGGYIGMEVAAAACGWNLDTTIVFPEDHIMPRLFTPSLAKKYEDLYQQNGVKFIKGALIDKLEAGSDGRVSSAVLKDGSVVEADTVIVGIGAKPVVGPFEAVGVNPEVGGIEVDSLFRTSGPGIFAIGDVAAFPLKMYNRIARVEHVDHARKSAHHCVETLLTSQTKAYDYLPYFYSRVFEYEGSSRKVWWQFYGDNVGETVEVGNFDPKVATFWIDSDSRLKGVFLESGTSEEFSLLPQLAKSQPIVDKSKLQAGASVEDALEIARSSLQSGASV

SEQ ID NO: 3613 - DNA, 1155 bp, Panicum virgatum
  misc_feature: Ceres CLONE 1792501
  misc_feature: Encodes the peptide sequence at SEQ ID NO. 3614
atccactctgacttccactctcctccccctcacccccatctttcttgctctcgccgcgacgacgcgcacccgcaccggattcgggcgacgccggcggcaggctccgatctagagacgatgtcagccgcgggctcctcgccgtccgcctcctcctccaccaagcggttggaagggaagtccgccctcgtcaccggtggtgccaccggtattggtgaagccatcgttcgcctcttcagagagcatggcgcgaaggtcggcatcgcggacgtccaggacgaagccggccagcggctgcgcgacgccctcggagaccaggacgtcatgttcgtccactgcgacgtcacggtcgaggaggacgtgagggccgccgtcgacgcggcggccgcgcggttcggcgcgctggacatcatggtgaacaacgccggcatcacgggcaacaaggtcaccgacatccgcaacgtggacttcgccgaggtgcgcaaggtgttcgacatcaacgtgcacggcgtgttcctcgggatgaagcacgcggcgcgcatcatgatcccccagaagcgcggctccatcgtgtcgctggcgagcgtggccagcgtcatcggcgggatgggcccgcacgcgtacaccggctccaagcacgccgtggtcgggctcaccaagagcgtcgccggggagctcgggcgccacggggtgcgcgtcaactgcgtgtcgccctacgccgtgcccacggcgctgtccatgccgcacctgccccagggcgcgcgcgccgacgactccctcaaggacttcctggccttcgtcggcggcgaggccaacctcaagggtgtcgacgtgatgcccagggatgtggccgaggcggtgctctacctggcaagcgacgaggcgaggtacgtcagcgcgctcaacctcatggtggacggcggcttcacagccgtgaaccataacctgaaagcgttcgaggattagctcaagctgttggcagcatttgccagctctggtagtgttgtccctgctgttctgctgcaattcagagatgtggcatgtgctaatatatgtagcagattcgactgtgctgtattcatgtgtctgcaagactaatgtgccagtatatgaatgtctcgcaactgattggatattcaaaaaaaaaaaaaaaaaaaa

SEQ ID NO: 3614 - protein, 281 aa, Panicum virgatum
  misc_feature: Ceres CLONE 1792501
  misc_feature: Great-hit functional homolog of the protein sequence given in SEQ ID NO 9642
  misc_feature: Great-hit functional homolog of the protein sequence given in SEQ ID NO 9717
  misc_feature (1)..(169): Pfam Name: adh_short Pfam Description: short chain dehydrogenase
  misc_feature (1)..(279): SWISSPROT Homolog: EC 1.1.1.288 Xanthoxin dehydrogenase
  misc_feature: Useful for making plants with modulated drought sensitivity
  misc_feature: Useful for making plants with modulated salt sensitivity
  misc_feature: Useful for making plants with modulated salt sensitivity
MSAAGSSPSASSSTKRLEGKSALVTGGATGIGEAIVRLFREHGAKVGIADVQDEAGQRLRDALGDQDVMFVHCDVTVEEDVRAAVDAAAARFGALDIMVNNAGITGNKVTDIRNVDFAEVRKVFDINVHGVFLGMKHAARIMIPQKRGSIVSLASVASVIGGMGPHAYTGSKHAVVGLTKSVAGELGRHGVRVNCVSPYAVPTALSMPHLPQGARADDSLKDFLAFVGGEANLKGVDVMPRDVAEAVLYLASDEARYVSALNLMVDGGFTAVNHNLKAFED

SEQ ID NO: 3615 - DNA, 2072 bp, Panicum virgatum
  misc_feature: Ceres CLONE 1792507
  misc_feature: Encodes the peptide sequence at SEQ ID NO. 3616
aacctttggctccaagcacaagcagcagccgagcctttcttcctcctctccaccccctcccccctcgggccacgcgaggctaaaaccaattccacatctccaccctcgctcaccgaggaccctcgccaagaattgcacctgcagcgggggagaggtagagcgagaagcgataagagtttctcctcgcctctctctctctgtatctccttcccgtcttcctatccgcctgcgattctcgtcgcattggtttggtttccttggaaaagggggcagctttcctgtcttccctttgatctagatgatggcgagcacgacgtcagcgaccgccgcggcggcggcattcggggccgcagccaccgccaagccgcgggggtcgtcgccgtcggccatctgcccgagggtgtccaccggcggcaggagacgctccggggtggtgcggtgcgacgccggcgtggagacccaggtgcaggcggtggccaaggcggccagcatcgccgcgctcgagcagttcaagatctccgccgaccggtacatgaaggaaaggagtagcatagctgtgattggcctcagtgtacacacagcaccagtggagatgcgtgaaaaacttgcggttgctgaggaactatggccccgtgctattcaagaactcactagtctaaaccatattgaagaggctgctgttcttagcacctgcaatagaatggaaatttatgtggtggccctgtcatggaaccgtggtatcagagaagtaatagactggatgtcaaagaaaagtggcattcctgcttctgagctcagggagcacctgttcatgttgcgtgacagtgatgctacacgccatctgtttgaggtatcagctgggcttgactctttggttctcggtgaaggacaaatccttgctcaagttaagcaagttgtaaggagcgggcaaaacagtggaggcctgggaaagaacattgataggatgttcaaggatgcaatcacagctggtaagcgtgtccgatgtgagaccaacatatcatctggtgcggtttctgtcagttcagctgcagttgaattggccctgatgaagcttccaaagactgaagccctgtcagctagtatgctgctgattggtgctggtaagatgggcaaattagtggtcaagcatctcattgccaaaggatgcaaaaaggtggttgttgtgaaccgctcggtggaaagggtggatgccattcgtgaggagatgaaagatattgagattgtgtacaggcctctctcagagatgtatgaggctgcttctgaagctgatgtcgtgttcacaagcaccgcatctgaatccccattgttcacaaaggagcacgcagaggcacttccccctatttctgatactatgggtggtgtccgtctatttgtcgacatatctgtcccgagaaatgtcagtgcatgtgtgtctgaagttagctcggcacgagtatacaacgttgatgacttgaaagaggtggtggaagccaacaaggaggacaggctcaggaaagcaatggaggcgcagacaatcatcaccgaagaactgaaacggtttgaggcatggagggactcgttggagaccgttccgaccatcaagaagttgaggtcatatgctgacaggatccgggcctcagagcttgagaagtgtctgcagaagatcggagacgacaatctcaccaagaagatgcggagagctgttgaggagctgagcaccggcatcgtgaacaagctcctccacggcccactgcagcatctgaggtgcgatggcagcgacagccgcaccctcgacgagacgcttgagaacatgcacgccctcaaccggatgttcagccttgacaccgagaaggcgatcatcgagcagaagatcaaggccaaggtggagaagacccaaaattgatgccaggaagcaatttttctaccccgtgtatacatactctgattcccagttttttttaatcacttagctcctcccctactcgctgagatcgccaactgtgtcgtgaattagtgccatggcagtagctcaatctgttgagaggtagtggcaaaaaaaaaaaaaaaaaaaa

SEQ ID NO: 3616 - protein, 534 aa, Panicum virgatum
  misc_feature: Ceres CLONE 1792507
  misc_feature (1)..(152): Pfam Name: GlutR_N Pfam Description: Glutamyl-tRNAGlu reductase, N-terminal domain
  misc_feature (1)..(534): SWISSPROT Homolog: EC 1.2.1.70 Glutamyl-tRNA reductase, chloroplast precursor
  misc_feature (2)..(534): SWISSPROT Homolog: EC 1.2.1.70 Glutamyl-tRNA reductase 1, chloroplast precursor
MMASTTSATAAAAAFGAAATAKPRGSSPSAICPRVSTGGRRRSGVVRCDAGVETQVQAVAKAASIAALEQFKISADRYMKERSSIAVIGLSVHTAPVEMREKLAVAEELWPRAIQELTSLNHIEEAAVLSTCNRMEIYVVALSWNRGIREVIDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKTEALSASMLLIGAGKMGKLVVKHLIAKGCKKVVVVNRSVERVDAIREEMKDIEIVYRPLSEMYEAASEADVVFTSTASESPLFTKEHAEALPPISDTMGGVRLFVDISVPRNVSACVSEVSSARVYNVDDLKEVVEANKEDRLRKAMEAQTIITEELKRFEAWRDSLETVPTIKKLRSYADRIRASELEKCLQKIGDDNLTKKMRRAVEELSTGIVNKLLHGPLQHLRCDGSDSRTLDETLENMHALNRMFSLDTEKAIIEQKIKAKVEKTQN

SEQ ID NO: 3617 - DNA, 2148 bp, Panicum virgatum
  misc_feature: Ceres CLONE 1792527
  misc_feature: Encodes the peptide sequence at SEQ ID NO. 3618
acacctccgctcctttccttctccgctcctttccttctccgctctacctctcagatccagcgcagcgatttctcctcttcctagcccggctcccccggcccccttgtgctagtttggttggattcagggggctaggttttagattcagagacatggcggaagtggaggactacgagatcattagggagggtgaggccgagatcctccagctcaaggaaaaagccgccttcttcaatcccgtgcaggttcacaacagagacatgtccattgctgttttaagggcctttgttgccaagcgcaaggaagaacatgaagcgctggcgaataagaggaataaatcgcatcaagaaaacaaacagagcgaaacatctgttcagaatggagaggatgcttcaactagccatcttgatgaaatggatgttgttcctgaaaaggatctaaatcaagctcaagcaacaaaaacaccttcctggaaagtaaccagagaacttaagccaccacttgttcttgaggctttggctgcttctgggttgagatctctccggtatgcccgtgaagttgatggcttaggaaaggtagttgctctggacaatgataaagcttctgtcgattgttgcaagcggaatataaagttcaatggtgcttcctctactagtaatgtggaagctcacttggctgatgctcgagtttacatgctcacgcatccaaaagaatttgatgtggttgatattgacccttatggggcaccatctgtattcctcgactcagctgtacaggctgttgctgatggagggctattgatgtgcactgccactgatatggcagttctttgtggcaccaatggagaagtttgttactcgaagtatggttcgtacccaaccaagggcaaatattgccatgaaatggctttgagaatcctccttgccagtattgagagccatgcaaatcggtacaagagatatatcgtgcctgttctctctgtgtttatggatttttatgtgcgtgtttttgttcgggtgttcacttctccaagtgaaataaagaatactcctcttaaactttcttacatatatcaatgtgttgggtgtgattctttccatctgcaatgtcttgggaggagtatttctaaggatagcactgtgaagcatgcacctgcaattgggcctgttgtccctcaagaatgtagtgattgtggaaagaaatttaatgtgggcgggccaatatggtctgctcctattcatgatcaagactgggtagtttctactttggcaggtgttaagtcaatgaaggatagatatcctgcatacgataaaattacttcagttttaacaactgtatcagaggagttacatgacattccattgtttttcaatctccataacatagctggcaccgttaagtgcacatctccatctttggttatgtttcggtctgcagttctaaatgcaggctatcgtatctcgggcacccatgttcatccacttggtgtaaaatctgatgccccttgggatgtaatttgggacattatgcgctgctgggtgaagattcatccaattaaggaacagccccatgactctccaggaacgaccatcctttcaaagtcgccaacgctagaagcggatttctctagagcaggggctgccctcagtaaggctcagatgaagaaggtgaagcggttccttccaaacccagaacggcactggggtccaaaggtcagagcaggccggaagatcacgagcaaacatgtctctctcttgggccctgaggctatcaatagtattctgaatggagcggtcagacacgaaggtggaaatggagcagtgacggacaagccagctccagaacctgaagggatcaaggaagatgaaccctcaaccaaacgccaaaaaactggtgatgacgaacaggcaaacgaaccttgatcgccaaaaccaccattaatttttgtttactttacctttataatgcttccgagctttaccctgtgttcgtgtggtcgattggttatttgtatcacctgttgctgggacaacgatggattttgatcggacaagttttgggctaggttttacctgttgctgggacaacgatgaattttgatcggacaagttttgggctaggttttgctaaaaaaaaaaaaaaaaaaaa

SEQ ID NO: 3618 - protein, 589 aa, Panicum virgatum
  misc_feature: Ceres CLONE 1792527
  misc_feature (1)..(460): Pfam Name: TRM Pfam Description: N2,N2-dimethylguanosine tRNA methyltransferase
MAEVEDYEIIREGEAEILQLKEKAAFFNPVQVHNRDMSIAVLRAFVAKRKEEHEALANKRNKSHQENKQSETSVQNGEDASTSHLDEMDVVPEKDLNQAQATKTPSWKVTRELKPPLVLEALAASGLRSLRYAREVDGLGKVVALDNDKASVDCCKRNIKFNGASSTSNVEAHLADARVYMLTHPKEFDVVDIDPYGAPSVFLDSAVQAVADGGLLMCTATDMAVLCGTNGEVCYSKYGSYPTKGKYCHEMALRILLASIESHANRYKRYIVPVLSVFMDFYVRVFVRVFTSPSEIKNTPLKLSYIYQCVGCDSFHLQCLGRSISKDSTVKHAPAIGPVVPQECSDCGKKFNVGGPIWSAPIHDQDWVVSTLAGVKSMKDRYPAYDKITSVLTTVSEELHDIPLFFNLHNIAGTVKCTSPSLVMFRSAVLNAGYRISGTHVHPLGVKSDAPWDVIWDIMRCWVKIHPIKEQPHDSPGTTILSKSPTLEADFSRAGAALSKAQMKKVKRFLPNPERHWGPKVRAGRKITSKHVSLLGPEAINSILNGAVRHEGGNGAVTDKPAPEPEGIKEDEPSTKRQKTGDDEQANEP

SEQ ID NO: 3619 - DNA, 1985 bp, Panicum virgatum
  misc_feature: Ceres CLONE 1792530
  misc_feature: Encodes the peptide sequence at SEQ ID NO. 3620
acgtatgccaggcattaggtgccaaaattgcctgactaaacctgtgtgtgtataaatgtaacctcctcttacagcctcacttcatcttctgattagttctcgcttctgctagcagcctgctgccatagctgcaagcaagacagggagcgcacgcagttcgtccctgtgtctcaagaaaattaattaaacaaaagcaagatcgtccatcagttgtcaagagacaagcagcaaccaccagcagagaaagacaggcagatgatggaggggagcatggacgctgcaaggatcatagggtacttggaggggaagagcatcctcatcaccggctcaactggctttcttggaaagattcttgtggagaagatcctgcgggtgcagcctcatgtccacaagatgtacctcctggtacgagccatcgacgcgcagtccgccaagcaccgcgtccaccaagaggtgatcggcgcagagctgttcggcctcctgagagaaaagtacggcgaggggttcgactcgttcatcgaggacaagattgttcctttggccggagacatcaccggcgaggacctgggcctggaggcatccacactgcaccaactggccaaggacatggacgtcatcgtcaacatcgctgcaaccaccaacttctacgaaaggtatgacgtctctttggacgtgaacgtgatgggggtgaagcacctctgccacttcgccaagcagtgcgccaacctcaagatgctcatgcatgtctcgaccgcttttgcgtccggcgacagtgcggaggtgatcccggagaagcccatcacgcccggccagtcgctgcgggaaggcttgcgcctcgacatcgacgccgagctgcgcctcgccgccgacgtcaagaagaacctgacggcggcggccagcggcgacggcggcggcgacgcccacaataataacaagacggccgatgagaggaaggccatgaaggagctgggcctccagcgggcacgccacttcgggtggtccaacacctacgtcttcgccaaggccatgggcgagatggtgctggagcagcaccgcggcgacatgcccgtggtgatcatgcgccccagcatcatcaccagcgtccgggcggacccgctgccggggtggatgcagggcacgcgcaccatcgacacgctcatcatcggctacgccaagcagaacatctcctgcttcctcgccgacctccgcatggtgatggacgtcatcccgggggacatggtggtcaacgccatgctggcggcggcggcggcgcgctccggggagaagggggcgctggccatctaccagcccacctcgtcgctgcgcaacccggtgacctacgccgtgctctaccgctccggcgcccggcacttcatcgagcacccgcgcgtgcgggacaacggcgaggtcatccccaacaaggagatgcgcttcttctccaccatcccgcggttccgcctctacatgatcctcaccttcaagctgccgctcgagatcctgcacgcggccaacctgctgctctgcgggaccttctccaagctctacaacgactccaaccgaaagtacaagttcgtcatgcatctcgttgacgtctatggccccttcgcattcttcaaaggatgctttgacgacaccaacctggagagcctgaggtcaacaatggtgacgaagagccctgatgaatatgagatgttcaactttgatcccaagatcatcgactgggacgactacttttacagaattcacattcctggtgtcctcaagtatgtctgcaagtgatcaagacatgttttattggccgtgcaccttgttcatacatggaccaaaaaatatatatgaaactctgttcatatatacttaaagacacaccaattaattgttttttttatgttgtaattaattacagtacaaaggatgttacaagttgaattggctgttaataaatgtgctgatgaagcacccatatatatgaaataatattgatg

SEQ ID NO: 3620 - protein, 507 aa, Panicum virgatum
  misc_feature: Ceres CLONE 1792530
  misc_feature (3)..(103): Pfam Name: Sterile Pfam Description: Male sterility protein
MMEGSMDAARIIGYLEGKSILITGSTGFLGKILVEKILRVQPHVHKMYLLVRAIDAQSAKHRVHQEVIGAELFGLLREKYGEGFDSFIEDKIVPLAGDITGEDLGLEASTLHQLAKDMDVIVNIAATTNFYERYDVSLDVNVMGVKHLCHFAKQCANLKMLMHVSTAFASGDSAEVIPEKPITPGQSLREGLRLDIDAELRLAADVKKNLTAAASGDGGGDAHNNNKTADERKAMKELGLQRARHFGWSNTYVFAKAMGEMVLEQHRGDMPVVIMRPSIITSVRADPLPGWMQGTRTIDTLIIGYAKQNISCFLADLRMVMDVIPGDMVVNAMLAAAAARSGEKGALAIYQPTSSLRNPVTYAVLYRSGARHFIEHPRVRDNGEVIPNKEMRFFSTIPRFRLYMILTFKLPLEILHAANLLLCGTFSKLYNDSNRKYKFVMHLVDVYGPFAFFKGCFDDTNLESLRSTMVTKSPDEYEMFNFDPKIIDWDDYFYRIHIPGVLKYVCK

SEQ ID NO: 3621 - DNA, 1522 bp, Panicum virgatum
  misc_feature: Ceres CLONE 1792535
  misc_feature: Encodes the peptide sequence at SEQ ID NO. 3622
aatatcttgtcgcgattggacgccacggcttcatcactcctgtcgccggcttcggctgatgcagcggcgagaggcgcgaggacgccgacgggacggacgccccaaaggtctccaccgccactgcgtcgcgtttgcctcagtaggccttctgctccagcatccgaggcggagagcacggcgacgatctaagttctgttcaagcacatgagactgttagctctgtgagtgtctccagggatgtgggtcaaggtaataaaagtccacgagctcggtggcccagaagtccttagttgggaagaggttgagattggggatcccaaagaaggagaaatccggatcaagaacaaggccggagtcaattatgtcgatatatattaccgtaccggattacatcgagctcctcttccatttattcctggcaaggaagcagttggtgttgtgtctgccgtgggtcctggtgttactagtttcaaagtcggtgatgttgtcagctatgctgataatccaatgggttcttatgctgaagaacaaatcatcccagcaagtgtggccattcctataccccctgcaatagactacaaaactgcagcatctgttttactgaagggaatgactgcatatgtccttgtgcgacaagcctttaaggtccagagaggccacactgttctagtccatgctgctgctgctggagtcggctctctcctctgccagtgggcaaatgcccttggcgccactgtcattggcactgtttcaactgaagagaaggtcggccaagcaacccaagacagatgccggcatgtgatagtgtacacgaaggaggactttgttacccgggttgctgagatcacgtcaggcgaaggtgttcatgttgtctacgatgccgttgggaaggacacattccagggatcgttggcatgcttgatgtcgcgcggctgcatgatctcctacggccagtcttcaggtagcaggccagacccagtccggttgagcgatctcgcgccaaaatcgttgatcctgggcagaccaggactgatgcactacaccaccaaccacgacgaattgctgcaggctgccagtgaagtctttgccagcatcatggccggcgtgctgcaggtgcactccaaccacgtgtacctgctgtcggaggctgcccgcgtgcacaaggatctcgaggctaggaggacatctggttccatcgtgctgatacctgacggccaaaggttgtaggagaatgcaagtgttagccgtggcctctggttctgcattgccatattcagagttttgtgcatgataatgttgctctgggatgcactctgctaaacagtttacgacaattctcaggtactgtgagatttcaaaaaaaaaatcagattgtcttggtggatgaatccatcaatccatcatgtgaaacagtatatgctgtctgtctatattgtgaggtactgtgagacttataaaattctatcagattttcttggtgaatgaatccatcatgtgatgcgaaaaaaaaaaaaaaaaaaaa

SEQ ID NO: 3622 - protein, 329 aa, Panicum virgatum
  misc_feature: Ceres CLONE 1792535
  misc_feature (1)..(81): Pfam Name: ADH_N Pfam Description: Alcohol dehydrogenase GroES-like domain
MWVKVIKVHELGGPEVLSWEEVEIGDPKEGEIRIKNKAGVNYVDIYYRTGLHRAPLPFIPGKEAVGVVSAVGPGVTSFKVGDVVSYADNPMGSYAEEQIIPASVAIPIPPAIDYKTAASVLLKGMTAYVLVRQAFKVQRGHTVLVHAAAAGVGSLLCQWANALGATVIGTVSTEEKVGQATQDRCRHVIVYTKEDFVTRVAEITSGEGVHVVYDAVGKDTFQGSLACLMSRGCMISYGQSSGSRPDPVRLSDLAPKSLILGRPGLMHYTTNHDELLQAASEVFASIMAGVLQVHSNHVYLLSEAARVHKDLEARRTSGSIVLIPDGQRL

SEQ ID NO: 3623 - DNA, 1938 bp, Panicum virgatum
  misc_feature: Ceres CLONE 1792552
  misc_feature: Encodes the peptide sequence at SEQ ID NO. 3624
atttttttctcgcccgggagccgcaattccgacctgctgctttggttcatacttgctcagtagatcaattctacaccggatgattgtacttcctgggatagaagggagtactgaagcagaagtcaggtggtgctgaatcgaaatggaaggcgggatgtcaagtttggaaactgccatgaaagcttcttcatcggttgcaagtggtacggcaacgaatgctgaccctgaccaacagactgtccgctccaattcagtagagcagttttattttccaagacctggccaatctttgccaggcattccaccattctttgggcctctctcctccagtttgtatcttcctaatgacaatgaagctaaagttggcaatcaatttgaaccaaatccttcacagaatacagattgggatccgcaagctatagttagcaacctaactttccttgagcagaagatcaagcaggtaaaagatgttgtgcagtccatgagtaaccgaaagaaccaagtagctggcggttcctgtgagctagcagcaaagcagcagctcataactgctgatctcactagcattgtaatccagcttatcacaactgctggttcgctgctcccttcaatgaagaacccacttagcagcaatccagcagtaaggcagctcagcaatactcttggttctcctatgggctttggcatgattgctaatcagcgaccaagtgtagacagcaagactgatattcctgacattggaaaggcctctggttatgaggaactgatcaatagccttaatactacccaagatgaaagagatgatctgatcaaatgcccaaatccttgtggtggggaagggtctgaaccgactccaatggaagaccttgatgtaaaagagagtgatgatggtgaacatgagggagagaatctcccccctggttcttatgtagtattgcaattggaaaaggaggagattttagcaccgcatactcatttctgcttgatctgtgggaagggcttcaagagagatgctaacctaaggatgcacatgaggggccatggagacgagtacaagactgctgcggctcttgccaagcccacaaaggattttggttcagatcatgcaccagttacaaggtactcatgcccatttgtgggttgcaagcggaacaaagagcacaagaagttccaacctctcaagacaatcttgtgtgtgaagaatcactacaagcgaagccattgtgacaagagatacacctgcagccgttgcaacactaaaaagttttctgtgattgctgacttgaagactcatgagaagcattgtggtcgtgacaagtggctctgttcttgtggaacaacattctctaggaaggacaagcttttcgggcatgttgcgcttttccagggccacacacctgcgctccccatggatgatgtcaaggtatcagaagcatcagagcaacagcaggacagcgagcctatgaatgaaatttctaggagcatggggtgcttcccttgcagctcgtctgatggcatttcaaaccttgacatgaaaatggctgatgatgcacgcggctattactcgccgctgagctttgatccttgctttggcgcactcgatgacttcactcgccctggattcgacatctctgaggatcccttcgcttttctgccttcgggatgcggttatgtacatcagaatggagacaactgaaggaggtcaccattgatgacactggcagcctttatgtatggtgtatgcatgatactagtctggttcttgctatattcaagagtcattttaggttatgcctttcttttttttttacgtaagtgtacttcatttggtggtcatcaataatgagcacttctagcatttcgtacagactgagatagccccaattttctgtatatacatgcaagtgttaactctttcaaaaaaaaaaaaaaaaaaaa

SEQ ID NO: 3624 - protein, 517 aa, Panicum virgatum
  misc_feature: Ceres CLONE 1792552
  misc_feature (1)..(23): Pfam Name: zf-C2H2 Pfam Description: Zinc finger, C2H2 type
  misc_feature: The sequence is a functional homolog of  SEQ ID NO 552 in the  10/666,642 US patent application
  misc_feature: Useful for making plants with modulated growth and phenotype characteristics
MEGGMSSLETAMKASSSVASGTATNADPDQQTVRSNSVEQFYFPRPGQSLPGIPPFFGPLSSSLYLPNDNEAKVGNQFEPNPSQNTDWDPQAIVSNLTFLEQKIKQVKDVVQSMSNRKNQVAGGSCELAAKQQLITADLTSIVIQLITTAGSLLPSMKNPLSSNPAVRQLSNTLGSPMGFGMIANQRPSVDSKTDIPDIGKASGYEELINSLNTTQDERDDLIKCPNPCGGEGSEPTPMEDLDVKESDDGEHEGENLPPGSYVVLQLEKEEILAPHTHFCLICGKGFKRDANLRMHMRGHGDEYKTAAALAKPTKDFGSDHAPVTRYSCPFVGCKRNKEHKKFQPLKTILCVKNHYKRSHCDKRYTCSRCNTKKFSVIADLKTHEKHCGRDKWLCSCGTTFSRKDKLFGHVALFQGHTPALPMDDVKVSEASEQQQDSEPMNEISRSMGCFPCSSSDGISNLDMKMADDARGYYSPLSFDPCFGALDDFTRPGFDISEDPFAFLPSGCGYVHQNGDN

SEQ ID NO: 3625 - DNA, 2122 bp, Panicum virgatum
  misc_feature: Ceres CLONE 1792558
  misc_feature: Encodes the peptide sequence at SEQ ID NO. 3626
atctgcctgcacgcagctggcgctgagcaacacgactcgggagcaccagagctagctagcccgccgcgccacccgaccgggacgatccaggccggcgtcgctgctgtccgagagaccgtcgaggtcgatcgtcggagagggagagcccggctagctatgtcgtcggggatggagacggccggcggcggcgtcgaggacgcgtacggcgaggaccgcgccaccgaggagcagctcatcacgccgtgggcattctccgtcgccagcggctacaccctgctgcgcgacccgcggcacaacaagggcttggccttctcggaggcggagcgcgacgcgcactacctgcgcggcctgctccccccggcgctggcgtcgcaggagctccaggagaagaagatgatgcacaacctgcgccagtacacggtgcccctgcaccgctacatcgccatgatggacctgcaggagcgcaacgagcgcctcttctacaagctcctcatcgacaacgtcgaggagctgctccccgtcgtctacacgcccaccgtcggcgaggcctgccagaagtacggcagcatctacaggcgcccgcaggggctctacatcagcctcaaggacaagggcaagatccttgaggtgctcaagaactggccggagaggagcatccaggtcatcgtcgtcaccgacggcgagcgcatcctggggctcggcgatctgggctgccaggggatggggatccccgtcggcaagctgtcactgtacaccgcactcggaggtgttcgcccatctgcttgcctgccgatcacaattgatgtcggcaccaacaacgagaccttgctcaacgacgagttctacattgggctccgccaaaaacgtgccaccggccaggaataccacgagcttcttgaagagttcatgaccgccgtcaagcaaaactacggcgagaaagtcctcacccagttcgaagactttgccaaccacaacgcttttgacttgcttgccaagtacagcaagagccatctcgtcttcaacgacgatatccagggaacagcgtccgtggtcctcgcaggtctcttggcggcgctcaaagttgtcggtggcacccttgcagaccacacttacctcttcctcggcgccggcgaggctggaactggtattgctgacctcattgctcttgagatgtcaaaacatacggatactccgatcgacgattgccgcaagaagatctggctggtggactccaagggcctgatcgtggagtcgcgcaaggagtcgctgcagcacttcaagcagccgtgggcgcacgcgcacgagcccctcaagtccctgctggaggccgtggagtccatcaagccgacggtgctgatcggcacctccggcgtgggccgcaccttcaccaaggaggtggtggaggccatggcgtccttcaacgagaagcccgtcatcttcgcgctgtccaacccaacgtcgcactcggagtgcacggcggagcaggcctacacctggtcacagggccgcgccgtgttcgccagcggcagccccttcgaccccgtcgagcacgacggcaaggtgcacgtccccggccagtccaacaacgcctacatcttcccggggttcggcctcggcgtggtcatctccggcgccatccgcgtccacgacgacatgctgctggccgcgtcggaggcgctggcggagcaggtcaccgacgagtacttcgccaaggggctcatcttcccgcccttcaccaacatccgcaccatctcggctcgcatcgccgccaaggtggccgccaaggcctacgagctcggcctcgccagccgcctgccccgccccgacgacctcgtcaagtacgcccagagctgcatgtacaccccaacctaccgcaactaccggtaagcaccgttgccggcggccgaggagggaagaggggcaccatttttgctgcagggtcgtcgtgagtgagtgaataaatttgttcagctggagcttgctgctgctgctagaggagttttaaactttgttttgtactgtacttctgtgtatcgtatacggcataccacaccattacaggccgtcagtcattttttttttcactttgttatatagtggtcaaaaaaaaaaaaaaaaaaaa

SEQ ID NO: 3626 - protein, 576 aa, Panicum virgatum
  misc_feature: Ceres CLONE 1792558
  misc_feature (1)..(254): Pfam Name: Malic_M Pfam Description: Malic enzyme, NAD binding domain
  misc_feature (7)..(576): SWISSPROT Homolog: EC 1.1.1.40 NADP-dependent malic enzyme
  misc_feature (8)..(576): SWISSPROT Homolog: EC 1.1.1.40 NADP-dependent malic enzyme, chloroplast precursor
MSSGMETAGGGVEDAYGEDRATEEQLITPWAFSVASGYTLLRDPRHNKGLAFSEAERDAHYLRGLLPPALASQELQEKKMMHNLRQYTVPLHRYIAMMDLQERNERLFYKLLIDNVEELLPVVYTPTVGEACQKYGSIYRRPQGLYISLKDKGKILEVLKNWPERSIQVIVVTDGERILGLGDLGCQGMGIPVGKLSLYTALGGVRPSACLPITIDVGTNNETLLNDEFYIGLRQKRATGQEYHELLEEFMTAVKQNYGEKVLTQFEDFANHNAFDLLAKYSKSHLVFNDDIQGTASVVLAGLLAALKVVGGTLADHTYLFLGAGEAGTGIADLIALEMSKHTDTPIDDCRKKIWLVDSKGLIVESRKESLQHFKQPWAHAHEPLKSLLEAVESIKPTVLIGTSGVGRTFTKEVVEAMASFNEKPVIFALSNPTSHSECTAEQAYTWSQGRAVFASGSPFDPVEHDGKVHVPGQSNNAYIFPGFGLGVVISGAIRVHDDMLLAASEALAEQVTDEYFAKGLIFPPFTNIRTISARIAAKVAAKAYELGLASRLPRPDDLVKYAQSCMYTPTYRNYR

SEQ ID NO: 3627 - DNA, 1609 bp, Panicum virgatum
  misc_feature: Ceres CLONE 1792564
  misc_feature: Encodes the peptide sequence at SEQ ID NO. 3628
attgacactgcaggcgccccccagcaggccaccacagatccccgccgcgacggaggagaatggaggccgccgccgccgccgtgctccccgcgctggtgccctccagtagcgcggtggtggtgctcttcgcctacctcggctacctcgccgccgccggggccatcctcccggggaagctcgttgccggcgccgtcctcccggactcctcccgcctccactaccgctgcaatggtttgctctcgctcctgctgctgctggggctctgcgcgttcggcgtctacatggggtggatgactcccacggttgtggctgacaggggactcgagcttctatccgcgaccttcatttttagtgtcgttgtctccttcggactatactttgccggcaccaagtcccgccacaaaagttcttctttgaaaccacatgttagtgggaacttcatagaagattggtggttgggagtgcagcttaatcctcattttatgggagttgacctcaaattcttttttgtgagggcaggaatgatggcatggttatttatcaacctctctttgtttgcgaagagctatctagctggttcagtcaatctttcggtcattctctaccaattcttttgtgcgtggtatattatagattacttcgtccatgaagaattcatgacctcaacgtgggacattattgctgaaaggctgggtttcatgctggtgtttggtgatctagttttcattcctttcaccttcactattcagggttggtggcttttgagaaatgaagtggagctatcacttttagcttctgtagctaatttctgcatcttcattattggctacctggtgttcagaggagctaacaagcaaaaacatatgttcaagaaggaccccaaagctcctatatggggaaaacctcccaaagtcgttgggggaaagctacttgcatccggctactggggcatcgcaagacactgcaattatctcggagatctactgctagcactttcgttcagtttgccctgcggattcagttctgtaatcccgtacttctacccgacgtacctgctgattctactgatctggagggaaaggcgcgacgaagccaggtgctcgcagaagtacaaggagatctgggcagagtactgcaagctcgtgccttggaggatcctaccttatgtgtactagttggaagtcgttacttggcacttagacagtcggcaatgctgaagcagcaggtcatcctagccttgtctattggtcttgggtggtctcctggcgaagctcgtgccttggaggatcctaccttatgtgtgcatgcggcgcttgctgagttcttgtatgttatccccgggacatttatgtttcgagtcggttgacccgaggcaccacgttgttgttgcagtgtgcaaaggtaaggtgagggtgttggtacttgatttgtctggagataggagtagaatggaactgaactgtactgtactgctgctggcaacggcagagggtgtggcacggcaggagcgatgcgtgtgcatgtggcggtgatgtgtacttcagaactcctgcgtgttttttatgataaaaggaaagttccagcctcagaaaaaaaaaaaaaaaaaaaa

SEQ ID NO: 3628 - protein, 371 aa, Panicum virgatum
  misc_feature: Ceres CLONE 1792564
  misc_feature (9)..(371): SWISSPROT Homolog: EC 1.3.1.70 Delta(14)-sterol reductase
MEAAAAAVLPALVPSSSAVVVLFAYLGYLAAAGAILPGKLVAGAVLPDSSRLHYRCNGLLSLLLLLGLCAFGVYMGWMTPTVVADRGLELLSATFIFSVVVSFGLYFAGTKSRHKSSSLKPHVSGNFIEDWWLGVQLNPHFMGVDLKFFFVRAGMMAWLFINLSLFAKSYLAGSVNLSVILYQFFCAWYIIDYFVHEEFMTSTWDIIAERLGFMLVFGDLVFIPFTFTIQGWWLLRNEVELSLLASVANFCIFIIGYLVFRGANKQKHMFKKDPKAPIWGKPPKVVGGKLLASGYWGIARHCNYLGDLLLALSFSLPCGFSSVIPYFYPTYLLILLIWRERRDEARCSQKYKEIWAEYCKLVPWRILPYVY

SEQ ID NO: 3629 - DNA, 1238 bp, Panicum virgatum
  misc_feature: Ceres CLONE 1792586
  misc_feature: Encodes the peptide sequence at SEQ ID NO. 3630
atcccgctgaatcgctgtgctgtgcctgtaggtggccaactcatttcctcccccaactcccatgggcgactacggcaccgccaccaacccctcctcgccgcccgcggccatgaatcccgactccgaggtggccttcgacttcctgccctacctctgccagtacaagaacggccgcatctaccgccccggcggctccccaaccgtccccgccggcacggaccccgccaccggcgtcgtctccaaggacgtccgcgccggccccgcctccgtccgcatctacctcccgcccggcgccgccggcaagatcccggtcgtcgtctacttccacggcggcggctttgtggtcggctcgccggcgcggccgagcacgcacaactacctcgtcgacctggtggcccgctcgggcgccatcgtcgtgtccgtctactaccgcctcgcgccggagcacaagctccccgccgcgtacgacgacgggtgggcggggctgcggtgggcggccacgctcggcggcggcgaggagccctggctgctggaccacgccgacctcacccgcgtgttcctggtcggctgcagcgccggcgccaacatcgcgcacaacaccgccgtgcgggcctcggcccccggcgcgctcccggacggcgtggccctccgcgggctcgcgctggtgcacccgtacttcacgggcagggaggccgtcggcggcgaggtcgcgttcggccccgagatccgggggtacatggaccgcacgtggcgcttcgtgatctcggagacggtggggctggacgacccgcgcgtgtgcccgttcgtggacgacgccgcccgccggacctccgccgggatcccgtgcgagcgcgtgctcgtgtgcgtcgccgagaacgacttcctgctcagggagcgcgggctctggtaccaccgggagctcaaggccagcgggtacgccggcgagctggagatcttcgagtccaagggcgtcggccacgcgttccacttcgacctgctcggctccgagcagggcgtccagctgcaggagcggaccatcgctttcatcaacaaatgaatggaatctcggctcctgatatcgacatgggttcatgaagatatattattgtctatttctcatgaaataagtgtttatgagttttgtgctaccatcgatcatttccatacttcaactcgatcatttccatacttcaactgtaataccttgaaatttgcttcaaaaaaaaaaaaaaaaaaaa

SEQ ID NO: 3630 - protein, 331 aa, Panicum virgatum
  misc_feature: Ceres CLONE 1792586
  misc_feature (1)..(226): Pfam Name: Abhydrolase_3 Pfam Description: alpha/beta hydrolase fold
MGDYGTATNPSSPPAAMNPDSEVAFDFLPYLCQYKNGRIYRPGGSPTVPAGTDPATGVVSKDVRAGPASVRIYLPPGAAGKIPVVVYFHGGGFVVGSPARPSTHNYLVDLVARSGAIVVSVYYRLAPEHKLPAAYDDGWAGLRWAATLGGGEEPWLLDHADLTRVFLVGCSAGANIAHNTAVRASAPGALPDGVALRGLALVHPYFTGREAVGGEVAFGPEIRGYMDRTWRFVISETVGLDDPRVCPFVDDAARRTSAGIPCERVLVCVAENDFLLRERGLWYHRELKASGYAGELEIFESKGVGHAFHFDLLGSEQGVQLQERTIAFINK

SEQ ID NO: 3631 - DNA, 1193 bp, Panicum virgatum
  misc_feature: Ceres CLONE 1792596
  misc_feature: Encodes the peptide sequence at SEQ ID NO. 3632
atacatacacactatacgctgtctcagcacacagctagcattagcaacccagcagtctaggcggcctctctagctctagctaaccaagggggtgccagtgccaggaagaagagctcggcggggaaaatggcgcagctgccgccgagggcgccgagcgccgcggcgcaggacccctggtcggcggcgggcgagttcctcgggttcgccgcggccaggcgcggcgcgcaccgccgctccgccagcgactcggccgcgttcctcgaggccgtgcccatggacgacgtcatcggcggcggcggcggcggcggcggcggcggcgacgacttcgaccgcctcgacgacgagcagctcatgtccatgttctccgacgtagacgcgccggccgtctccgacggcgccggcggggagagggccggggacgcgcagctgatggacatgggggacgcggaggacggaatggcggcctcgtcgccggccggcgcgcgcgcggccgcggacggcgtcgcggaccccaagagggtcaagaggatattggcaaacagacagtcagctcagaggtcacgagttaggaagctgcagtacatctccgagcttgaacgcagtgtaaccagtctccagatggaggtgtcagcactgtccccacgcgtggccttcctcgatcaccagcgctcgcttctcaccgtcggcaacagccatctcaagcaaagaattgcggcgctcgcccaagacaagatcttcaaagatgctcatcaagaggcgctgaagaaggagattgagcggctacgccaactgttccaccagcagcagatcaaggccaccaccagaggcgccgacatcgccactgccgcctcgatgcagaccaggcaagagctgctcgcgtgcgagggcgctgccattcgatagcggtggtgatcgtcggcgcaacgcgtgccaacttgcattgtgctggttttttggggggcagttcatcgtgtgcaaagacacacctgttagtagtttaaaaatttgtgcagtctgatatgctggttttatttgttaccttttgatttgtatgtgatgtaatttgctcatcctagctaaaaatgggctggaatgggggaatctttgtgaatgtattgtttggacagcctcacatttgagttggtaaagaatttccaaggtgattggtttctccaaaaaaaaaaaaaaaaaaa

SEQ ID NO: 3632 - protein, 258 aa, Panicum virgatum
  misc_feature: Ceres CLONE 1792596
  misc_feature (1)..(55): Pfam Name: bZIP_2 Pfam Description: Basic region leucine zipper
  misc_feature (1)..(64): Pfam Name: bZIP_1 Pfam Description: bZIP transcription factor
MAQLPPRAPSAAAQDPWSAAGEFLGFAAARRGAHRRSASDSAAFLEAVPMDDVIGGGGGGGGGGDDFDRLDDEQLMSMFSDVDAPAVSDGAGGERAGDAQLMDMGDAEDGMAASSPAGARAAADGVADPKRVKRILANRQSAQRSRVRKLQYISELERSVTSLQMEVSALSPRVAFLDHQRSLLTVGNSHLKQRIAALAQDKIFKDAHQEALKKEIERLRQLFHQQQIKATTRGADIATAASMQTRQELLACEGAAIR

SEQ ID NO: 3633 - DNA, 2017 bp, Panicum virgatum
  misc_feature: Ceres CLONE 1792597
  misc_feature: Encodes the peptide sequence at SEQ ID NO. 3634
ctccttcgcctcgctttccccccacctccctccctccctccctcgatcccctcgccgggaagatccgatcccatccacctcccggctcaatcagagccccccactcggcggcggagcagagcagggcggaggcggaaggaaatgttgcgcctttgatcgacgcggcctcccggtggtgcttctcctggcccgcggcgatgggctgcttctcctgcttcgactcgcccgccgatgagcagctcaaccccaagctcggcggcgccggagggtacggcggcgcgtcctcggccgccgcagcgtacggcgccggctccggcgccggccggcacggggacagggggtatccggacctgcagcaggcgcccatggcggccccgcgcgtcgagaagctctccgcagcggctgagaaagcgagggtcaagagtaatgcgctcgcgagagaggcttcggtgccaaaggatgccaatggcaatgttatctctgcgcaaactttcaccttccgcgagcttgccacagccaccaggaacttcaggcccgagtgcttcctgggagaaggagggtttgggcgcgtttacaaaggccgtctcgagagcacaggccaggttgttgctataaagcagcttaatagggatgggcttcaaggaaacagagaatttctagtagaagtcctcatgctcagtttattgcatcatcaaaacctggttaatttgattggctattgtgctgatggcgatcagcgccttcttgtttatgagtatatgccattcggatcattggaagatcatttacacgatctacctcttgataaggaggccttggactggaacaccaggatgaaaattgcagcaggtgctgccaaaggactggagtacctacatgacaaagctaatcctccagttatttatagggattttaagtcatcaaacattctattggatgaaggtttccacccaaagctctctgactttggccttgctaagttgggtcctgttggtgataaatctcatgtctcaacacgtgtgatgggtacatatggttattgtgcaccggagtatgctatgacaggacaactgacagtgaagtctgatgtgtatagctttggagttgtcctgcttgagttgattactggtcgtagggctatcaacagcactagaccacatggagaacaaaatcttgtctcatgggcacggcctcttttcaatgacagaagaaaactccctaaaatggctgaccctaggctggaagggcgatatcccatgcgcgggctttaccaagccctcgcggtagcatccatgtgcattcagtcggaggctgcttcccgcccactgattgcagatgttgtgactgctctgtcctacttggcatctcagtcatatgattccaatgcggcccttgcttcaaggaagcccggtggcgaccagcgaagcaagcctggggagaacggcagggtggtttccaggaacgacgagaccagcagctccggccacaagtcgccgggcaaggacagggaggactcaccccgggacctcccaggtatactgaacaaggactttgaccgggagcgcatggtggcggaggccaagatgtggggtgaccgtgagcgcatggtagcggaggcgaagatgtggggcgaccgcgagcgcatggtgaccgaggcgaagatgtggggcgagaactggcgtgacaagcggcgagcggagaatgggcaggggagcctggattcgccaaccaggaacagctagggtgcaagattaaaggagagagaagacgacggcagaggttttcatccatccacccatgcattatctgtttatttccaggtcgatttgcgttccggtggcagagggaggacagggagggttagatgtacattcctagggcgggatcgcggggaaaacacggtggtgttgtactggacagtggatgcatgtggttgtacttgtaaattctcagaaaattttgtgagaatgaaaggacattttgagttccacttgtagaaaaaaaaaaaaaaaaaaaa

SEQ ID NO: 3634 - protein, 514 aa, Panicum virgatum
  misc_feature: Ceres CLONE 1792597
  misc_feature (53)..(469): SWISSPROT Homolog: EC 2.7.11.1 Serine/threonine-protein kinase PBS1
  misc_feature (55)..(388): SWISSPROT Homolog: EC 2.7.11.1 Protein kinase APK1B, chloroplast precursor
MGCFSCFDSPADEQLNPKLGGAGGYGGASSAAAAYGAGSGAGRHGDRGYPDLQQAPMAAPRVEKLSAAAEKARVKSNALAREASVPKDANGNVISAQTFTFRELATATRNFRPECFLGEGGFGRVYKGRLESTGQVVAIKQLNRDGLQGNREFLVEVLMLSLLHHQNLVNLIGYCADGDQRLLVYEYMPFGSLEDHLHDLPLDKEALDWNTRMKIAAGAAKGLEYLHDKANPPVIYRDFKSSNILLDEGFHPKLSDFGLAKLGPVGDKSHVSTRVMGTYGYCAPEYAMTGQLTVKSDVYSFGVVLLELITGRRAINSTRPHGEQNLVSWARPLFNDRRKLPKMADPRLEGRYPMRGLYQALAVASMCIQSEAASRPLIADVVTALSYLASQSYDSNAALASRKPGGDQRSKPGENGRVVSRNDETSSSGHKSPGKDREDSPRDLPGILNKDFDRERMVAEAKMWGDRERMVAEAKMWGDRERMVTEAKMWGENWRDKRRAENGQGSLDSPTRNS

SEQ ID NO: 3635 - DNA, 983 bp, Panicum virgatum
  misc_feature: Ceres CLONE 1792610
  misc_feature: Encodes the peptide sequence at SEQ ID NO. 3636
atcagctcggcagcttctcctatagatagcttggtgcgtgtgccttggcattcatcagcaacgaagtaatcttgccactttgcttgccagcctactagtacctagtaggatccgttgatccatggaggtggccggaggagctgtcggcgcgccgtccccgccgcggcgcgtggtggtggcggtggacgagagcgaggagagcatgcacgcgctctcctggtgcctctccaacgtcgtctccgccgccagggccgccgcggcgccgccccccgccgtggtgctcgtccacgcccgctcgccgcgcccgttctactgccccgccgtcgacggcgccgggtacctcctgacgcagcaggtgatggacagcatggaccagtacatggccgccgcggccgacaccgtcgtcaccaaggccaagagcatctgcaccgcgttccccggcgtgagggtggagacgtgcgtggagaagggcgacccgcgcgacgtgatctgcggcgcggcggagaaggccggcgccgacatggtggtaatgggcagccacggctacggcttcctgcagagggcgctgcgggggagcgtcagcaaccactgcgtgcagaactgcaagtgccccgtcgtcgtcgtcaagaggcccggcggcgagcgccgcccggcgccgccgcggatctaggctcttgatgaggccgtatataatataataaccgtaagtgaataggagcccgactcgcctcggctaaacgtgacggtggccgcccgtgtacatatctcgcttgttcggggcctgtatctccctgagtatataatgttttcggttcacacaaaatattgtaacgtgtcatgtacattctatatagtcgtttcgaatatgtaagatgagaagaggcatattcgttgttctgtccgacaccttaatatacttgaagagcctgagttttttagaaaataaagttagatgactttgccaaaaaaaaaaaaaaaaaaaa

SEQ ID NO: 3636 - protein, 182 aa, Panicum virgatum
  misc_feature: Ceres CLONE 1792610
  misc_feature (2)..(150): Pfam Name: Usp Pfam Description: Universal stress protein family
MEVAGGAVGAPSPPRRVVVAVDESEESMHALSWCLSNVVSAARAAAAPPPAVVLVHARSPRPFYCPAVDGAGYLLTQQVMDSMDQYMAAAADTVVTKAKSICTAFPGVRVETCVEKGDPRDVICGAAEKAGADMVVMGSHGYGFLQRALRGSVSNHCVQNCKCPVVVVKRPGGERRPAPPRI

SEQ ID NO: 3637 - DNA, 3689 bp, Panicum virgatum
  misc_feature: Ceres CLONE 1792617
  misc_feature: Encodes the peptide sequence at SEQ ID NO. 3638
atttttttttctcttctccgtctccttccttccacccccgactcgaaccatccaatccatctccgtctccctctcttatctggaaacctagcccaccaaccaatctaggccgaggccgaatggcggcgccagggagcgaggacaagaacgtcgatgccttcctggcggactgcacgccctcgggcgacgccgcgtacggcgccgccaaggccgtgctcgagcgcctccacgcccccgccacccgccccgccgcgcgccgcctcctcggcgccgtccgccggcggttcgccgccgacccggccgcgggggaggactgcttccgcaccttccacttccgcatccacggcgtcctcctcgacccacacgtacaaggtttccaacaaaggaggaagctgacaatgatggagatacctagcatcttcattcctgaagattggtccttcactttctatgagggcctcaatcggcatccggattccatttttagggataagactgtagcagagttgggatgtggtaacggttggatttccattgctcttgcagaaaagtggtctcctttgaaggtctatggcttggatataaacccaagagctgtgaagattgcgtggataaacctgtacttgaatgcattagatgatgatggtctcccaatctatgacagcgaggggaaaacattgcttgatagagttgaattccatgaatctgatcttctttcttactgtagaaacaacaagattgagcttgatcgcattgttggatgcataccacagatccttaacccaaatccagaggcaatgtcaaagattataaccgaaaattcaagtgaggattttttgtactccttgagtaactactgtgcacttcagggtttcgttgaagatcaatttggacttgggttgattgcacgggcagttgaagaagggatagctgtcataaagccttcaggtattatggtattcaacatgggaggtcgaccaggacagggtgtctgtcaacgtctatttgaacgccggggatttcgtatcacaaagctctggcaaaccaaaattatgcaggctgctgacacagatatttcagctctagttgaaattgagaaaaatagcagacatcgcttcgagttcttcatggatcttgttggggatcagcctatatgtgctcgcactgcttgggcatatatgaaatcaggtggccgcatttcacatgctttgtctgtgtatagctgtcaacttcgccagcccaaccaggtgaaaaaaatatttgagtttctcaaagatggatttcatgaagccagcagttcccttgatttatcctttgacgacgactccgttgctgatgaaaaaattcccttcctagcatacctagctagttttttgaaagagaataagtccaatccctgtgagccaccggctggatgtctaaattttcggaaacttgttgctggatttatgaagagctaccaccacattcctctaactcctgataatgttgttgtgttcccttctcgtgctgtggcaatagaaaatgctcttcaattgttctctccggcacttgcaattgttgacgaacatttgaccagacatttgcccaagcagtggttaacatctttagcaattgagggaagagcagaaagtaaccatgctgaaggtacagtcactgtgattgaggcaccacgccagtcagatttgctgattgagttgatcaggaagctgaagcctcaggttgttgttactgggatggctcaatttgaggctatcactagtgccgcttttgagaacttactaaatgcaacaaaagatgttggttcccggttattcctggatatttcagaacatttggagttgtctagtctgccaagctctaatggtgtcttgaaatatcttgccggaaagaccctaccttcccatgcagccatactgtgcggtttagtaaagaaccaggtttattcagatctggaagttgcttttgccatatctgaagatgcagctgtatataaagcattatcacaaactattgagctattggaaggtcacacttccttgatcagccagcactattatggctgcctcttccatgagcttctggcatttcaaattgctgatcggcatccacaacaagagaggcaacctgcagaagtgatacctcagcagatgataggattttgtgatccagctatgtctatcctaaaggcagctgaatttttcgttcctgattcaaatgaatccagtgtcattcatatggatttagatcgcagctttctgccagtgccttctgcagtgaatgcctctgttttcgagagttttgtcaggcaaaacataactgattctgagaccgatgtccattccagcatccagcagctggtgcaagatagctatggtttatctgtagatggttgttctgaaattatctatggcaatacctctcttgcactcttcaataagcttgttctttgctgcatgcaagaacaaggcaccttgctttttcccttgggcaccaatggcaattacatttctgcagcaaagtttatgaacgcaagcaccttaactataccgacaacttttggttcaggattcaagattgagccaaaggttttatctgacactcttaagaacgtatctcggccatgggtgtatatttctggcccgacgatcaaccctactggttttctatacagtgacagtgacattcaagagctgctctgtgtctgcgctgaatatggagctagggtagtgatagatacctccttctcaggcctggagtaccaaacggatggctggagtcggtggaatctggaaggatgtccttcttctttgaaaagttcaaagccatcgttctctgtagtcctgctgggagagctgtcctttcagctgatcgcatcagggcatgactttgggtttgtgattttgagcgactcatccttggctgacacatttcatagtttccctagcttgagtcggccgcacagcacattgaagtacactttcaagaagctacttggcctgaagaaccagaaggatcagcatttctccgatctaatggtggagcagcaggaggagctgaagagtcgttccaaccacttaattaagacgctgcaaagctgtggctgggacgttgccagcggttgcggtggcatctcgatgctggcgaagccgactgcctacatagggaagcacttcaaagctgatggctttgagggcaagctggatgcgagcaacatcaggaaagccatcctcagggccacggggctgtgcataaacagcagctcctggaccgggatacccgactactgccggttcagctttgcactggagagcagcgaatttgagcgcgcgatgggatgcataactcggttcaaggagttggtttttggaggcgatgcccaggctcagatgaacggtaactgacggaacaggctggcagttggtctattgcctccatccaatccatcaccgttcgggggggcaatccatccattgtttgaaaactttgcctcagtgctatgaatcattgttcagggaaatatcaaatatatgtaaaggaataacggctgcaagaaatgcctactgtgaattgagtgtgttggctacaagctggtctgaagtttgttccgtccggcttacgcattctcttgctctcccctgttgtattaaagctggcttattctttcttaacctacgggagttacgtgc

SEQ ID NO: 3638 - protein, 1094 aa, Panicum virgatum
  misc_feature: Ceres CLONE 1792617
  misc_feature (1)..(55): Pfam Name: MTS Pfam Description: Methyltransferase small domain
  misc_feature (1)..(372): Pfam Name: Aminotran_1_2 Pfam Description: Aminotransferase class I and II
  misc_feature (1)..(40): Pfam Name: Methyltransf_11 Pfam Description: Methyltransferase domain
  misc_feature (1)..(1093): SWISSPROT Homolog: EC 2.1.1.12 Methionine S-methyltransferase
  misc_feature (10)..(1094): SWISSPROT Homolog: EC 2.1.1.12 Methionine S-methyltransferase
MAAPGSEDKNVDAFLADCTPSGDAAYGAAKAVLERLHAPATRPAARRLLGAVRRRFAADPAAGEDCFRTFHFRIHGVLLDPHVQGFQQRRKLTMMEIPSIFIPEDWSFTFYEGLNRHPDSIFRDKTVAELGCGNGWISIALAEKWSPLKVYGLDINPRAVKIAWINLYLNALDDDGLPIYDSEGKTLLDRVEFHESDLLSYCRNNKIELDRIVGCIPQILNPNPEAMSKIITENSSEDFLYSLSNYCALQGFVEDQFGLGLIARAVEEGIAVIKPSGIMVFNMGGRPGQGVCQRLFERRGFRITKLWQTKIMQAADTDISALVEIEKNSRHRFEFFMDLVGDQPICARTAWAYMKSGGRISHALSVYSCQLRQPNQVKKIFEFLKDGFHEASSSLDLSFDDDSVADEKIPFLAYLASFLKENKSNPCEPPAGCLNFRKLVAGFMKSYHHIPLTPDNVVVFPSRAVAIENALQLFSPALAIVDEHLTRHLPKQWLTSLAIEGRAESNHAEGTVTVIEAPRQSDLLIELIRKLKPQVVVTGMAQFEAITSAAFENLLNATKDVGSRLFLDISEHLELSSLPSSNGVLKYLAGKTLPSHAAILCGLVKNQVYSDLEVAFAISEDAAVYKALSQTIELLEGHTSLISQHYYGCLFHELLAFQIADRHPQQERQPAEVIPQQMIGFCDPAMSILKAAEFFVPDSNESSVIHMDLDRSFLPVPSAVNASVFESFVRQNITDSETDVHSSIQQLVQDSYGLSVDGCSEIIYGNTSLALFNKLVLCCMQEQGTLLFPLGTNGNYISAAKFMNASTLTIPTTFGSGFKIEPKVLSDTLKNVSRPWVYISGPTINPTGFLYSDSDIQELLCVCAEYGARVVIDTSFSGLEYQTDGWSRWNLEGCPSSLKSSKPSFSVVLLGELSFQLIASGHDFGFVILSDSSLADTFHSFPSLSRPHSTLKYTFKKLLGLKNQKDQHFSDLMVEQQEELKSRSNHLIKTLQSCGWDVASGCGGISMLAKPTAYIGKHFKADGFEGKLDASNIRKAILRATGLCINSSSWTGIPDYCRFSFALESSEFERAMGCITRFKELVFGGDAQAQMNGN

SEQ ID NO: 3639 - DNA, 2000 bp, Panicum virgatum
  misc_feature: Ceres CLONE 1792626
  misc_feature: Encodes the peptide sequence at SEQ ID NO. 3640
gaggccgggcgcgggagcgcgcgggggtcagagaccccggcggacaagaaacctccctccccgcctacgctgccgctgccacatcatcgcattgcattgccgccgggtggagcaataagcaattgacttgacttcccccctccactgcacagcggggtctcccctccggttattattgtaaccgagtgcgctgcgctgcatccggtgggcggcccgactcactcccgtcgtcgtcttcctcgtcctcgccctcgtcgcggagcggaggcgcgcgttcttggacgccaccggggcacgggcgtgaggaagctcatctgggtgttggggtcatccggagcccggaggtgcaggctgaacaatggggcaaaaggactccaagccttcctatagctactcttatgatcacggcaatacttcgtcggggtatacttccaggtatgctggaaatccatcatccagttatagcgcgaggtacgcgccttcttcggagaacaatgtgcagccagaaacacacgccaggttgcagaggaagtattccaggattggtgatgactaccgctctttgagtcaggtgactgaagctttggcacaagcaggccttgaatcttcaaatcttattgtaggcattgattttacaaaaagcaatgaatggacaggtaaaatgtccttcaatcgccgctgcctgcatgatattggaagcactccaaacccatatgaacaagccatatctattattggaaggacactttcagcttttgatgaagataatttgattccctgctttggatttggtgatgcatcaactcatgatcaggaggtattcagcttttacccagagaaccgtccatgcaacggttttgaagaggtgctagaaagatacagagaaattgttccaactcttcgattagctgggccaacatctttcgctccgataattgagacagcagttggaattgttgacagcactggtggccaataccatgttcttctgataattgctgatggacaggtaacccgaagtgttgatacacaatatggacaactaagtccgcaggagcgagatacaattgacgcaataataaaagcaagccagttccctctgtcaattgttcttgtcggggttggtgatggaccatgggatatgatgcaccagtttgatgacaatatacctgctcgctcatttgacaatttccagtttgtgaatttcacggagattatgtcaaagagcatagctgctgagagaaaggaggcagagtttgcattgtcagcactgatggaaattcctgaacagtacaaagcaacacttgatcttcaactcttaggacgccgacacagaataactccaagagttgctctgccgccaccaacaaggaatgcttattcgcggtcaactagcttcagtcagcaatctggtgtttattcacgatctagtagctttgaccaacaaacaagtggctttcagcaacgttctgagagctccaaaccgcagcagcagcctgccgccacaaggagacctgacacttatgcagcagaaagtgctttagaggacagattgctgtgccccatttgcatgtataaatcgaaggaccttgcatttggctgtggacatcagacttgctatgaatgcgggaaaattttggagcgctgccctctatgccagcagaaaataactacaaggatcaggctgtactgatcggaagcctatggaatggcacatattggaagagactaccgcgcaaaattgttcagaaccagagtgcttcatcagattgtaattggtgtgttagtctttctgcataataagaaggcttaatgtagatagtggtgatgtcactgccccagtagtgcacaatatgtagtttagctacagtgtttactgtagaaaagatcgcagcaccaaataatgtacatgttttcaaccctttctttcccttcacatctcttagtaaataagttggaacacctgaaaatttctggattaaaaaaaaaaaaaaaaaaaa

SEQ ID NO: 3640 - protein, 444 aa, Panicum virgatum
  misc_feature: Ceres CLONE 1792626
  misc_feature (1)..(33): Pfam Name: zf-C3HC4 Pfam Description: Zinc finger, C3HC4 type (RING finger)
MGQKDSKPSYSYSYDHGNTSSGYTSRYAGNPSSSYSARYAPSSENNVQPETHARLQRKYSRIGDDYRSLSQVTEALAQAGLESSNLIVGIDFTKSNEWTGKMSFNRRCLHDIGSTPNPYEQAISIIGRTLSAFDEDNLIPCFGFGDASTHDQEVFSFYPENRPCNGFEEVLERYREIVPTLRLAGPTSFAPIIETAVGIVDSTGGQYHVLLIIADGQVTRSVDTQYGQLSPQERDTIDAIIKASQFPLSIVLVGVGDGPWDMMHQFDDNIPARSFDNFQFVNFTEIMSKSIAAERKEAEFALSALMEIPEQYKATLDLQLLGRRHRITPRVALPPPTRNAYSRSTSFSQQSGVYSRSSSFDQQTSGFQQRSESSKPQQQPAATRRPDTYAAESALEDRLLCPICMYKSKDLAFGCGHQTCYECGKILERCPLCQQKITTRIRLY

SEQ ID NO: 3641 - DNA, 1798 bp, Panicum virgatum
  misc_feature: Ceres CLONE 1792635
  misc_feature: Encodes the peptide sequence at SEQ ID NO. 3642
gctagtgatagcgcgtcgtcaattcggggtctcgtcttcctgcgtcggccccttccgcctcggacctctcggcttctcggcggcggcggcggcggagcgcaggaggggggatggcgcaccggctgctgcgggacgcgcaggcggacgggtgggagcggtcggacttccccatcatctgcgagtcatgcctcggcgacaacccctacgtccggatgttaagagcagaatatgacaaagagtgcaaaatatgtgcacgcccttttactgtcttccgctggagacctggccgggatgcaaggtacaagaaaacagagatctgccagacatgttgcaagctgaaaaatgtctgccaggtctgcctgctagatcttgagtatggtctaccagttcaggtccgggatacagcactcgctatcaattcgaacgatgcaattccaaggagtgatgtcaatcgtgaatattttgcagaagagcatgatcgaagggccagagctggcatagactatgattcttcctatgggaaggcccgtccaaatgataccattctgaagcttcagaggacagcaccatattacaagaggaacagggctcacgtttgcagtttctatgtgcgtggtgaatgtactagaggtgctgagtgcccatatcgacatgagatgcctgaaaccggggagttatctcagcagaacatcaaagatcgttactatggagttaatgatccagttgcaatgaaacttttgagtaaggcaggtgagatgccatccctgacaccaccagatgatgagactataaggacactatatattggtggactcgatagcagagtaactgaacaggatttgagggaccagttttatgcccatggtgagatcgagtccataaggatggtgcttcagcgtgcatgtgcatttgtgacatacactacaagagaaggcgctgagaaggctgcagaggagcttgctaacaaactagttatcaagggtgtgcgactgaagctcatgtggggcaagcctcaggctccaaagcctgaagaggatgaatcgggaaggcaggggcaggtttcccatggaggactgctgcctagggctgtcatatctcagcagcagggcagcgaccagcctcaacctcctgggatggagggccagcatcagccacaagcaccagcttcatactactttaacattccagctccaccggcagcagagcggactctgtacccgtccatggatcctcagaggatgggtgctgtagttaagtcacaggatggcgaaggcaaaccagggccgcagcaagctggacaagctcagccatcaagcagttcaggacagggcggctatcctgcgccaccaccatactaccatggtcagtacccaccatactatccacctccaccatatggaagctacatgcatccacctcgcatgccctacccaccccagtatccaccataccagccaatgctagcaccaccagcacaagctcacgcaagctcatctcagcaaccagcgcaagcaggacagcagccacctcatggccctccggctcaggcacagcagccggcgcctggcccttcagcacagcagcagccatcccagaactgaagtacttgcaagatattggatgtactgttgtaattcctctccgcaagagaatgtaaccctcgtcagtcgccagcttttgtaatttcttaatctgtgattaacagtaacacatcgtggtattgcttatctgactttgaaaacggagatatactggatctatccagcggacgccgtttcaaaaaaaaaaaaaaaaaaaa

SEQ ID NO: 3642 - protein, 496 aa, Panicum virgatum
  misc_feature: Ceres CLONE 1792635
  misc_feature (1)..(26): Pfam Name: zf-CCCH Pfam Description: Zinc finger C-x8-C-x5-C-x3-H type (and similar)
MAHRLLRDAQADGWERSDFPIICESCLGDNPYVRMLRAEYDKECKICARPFTVFRWRPGRDARYKKTEICQTCCKLKNVCQVCLLDLEYGLPVQVRDTALAINSNDAIPRSDVNREYFAEEHDRRARAGIDYDSSYGKARPNDTILKLQRTAPYYKRNRAHVCSFYVRGECTRGAECPYRHEMPETGELSQQNIKDRYYGVNDPVAMKLLSKAGEMPSLTPPDDETIRTLYIGGLDSRVTEQDLRDQFYAHGEIESIRMVLQRACAFVTYTTREGAEKAAEELANKLVIKGVRLKLMWGKPQAPKPEEDESGRQGQVSHGGLLPRAVISQQQGSDQPQPPGMEGQHQPQAPASYYFNIPAPPAAERTLYPSMDPQRMGAVVKSQDGEGKPGPQQAGQAQPSSSSGQGGYPAPPPYYHGQYPPYYPPPPYGSYMHPPRMPYPPQYPPYQPMLAPPAQAHASSSQQPAQAGQQPPHGPPAQAQQPAPGPSAQQQPSQN

SEQ ID NO: 3643 - DNA, 1944 bp, Panicum virgatum
  misc_feature: Ceres CLONE 1792646
  misc_feature: Encodes the peptide sequence at SEQ ID NO. 3644
acaccgcgccgcctgcctccactctccgcttccttccttcccatctcttcttcccccttccacttcctggcttgctcttccccttctcgggttcaggcagattggaagttgcagtgaaggcggtgggtgccttgcttctttacccgttggggagagggaccggagcagttggagagcgataaagattgcagcgacaggggagacctgaagggctgcaaggggcttctctcttacggcaacatgaagaagctgctcttggtcttcttcctcttcctgctgggcgtcgcagcagttcatggtgaagatggtgcctacatcggcgtgaacattggcacggccatgtcgtcggtgccggcgccgacgcagatcacgacgctgctccgctcgcagaacatccgccacgtccgcctctacgacgccgacccggcgatgctggcggcgctcgccaacaccggcatccgcgtcatcgtctccgtgcccaacgagcagctgctcgccatcggcaactccaacgcgacggcggccaattgggtggcgcgcaacgtggccgcgcacttccccgccgtcaacatcacggccattgccgtggggtccgaggtgctctccgcgcaggccaacgcggcgccgctgctcatgcccgccatgcgctacctccagaacgcgctggtggccgcggcgctggaccgatacatcaagatctccacgccgcactcgtcgtccatcatcctcgactccttcccgccgtcccaggccttcttcaaccggtcgctggacaacgtgctggtgccgatgctcaagttcctgcagtccacggggtcgccgctcatgctcaacgtgtacccctactacgactacatgcgctccaacggcgtcatcccgctggactacgcgctgttccggccgctgccgcccaacaaggaggccgtggacgccaacaccctgctgcactacaccaacgtcttcgacgcggtcgtcgacgccgcctacttcgccatgtcgtacctcaacgtcaccaacgtgccggtgatggtgacggagaccggatggccgcacaagggcgacccctcctccgagcctgacgctaccgccgagaacgctgacacctacaacagcaacctcatccggcacgtgatgaacagcaccggcacgccgaagcaccccggcgtggccgtgccgaccttcatctacgagctgtacgacgaggacacccggccggggtcgacttcggagaagtactggagcctgttcgacatgaacggcgtcccggcgtacaccctgcacctgacgggctccggcgtgctgctggccaacgacacgacgaaccagacctactgcgtggcgcgggaggacgcggacccgaagatgctgcaggcggcgctggactgggcgtgcggccccggcaaggtggactgctccgcgctcacgcaggggcagccgtgctacgagccggacaccgtggaggcgcacgcgacgtacgccttcaacgcctactaccacggcatggggatgggctccgggacctgctacttcagcggcgtcgcggtgatcacgacgaccgacccaagtcatggatcctgtgtctacgctgggaagaacgggtcggcgttgctgaacggcacctcgctggcgccgtcgtccaactccacggagggcggctccggcacgcaccgggcggtcggcgacgtctcggctctcgcccgcgtcgtctccgcagcgctgctcttgagcgtcctcctgttgtagagaggcttgtagtttgtagtactaggcacccgcgattatgcagagacttgcagaggagttaggcgttcgcgagagggatgattctttttgctgtcaagtgggatttggcctgggtgttggtttggtggagggactattgtctctccgaatggaacaggatgtgcttctgttgctcttgcagaaaaaaaaaaaaaaaaaaaa

SEQ ID NO: 3644 - protein, 500 aa, Panicum virgatum
  misc_feature: Ceres CLONE 1792646
  misc_feature: Great-hit functional homolog of the protein sequence encoded by LOCUS At2g01630
  misc_feature (1)..(323): Pfam Name: Glyco_hydro_17 Pfam Description: Glycosyl hydrolases family 17
  misc_feature: Useful for making plants with altered cell wall content and/or composition
MKKLLLVFFLFLLGVAAVHGEDGAYIGVNIGTAMSSVPAPTQITTLLRSQNIRHVRLYDADPAMLAALANTGIRVIVSVPNEQLLAIGNSNATAANWVARNVAAHFPAVNITAIAVGSEVLSAQANAAPLLMPAMRYLQNALVAAALDRYIKISTPHSSSIILDSFPPSQAFFNRSLDNVLVPMLKFLQSTGSPLMLNVYPYYDYMRSNGVIPLDYALFRPLPPNKEAVDANTLLHYTNVFDAVVDAAYFAMSYLNVTNVPVMVTETGWPHKGDPSSEPDATAENADTYNSNLIRHVMNSTGTPKHPGVAVPTFIYELYDEDTRPGSTSEKYWSLFDMNGVPAYTLHLTGSGVLLANDTTNQTYCVAREDADPKMLQAALDWACGPGKVDCSALTQGQPCYEPDTVEAHATYAFNAYYHGMGMGSGTCYFSGVAVITTTDPSHGSCVYAGKNGSALLNGTSLAPSSNSTEGGSGTHRAVGDVSALARVVSAALLLSVLLL

SEQ ID NO: 3645 - DNA, 1064 bp, Panicum virgatum
  misc_feature: Ceres CLONE 1792662
  misc_feature: Encodes the peptide sequence at SEQ ID NO. 3646
aataaattctcctcccttccacggatcaatcactccaccttccccccaccgcgtctcctccccgccatcgctcgggacctccggccgcacccctccttgtcgtccgcggcccagcaccgctcggcttctgccgcaggcgacgagaccgcccccgtcgccaatccgatcgggagccggaggtcaagggttgggcgacatggcagcggccggcgccgacaccaatcccgccgcggctgcccccgccatctccacctgcgcgcactgtcagcgggagatcccgtcttcgaacatcgacttgcattctgtacattgcgcccgtaacctccaaaagtgccagcactgcggagaaatggttccgaggaagcttatggatgaacattacgatgaaaatcatgccccgatgaattgcacccattgcaaagaaacaatagagcgtgaaagttggggtcttcataaaagtgaaaagtgcccacagagaatggttgcctgtgaatattgcgagtttgaactgcctgcagttgatatgggtgaacatcaggatgtatgtggaaaccgaacagaatattgccaaacatgcaaaaaatatattagactacgtgagtggatagggcatgaaatacagtgccatacaaactcaaatggttctgcagaaacatcgagaacaattccagagagggaagtacgacctccgccaccagtacgaccagcacgtcctgctcatggttcacaacacaagcggctcctcttcacaattgcggtcactggaatagctgtcatggtcggctcaatactgttccaaagggatgagagtttctagctcccacagccatgtacatcctttgccgagttgatttcgacagggagagtgttgccataagaggtctgttgatgtaaaataaccccttgtaatcaactgatacatcggatttgtttgagtatccatggcatgtatttattagaaaagcaaaataaccaggatattccgttgtcagttcttaaacatctattttgttttcaaattagacctttgttcctctgtaaggtaaaaaaaaaaaaaaaaaaaa

SEQ ID NO: 3646 - protein, 206 aa, Panicum virgatum
  misc_feature: Ceres CLONE 1792662
  misc_feature: Great-hit functional homolog of the protein sequence given in SEQ ID NO 9618
  misc_feature: Useful for making plants with altered terpenoid content
MAAAGADTNPAAAAPAISTCAHCQREIPSSNIDLHSVHCARNLQKCQHCGEMVPRKLMDEHYDENHAPMNCTHCKETIERESWGLHKSEKCPQRMVACEYCEFELPAVDMGEHQDVCGNRTEYCQTCKKYIRLREWIGHEIQCHTNSNGSAETSRTIPEREVRPPPPVRPARPAHGSQHKRLLFTIAVTGIAVMVGSILFQRDESF

SEQ ID NO: 3647 - DNA, 1952 bp, Panicum virgatum
  misc_feature: Ceres CLONE 1792673
  misc_feature: Encodes the peptide sequence at SEQ ID NO. 3648
gatttgccgtgacgagagtgggcagtggagcaaggggaggaggaggagattccatagacaaaataggacacgtcttcctccgccaagtgcgccttcctcctcgcttggcccctctcagcctctcttctcgcgctgttccttcccttcctggttccatcaactcgtgaggccgccgtccgtctccgtctcgggggaagatgatgattgcgcggcgcctgctccgatcaaatgcctccgcccaggcaagcagcttggtgaagtatgtaaccagcgctgcaactttgcaagggcaagcagaatgtttgtcggatggatcaatcagacattttagttcagcgccatcttcccaatctgactcaactgaagaaaatggatttaaggggcatggcatgttggcaccgtttacagctggctggcagagcaatgacttgcatccactgattatcgagagatctgagggttcctatgtttatgacataaatggaaataagtacctagattctcttgcaggactatggtgtacagctttaggtggtagcgagcctcgattagtcaaagcagcaactgatcaattaaacaagttacccttctatcattccttttggaaccgcacaaccagaccttcattggatcttgcgcaggagattcttagcatgttcactgcacgggaaatgggaaaagtgttcttcacaaatagtggttcagaagccaatgactctcaggtcaaactggtatggtattataacaatgcattggggagaccaaacaagaagaaatttattgcacggacaaaagcataccatgggtctacattgatatcatcgagcttaactggtcttcctgccctgcaccagaagtttgatctgccagcaccttttgttctgcacactgactgccctcactactggcgttatcatcttcctggtgagacagaagaagaatttgctactagacttgccaccaatttagagaatcttattctgaaagaaggaccagaaacaattgctgctttcattgctgaacctgtgatgggtgctggtggtgtcatccctcctccgaagacctattttgacaagattcaagcagtggtcaagaagtatgacattcttttcatagcagatgaggtcatcactgcatttggaaggttgggaaccatgtttggatctgattattataacatcaaaccggatcttgtttcactagctaaggctctttcgaatgcttatgtacccatcggagcaactctcgttagcccagagatatcagatgtgattcattcccagagcaataagcttggttcatttgctcatggatttacatactccggtcatccagttgcctgtgctgtggccatagaagctctgaaaatttatcgcgaaagggatattccgggccatgtcaggcagattgctccaaagtttcaggatggaattagggcatttgcagacagtccaattatcggggagatacgtggcttagggatgataatgggaactgaattcaccaacaacaagtcaccagctgatctattcccttctgaatggggcgttggtgcaatctttgggcaggagtgccagaagcgcggcatgctggtgagggttgccggcgacgctatcatgatgtcgccgacactgatcatgacacctggggaagtcgacgagctggtgagcatctacggggaagcccttaaggccacggaggcgagggtggcggagctgaaatccaagagttaagccaagcacgacgacgatgacgataaacgtcaggcagcgatgaacacagctgatgtacagaagaataagttcggggctgggagatggcaataataatgctgcaacgggcactgttcttgaagggcaacaactgtgcaaggtagcagctgctgtgtactgagcaattgtgaccactaatataaaggacatacatgtttttaaaaaaaaaaaaaaaaaaaa

SEQ ID NO: 3648 - protein, 511 aa, Panicum virgatum
  misc_feature: Ceres CLONE 1792673
  misc_feature (1)..(357): Pfam Name: Aminotran_3 Pfam Description: Aminotransferase class-III
MMIARRLLRSNASAQASSLVKYVTSAATLQGQAECLSDGSIRHFSSAPSSQSDSTEENGFKGHGMLAPFTAGWQSNDLHPLIIERSEGSYVYDINGNKYLDSLAGLWCTALGGSEPRLVKAATDQLNKLPFYHSFWNRTTRPSLDLAQEILSMFTAREMGKVFFTNSGSEANDSQVKLVWYYNNALGRPNKKKFIARTKAYHGSTLISSSLTGLPALHQKFDLPAPFVLHTDCPHYWRYHLPGETEEEFATRLATNLENLILKEGPETIAAFIAEPVMGAGGVIPPPKTYFDKIQAVVKKYDILFIADEVITAFGRLGTMFGSDYYNIKPDLVSLAKALSNAYVPIGATLVSPEISDVIHSQSNKLGSFAHGFTYSGHPVACAVAIEALKIYRERDIPGHVRQIAPKFQDGIRAFADSPIIGEIRGLGMIMGTEFTNNKSPADLFPSEWGVGAIFGQECQKRGMLVRVAGDAIMMSPTLIMTPGEVDELVSIYGEALKATEARVAELKSKS

SEQ ID NO: 3649 - DNA, 1819 bp, Panicum virgatum
  misc_feature: Ceres CLONE 1792677
  misc_feature: Encodes the peptide sequence at SEQ ID NO. 3650
atcccatccttgccttgatccccggcctcctctcgccttgcattgcattggtcgatccactatatgtattgagagaagcagcagcagcagcgtggtacagtacctcctccatcgatcgatcacatattcacattcatcatatgccacacaaacaatgcggcacacggcagacagcaggaagaagaagcggaggatgatgagtcctccatccccatcctcctcctcctcgaaatctgcagcagcagctgctgctgctccaggtcaatggtgctgctactcccagtcccagcagcagctgatgctcctccttgcacttgcactcgcgctcctccttcctcatgtggcggtggcggggaggatggcgaggatccagagccatctggacaggatcaacaagcccgccctgcgctccatacgcagcgcggacggcgacaccatcgactgcgtggcggcgcaccagcagcacgctctggaccacccgctcctcaaggggcacaccatccaggcggagccacccgagatgccagccagccgccgacgacttgcagctgctgctgatgccaagacgggcagcggcagatcttggggcgcctggcagacctggcaccatggcggtcactgtcccaggggcacggtggccgtccgtcggaccaccgccgccgacgtgctgcgcgctggctccatctcccgcttcggccacaagaagaggaagaagagatcatccgtggacgccgcccgcgcggccaatgcgccggacgtcatctccggcaacgggcacgagcacgccatcgcgtacacggcgccttcttcgcagcagcagccggtgtatggcgccaaggccaccatcaacgtttgggatccggccatccaggaatccaacggcttcagcctctcccagctctggatcctctccggctccttcaacggctccgacctcaacagcatcgaagcaggatggcaggtcagccctgagctgtacggggacagcaggccgagactcttcacctactggacaagcgacgcgtacgaggctaccgggtgctacaacgcgctgtgcccggggttcgtgcagacgagctcccgcatcgccatcggcgcgtccatctcgccggtgtcgtcgcccggcggcgcgcagtacgacatgacgctgctggtgtggaaggaccccaagctgggcaactggtggctcagctacggcgaccagctcgtgggctactggccagcccagctcttcacgcacctctccgaccacgccaccatggtcgagtggggcggcgaggtcgtcgacaccaggcccggcggcgtgcacacggccacccagatgggctccggacgcttcgccgccgaggggttcggccgggccagctacttccggaacctcgagacggtggacgccgacaacagcctggcgaaggtgcccctggacgccatccagaccctggcagaggacgccgcctgctacgacatacacaaggccgccgccgacgacgacgacggacactcgggatctgccggcggctggggcacccacttctactacggaggcccgggacacaacccggcatgcccctgaacgaatccttgctgctaattatattttattattagctataggaggagtacttactactactctactaatacagtagtgcgtagtagtagtattgcaccaatataatcaatcaagctgctaattaattgatttttcattctcctccagtccttaattatattctgcactgcatgctgcatgtaattgtaatcccaagctagcaaggatgatgatgatggatttctttaaaaaaaaaaaaaaaaaaaa

SEQ ID NO: 3650 - protein, 472 aa, Panicum virgatum
  misc_feature: Ceres CLONE 1792677
  misc_feature: Great-hit functional homolog of the protein sequence given in SEQ ID NO 9230
  misc_feature: Useful for biocontainment applications
  misc_feature: The plant produces a reduced number of seeds.
MRHTADSRKKKRRMMSPPSPSSSSSKSAAAAAAAPGQWCCYSQSQQQLMLLLALALALLLPHVAVAGRMARIQSHLDRINKPALRSIRSADGDTIDCVAAHQQHALDHPLLKGHTIQAEPPEMPASRRRLAAAADAKTGSGRSWGAWQTWHHGGHCPRGTVAVRRTTAADVLRAGSISRFGHKKRKKRSSVDAARAANAPDVISGNGHEHAIAYTAPSSQQQPVYGAKATINVWDPAIQESNGFSLSQLWILSGSFNGSDLNSIEAGWQVSPELYGDSRPRLFTYWTSDAYEATGCYNALCPGFVQTSSRIAIGASISPVSSPGGAQYDMTLLVWKDPKLGNWWLSYGDQLVGYWPAQLFTHLSDHATMVEWGGEVVDTRPGGVHTATQMGSGRFAAEGFGRASYFRNLETVDADNSLAKVPLDAIQTLAEDAACYDIHKAAADDDDGHSGSAGGWGTHFYYGGPGHNPACP

SEQ ID NO: 3651 - DNA, 1540 bp, Panicum virgatum
  misc_feature: Ceres CLONE 1792699
  misc_feature: Encodes the peptide sequence at SEQ ID NO. 3652
actcgtcaggcttccatcggcgccaccgcccgaagcttctggacggagatggcggaagctccgagaacctcggaggcgcgccgggacgccgtgttcgggcggtgggtcgtcttctcgccggcgcgctcgcgccgccccaccgacctcaagtcgcacaaccccaccgccaaccctagctccggccccggcgccgacgcccccaagccgtcctgccccttctgctccggccgcgagtccgagtgcgccccccagatcttccgcgtgccgcccgacgacgcgctgccgtggcggatccgcgtcatccagaacctctatcccgcgctgcggcgcgacatcgagccgccgcccgcgcctgagccggaggtggttgacggggaggcggaggcggaggagcagcccggggagcgcgctgtgcgcgggttcgggttccacgacgtggtcatcgagacgccgcgccacgacgtccggctgtgggacctgggcgcagagggggtccgcgacgcgctgctcgcctacgcggcgcgcgtgcggcagctccgggagcaccccgcggtgaagtatgttcaggtgtttaagaaccatggggcatctgctggagcgtcaatggcacattcacacagccagatgctgggaactccctttgtccctccctctgttacatctcggcttaactgcatgaaggggttttttgatagatcagggaactgcagcctttgcgagattaggtccaaagatatcctgatcagcgagacaccctatttttctgcgattgttccttttgctgcatcatatccatttgagatatggattattccccggcaacatctttcttattttcatgaaattgatgaggctaaggcactggatcttggatctctgttgaagacaatgctacaaaagctgtctaagcagctcaatgacccaccattcaattttatgatccacagcacaccatttgggctctcatcatcctgcctgccttatgcacactggttccttcagatcgtgccccagttaagtgtaataggcgggtttgagcttggaagtgggtgctacatcaatccagtttttcctgaagatgctgtcaagattttgagggaacttgactgttcaacctagctggtggttttttctcgaatatgcaggagagctgctgcgtatcattgcattaagaaagaagatcctagctggcggttggtatctgattgttcactaaatatgaaagaaagctatgttccacaatactttccctgaaagcaaaagtaacatgttaataatccaagtggacagttaacatgatatgtaacagcggacggaccttgttttggcgaggatgatctgctggggtttcattaaacttttatctgaatcctcccctggcaaatagctattgtcaggcctgcatgccaagtgttgtttttttaattttgtgggccgtcaggttgatgattgcatgttgatgtacaattgggttaaaaacagagttttccagactaataaattgttgatatctgtctgacaaaaaaaaaaaaaaaaaaaa

SEQ ID NO: 3652 - protein, 356 aa, Panicum virgatum
  misc_feature: Ceres CLONE 1792699
  misc_feature (1)..(36): Pfam Name: GalP_UDP_transf Pfam Description: Galactose-1-phosphate uridyl transferase, N-terminal domain
MAEAPRTSEARRDAVFGRWVVFSPARSRRPTDLKSHNPTANPSSGPGADAPKPSCPFCSGRESECAPQIFRVPPDDALPWRIRVIQNLYPALRRDIEPPPAPEPEVVDGEAEAEEQPGERAVRGFGFHDVVIETPRHDVRLWDLGAEGVRDALLAYAARVRQLREHPAVKYVQVFKNHGASAGASMAHSHSQMLGTPFVPPSVTSRLNCMKGFFDRSGNCSLCEIRSKDILISETPYFSAIVPFAASYPFEIWIIPRQHLSYFHEIDEAKALDLGSLLKTMLQKLSKQLNDPPFNFMIHSTPFGLSSSCLPYAHWFLQIVPQLSVIGGFELGSGCYINPVFPEDAVKILRELDCST

SEQ ID NO: 3653 - DNA, 1718 bp, Panicum virgatum
  misc_feature: Ceres CLONE 1792702
  misc_feature: Encodes the peptide sequence at SEQ ID NO. 3654
gtctcgccgtgcccgtcgtcgtcgtcgccaccaccacttggctcccccgtcgcctcccccgccgaccaccaccaccgtccaccggcgacaaggacagcgacgatgcagtcggcggcgtggaggtgtcacctcctcgaccaccacctctccccttccaccttggccgccatcgctgccttcagatccgcctcacagcccgggctcactccccaagggttgtgtggagcggatggcgcgaggtacatgtcgtccgcgagggcgccggcggtcaagggctcggggcatctcgtccgcaagggcaccggagggaggtcttctgtcagtgggattgtagctacggtgttcggagctactgggtttcttgggcgttatcttgtgcaccagcttgccaagatgggttctcaagtgcttgtcccattcagaggttctgaggattgtcaccggcacctgaagattatgggtgacttgggtcagattgtaccgatgaaataccatccaagagatgttgattctattaaggctgttatggccaagtcaaatgtggttgttaacctcataggacgagagtatgaaacaagaaactacagcttcgaagaagtaaaccatcatatggctgaacagcttgctatgatttctaaggagcatgggggtatcatgagatttatccaggtttcatgcctaggggcatcaccctcttcggaatctagaatgttgaggacaaaagctgcaggagaggaatcaatcttgaatgaatttcctgaggctacaatcatgaggcctgcaaccatgattggcacagaagatcgaattttgaacagatgggcacaattcgcgaagaattggggtttcctcccgcttgttggcggaggaactgcaaggattcagcctgtttatgtgattgatgttgctgctgctattgtcaactccctcaaggatgatggtactagcatggggaagatatatgagcttgggggacctgagatatacactgtccatgagctggctgagctgatgtatgagacaatccgtgaatggccgcgatatgtcaatgttccgcttcctgttgcaagggctattgcttctccaaggaaaatgttgctaaacaaagtaccatttcccctgccaaccccttctattttcaacctagatcaaatcaatgcattctctgtggataacctcgtgtctgaagatgctctcactttcgaggacctgggcatcatgcctcagaagctgaaggggtaccctgtggagtacctcatgtcttaccggaagggcgggccttctttcggttcaactgtgagcgagaagatgaggagctctgagatgtagcctccttccgtccctgaaggcactgtagattcataatcatttagttgcagatgcattgttgtgtttgttgtctggcgatctgtcgccgctgcagctgctcccgccggctgcctcacccgtgggcaggacccaaattccatgcatggctcctgctccttgtttgtttttacatcaataagaacgctcggatgcttcttttgtcaaaatttttgagctggatgcaacaagtgaagagaggaaccgttccaacgatgacacgattgtggggaggcctcagtgttggatgttctaggatctttagctcaaaatggaatcacataaggacatgaaatgcatattttgatctttagagccactcttcttcttctgaaaaaaaaaaaaaaaaaaaa

SEQ ID NO: 3654 - protein, 408 aa, Panicum virgatum
  misc_feature: Ceres CLONE 1792702
  misc_feature (1)..(213): Pfam Name: Epimerase Pfam Description: NAD dependent epimerase/dehydratase family
MQSAAWRCHLLDHHLSPSTLAAIAAFRSASQPGLTPQGLCGADGARYMSSARAPAVKGSGHLVRKGTGGRSSVSGIVATVFGATGFLGRYLVHQLAKMGSQVLVPFRGSEDCHRHLKIMGDLGQIVPMKYHPRDVDSIKAVMAKSNVVVNLIGREYETRNYSFEEVNHHMAEQLAMISKEHGGIMRFIQVSCLGASPSSESRMLRTKAAGEESILNEFPEATIMRPATMIGTEDRILNRWAQFAKNWGFLPLVGGGTARIQPVYVIDVAAAIVNSLKDDGTSMGKIYELGGPEIYTVHELAELMYETIREWPRYVNVPLPVARAIASPRKMLLNKVPFPLPTPSIFNLDQINAFSVDNLVSEDALTFEDLGIMPQKLKGYPVEYLMSYRKGGPSFGSTVSEKMRSSEM

SEQ ID NO: 3655 - DNA, 2027 bp, Panicum virgatum
  misc_feature: Ceres CLONE 1792718
  misc_feature: Encodes the peptide sequence at SEQ ID NO. 3656
attgccacgcccgccaagtcagaccaagcagagagacgcccgcagacgcaccaaccaccagcacagcacagcacagcagagcagagcagagcagagcagaggaggactagagcgcggcgccaccacccgggaccaagagagccaacaggcagatcgcgcgcgatccatccatccgatcccgccgatcgccatggccccgccgccgccggtggacccgcgcagcggctactgcgccgccacgcgctccttccgcagcaagcgcgccgacgtcccgctccccgccgacctcgacctcgacgtcgtcaccttcctcgcctcccgccgccacgcggggaccgtcgcgctcgtcgacgccgccacggggcgcagggtcaccttcgccgacctctggcgcgccgtcgcaggcgcggccaccgcgctcgccgccccgccgctctccctccgcaagggccaggccgcgctcatcctctcccccaactccgtccacttccccgtcgccgcgctcgccgccatgtccctcggcgccgtgctcaccaccgccaacccgctcaacacgcccgccgagatcgccaagcaggtcgccgacgcgcgccccgtcctcgccttcaccacccgggacctcctccccaagctccccgccgccggcctccgcgtcgtgctcctcgagcccgagcgcctcccctccgaccccgccgccgtcgtcgccaccatcggggagatctccgccacgacgcccgaccccgcgcgccgcagggagcgcgtcacgcaggacgaccccgccacgctgctctactcctcggggaccacggggcccagcaagggcgtcgtcgccacgcaccggagcctcatctccatggtgcagatcatcatgacgcggttccgcctcgagagctccgacaggaccgaggccttcctctgcaccgtgcccatgttccacgtctacggcctcgtcgccttcgccacggggctgctcggctgcggcgccaccatcgtcgtgctctccaagtacgagctccccgagatgctgcgcgccatcaacgagtacggggtcacctacctgccgctcgtgccgcccatcctggtcgccatggtggcgcaccccaagccgctgccgctcggccagctgcgcaaggtgctctccggcggcgcgccgctgagcaaggagatcatcgaggggttcagggacaagtacccgcaggtggagatcctgcaggggtacgggctcacggagagcacggccatcggcgcgtccacggactctgcagaggagagccgccgctacggcacggctgggctgctctcgcccaacaccgaggctaagatcgtcgatccggacaccggtgaggcgctcccggtgaaccgcacaggcgagctctggatccgggggccatacgtcatgaaagggtacttcaagaacacagaggcaacacagtcaacgttgacacctgacggatggctcaagactggggacctctgctacatagacgaggatgggtatctcttcgtggttgatcgcctcaaagagctgatcaaatacaaagggtatcaggtgcctccggcagagttggaggctcttttgctaacacatccggaaattgcagatgtcgctgttataccgtttcctgatcgtgaggttggccagttcccgatggcctacgtagttaggaagaaggggagcaacttgtcagatcgcgaggtgatggagtttgtggcgaaacaggtagcgccttataagaaggttaggaaggtggcatttgtgacagaaattcccaagaatgcgtccggcaagatactgaggaaggatctcatcaagctcgccacatcaaaattgtgagatgtctactggtccgaatttactgtgttggcatcaagcggcagtgagctctgcactttcccagtactggcgagtaagatcccattgggggctatttgcctgtgtaagctgttcatgtacaaggttattgcgtctgtaaccaggaatgaataatcaatttggtaaataattccgagttgtagtgttgtatcac

SEQ ID NO: 3656 - protein, 547 aa, Panicum virgatum
  misc_feature: Ceres CLONE 1792718
  misc_feature: Great-hit functional homolog of the protein sequence encoded by LOCUS At1g20510
  misc_feature: Useful for making plants with altered cell wall content and/or composition
MAPPPPVDPRSGYCAATRSFRSKRADVPLPADLDLDVVTFLASRRHAGTVALVDAATGRRVTFADLWRAVAGAATALAAPPLSLRKGQAALILSPNSVHFPVAALAAMSLGAVLTTANPLNTPAEIAKQVADARPVLAFTTRDLLPKLPAAGLRVVLLEPERLPSDPAAVVATIGEISATTPDPARRRERVTQDDPATLLYSSGTTGPSKGVVATHRSLISMVQIIMTRFRLESSDRTEAFLCTVPMFHVYGLVAFATGLLGCGATIVVLSKYELPEMLRAINEYGVTYLPLVPPILVAMVAHPKPLPLGQLRKVLSGGAPLSKEIIEGFRDKYPQVEILQGYGLTESTAIGASTDSAEESRRYGTAGLLSPNTEAKIVDPDTGEALPVNRTGELWIRGPYVMKGYFKNTEATQSTLTPDGWLKTGDLCYIDEDGYLFVVDRLKELIKYKGYQVPPAELEALLLTHPEIADVAVIPFPDREVGQFPMAYVVRKKGSNLSDREVMEFVAKQVAPYKKVRKVAFVTEIPKNASGKILRKDLIKLATSKL

SEQ ID NO: 3657 - DNA, 1648 bp, Panicum virgatum
  misc_feature: Ceres CLONE 1792768
  misc_feature: Encodes the peptide sequence at SEQ ID NO. 3658
acttaccggccgcctattttccttttctcacgaaaaaaaagatttttgttaattgcgaaaacgaaggagcccgtgtgaactagagaggtcaagaaaggaggaaaaaggagagataaattggaggctattagcgagaaaccatgcgtgctaggttcacaatccgtagtcctgacctcagttgagcgctcgtgagctcgcgccgctgattaaagattgcagctatcagttctagtccaagaaacgagtgcttctccgccatggaggtgaggtccgagcaagggctgatggcgggcagggatctgtttggcatgcccaagagcccgccagcgccgccggcgtccgcagccatgcagagcgtgcgcatggcgcacaccgcagacggcacccctgtcttcgccccggtaacctcggcagcgccgccgtcttatcagccgcaggttgcggtccacgggcctagcatgtccactgcggcggtcactggaggcaatggcgccatggcgtcaccgggcataagtgagccagtggccaagaagaagcgcgggcggccaaggaagtatggacccgatgggtccatgtcgctggcattggtgcctgcatcgtcggctacagggtcgtcgacgatggggcagggttcttccgggcctttctcactggtggggccaaatccggcgaactctgtgccaggggtgtcgccgtacggaatgaagaagcggggccgacccaagggttctaccaacaagccgcgcatggatgctcttgggtcatcaggagttggatttactcctcatgttattacagttcaacctggggaggacgtttcatcgaagattatgtcattttctcagcatggaacacgtgcggtttgcgttctttcagcaaatggtgccatatcaaatgtaacgcttcgccagactgctacttcaggtggaactgtaacatacgagggtcgatttgagttactatcactgtcagggtcattcctcctgatagagaatggaggccagcatagtcgaacaggagggctgagtgtgtcactggcgggtcctgatggtcgtctcttgggtggtggagttgcaggacttctcatagcagcttcaccaattcagatagtattgggaagcttcagttctgaaggcaaaaaggcgccaaaacagcatgctccttcagaccctgcatcagcaccactgaaggtcgccccgaccacctctatgcgacccaacagccccccttcaagaggcacattgagtgaatcatctggtgggcctggaagtccaccaccactgcatcaaggcatggctgctagcaacactaatcaaccaccaatcatgtccagcatgccctggaaatgagctctgcatcctcgaccaaattcaggcaggctcaggtctacgattggtgaactgccttccaggagggagcagcaatttgcgcttcaatagtgctcgttctctgacaagcttatatgtagtgcaattcggagcttgactgcttgagtagtgagagtactgtagcaagaagtttgtagctctattgtaggttttcaccctgaattcatgtgctaggtagctgtctgttgtcatctagagatgatgtactgagctttgtctatgtgatccttggcagtgttatcaaatgtttatttagtcct

SEQ ID NO: 3658 - protein, 363 aa, Panicum virgatum
  misc_feature: Ceres CLONE 1792768
  misc_feature: The sequence is a functional homolog of  SEQ ID NO 1012 in the  10/225,066 US patent application
  misc_feature: The sequence is a functional homolog of  SEQ ID NO 124 in the  10/374,780 US patent application
  misc_feature: Useful for making plants with modulated growth and phenotype characteristics
MEVRSEQGLMAGRDLFGMPKSPPAPPASAAMQSVRMAHTADGTPVFAPVTSAAPPSYQPQVAVHGPSMSTAAVTGGNGAMASPGISEPVAKKKRGRPRKYGPDGSMSLALVPASSATGSSTMGQGSSGPFSLVGPNPANSVPGVSPYGMKKRGRPKGSTNKPRMDALGSSGVGFTPHVITVQPGEDVSSKIMSFSQHGTRAVCVLSANGAISNVTLRQTATSGGTVTYEGRFELLSLSGSFLLIENGGQHSRTGGLSVSLAGPDGRLLGGGVAGLLIAASPIQIVLGSFSSEGKKAPKQHAPSDPASAPLKVAPTTSMRPNSPPSRGTLSESSGGPGSPPPLHQGMAASNTNQPPIMSSMPWK

SEQ ID NO: 3659 - DNA, 2193 bp, Panicum virgatum
  misc_feature: Ceres CLONE 1792779
  misc_feature: Encodes the peptide sequence at SEQ ID NO. 3660
gccacgcaacgctcgtccccaaaaattcgaaagcaatcgaagccaagccacacctgcacgtggacgacacagctctccatctccctcccgtcttctccaccgatctgctcggctcctcccgcccgacgcgcttcgtcgggaaccctagcgccggatctccgcggcggccgcggaaatggcgaaccccgtagcggggctgcaggaccacctcaaactcgcgcgcgactacgcgctcgagggcctctacgacacctccgtcatcttcttcgacggcaccatcgcccagatcaacaagcatctaactactctggacaatgctctggttcgtacgaaatggatgaactgcaagaaagcaatctctgaagaagtggaaattgtaaaacagttagatgcccaattaaagtcccttaaagaagctcctggggtgaggcggtcctcatcacctcctattcgctccaacaaatcatttcatttccaaccgttggatgaatatccaacttcatcgccagcaccctttgatgatcctgatgtgtgggctccaccaagagatacaccaaaccgaaggtcaacaagaggtcaatctagtgcaagaaaatcctcccaagatggagcttgggcacgtggtgcatcaaggactggaacacctagccgtagcgcaaagcctaatgggagcaaaggaggctctgctgtaagatcatcaactgcgcctggcactggtgggagaaaaggaaaaccaagttcaagcaaggctgattcagcgagtagtgatgctgaagaaggtaagtccaagaagggccagtacgaaggtccggacgcggacttagctgccatgcttgaaagggacgttctagattctactccaggtgtaagatgggatgatgttgcaggacttagtgaggccaaacggctccttgaggaagcagttgtgcttcctctctggatgcctgaatattttcagggtattcgtaggccttggaaaggagttcttatgtttggtccaccaggtactggaaagactcttttggcaaaggcagtggctacagaatgtggaacaacattctttaacgtttcatctgcaacattggcttccaaatggcgtggcgagagtgagcgcatggtccgttgtctatttgaccttgcgagggcctatgctccaagtacaatattcattgatgaaatcgactccttgtgtacatcccgtggagcttctggtgagcatgaatcatcaagaagggtgaagtctgaacttcttgtgcaaattgatggtgtaaacaatagctctaccactgaagatggtcaaccaaaaattgttatggttctggctgctaccaactttccatgggatattgatgaagcactgaggcggaggctggagaagcgtatctatattccacttccagactttgaaagtagaaaggcacttatcaacattaaccttagaacagttcagatagctgcggatgttaacatagatgaagttgctcggaaaacagaaggttacagtggagatgaccttacaaatgtttgccgtgacgcttcaatgaacggtatgaggcgaaagatagccggcaagactcgcgatgagatcaagaacatggcaaaggatgagatagcgaaggatccagtggccatgtatgactttgtggaggctctgggcaaggtccagaagagtgtctcacctgctgacatagaaaaacatgagaagtggatggctgagtttggatctgcatgagacctatgctcccgttcaaagttctgcaaatcttcaatcttcttcacccttttgtgtgctgtgccggtttttccaatcaattgcagtgacatcaatgacacctgttgactgttatatgcgttggtggtgtcgtagcatagaccagagtcaggtttgtccacagaaccatcctgttgattttcagtggcggtaggaattaaattctcgattatttcagttcttcaaattcaaatgcattctctgtccatgaaatggatctcaacctgacagtttcatctcggtaatgagcaagattaaagaggaagtttccgcttggattgcggcaggagcgcggccctttgcggccttaattgtgtgagattagccctttgtaaccttgctttttttgctttgtacttgcttcctctttatcaatgaaataggcacactctccgttcgttcaaaaaaaaaaaaaaaaaaaa

SEQ ID NO: 3660 - protein, 518 aa, Panicum virgatum
  misc_feature: Ceres CLONE 1792779
  misc_feature (2)..(518): SWISSPROT Homolog: EC 3.6.4.3 Katanin p60 ATPase-containing subunit
MANPVAGLQDHLKLARDYALEGLYDTSVIFFDGTIAQINKHLTTLDNALVRTKWMNCKKAISEEVEIVKQLDAQLKSLKEAPGVRRSSSPPIRSNKSFHFQPLDEYPTSSPAPFDDPDVWAPPRDTPNRRSTRGQSSARKSSQDGAWARGASRTGTPSRSAKPNGSKGGSAVRSSTAPGTGGRKGKPSSSKADSASSDAEEGKSKKGQYEGPDADLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCTSRGASGEHESSRRVKSELLVQIDGVNNSSTTEDGQPKIVMVLAATNFPWDIDEALRRRLEKRIYIPLPDFESRKALININLRTVQIAADVNIDEVARKTEGYSGDDLTNVCRDASMNGMRRKIAGKTRDEIKNMAKDEIAKDPVAMYDFVEALGKVQKSVSPADIEKHEKWMAEFGSA

SEQ ID NO: 3661 - DNA, 906 bp, Panicum virgatum
  misc_feature: Ceres CLONE 1792799
  misc_feature: Encodes the peptide sequence at SEQ ID NO. 3662
attcatcctctgctctccgccgataaatcctcctcctctgctccctcctgctctctcctcgccgccaccttactccgaattcgatggacctgcatgcggagctgcggcgcccggcggcgccccacaaggcggcgctgagggccgtgcagaagccgcccgccaagccctggcgcgggggagccggagccgccgccaccgcggccccgcccccgccgcccaaggtgtaccgcgtcgagccccgggagttccgggacctcgtgcagaggctcaccggcgcgccgcccgcggccacggccaggggcggcgtggcgccgcggccgcagcatcagcatcagctggcgacggcggtgcagccgcagcagccggtggccgttcgcgcttcaggggaccaccagcagcagctttacggctcgccgtggttctcgttcccgctagccggggtggacggcgccaacgccggcggactcatgtagtcacctacctctgcctggtggtgaagcatgcatcaagggaagacaagggacgggatgcagcaaatcaaagctttctccttaattttttcttggttattacagtagtttgtttctgaaacaaggaagggaatcgaagagcatacaagaatcaacagcagcagtcaccacaccaacacgctggcaattaggcagggcaggcagacacatagatgaatttattaatgatgttgaataataatgtcagtatatagtactagctaatagttagttactctgttaattacaactaccagcagtaagtaccggtgttcatagacagtcttcgtatcactgtaacaagtgtgatggaaaaatattgagatatatgttggtgttgcagtccagctgcctgctgaataacacaaagtcttttcaaaaaaaaaaaaaaaaaaaa

SEQ ID NO: 3662 - protein, 129 aa, Panicum virgatum
  misc_feature: Ceres CLONE 1792799
  misc_feature: Great-hit functional homolog of the protein sequence given in SEQ ID NO 9407
  misc_feature: Useful for making plants with modulated biomass
  misc_feature: The plant is abnormally small.
MDLHAELRRPAAPHKAALRAVQKPPAKPWRGGAGAAATAAPPPPPKVYRVEPREFRDLVQRLTGAPPAATARGGVAPRPQHQHQLATAVQPQQPVAVRASGDHQQQLYGSPWFSFPLAGVDGANAGGLM

SEQ ID NO: 3663 - DNA, 1812 bp, Panicum virgatum
  misc_feature: Ceres CLONE 1792812
  misc_feature: Encodes the peptide sequence at SEQ ID NO. 3664
aagaggaggcgagcgaccggccgattcgagcagcagccagctagccatggcgacgcaggccgcgctgttcgctgggttctcgcagctcgccgcgcagccggcccgcgaccgcgccgggacgggggcgccggcgcgggttggcgtggcggcgatcgggggcgccagggcggggggcgtgaaggcgggggccgccgggcccgggtgggcggcggcgccccgcggggtgcggtgccgggccagcctgattgagcccgacggcgggcggctggtggacctggtggcgcccgaggagggcggccggcgcgcggccctgcggcgggaggcggcgtccctgccgcaccggctgcgcctgggccgcgtcgacaaggagtggctccacgtcctgaacgaaggatgggccagcccgctgcaagggttcatgcgcgagcatgagttcctccaagcacttcatttcaacgccatccgcggcgcggatggcaggatggtcaacatgtccgtccccatcgtgctctccctcggggacgcgcagcgacgggccatccaggccgacggcgccacgcgcgtcgcgctcgtcgacgaccgcgaccgccccctcgccgtattgagcgacattgagatctacaagcacaacaaggaagaaagaattgcaaggacatgggggacaactgcacctggattaccttacgttgaggaggcaattaccaatgctggtgactggttgattggtggggacttggaggtcatagaaccgatcaagtacaatgatggtctcgatcagtatcgcctgtctccggcacagctgcgcgaagagtttaccaggcggaatgctgatgctgtatttgcctttcagcttcgcaaccctgtacacaacgggcatgctttgcttatgactgacactcgcaaacgcctccttgatatgggctacaaaaaccctgttcttttgctccatccactggggggattcacaaaagcagatgatgtacctcttagctggagaatgaagcagcatgagaaggttcttgaggaaggtgtcctcaacccagaatcaactgttgttgcaatcttcccctctccaatgcattatgctgggccaactgaggtgcaatggcatgctaaggctcgtattaatgctggtgcaaatttctatattgttggaagggatcctgccggtatgagccatcctactgcgaaaagggacctttatgacgctgatcatggaaagaaggttttgagcatggctcctggccttgagaagctcaatatccttcctttcagggttgctgcatatgacacaaagcaaaagaaaatggatttcttcgatccatcaaggaaagatgattttctgttcatctctggcacaaagatgcgcactcttgccaagaaccgcgagagccccccagatggttttatgtgcccgggtggctggaaagttctcgtggaatactatgacagcttggtgccatcagaggggagcagcaagctgcgcgagccagttgcagcctagaagctggaaatgcttaagataatggatactactgtatctcagcaagcggttctttgcgacatagaaccaatgttatatgattgtataccggtcgtaagacctacactgggcttgattcagacaattactgtgtggcttgtaattggtgtgcattatctgctggcagtgttgcacatgcaacgcagcccatctctcgtgttcagtgtcaataaggacgggctctgtatcctctgccagattgtacatatacgttgtggtgatatgtttacaaggcttgatatgcttgctaaaaaaaaaaaaaaaaaaaa

SEQ ID NO: 3664 - protein, 485 aa, Panicum virgatum
  misc_feature: Ceres CLONE 1792812
  misc_feature (1)..(330): Pfam Name: ATP-sulfurylase Pfam Description: ATP-sulfurylase
  misc_feature (76)..(470): SWISSPROT Homolog: PAPS synthetase 1 Bifunctional 3'-phosphoadenosine 5'-phosphosulfate synthetase 1
  misc_feature (76)..(470): SWISSPROT Homolog: PAPS synthetase 2 Bifunctional 3'-phosphoadenosine 5'-phosphosulfate synthetase 2
MATQAALFAGFSQLAAQPARDRAGTGAPARVGVAAIGGARAGGVKAGAAGPGWAAAPRGVRCRASLIEPDGGRLVDLVAPEEGGRRAALRREAASLPHRLRLGRVDKEWLHVLNEGWASPLQGFMREHEFLQALHFNAIRGADGRMVNMSVPIVLSLGDAQRRAIQADGATRVALVDDRDRPLAVLSDIEIYKHNKEERIARTWGTTAPGLPYVEEAITNAGDWLIGGDLEVIEPIKYNDGLDQYRLSPAQLREEFTRRNADAVFAFQLRNPVHNGHALLMTDTRKRLLDMGYKNPVLLLHPLGGFTKADDVPLSWRMKQHEKVLEEGVLNPESTVVAIFPSPMHYAGPTEVQWHAKARINAGANFYIVGRDPAGMSHPTAKRDLYDADHGKKVLSMAPGLEKLNILPFRVAAYDTKQKKMDFFDPSRKDDFLFISGTKMRTLAKNRESPPDGFMCPGGWKVLVEYYDSLVPSEGSSKLREPVAA

SEQ ID NO: 3665 - DNA, 1726 bp, Panicum virgatum
  misc_feature: Ceres CLONE 1792828
  misc_feature: Encodes the peptide sequence at SEQ ID NO. 3666
ctcctccggctcctcctcacccatccaattccggcgccggagtatcgccgcccgccggctcagatcgacctctgctcgggatgctatcgaactccagcttcagttggcgggctcgctggagctcggctcattgacaaccctcccgcctcagggctcagggcctcagcctcatctctgtttccttcccgcttccccttgtctccgactctctcctcccttgctcttccttccccggcggccacggctgggccattcgtcacctcttcgcccagccctttgccggcgactagcatccaccagcgaagcgctccgctcccacagacaacttgggctcaagcggatgagcatgtgtgagaaagatcagaatttgccctggggatacgacctttttcgcgatccctttgctcctcctcccgggtactatggacctcctcccggttactgcgatggtaactgttgtcacctccattatgcacatccagatgagactcacttgcattcctctcaactcacatatgatttgtacaacccatcagtaggcatctaccatcccggtagtgctgatgatcatgagcacgatacagtatacatagaatcgtctagttcctctccaggccccagcagtgacggttattttgagatggaggaggaagtagggaagaggttttatcccatggtcccagtccctcatgtccctaaaattaatggagaaattccatcagtcgatgaagccactatggaccatgaaaggctgacagaaaggttgaagttgtatgatctggttgaacacaaggtgcaaggagatggcaactgtcagttccgagcactatcagatcaactgtaccaaactccagatcaccatgagtttgtgagagagcagataattagccagcttaaaactaaccgtgatgcctatgatggatacgttcccatggcatatgatgattacttggagaaagttgcacgaaacggtgaatggggcgaccacgtgacgttacaggctgctgctgacaagtatggagtaaaaatttttgtgatgacatcgttcaaggatacctgctacatcgagatccagcctaaggttcagaagtccaacaaagtggtactgttgagcttctgggcggaggtgcactataactccatatatccccagaatgatgcaccgaggtcgcagacaacgaagaggaggagatggtggccgttctcacagcaccacaaccattgatggcggatggcagaaggctcacccccatcatcttcatctctctgggactgggatagatgccagcatggtggagctcgtcatcattgaggatcaggtggtggtcctgggagctatggaggggccgtcgtccaaatgatacaaggaacggcattatgattaatatcatatccagagcagagcagagcagaccagacccgatatagatacatgggatgggatgaaatgaaataagcatgagatgaggactgtcctctggtacatagttgggagtggaggccagtgcatgccaactaaactctagtattattgtttgtatctacaaattttgccggaatgaggctagaattactgggaaacgattatggtaataattatggtgataataaaatgggcaagaattgagatgacccagttgcagggggtttgctatctatcttgtgtaagatggataagctatttattttaaaatccattttggcccaaaaaaaaaaaaaaaaaaaa

SEQ ID NO: 3666 - protein, 294 aa, Panicum virgatum
  misc_feature: Ceres CLONE 1792828
  misc_feature (1)..(113): Pfam Name: OTU Pfam Description: OTU-like cysteine protease
MSMCEKDQNLPWGYDLFRDPFAPPPGYYGPPPGYCDGNCCHLHYAHPDETHLHSSQLTYDLYNPSVGIYHPGSADDHEHDTVYIESSSSSPGPSSDGYFEMEEEVGKRFYPMVPVPHVPKINGEIPSVDEATMDHERLTERLKLYDLVEHKVQGDGNCQFRALSDQLYQTPDHHEFVREQIISQLKTNRDAYDGYVPMAYDDYLEKVARNGEWGDHVTLQAAADKYGVKIFVMTSFKDTCYIEIQPKVQKSNKVVLLSFWAEVHYNSIYPQNDAPRSQTTKRRRWWPFSQHHNH

SEQ ID NO: 3667 - DNA, 1761 bp, Panicum virgatum
  misc_feature: Ceres CLONE 1792829
  misc_feature: Encodes the peptide sequence at SEQ ID NO. 3668
gttggagatagcaaccccaaaactcctccgcaagcacccaccccgttcatggccctcgccactgcaaccacggccgcggccgtctccctccaccctctcctcacccggcccgcctgcgtcctccgcttcggccgccgcctgactccccacctcctccgcgccacctcctctgcctccagcgccccggatttcaacatcaccttcgcggagcccgctccggcaaagaaggcctcgtcccccgccccgtccgcgcagcctctggtcccatggatcgtccgcggggaggacaggaagccacgcctcagcacctcgccgccaccggaggtgctccaggccattgcgctcgcggaggcggaggccaagaaggcggctaagaaggaaagtctcaagggccagaagggtgcggttgctgccgccgctgcttcgagtgccggcatcaagatcaaggaaaggaaggacgccccggccgcgccgcccaagttctcaaaggcggccaggaggttctacaatgagaatatcaaggagcgcgagccgcagcggctcgccaaggtccttgccgctgcaggagtggcctcaagaaggacgagtgaggagctcattttccaagggaaagtgactgtcaatggcgcagtctgcacttctcctcagaccaaagttgacatctcgaaggattctatctatgttaatgggaaccgcatttccaagaagctgcccccaaagctgtattttgctgtgaacaagccaaaagggtatatctgctcatgtggtgaagaatcaaagtctgttgtctccttatttaatgactatttgaagggttggaacaagcttcaaccaaggctgccgaaaccacgcttatttactgtgggtcgtcttgatgttgccacagctggtttgataataatcacaaatgatggagagtttgctcagaaacttgcgcatccttcttcaaatgtaacaaaggaatatgtagtaactattgatggtgttgtgcacaagaaacacctcatagctatcagtgaaggcacaaaaattgatggggtcatgtgcgtacctgatttagtagagccattggctgaatcagatacaagaaaaacccgtcttaagatagtggttcatgaaggacgaaatcatgaagttcgtgaacttgtacagaatgcagggctaaaggtttacgcattgaaacgtgttcggattggcaggttccggcttccagcagatctaggaattgggaagtttgttgagctcaaacaggctgatatcaaggcactagaaggcaacaactagatatgacaggctgatatcaaggcacttgaaggcacgaactagtgatgacatctttgctccttcactgatcagttttgaattaatgtggataagtacatctccgtcaaaggatggcaacaatccttctgactctcacaattcaggagctgctactccacttagaaaacctgtgaatctcctgggtgtacattggtggtggtggtggtggctgatgagcaagttcaacaaacatatttttgcctggaagaacctgtgaactgcttcgttgaagaacaccatggtcctaaaaaacagcagaacctccaattccgacggtggagcagcctttggtgaaggacataaaacattgtcaaagagcagaactcgtgaaagcatgtactctgtatatcggtgttacggtgtaaatctacatgctctcatgcgagcacatgaaccatttttccaatggttaaacagcaaaaaaaaaaaaaaaaaaaa

SEQ ID NO: 3668 - protein, 411 aa, Panicum virgatum
  misc_feature: Ceres CLONE 1792829
  misc_feature (1)..(147): Pfam Name: PseudoU_synth_2 Pfam Description: RNA pseudouridylate synthase
MALATATTAAAVSLHPLLTRPACVLRFGRRLTPHLLRATSSASSAPDFNITFAEPAPAKKASSPAPSAQPLVPWIVRGEDRKPRLSTSPPPEVLQAIALAEAEAKKAAKKESLKGQKGAVAAAAASSAGIKIKERKDAPAAPPKFSKAARRFYNENIKEREPQRLAKVLAAAGVASRRTSEELIFQGKVTVNGAVCTSPQTKVDISKDSIYVNGNRISKKLPPKLYFAVNKPKGYICSCGEESKSVVSLFNDYLKGWNKLQPRLPKPRLFTVGRLDVATAGLIIITNDGEFAQKLAHPSSNVTKEYVVTIDGVVHKKHLIAISEGTKIDGVMCVPDLVEPLAESDTRKTRLKIVVHEGRNHEVRELVQNAGLKVYALKRVRIGRFRLPADLGIGKFVELKQADIKALEGNN

SEQ ID NO: 3669 - DNA, 1316 bp, Panicum virgatum
  misc_feature: Ceres CLONE 1792831
  misc_feature: Encodes the peptide sequence at SEQ ID NO. 3670
agtcatccaccactcgctcgcccgcgccattccccttccccctcctcgtcgcggcgccgcggcggcgaagggcgaaggcaatggcgatggcctccacctacgcaccgggcggcggcgcgggggcgctcgcgccgggaagggccagggtccgcgagcccgccggggggctcgtcctcggcccctccaaggccggcctcccccgccccctcgccctcgccaggcggagcccccagctcgcggccgccaggctgcggtgcgcggcgtcctcgtcgcccgcggcccccgcgcggcccgtcacggcgccgcggttcatccagcacaagaaggaggccttctggttctaccgcttcctctccatcgtctacgaccacgtcatcaacccgggccactggaccgaggacatgcgcgacgacgcgctcgagcccgccgacctctacagccgccacctcaaggtcgtcgacgtcggcggcggcaccggcttcaccacgctcgggatcgtcaagcacatcaacccggagaacgtcacgctgctcgaccagtccccgcaccagctcgagaaggccaggcagaaggaggcgctcaagggggtcaccatcatggagggcgacgccgaggacctgcccttcccgaccgacagcttcgaccgatacatctccgccggcagcatcgagtattggcctgatccgcagagaggaatcaaggaagcgtacagggtcctgaggtttggtgggacagcttatgtgatcggccctgtgcacccaaccttctggctctcccgcttcttcgccgacatgtggatgctcttccccaagaaagaagagtacatcgagtggttcaagaaggctgggttcaaggatgtcaagctgaaaaggattggaccaaagtggtaccgtggcgtccgaaggcatggcctgatcatgggatgctctgtcacaggtgtgaagagagaacgtggagactctcctttggagcttggtccgaaggctgaggatgtcagcaagccagtgaatcctatcacgttcctctttcgcttcctcataggaacaatatgtgctgcatactttgttctggtgcctatttacatgtggataaaggaccagatcgtgcccaaaggcatgccaatctgagtgaagggggctgagctcaaggaagagaggatagccaatatctcaattagtcttctctatattaggcgcttcctgtctgttttgtatttacctttcatttttcttctgttatgtatttcttctactgttgttcctgtttgtgcgaagcaataatattaagaccttgatcaaaaaaaaaaaaaaaaaaaa

SEQ ID NO: 3670 - protein, 348 aa, Panicum virgatum
  misc_feature: Ceres CLONE 1792831
  misc_feature: Great-hit functional homolog of the protein sequence given in SEQ ID NO 9676
  misc_feature (1)..(94): Pfam Name: Methyltransf_11 Pfam Description: Methyltransferase domain
  misc_feature: Useful for making plants with altered tocopherol content
MAMASTYAPGGGAGALAPGRARVREPAGGLVLGPSKAGLPRPLALARRSPQLAAARLRCAASSSPAAPARPVTAPRFIQHKKEAFWFYRFLSIVYDHVINPGHWTEDMRDDALEPADLYSRHLKVVDVGGGTGFTTLGIVKHINPENVTLLDQSPHQLEKARQKEALKGVTIMEGDAEDLPFPTDSFDRYISAGSIEYWPDPQRGIKEAYRVLRFGGTAYVIGPVHPTFWLSRFFADMWMLFPKKEEYIEWFKKAGFKDVKLKRIGPKWYRGVRRHGLIMGCSVTGVKRERGDSPLELGPKAEDVSKPVNPITFLFRFLIGTICAAYFVLVPIYMWIKDQIVPKGMPI

SEQ ID NO: 3671 - DNA, 2465 bp, Panicum virgatum
  misc_feature: Ceres CLONE 1792840
  misc_feature: Encodes the peptide sequence at SEQ ID NO. 3672
tcggctgcgctgcgcctcctccacgcaactcggccaccgctcctaccctaccggcgaggtcgccgaagcctccgcctccgtctcctccaaagtctccactagtgctcgccggccccgccaatcggccacctgtatccccagacacaccgctccagatacaccggtgcacaggtgcccctgcacagctgcccctgcacaggtgcgcagctgcctcgccggcccgccgccgcacgcctgctttcccttccttttagtataaccacctgcagctgcacccccgtgctctgctcagtgctcagcgctcgccaaccaactccccaaccaccggatcccaggcaaaagggagggatggccgccgagaccgtcgacggcagcgcgctcgcggggcgcgcgctggccgcggccggcgcccgccacatgttcggcgtcgtcggcatccccgtcacctccctcgcctcccgcgccgccgccgcgggggtccgcttcctcgccttccgcaacgagcagtccgcgggctacgccgccgccgcctacggcttcctcaccggctccccggggctcctcctcaccgtctccggccccggctgcgtccacggcctcgccggcctctcccacgccaccgccaacgcctggccgctcctcatgctctccggctcctgcgaccaggccgacgccggcaggggcgacttccaggagctcgaccagatcgccgccaccaagcccttcgccaagctcgcagtcaaggccaccaccatcgccgacatcccgcgcctcgtcttccaggccctcgccgctgccgtctccggccgccccggtggctgctaccttgacatcccctccgacgtcctgcaccagaccctccctcaatccgaggccgcggatctcatagcagcagcagcagccgattcggccgcttccaacccatccccgcccaaccagaagcccctagatgaagatgaggccatcgtgaaagctgcggacctgctccggcgcgcggagcggcctcttgtcgtcattgggaagggtgccgcgtacgcgcgcgcggaggaggccatccggaagctggtggacaccacgggcatccccttcctcccgacgcccatggggaagggggtcgtgcccgactcgcacccgctctccgccacggcggcacgctcactcgccatcgggcagtgcgatgtggctctggtcgtcggtgccaggcttaactggttgcttcacttcggcgagccgcccaagtggtccaaggatgtcaagttcatacttgtggatgtctgcgaggaggagattgagctccggaaaccacatgtggggattgttggtgatgccaagagggtgattgagctcatcaatagggagatcaaggatgatccattctgcttggcaaggtcgcacccatgggttgaagccatcaccaagaagaccaaggacaatgttgttaggatggaggcacagctagcaaaggatgttgtgccgttcaatttcttgacaccgttgcggataatccgggatgccatccttgctgagggaagccctgctccgatagtggtctcagaaggggcaaacactatggatgttggcagggctgtgctagtgcagaatgaaccaaggacaagactggatgcagggacatgggggaccatgggggtcggattggggtactgtattgctgctgcagtagccgaacccgaacgccttgtggttgctgtggagggtgactctggatacggattcagtgcaatggaggttgagacattggtgaggtaccagttgcccgttgtagtaattgttttcaacaacaacggtgtctatggtggtgaccggagaagctctgatgagataactggacccttcaaagatgaccctgccccaacttcttttgtcccagcagcaggctaccacataataatggaagcgtttggaggaaaaggttatcttgtggagacaccagacgagcttaaatctgccctttcggaatcattccgtgccaggaaaccagcagtcatcaattgtatcattgatccttacgcgggtgcagagagcggccggatgcagcacaagaactgagggtgtttgtaccataccatagcaagatgcagatgcgacttaataagcaatgccctccagcgtccagcccttttgtttttgacgactggttctttgttctgcgtaccgatgtgaggtgctctgtaaacttagctggacggttgaaactgaagcgggtattcacggaatttagcttcactcccccggtaaatatggtctatggatgctctcgtggatagtgttccatctttgatggcatgtacatgtattatgattgtcctcaagccacgatgcaaatgtgaaactagtatcctctaaaagaacagtttgtaaactggtgtgtttttccttcttaaaatgaatgagtaataagttgcaacaggcttcaacatttctgccaaaaaaaaaaaaaaaaaaaa

SEQ ID NO: 3672 - protein, 572 aa, Panicum virgatum
  misc_feature: Ceres CLONE 1792840
  misc_feature (1)..(146): Pfam Name: TPP_enzyme_C Pfam Description: Thiamine pyrophosphate enzyme, C-terminal TPP binding domain
  misc_feature (1)..(170): Pfam Name: TPP_enzyme_N Pfam Description: Thiamine pyrophosphate enzyme, N-terminal TPP binding domain
MAAETVDGSALAGRALAAAGARHMFGVVGIPVTSLASRAAAAGVRFLAFRNEQSAGYAAAAYGFLTGSPGLLLTVSGPGCVHGLAGLSHATANAWPLLMLSGSCDQADAGRGDFQELDQIAATKPFAKLAVKATTIADIPRLVFQALAAAVSGRPGGCYLDIPSDVLHQTLPQSEAADLIAAAAADSAASNPSPPNQKPLDEDEAIVKAADLLRRAERPLVVIGKGAAYARAEEAIRKLVDTTGIPFLPTPMGKGVVPDSHPLSATAARSLAIGQCDVALVVGARLNWLLHFGEPPKWSKDVKFILVDVCEEEIELRKPHVGIVGDAKRVIELINREIKDDPFCLARSHPWVEAITKKTKDNVVRMEAQLAKDVVPFNFLTPLRIIRDAILAEGSPAPIVVSEGANTMDVGRAVLVQNEPRTRLDAGTWGTMGVGLGYCIAAAVAEPERLVVAVEGDSGYGFSAMEVETLVRYQLPVVVIVFNNNGVYGGDRRSSDEITGPFKDDPAPTSFVPAAGYHIIMEAFGGKGYLVETPDELKSALSESFRARKPAVINCIIDPYAGAESGRMQHKN

SEQ ID NO: 3673 - DNA, 1962 bp, Panicum virgatum
  misc_feature: Ceres CLONE 1792844
  misc_feature: Encodes the peptide sequence at SEQ ID NO. 3674
gtgagcttagcggagctggtccctcgacattcatccattccattccggtcccgctacccgacgccaatgcgccatgattgacgctgcttcccccttccaatcctccatagcctgatcctgctgccgtgtccggccgccgccgcctcgcttggagctgtccctcgaggggctcgccgccggaggaggagtatcgcttcttgctctgcactgttctgtcccctccggtgtgccttactgaggggcggctccaccgctgacggcgcggttgccctgatggggatttggtgaccggtggagaatgttcgtcagcccgagcaggaagatgagtagatccgcgagcacatttcaagtccttttggttttagcgacgattgttgctcagacacaatgggctagagctagtgtatcaggcatgcactgcaatgacttgacaccaagcgttgaaaggccccacagtgcctcaataaccgattttggtgctgttggtgatggcacaactcttaacacgaaagcatttcagaatgcactcttctacctcaactcatttgcaaacaagggtggggcgcagctgtttgtgcctgctggaaggtggttgaccgggagttttagtctaatcagccatctcacgctgtcactggacaaggatgcagtaattcttggatcaccagactcatctgactggccagttattgatgctcttccatcctatggacgtggtagagaactccctggtaaaagacatcaaagtttgatatttgggtccaatcttactgatgtgataataactggtactaatggtaccattgatggccaaggtgcaatttggtgggactggtttcacaaccacactttgaattatactagaccacccctcgtcgaactgatgtactctaccagagttattatttccaatctaacctttataaattcgccattttggaatatccatcctgtatactgcagccaagtccttgtccagcatctcacgatcttagcacctatcagttcaccaaacactgatggcattgatccagactcatctacaaacgtctgcattgaagactgttacatcaggaatggcgatgacattgtcgtcatcaagagtgggtgggatgaatatggcatttcatttgctcatcctagctccaacattagcatccgcaacatcacaggacagacaaggaacagtgctggaatcgcttttggaagcgagatgtcaggtggcatatcaaatgttcgagcagagggtattcacatagtcaactcagtgcatgggatcagaatcaagacagccccagggcgtggaggatatgtgaaaaatgtgtatgtagctgatgtgagcttggacaacgtttccatagccatcaggatcactggaaactatggtgaacatcctgacgagaactacaacaagaatgcactccccaccataagcaacataactatcaagaatattgtgggtgtcaatattggtgttgcgggaatgttgcaaggcatctcaggggataacttcagcaatatttgcttatcaaatgtttccctcagtgtcagatccacgaatccatggaattgttcacttgtcgaagggtattcgaactctgtgtcacctgagatatgtgagcaacttagaaaaggtcctgggcctggacaagtatgctatgatggcaatagctatccagcagcagcagcacaaccccagtcgccacagaagtcaagtgctagccgattggtaaatcctttcttttgcacaagttggtttctctgtaggtaaccattgagtatatctacttgatgcatttgtttccttgtttccccagcggtttggtaattgtactttaatggatcagtgttttgtactcatgttattccaaaaccttcttgtaagggtatgtaggtactgattattagtggaaatgaaataaatatgtttggcttgacgaacaaaaaaaaaaaaaaaaaaaa

SEQ ID NO: 3674 - protein, 490 aa, Panicum virgatum
  misc_feature: Ceres CLONE 1792844
  misc_feature: Great-hit functional homolog of the protein sequence encoded by LOCUS At3g62110
  misc_feature (1)..(354): Pfam Name: Glyco_hydro_28 Pfam Description: Glycosyl hydrolases family 28
  misc_feature: Useful for making plants with altered cell wall content and/or composition
MFVSPSRKMSRSASTFQVLLVLATIVAQTQWARASVSGMHCNDLTPSVERPHSASITDFGAVGDGTTLNTKAFQNALFYLNSFANKGGAQLFVPAGRWLTGSFSLISHLTLSLDKDAVILGSPDSSDWPVIDALPSYGRGRELPGKRHQSLIFGSNLTDVIITGTNGTIDGQGAIWWDWFHNHTLNYTRPPLVELMYSTRVIISNLTFINSPFWNIHPVYCSQVLVQHLTILAPISSPNTDGIDPDSSTNVCIEDCYIRNGDDIVVIKSGWDEYGISFAHPSSNISIRNITGQTRNSAGIAFGSEMSGGISNVRAEGIHIVNSVHGIRIKTAPGRGGYVKNVYVADVSLDNVSIAIRITGNYGEHPDENYNKNALPTISNITIKNIVGVNIGVAGMLQGISGDNFSNICLSNVSLSVRSTNPWNCSLVEGYSNSVSPEICEQLRKGPGPGQVCYDGNSYPAAAAQPQSPQKSSASRLVNPFFCTSWFLCR

SEQ ID NO: 3675 - DNA, 2121 bp, Panicum virgatum
  misc_feature: Ceres CLONE 1792861
  misc_feature: Encodes the peptide sequence at SEQ ID NO. 3676
acgcggccggggcaggaagggagggagaggtgatccactggtgttgggccctcggatccggaacgcggagctcctgcggcgctcggatcggtcgctcggagggcgcggggcgcgaggtagggaccgggatcggcagtgatggggaaggccgcggcggtgggcacggcggtggtggtgtgcgcggccgtcggggtggcggtcgtggtggcgcacaggcggcgccggcgggaggccgagctgaaggggtccgcggaggcggacaggaagaggcgggcggccgccgtgatcgaggaggtggagcgcagcctctccacgcccaccgcgctgctgcggagcatcgcggacgccatggtgtccgagatggagcgcggcctgcgcggggacatccactcgcagctcaagatgctcatcagctacgtcgacaacctccccaccggggatgaacatgggctgtattatgcactggatctcggaggcacaaacttccgtgtgctgcgagtccaactaggaggaagggagaaacgggttgtcaaacaacagtatgaggaggtttccattccaccacatctgatggtcgggtcttccatggaactatttgattttattgctgctgcattggccaaatttgttgatactgaaggtgaagatttccacctcccagagggtaggcagagagaacttggtttcaccttttccttcccagtgaaccaaacatcaatatcgtcaggaacactcattaaatggacaaagggattttccgtcaatggcacggttggtgcagatgttgtgtctgagttgagcaaggccatggagaggcaggggctagatataaaagttacggcgttggttaatgatacggttggcacattggccggtgggagatatttggataacgatgttgttgcagctgtaatattgggcactggtacaaatgcagcatatgtggagcacgcaaatgcaattcctaaatggactggtttactgcctaaatctgggaacatggtaattaatacggaatgggggagcttcaaatccgacaagcttcctctttcagaatacgataaagccatggactttgaaagtttgaaccctggagaacagatatacgaaaaaatgatttctggcatgtatctaggagagattgtgcgaagaattttactgaagttggcacacgatgcttctctgtttggggatgttgttccatctaagctggagcagccatttgtactgaggacaccagatatgtcagccatgcatcatgactcctcacatgacctcaaaattctgggagctaagctgaaggatattgttggggttgcggatacttcactggaagtaagatacattactcgacacatctgtgaccttgttgctgagcgtggggcacgcttagctgctgctggtatatatagcatcctgaagaagataggccgggacaaagtaccaagcaatggcagtaaaatgccgaggaccgtcattgctttggatggtggtctctatgaacattacaagaagttcagcagttgtgtagaaacaactcttacagacttgctcggtgaagaggcctcatcctccgtggttgccaagctggccaacgatggctctggcattggagcagctcttcttgcagcctcacactcccagtatgccgatgttgactagtcttgaaatcaagcgtggatcaagctttgggtgtagtttctctcttttttttctccttttcccttcaaacattcctaatattccgggcactccttcgggaaattttcggcttccttttctctggatgcacccaagttctctgcagcggaatatagctagtatagaaccaatgagtttggaggttctctgatggcataaatgtttggacggcaggagcatagaattggaggttgaacaatgccattcatgttctgcccattctttccccttgcatggtgttgtaaaccaatcgaatttttaacctttttttttgtgttggcaataacgaggaggacacgaacgaatttaaccatgtgttctcttcattgcttcttcaaatatgtacgagtgaatttagttgcatggcttcaaaattatatagttacagtacattgctattaaaaaaaaaaaaaaaaaaaa

SEQ ID NO: 3676 - protein, 507 aa, Panicum virgatum
  misc_feature: Ceres CLONE 1792861
  misc_feature (1)..(245): Pfam Name: Hexokinase_2 Pfam Description: Hexokinase
  misc_feature (1)..(507): SWISSPROT Homolog: EC 2.7.1.1 Hexokinase-5
  misc_feature (1)..(507): SWISSPROT Homolog: EC 2.7.1.1 Hexokinase-6
MGKAAAVGTAVVVCAAVGVAVVVAHRRRRREAELKGSAEADRKRRAAAVIEEVERSLSTPTALLRSIADAMVSEMERGLRGDIHSQLKMLISYVDNLPTGDEHGLYYALDLGGTNFRVLRVQLGGREKRVVKQQYEEVSIPPHLMVGSSMELFDFIAAALAKFVDTEGEDFHLPEGRQRELGFTFSFPVNQTSISSGTLIKWTKGFSVNGTVGADVVSELSKAMERQGLDIKVTALVNDTVGTLAGGRYLDNDVVAAVILGTGTNAAYVEHANAIPKWTGLLPKSGNMVINTEWGSFKSDKLPLSEYDKAMDFESLNPGEQIYEKMISGMYLGEIVRRILLKLAHDASLFGDVVPSKLEQPFVLRTPDMSAMHHDSSHDLKILGAKLKDIVGVADTSLEVRYITRHICDLVAERGARLAAAGIYSILKKIGRDKVPSNGSKMPRTVIALDGGLYEHYKKFSSCVETTLTDLLGEEASSSVVAKLANDGSGIGAALLAASHSQYADVD

SEQ ID NO: 3677 - DNA, 1663 bp, Panicum virgatum
  misc_feature: Ceres CLONE 1792872
  misc_feature: Encodes the peptide sequence at SEQ ID NO. 3678
agaagccagaagcggagaagcccagcccgctggaatcatcagttgagaccacctccactccactcgttccgcttctcccccgcgagagccaccagctccaccaccgccggcggccgccaccgcctcccacgcccacgcaatgctggcggcgtccctcaagcccgcgcccttcctcgcggccttctccccttccgcccggaggagccccgcgccgtcagtcgccttccccttccctgcccgcctcaaccagcgtccgctcctctcggccgccgcaaccgccgagggcaccggcgcctccgccaggcagggagaagactcctcctcctctttctccgccgccgccaccgccgctcccccgattgatgaggcccgcctggcccagtttgctgcggactgggaagccgcgcgcgcggacaaggagcaggggaagatcctcacgctacctgtgctcagggcgaacagcggcgggctcatcgtcaagttcaactccctgcaggggttcgtgcccaaccctctcctcagccccgtgcactggtgcagagacccaaaaaggcccatccaagatgttaccaaggacctagtaggaacgtccatttctgtcaaggtgtccgaagtaaatgaggaggaaaggaagcttgtcttcaccgagaaagatgctagttggtcaaaatactcttcccaaatcaagattggtgacatctatgatggaatcgtgggctcagtgttccattatggtgcatttgttcacctgcgatttcctgatggattataccatcttactggtcttgtacatatctctgaggtgtcttgggatcttgttcaggatgtccaggattttctaaatgaaggggatgctgtcaaggttatagtggtcaatattgatacggagaagtcaaggatagctttatcgatcagacaactggaggaagatcctttattggagacattggacaaagttattcctttggaagctgatcaatctcctgaccgtatcatgtctccttcagaagttgaacttctgccaggacttgatggtatatgtaatgaactattgcaagaggatggtataactgatgtacagtttgggcgccaagtgttggagaaacgtgttgtttcacaagatttggagctttggctttccaatgtgccagctaaggataacaagttcacgcttcttgcgcgagctgggaggcaggtccaggaagtgtatttgacatcttccctagaccaagagggtataaagaaggctgtgcaaagagtgctagggcgtgttccttgagtctgacacacagcaaggagaaacaaaggtgtgcctgtcctccccaattttctaactatatatgaagcattatagcaaatcaacagtactagcaaacagcctgaaatatccgtcactgtcactacactctgctaaacttttattatctctgttggatactacaccaaccaaaatctgtaaatatttgtagcacagcaatgagtagtttagccatcctttgtgcatcctctacacaagcatgtcgttaagcggtggttctatgtatttgctgggtttgccttttgatgtcactgcttggacttgtctgactctgaactcttgaggcggttttatgtatatgatgagtatagcaaagttttatgtcaaaaaaaaaaaaaaaaaaaa

SEQ ID NO: 3678 - protein, 379 aa, Panicum virgatum
  misc_feature: Ceres CLONE 1792872
  misc_feature (2)..(79): Pfam Name: S1 Pfam Description: S1 RNA binding domain
MLAASLKPAPFLAAFSPSARRSPAPSVAFPFPARLNQRPLLSAAATAEGTGASARQGEDSSSSFSAAATAAPPIDEARLAQFAADWEAARADKEQGKILTLPVLRANSGGLIVKFNSLQGFVPNPLLSPVHWCRDPKRPIQDVTKDLVGTSISVKVSEVNEEERKLVFTEKDASWSKYSSQIKIGDIYDGIVGSVFHYGAFVHLRFPDGLYHLTGLVHISEVSWDLVQDVQDFLNEGDAVKVIVVNIDTEKSRIALSIRQLEEDPLLETLDKVIPLEADQSPDRIMSPSEVELLPGLDGICNELLQEDGITDVQFGRQVLEKRVVSQDLELWLSNVPAKDNKFTLLARAGRQVQEVYLTSSLDQEGIKKAVQRVLGRVP

SEQ ID NO: 3679 - DNA, 1583 bp, Panicum virgatum
  misc_feature: Ceres CLONE 1792874
  misc_feature: Encodes the peptide sequence at SEQ ID NO. 3680
acagataggtagtgtagtggagcactgcactctgccgagccatcggccatgacgccgccaccagcgccagccatggccgcggagagcgacgctgtccacggcgggcggcgccggcacgtgctcctgttcccgctcccgtaccagggccacatcaaccccatgttccggctcgctggcctcctccacgcgcgcggcttctccgtcaccgtcttccacacccacttcaacgcgccggtcccggcgcgccacccgcagtaccgcttcgtccccgtccccgacggcacgtccggccctgcgcccgccgccatcgaggacgtcatcgcccagatcctcgcgctcggcgccgcgtgcgagtccgggttccgggaccgcctcgccgccgtcctggaggagtactcctgggacgccgtcgcgtgcctcattgccgacgcgcacctgctgccgatcttcgaggtgaccgcgaagctcgccgtgcccacgctggcgctgcgcaccggcagcgccgcctgctttgcgtgcttcctcgcgtacccgatgctcttcgagaaaggctacctccccgtgaaagagtcgcagcgtgacatgccggtgagcgagctgccaccgtaccgagtgcgtgacctgatggtgtttctcggcgacgacgaccgcggcagtttgcgcgagcttctggcccgcgccgtgacggccgtgaaggtctcctcgggcctcatactcaacacgttcgacgcgctcgagcggcgcgagctggagggcctccggcgggacctcgccgtgccggtgttcgacatcggcccgctccacaagttctccccggccggcgaaagcagcctgctgcgccaggaccggagctgcctggactggctggacgcgcggccgccggcgtcagcgctctacgtgagcttcggcaacctagcctgcatgagcccgcgggacctggtggagacggcgtggggcatcgccggcagcggcgtgccgttcctctgggtggtccggccgggcatggtccgcgggtcggcgcaccaagagcaagagctccccgaggggttcgaggccgcgacgcgcgggcgcgggatggtggtggcgtgggcgccgcaggaggaggtgctgcgccaccgcgccgtgggcggcttctggacgcacaacgggtggaactcgacgacggagagcgtgtgcgagggggtgccgatgctgtgccgcccctacttcggcgaccagatggggaacgcgaggtacgtggagcacgtgtggagggtgggtttcgaggtgggcggcgagctcgagaggggcgccgtcgaggcggcgatccgccggctgatgaccggcaaggacggcgcggagatgagggcgagggccggcgagctgaagaaggcggcggaggagtgcatcggcaagggcgggtcgtcgtgcctggccattgataagctgatcgcgcacatgacgtccctgtaaaattagcttcttgtccctctgtcatcatgcttgaggttttcgtgtctgaactctgcttgaggttttcgtgtctgaactcggtaatcagttgaaactcttttcggtatgatgaaaaaaaaaaaaaaaaaaaa

SEQ ID NO: 3680 - protein, 467 aa, Panicum virgatum
  misc_feature: Ceres CLONE 1792874
  misc_feature (1)..(162): Pfam Name: UDPGT Pfam Description: UDP-glucoronosyl and UDP-glucosyl transferase
MTPPPAPAMAAESDAVHGGRRRHVLLFPLPYQGHINPMFRLAGLLHARGFSVTVFHTHFNAPVPARHPQYRFVPVPDGTSGPAPAAIEDVIAQILALGAACESGFRDRLAAVLEEYSWDAVACLIADAHLLPIFEVTAKLAVPTLALRTGSAACFACFLAYPMLFEKGYLPVKESQRDMPVSELPPYRVRDLMVFLGDDDRGSLRELLARAVTAVKVSSGLILNTFDALERRELEGLRRDLAVPVFDIGPLHKFSPAGESSLLRQDRSCLDWLDARPPASALYVSFGNLACMSPRDLVETAWGIAGSGVPFLWVVRPGMVRGSAHQEQELPEGFEAATRGRGMVVAWAPQEEVLRHRAVGGFWTHNGWNSTTESVCEGVPMLCRPYFGDQMGNARYVEHVWRVGFEVGGELERGAVEAAIRRLMTGKDGAEMRARAGELKKAAEECIGKGGSSCLAIDKLIAHMTSL

SEQ ID NO: 3681 - DNA, 1207 bp, Panicum virgatum
  misc_feature: Ceres CLONE 1792879
  misc_feature: Encodes the peptide sequence at SEQ ID NO. 3682
agccttgtctgttgcctccatcccatcccgctgcgctgctccccagcacacgcctcctcgccttcgcctcccccgatctccagggcgctccgcggcggcggcggcggcggcggcagagatggcggctccggtggtggacgccgagtacctgcgccaggtcgacagggcgcgccgccagctccgcgccctcatctccaacaagggatgcgccccaatcatgctccgtctcgcatggcatgatgctggaacttatgatgtgaaaacaaaaactggtggcgcaaatggttcgattagatttgaggaagagtacacccatggttctaatgctggtttaaagattgctatcgatcttcttgagcctatcaaagccaagaacccaaagataacatacgcagacctttatcagcttgctggagtggttgcagttgaagtgactggtgggccaactattgagtttgttcctggcagacgcgactcatcagtgtgcccccgtgaagggcgtctaccagatgctaagaaaggtgcaccacatctgagggacatcttttatcggatgggcttaacagacaaagacattgttgctctatctggtggccacactctgggaaaggctcatcctgagaggtctggattcgaaggtgcctggacacaagagcctctaaagtttgataactcgtactttcttgagctgttgaagggggcatctgaggggcttctgcagctccctactgacaaggcacttctgtcggatcctgaatttaggcactatgttgagctttatgcaaaggatgaagatgccttcttcaaagactacgctgaatcccacaagaaactctcagagcttggctttgctcctcgcagcgcagcatctgcaaaatcagatcttccaaccggtgccgtgcttgcacagggtgcctttggggtagcagttgctgcggctgtagttgtcgctggctacttatacgaggcttccaggaaggccaagtagatggcaaagttctttgtcgcaccgcttcctcgcttagtaagtatgaagaccgaataacaggatcatagcaataaggaaccgcggcattgcccctgaaaatactttgaaattcttacgaacagaaacatcgccttcatgtttacattgtactcgtgaatatttcaatgagaatgatatggagatggcatggccagctagtaaaaaaaaaaaaaaaaaaaa

SEQ ID NO: 3682 - protein, 289 aa, Panicum virgatum
  misc_feature: Ceres CLONE 1792879
  misc_feature (1)..(208): Pfam Name: peroxidase Pfam Description: Peroxidase
  misc_feature (1)..(289): SWISSPROT Homolog: EC 1.11.1.11 L-ascorbate peroxidase 3, peroxisomal precursor
  misc_feature (6)..(289): SWISSPROT Homolog: EC 1.11.1.11 L-ascorbate peroxidase 5, peroxisomal precursor
MAAPVVDAEYLRQVDRARRQLRALISNKGCAPIMLRLAWHDAGTYDVKTKTGGANGSIRFEEEYTHGSNAGLKIAIDLLEPIKAKNPKITYADLYQLAGVVAVEVTGGPTIEFVPGRRDSSVCPREGRLPDAKKGAPHLRDIFYRMGLTDKDIVALSGGHTLGKAHPERSGFEGAWTQEPLKFDNSYFLELLKGASEGLLQLPTDKALLSDPEFRHYVELYAKDEDAFFKDYAESHKKLSELGFAPRSAASAKSDLPTGAVLAQGAFGVAVAAAVVVAGYLYEASRKAK

SEQ ID NO: 3683 - DNA, 1653 bp, Panicum virgatum
  misc_feature: Ceres CLONE 1792884
  misc_feature: Encodes the peptide sequence at SEQ ID NO. 3684
attctcaaaaaaatgcaaactgcgaaaagccgaacctatcctcccctctagtccttaccctgcgccggcggccggcggccggtggctccaagcactggctctcccaccgcagatttcccctccccctccacgctccgcgcaccttcatacccaagcaaggttgtaaggttgcgcgcgctccgtagcacgcacgctaggtgctcgagggattgccggaacccctcatcacctcgcgctccgccgtcgccgtcgccgtcgtcttcaccacagagctcgtattttgaatcagacttaagggggatgagttttgcggtgacgaaggtgtgcggtagtgaggcaaaagcgcgggcgggtgtgctgcaaattggcggcagcggcactggcatcgagacgccggcgctgctgctgtccacgcgcaaagggctgccgtcgttcgtgtcgtgcgacctcctagcctcactgcccctcccggactccctcctcctccatgtctgcccaacccactttatagagggccctccattgaaaacaatatcaaacattggcggtttgcaccgtatgctgggtttgcctgatcacattcttgtagccgcggcaggtgattctatcgagagtctgccatcaagtgaagccaccaataaattcggtgcctcctttgatacaccttctggccgtagactggtcaaaccatcagattatatggagttggtttcctgcatgaagcctaatgtatgggccagtttggcggatgaggtgcctgcttgggtaactgagaaacggaacaaaatctctgttgacaggacattgcggtggcttgatgcatgcattgctttggatacagcttccggagaaaatagttttggtgttgttgtaggaggatcaagcatagaacaacgaaggctatgtgccacagaagtatcaaagcggaatgtttcaggcttttggattggcggatttggccttggagagaataccgaagaacgctgcagtttactcaatgcagtaactgattgcttgccaccagaaaaacctcggcttgtgtctaagcttggtctcccagaggaggtcttggaaggtgtagctgctggtatcgacctctttgactccacgtacatataccaactaaccatgggtggttttgcactgatcttccctattgacatggttggaaaagagacacagaatggtccatttgacaatgatggtagagattcaacaaagattaacctgcatgcaacaacgtatcggaaagacacatcgcagctagttgatagctgtagctgcttcacctgccagaatcacactcgtgcttacctcaatcatttgctcaatgtccatgagatgctggctcaaattctactggagatacacaatacccatcattatcttcgttttttccgttccattcgggaggcaatcaaggttggagagttcaatctctttcggcagcagtttgttaagaagaggcatgcccatatcgccgctgctgtgctgtagacgtggtcaatggttcatctggttgccctcacaaaactgaccgatgttgcaatcatatttatgcacacctgaatctttactggtgaactctgatgtcaatcgttgacaaatctgaaaaggttgccttggaagtcggaaaaaaaaaaaaaaaaaaaa

SEQ ID NO: 3684 - protein, 398 aa, Panicum virgatum
  misc_feature: Ceres CLONE 1792884
  misc_feature (1)..(238): Pfam Name: TGT Pfam Description: Queuine tRNA-ribosyltransferase
MSFAVTKVCGSEAKARAGVLQIGGSGTGIETPALLLSTRKGLPSFVSCDLLASLPLPDSLLLHVCPTHFIEGPPLKTISNIGGLHRMLGLPDHILVAAAGDSIESLPSSEATNKFGASFDTPSGRRLVKPSDYMELVSCMKPNVWASLADEVPAWVTEKRNKISVDRTLRWLDACIALDTASGENSFGVVVGGSSIEQRRLCATEVSKRNVSGFWIGGFGLGENTEERCSLLNAVTDCLPPEKPRLVSKLGLPEEVLEGVAAGIDLFDSTYIYQLTMGGFALIFPIDMVGKETQNGPFDNDGRDSTKINLHATTYRKDTSQLVDSCSCFTCQNHTRAYLNHLLNVHEMLAQILLEIHNTHHYLRFFRSIREAIKVGEFNLFRQQFVKKRHAHIAAAVL

SEQ ID NO: 3685 - DNA, 1590 bp, Panicum virgatum
  misc_feature: Ceres CLONE 1792885
  misc_feature: Encodes the peptide sequence at SEQ ID NO. 3686
aaaccgcggggagccactgaataggtcggcggaaaggggaggcgacgccggcgacgacgaggagggcgacgaggcacaggcaaccgcggcgggcacaggcgcgcgcgcgcacgtacgcctcctttactctccccgagcgggagctcgcggccgccgggtggccggaggagtgcgtgtgtgaggagcaagggagtgcctcgaggtggcgggagcgggatcggggatggcggcaacggggaagggaggggcggcgcgggtcgccgccgccttcctcgtcctcctgcatctcttttcggcgatcgccgggaagagctactacgacgtgctgcaagtgcctaagggcgcgtcggaggatcagatcaagaggtcgtaccgcaagctcgccctcaagtaccaccccgacaagaaccccgataatgaagaggccaacaagcgcttcgcggagatcaacaacgcgtatgaggtgctcacggaccaggagaagaggaagatatatgaccggtatggcgaggaggggttgaaacagttccaaggccggggaggtggcggtggtgggatgaacattcaggacatctttagcagcttttttggtggtggtggtggaacggaagaggaggaagaacagatcctaaaaggtgacgaagtggttgttgagctggaggcttcactagaggatttgtacatgggtggttccttaaaggtttggagagagaaaaatgtcataaaaccagcaccaggaaagaggaaatgcaactgtaggaacgaagtttaccatcgacaaattggtcctggaatgtatcaacagatgactgagcaggtctgcgatcaatgtccaaatgtgaaatttgtacgagaaggtgaatttttgactgttgatattgagaagggaatgcaagatggacaggaggttttatttttcgaggaaggtgaacctaagattgatggtgaacctggtgatttgaagtttaggatccgaacagcaccacatgggcgcttcagaagagaaggcaatgacctgcatgcaacagttacaatttccctgctgcaatctctggttggtttcgagaagactatcaagcatcttgacaaccatctcgtggaaatcggcaccaagggtatcactaagcctaaggagataaggaaattcaaaggcgaaggcatgccgctgtaccaaagcaacaagaaaggcgacctgtacgtcacattcgaggtggtgttcccgaaaacgctaactgacgaccagaaggcaaagctgaaggacattctggtgtagaccatttttgcgctcgtatgctacagatagttcgggggcggttgcctcacgaaaattttccatgtagcttgcacagaaaggagcgggcagctgtgtttctgggtgtgattttgcgttgctaatgccagcggctcagttttcgtttctctttcccttgttttgccatgtccttaatagctcagcgtagttttagaaagtgcaacaaaagtgtaccagagtatttgtacccttttgaattcagaatacattgattacaaaactgtactagcgtataaaaaattccgaaatccttattctaaaaaaaaaaaaaaaaaaaa

SEQ ID NO: 3686 - protein, 349 aa, Panicum virgatum
  misc_feature: Ceres CLONE 1792885
  misc_feature (1)..(63): Pfam Name: DnaJ Pfam Description: DnaJ domain
  misc_feature (1)..(122): Pfam Name: DnaJ_C Pfam Description: DnaJ C terminal region
MAATGKGGAARVAAAFLVLLHLFSAIAGKSYYDVLQVPKGASEDQIKRSYRKLALKYHPDKNPDNEEANKRFAEINNAYEVLTDQEKRKIYDRYGEEGLKQFQGRGGGGGGMNIQDIFSSFFGGGGGTEEEEEQILKGDEVVVELEASLEDLYMGGSLKVWREKNVIKPAPGKRKCNCRNEVYHRQIGPGMYQQMTEQVCDQCPNVKFVREGEFLTVDIEKGMQDGQEVLFFEEGEPKIDGEPGDLKFRIRTAPHGRFRREGNDLHATVTISLLQSLVGFEKTIKHLDNHLVEIGTKGITKPKEIRKFKGEGMPLYQSNKKGDLYVTFEVVFPKTLTDDQKAKLKDILV

SEQ ID NO: 3687 - DNA, 1838 bp, Panicum virgatum
  misc_feature: Ceres CLONE 1792898
  misc_feature: Encodes the peptide sequence at SEQ ID NO. 3688
actcggatcagcggggactggaggcgggccggccatggaggagggaggcgagcgcacgagccttctgatcaaggatgatgcatcatgccatggagatgaatcacagaatctattggaaacaaggcaagggtcacagcttaaaagtaaacgctcggactggagagcaccggcactcattctgggattggaatgcttggagagcatggctttcaatggaattgcgacaaacctagtcgtgtatatccgctcagttctccatggtggtattgcttccagtgcatcaaccgtatctctttggtttggaacaagtttctttgtgccaatacttggagctgccatagcagatacttacttgggaaattacaagaccattttaatctcacttatcatgtacctacttggcatggtactcattacagttgcagcatttatgccttctacttcagtctcgtgtgatatgagctcatcatgcctttcgtcagatggaactcaaaatctgattttctttgttgcgttgtatctcactgctgttggatgtggaggagtaagatctgcattgcttccatttggtgcagaccaattcaacaatgaccacagtttagatattaagaggagaaggaatttcttcagttcattctatatatgtgtcatcttcggtgtgattacttcagggactgttatagtctgggttcaggaaaatgttagctgggctataggatatggaattgccacgacatgcataggccttgctttgataggatttctggtgggaacacctatattccgacaacatgtgccttgtggttctccggtgaagagtattttcaaggttattgttgccacttttagaaacatgagcttggaagttcctgatgatagctctcttctgtatgaggtcaggagcaaccacacacaaaggataaaactagcccactctgatgattttagattcttagacaaggcagcagttatttctgatctgagcttggcctatggaaatcgtcaaagttcatggagtctatgcacggttactgaagttgaggaactgaaaatactaatccgcttactcccaatatgggtgactggaatattttttggtgccgcaatctctcaaatgcacaccaccttcattcagcagggaactgtgatgaacaccaagattggctccctgaccattccaccggcatccttgtactcatttgaagtgatatgcgtcacactctgggtacttgttgtgaacaaagtgattgtaccagcaacccgaatgtactttgcaaatggcctagagctcacacagttacaacggatcgggataggtcgtttcctgatgatttttgccatggcaatggctgcacttctagaaacaaagagactacagagtgttcgggaagcagagccgctaagcattgcatggcagcttccacagtactttattattgctgggtccgagtgcttcgctgtcatcactcagttggaattcttccatggtcaggcgccagactccatgaagagcatgttgacggcattcgcgttgctcaccactgctctcggtaattacttgagctcagccatcatcaccttcattgctggggtgacagttgtatggcaaagcccgggatggataccggatgatctgaatagaggtcacctggactactattattggtgttttgcagccctctctttggcgaattttgttgtgtatgtgtattttgccagtaaatacaaactgaagaaagttgttattagctaacatcacctgttatatcactagatgtaatatatggaaatgtttatatttattctttgtgtatagccaaaaaaaaaaaaaaaaaaaa

SEQ ID NO: 3688 - protein, 572 aa, Panicum virgatum
  misc_feature: Ceres CLONE 1792898
  misc_feature: Great-hit functional homolog of the protein sequence given in SEQ ID NO 9443
  misc_feature: Useful for making plants with modulated nitrogen use efficiency
MEEGGERTSLLIKDDASCHGDESQNLLETRQGSQLKSKRSDWRAPALILGLECLESMAFNGIATNLVVYIRSVLHGGIASSASTVSLWFGTSFFVPILGAAIADTYLGNYKTILISLIMYLLGMVLITVAAFMPSTSVSCDMSSSCLSSDGTQNLIFFVALYLTAVGCGGVRSALLPFGADQFNNDHSLDIKRRRNFFSSFYICVIFGVITSGTVIVWVQENVSWAIGYGIATTCIGLALIGFLVGTPIFRQHVPCGSPVKSIFKVIVATFRNMSLEVPDDSSLLYEVRSNHTQRIKLAHSDDFRFLDKAAVISDLSLAYGNRQSSWSLCTVTEVEELKILIRLLPIWVTGIFFGAAISQMHTTFIQQGTVMNTKIGSLTIPPASLYSFEVICVTLWVLVVNKVIVPATRMYFANGLELTQLQRIGIGRFLMIFAMAMAALLETKRLQSVREAEPLSIAWQLPQYFIIAGSECFAVITQLEFFHGQAPDSMKSMLTAFALLTTALGNYLSSAIITFIAGVTVVWQSPGWIPDDLNRGHLDYYYWCFAALSLANFVVYVYFASKYKLKKVVIS

SEQ ID NO: 3689 - DNA, 2020 bp, Panicum virgatum
  misc_feature: Ceres CLONE 1792902
  misc_feature: Encodes the peptide sequence at SEQ ID NO. 3690
gtcactctcggcactgctcccagctgttgcgacctccgaacatccaaggctcctgcacccctgtcagtcctagctccagccaaaaatcgttggctcccgctgcctgctcctccgccttgcacctcccatgaccttccacgcgacatgattgcattgcaggcccctgcggagctcagctgtcctcccacgccgctgacgccttcttgttgcctccacgctgctgcgctcaaccgaaagggccttcctctctttgcttccgcggaaggatttggcgatttattcatctactaaagttgcatctctcttgtgcgtggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattaaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtggggctggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcaacgccctccgctaaagtagcgccaatacctgtgaggagaaaatccgtcacgccaaagaatgggctttcacatgtggatgacgatgcgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtaaaaaaaaaaaaaaaaaaa

SEQ ID NO: 3690 - protein, 471 aa, Panicum virgatum
  misc_feature: Ceres CLONE 1792902
  misc_feature: Great-hit functional homolog of the protein sequence given in SEQ ID NO 9196
  misc_feature: Useful for making plants with modulated oxidative stress sensitivity
MGKKGKWFGAVKKVFSPESKEKKEERQRRKSAASNPTPLDLTPSTSLEVNVSVPPPPAPPALHQIKEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 3691 - DNA, 1313 bp, Panicum virgatum
  misc_feature: Ceres CLONE 1792915
  misc_feature: Encodes the peptide sequence at SEQ ID NO. 3692
aggggaggcggaggcagcagcaactactaccaccagtagtaatctaatcccctcttctcccgcttggcctcttctcccgcagtgccgtctgcagcggcctccaaagcatcgcatccaacgaccaacccgcttccaacaaagacgccaccaacagcgacaaggcagcagcagacatggtagggatggggggagtgcatcggccaaaggaggaggaggaggaggagaacgggaggaagccggcgccggtggtcctcctcaggctgttcggcgtggatgtcgtcgccgacgaggagccggatgacaacgacatcgggctcaggaagaattcgagcatgcccaacctcgccaacccgctcctgccgcacggggaggccggcgagcgcaaggggtacgcctccgatgatctcgagctggcctccaggcaccagaagcgccgccgccgcaaggcccaggagaggaagaaagggattccgtggaccgaggaggagcacaggaagttcctggacggcctgaggcagctgggcaaggggtactggaggggcatctccaagagcttcgtgatcaccaggacggcgacgcaggtggccagccacgcccagaagtacttcctccgccagaccaaccccggcaagaagaagcgccgggccagcctcttcgacgtcggcatcgccgacttcggtgaccatcaggtgccgccaagccctccaaacagtgccactaagcctgctcctgctcaggagataattcataccgaccgcggcgatgtcccgctaccaagctgtaggggctttggagagattttaggcaataacattcaggttagcgaactgactaattacttcatgacaacaatgggtcacgtcgagacgtcgctcgcgtccatgtcctccggcctggaaccagcctcgtccgtcagcagcctggagctcagcatcgccgtcaacaatctggagctcagcatcgcgcctcctgctcgctgcggctgcggtggcgctgccggggcaatcaaagtgctgtgactcgagacgcgccggggctgcttgggctcagctgccgcgatctctgtttcagctgcacacaggcacctcctgcctgttcgatcttgctgttgttgttgttgtgttgttgttgtgttgttgttgtctttgttgtgctaataacttggtgttcttcgccgatggcgtgccggttttctttagtttcatgtaatcctagtactactacaggaaggaagtttgtgctggttggttggtagaagctgttgaacagaaatcagattttactatttgttgcaaaaaaaaaaaaaaaaaaaa

SEQ ID NO: 3692 - protein, 281 aa, Panicum virgatum
  misc_feature: Ceres CLONE 1792915
  misc_feature (1)..(48): Pfam Name: Myb_DNA-binding Pfam Description: Myb-like DNA-binding domain
MVGMGGVHRPKEEEEEENGRKPAPVVLLRLFGVDVVADEEPDDNDIGLRKNSSMPNLANPLLPHGEAGERKGYASDDLELASRHQKRRRRKAQERKKGIPWTEEEHRKFLDGLRQLGKGYWRGISKSFVITRTATQVASHAQKYFLRQTNPGKKKRRASLFDVGIADFGDHQVPPSPPNSATKPAPAQEIIHTDRGDVPLPSCRGFGEILGNNIQVSELTNYFMTTMGHVETSLASMSSGLEPASSVSSLELSIAVNNLELSIAPPARCGCGGAAGAIKVL

SEQ ID NO: 3693 - DNA, 2720 bp, Panicum virgatum
  misc_feature: Ceres CLONE 1792925
  misc_feature: Encodes the peptide sequence at SEQ ID NO. 3694
gaatgaattccagccacacgcgcccggccatggccttccccacctccgtggtcacccacacggtcacactcgccgccctccccacccctatcgccacatcccgccagcatcaccccatcacctctcccgccggccgcagcgcaccactactcctataggaacctcccagcccagggctgtctcctcactctccccctccgggcactccccgaccgaatcccccgccatcctccgggcacactgccgccgccactactgttagcttgcagctcaagctcggcactcgcatttgggtcggttctcgaggaaatcgagcgccgccattgggagaagctgctgctgcggtcctgagcaggaggagcaatggcgctgtcgacgttctctgttccgcgcggattcctcggcgtgccggctcaggactcccatttcgctccggcggccgagctccatgcgcacaagcaacttcaggccaggcctgctgtcaagggccagggtcggcggaggtcggcgtgcgtgtcggcgtcgctgtcggagcgcgagcgcgaggcggagtactactcgcagcggccgccaacgccgctgctggacaccatcaactacccggtccacatgaagaacctgtcggtgaaggagctccggcagctcgccgacgagctccgctccgacgtcatcttccacgtctccaagaccggcggccacctcgggtccagcctcggcgttgtggagctcaccgtcgcgctgcactacgtcttcaacgcgccgcaggaccgcatcctctgggacgtcggccaccagtcgtacccgcacaaaatcctgacggggcggcgcgacaagatgccgacgatgcggcagaccggcgggctggcggggttcacgaagcgcgccgagagcgagtacgactgcttcggcacggggcacagctccaccaccatctcggcggcgctgggcatggcggtggggcgggacctcaagggcggcaagaacaacgtggtggcggtgatcggcgacggcgccatgacggcggggcaggcgtacgaggccatgaacaacgccggctacctcgactccgacatggtcgtcatcctcaacgacaacaagcaggtctccctgccgacggcgacgctcgacgggcccgtgccgcccgtcggcgcgctcagcagcgcgctcagcaagctgcagtccagccgcccgctcagggagctccgggaggtggccaagggcgtgacgaagcagatcggcgggtcggtgcacgagctggcggcgaaggtggacgagtacgcccgcggcatgatcagcggccccggctccacgctcttcgaggagctcggcctctactacatcggccccgtcgacggccacaacatcgacgacctcatctccatcctcaacgacgtcaagagcaccaacaccaccggccccgtcctcgtccacgtcgtcaccgagaagggccgcggctacccctacgccgagcgcgccgccgacaagtaccacggcgtcgccaagttcgacccggcgacggggaagcagttcaagtcgccggccaagacgctgtcctacaccaactacttcgccgaggcgctcatcgccgaggccgagcaggacagcaggatcgtcgccatccacgccgccatgggcggcggcacggggctcaactacttcctccgccgcttccccacccgctgcttcgacgtcgggatcgccgagcagcacgccgtcacgttcgcggccggcctcgcctgcgaggggctcaagcccttctgcgccatctactcgtccttcctgcagcgcggctacgaccaggtggtgcacgacgtcgacctccagaagctcccggtgaggttcgccatggacagggccgggctggtcggcgcggacgggccgacccactgcggcgcgttcgacgtcacgtacatggcgtgcctgcccaacatggtcgtcatggccccgtccgacgaggccgagctctgccacatggtcgccaccgccgcggccatcgacgaccgcccgtcctgcttccggtacccgagaggcaacggcatcggcgtcccgttgccgcccaactacaaaggcacccccctcgaggtcggtaagggcaggatcctgctggagggcgaccgggtggcgctgctggggtacgggtcggcggtgcagtactgcctggcggcggcggccctggtggagcgccatggcctcaaggtcaccgtcgccgacgccaggttctgcaagccgctggaccacgccctgatcaggagcctcgccaagtcccacgaggtgctcatcaccgtggaggaaggctccatcggagggttcggctcgcacgtcgcccagttcatggccctggacggccttctggacggcaaactcaagtggcggcctctggtgcttccggacaggtacatcgaccacgggtcgccggccgatcagctggccgaggccgggctgacgccgtcgcacatcgccgcgacggtgttcaacgtcctggggcagaacagggaggccctggccatcatggcagtgccgaacgcgtaggattcgcggcgatcccggcctatagagatgtgctttgtacatttggttgttagatgtcagcagggagattagtctgctttggatgaaaatgccgcggggaacgagtcaacgatgacagttttttgctgcttattctgatgatatattgaagtacagaaatgttcttgcggcaaaaaaaaaaaaaaaaaaaa

SEQ ID NO: 3694 - protein, 721 aa, Panicum virgatum
  misc_feature: Ceres CLONE 1792925
  misc_feature (1)..(168): Pfam Name: Transket_pyr Pfam Description: Transketolase, pyrimidine binding domain
  misc_feature (53)..(712): SWISSPROT Homolog: EC 2.2.1.7 1-deoxy-D-xylulose-5-phosphate synthase
  misc_feature (68)..(719): SWISSPROT Homolog: EC 2.2.1.7 1-deoxy-D-xylulose-5-phosphate synthase
MALSTFSVPRGFLGVPAQDSHFAPAAELHAHKQLQARPAVKGQGRRRSACVSASLSEREREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTGGLAGFTKRAESEYDCFGTGHSSTTISAALGMAVGRDLKGGKNNVVAVIGDGAMTAGQAYEAMNNAGYLDSDMVVILNDNKQVSLPTATLDGPVPPVGALSSALSKLQSSRPLRELREVAKGVTKQIGGSVHELAAKVDEYARGMISGPGSTLFEELGLYYIGPVDGHNIDDLISILNDVKSTNTTGPVLVHVVTEKGRGYPYAERAADKYHGVAKFDPATGKQFKSPAKTLSYTNYFAEALIAEAEQDSRIVAIHAAMGGGTGLNYFLRRFPTRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGTPLEVGKGRILLEGDRVALLGYGSAVQYCLAAAALVERHGLKVTVADARFCKPLDHALIRSLAKSHEVLITVEEGSIGGFGSHVAQFMALDGLLDGKLKWRPLVLPDRYIDHGSPADQLAEAGLTPSHIAATVFNVLGQNREALAIMAVPNA

SEQ ID NO: 3695 - DNA, 2217 bp, Panicum virgatum
  misc_feature: Ceres CLONE 1792927
  misc_feature: Encodes the peptide sequence at SEQ ID NO. 3696
tccagaccgagagagagagagagagagagagagaggagcagcagcgtcgtgacgcccaaatcgccgattcgatcgagacccctcgcccctactcgctgaatcggaggccgagcccgccaattgggcgcccccccgcccacgcagaggacaaagggaagaacaacattggcgtgctgagaaatccaactgcacttttttttggaccacagatgaagcgaactcgaaggcgtatgtgggagggatgactgatgagggatgctagtgacattgatgaacttgttgcgggcgtgctggcgaccgtcatcgaaccggcatgcccgaacaggctcagatgctgccggtaggcaggatggacttctatggtacaaggataccgggcagcatgtcaatggagaattctccatagctgttgtccaagccaataacttacttgaggaccagtgtcagattgagtcgggtccattgagctttctagattctggaccatacggcactttcgttggcgtttacgatggacatggtggtccagagacagcttgctacatcaacgatcatctcttccagaatctgaaaaggtttgcatctgagcagaattcaatgtctgctgatgtcctgaagaaagcatatgaagctacagaagatggattcttctctgttgttaccaaacagtggcctataaagcctcagatagcggctgtgggctcatgctgccttgtcggtgtaatttgtggtggcatgctttatgttgccaacgttggggattcccgtgttgttttaggaagacatgttaaggccactggagaagttttggctgtccaactgtcagcagagcataacgtaagtattgagtcagtgagaaaggaactgcagtcaatgcacccggatgataggcatattgttgttctcaagcacaatgtttggcgtgtaaaaggactaattcaggtctgcagatcaatcggtgatgcttatttgaaaaagcaagagttcaacagggaacctctatatgcaaaatttcgcctccgcgaaccttttcacaagcctatactaagttcggaaccgtcaatcagtgtgcaaccactacaaccacatgatcagtttctcatatttgcatctgatggtctttgggagcacttaaccaaccaagaggctgttgatattgtttgcagtagccctcgcaatggctgcgctaggaagttgataagagcggcactgcaagcagcagccaagaaaagagagatgaggtactcggacctcaagaagattgatcggagtgttcgccgccacttccacgacgacataacagtcatagtagtgttccttgactccagcctcgtaagtagggcaagcacgaaccgaggtcccgctctttccctgcgaggcgggggggccagcatgcgcagcaacacgctcacaccaacgtaactagaggggcggagatgacgcacctttctgaagaaggttatttttccatgtgtttaatgtgttatgtatgtatcggccaagaccacacatcccctcaacgttgtaaagaaataggagacgcagataagctcctatcccggtgtcccttaattgacagtaatgtatgtgtcaaggttggttcaattcaaaaaaaaaaaaaaaatctcttctctcttctctcaatctttccatcgttctcatcccttctctcctctctcgagcagggagcggaccggcgcatggcgctccccggccggccggccgcggcatggcgccggcggaggcgcgcgggccggtgcggccgggccccggcggcggaggcgcgccggtgtgtgcggcccggacccggcggcggagccgcgcaggcagcacggccaggccacggcggcggagcgcggctctggcgttggaggcacgtggccatgtccgtcgcatgctgcgcatggcgcgacgccgccgtcaccaggaggtccaggccccgtcgcccccgctctcccgtggctcctcctcccgacaggccacccggacggctccgcccgcgtcgcctgtgccttttgcggcagccgcgtcgtccgcgccgcaggctcaccatcgcaccgcccggggcgggcgcggccaggccgtggcaagccaagatttttttttcatttccagatgtgtaggtcaatgttgaatcctttctcagggaatctggtgttgtataatttttcttataattttagatctttataatctcaaaaaaaaaaaaaaaaaaaa

SEQ ID NO: 3696 - protein, 388 aa, Panicum virgatum
  misc_feature: Ceres CLONE 1792927
  misc_feature (1)..(279): Pfam Name: PP2C Pfam Description: Protein phosphatase 2C
MLVTLMNLLRACWRPSSNRHARTGSDAAGRQDGLLWYKDTGQHVNGEFSIAVVQANNLLEDQCQIESGPLSFLDSGPYGTFVGVYDGHGGPETACYINDHLFQNLKRFASEQNSMSADVLKKAYEATEDGFFSVVTKQWPIKPQIAAVGSCCLVGVICGGMLYVANVGDSRVVLGRHVKATGEVLAVQLSAEHNVSIESVRKELQSMHPDDRHIVVLKHNVWRVKGLIQVCRSIGDAYLKKQEFNREPLYAKFRLREPFHKPILSSEPSISVQPLQPHDQFLIFASDGLWEHLTNQEAVDIVCSSPRNGCARKLIRAALQAAAKKREMRYSDLKKIDRSVRRHFHDDITVIVVFLDSSLVSRASTNRGPALSLRGGGASMRSNTLTPT

SEQ ID NO: 3697 - DNA, 1756 bp, Panicum virgatum
  misc_feature: Ceres CLONE 1792937
  misc_feature: Encodes the peptide sequence at SEQ ID NO. 3698
gtttttctctctcctgcgccgcgccgtccctcatctccgccgccgaatccgaggctccgatctcgggttcaccgcagcgcaccaagcacccccggctcgatctgctactcctcctccgcgcttcagtcatgtcgggaatggcacctgagggttcccagtttgatgctaagcactacgattctaaaatgcaggagctgctgagcactggtgagactgaggaattcttcacttcctatgatgaagtgtttgagagttttgatgacatgggcctccaagagaatcttttgagaggcatttatgcttatggttttgagaagccttctgctattcagcagagaggaattgtgcctttctgcaagggccttgatgtcattcagcaagcacagtctggtacaggaaagacagcaactttctgttctgggatcttgcagcagcttgactacggcctggttgaatgccaggccttagtccttgcccccacccgtgagcttgctcagcaaattgagaaggtcatgcgtgcgcttggtgactaccttggtgtgaaagttcatgcatgtgttggaggaacctctgtccgtgaggaccaaaggattcttgctagtggtgtgcatgttgttgttgggacacctggtcgtgtgtttgacatgttgcgtaggcagtctctccgacctgatcacatcaagatgtttgtcctggatgaagcagatgagatgctttctcgtggtttcaaggatcagatttatgacatcttccagcttctcccagcaaagattcaggttggagtcttctctgctaccatgccccctgaggctcttgagattacccgcaagttcatgaacaagcctgtgagaatcctcgtcaagagagatgagctcacccttgagggtatcaagcagttctatgtgaatgtggagaaggaagattggaaactggacacactatgtgatctgtatgagaccctggccatcacccagagtgtcatcttcgtcaacacccgccgcaaggtggactggctcactgacaagatgaggagcagggaccatactgtttctgccactcatggtgatatggaccagaacactagggacatcatcatgagggagttccggtctggttcatcccgtgtgctcatcaccaccgacctgcttgcccgtggtattgatgttcagcaggtgtccctggtcatcaactacgatctccctacccagccagagaactacctgcatcgcattggtcgtagtggtcgtttcggtaggaagggtgttgccatcaactttgtcactcgtgacgacgagcggatgctgtttgacatccagaggttctacaatgtgctgattgaggagctgcctgccaatgttgctgaccttctgtgatcaagttgatgaaaaacagcaaaacaaaaaattcggtaagggggacctgataaggcttgtttttgttgaaatattgccacatgtggggagggggtgatatggtcggtggcgtttctagtcgtggtcatggtctcatggacaatttgtgatttttccttatgccatgttttggtaatttttgtagctgcctaggccttgtggtatgtgctgctggggggggggggggggtcattagtatggagagggagacgctgctggagtctttttcgatttagtcttttgtttaaaactatgtatgaccctatgatggtattatttgtgtcatccttgacttatattctgccataactgcatgtatcctgcaaaaaaaaaaaaaaaaaaaa

SEQ ID NO: 3698 - protein, 414 aa, Panicum virgatum
  misc_feature: Ceres CLONE 1792937
  misc_feature: Great-hit functional homolog of the protein sequence given in SEQ ID NO 9452
  misc_feature: Great-hit functional homolog of the protein sequence given in SEQ ID NO 9577
  misc_feature (1)..(77): Pfam Name: Helicase_C Pfam Description: Helicase conserved C-terminal domain
  misc_feature (1)..(167): Pfam Name: DEAD Pfam Description: DEAD/DEAH box helicase
  misc_feature: Useful for making plants with altered Lignin content
  misc_feature: Useful for making plants with altered alkaloid content
  misc_feature: Useful for making plants with altered terpenoid content
MSGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVLIEELPANVADLL

SEQ ID NO: 3699 - DNA, 1838 bp, Panicum virgatum
  misc_feature: Ceres CLONE 1792940
  misc_feature: Encodes the peptide sequence at SEQ ID NO. 3700
gcaccgacaattccggctccgatccagttcttcggaaacgggtcctggaaccggaatggcgcggcgggtcctctccgcgctgcttctcgcagccctggcgtgcgacgtcgcgtccgccgagttcggcaggcacagcttccccgagggcttcgtcttcggcaccggctccgcggcgtaccagtacgagggtgcctacaaggaaggaggcaaaggtcccagcgtgtgggacatcttcagtcacttaccaggtaaaatcaagaacaatgatactggcgatgtagcggatgacttctaccatcgatacaaggaggacgtgaagctcctcaaggacatgaacatggatgccttccggttctcaattgcctggaccaggatcctgccaactggctccctgagcggaggaatcaacaaggaaggggtggccttctacaacaacctcatcaacgaggtcatagcaaatgggctgaagccattcgtcaccatcttccactgggacacaccccaggccctcgagagcaagtataagggcttcctcagcgagaacatcatccaggactacgtggacttcgcggaggtgtgcttccgcgagttcggcgaccgcgtcaagttctggaccacgttcaacgagccctggacgtacgcgtcgcaggggtacggcaacggcgcccacgcccccggccggtgctcgccgtccatctccccgtcctgcacccccggcgactccggccacgagccctacctcgtgacgcaccacatcctcctcgcccacgccagggccgtggcgctgtaccgcgcccggtaccagccagcgcagcgcggccagatcggcatcaccgtggtctcgcactggttcgtgcccaacaccgacacccccgccgaccgccgggccgtgcagcgcagcctggacttcatgctcggctggttcctgagccccatcgtgcacggcgcgtacccgggcaccatgaccagcttcctcggcggccggctgccgcggttcacgccggagcaggcggagatggtcaggggctcctacgacttcatcggcctcaactactacaccagctacttcacctcggcgcggcccgcgcccaacgggctcgcgcagtcctacgaaggcgacatccgcgccaacacctccggcttccgcgacggcgtgcccgtcggccagccggagttcgtgcccatcttcttcaactccccggccggcctccgcgagctcctgctctacaccaagcgccggtacaacaaccccgtcatctacgtcaccgagaacggcattgccgaggagaacagcgcacgcatcccgctcagggaggcgctcaaggacgggcaccggatcgagttccactccaggcacctgcagttcgtgaaccacgccatcaggaacggcgtcaaggtaaagggttacttcacctggaccttcatggactgcttcgaatggggcgacgggtacctcgaccgcttcggcctcatcttcatcgaccgcctcaacgggctcaagcgctaccgcaagcagtccagctactggatcgagaagttcctgaagcgctagacggtttaatttgcagcccacactgctggtcacgaggtccatccatgtcgatctcatcctgtttcgatcgacaagctggtggtggtgccatgatgccgttgctgctgccatggcatcttctagctagtttgctgccgaggggccggggtgtatttgtttccagagagcgattgctgttttgtgggtcggggttgccgctgtcgttgcattgtgtgtgcttggtgcttgcagagagggaaataaagctcacttcggagctatctgtcaaaaaaaaaaaaaaaaaaaa

SEQ ID NO: 3700 - protein, 498 aa, Panicum virgatum
  misc_feature: Ceres CLONE 1792940
  misc_feature: Great-hit functional homolog of the protein sequence encoded by LOCUS At2g44480
  misc_feature: Great-hit functional homolog of the protein sequence given in SEQ ID NO 9260
  misc_feature: Great-hit functional homolog of the protein sequence given in SEQ ID NO 9651
  misc_feature (1)..(470): Pfam Name: Glyco_hydro_1 Pfam Description: Glycosyl hydrolase family 1
  misc_feature: Useful for making plants with altered cell wall content and/or composition
  misc_feature: Useful for making plants with altered oil content
  misc_feature: Useful for making plants with modulated biomass
  misc_feature: The plant is abnormally small.
MARRVLSALLLAALACDVASAEFGRHSFPEGFVFGTGSAAYQYEGAYKEGGKGPSVWDIFSHLPGKIKNNDTGDVADDFYHRYKEDVKLLKDMNMDAFRFSIAWTRILPTGSLSGGINKEGVAFYNNLINEVIANGLKPFVTIFHWDTPQALESKYKGFLSENIIQDYVDFAEVCFREFGDRVKFWTTFNEPWTYASQGYGNGAHAPGRCSPSISPSCTPGDSGHEPYLVTHHILLAHARAVALYRARYQPAQRGQIGITVVSHWFVPNTDTPADRRAVQRSLDFMLGWFLSPIVHGAYPGTMTSFLGGRLPRFTPEQAEMVRGSYDFIGLNYYTSYFTSARPAPNGLAQSYEGDIRANTSGFRDGVPVGQPEFVPIFFNSPAGLRELLLYTKRRYNNPVIYVTENGIAEENSARIPLREALKDGHRIEFHSRHLQFVNHAIRNGVKVKGYFTWTFMDCFEWGDGYLDRFGLIFIDRLNGLKRYRKQSSYWIEKFLKR

SEQ ID NO: 3701 - DNA, 2279 bp, Panicum virgatum
  misc_feature: Ceres CLONE 1792941
  misc_feature: Encodes the peptide sequence at SEQ ID NO. 3702
acgattctgactgagccgctacgaaatcagccaatgcagcaccgccacgcttcccctccccgccctcggagccccgcgtccgccgcgccgctgctggtataatagccccctcgccgcgcaaccgcacgagctcgcccgagcaaaccgccgccgctgcccgccgttaccctcgccgctcgctcccctctgcaaagcccatagacaagttgatctcatgagttcaggaagaacagtagcatccaaagtttcctgttcagcgggaaacagtggcagcttccctccctgcctccttccagggtttctagggttcccagttgttttcgtaaacttccacttgttcaaggccattgttcgcagccctgcatcttccgttgtcttgggaatctgtggagggagcctcccttagacagttgccctataaggcatcattctggttaatctgggaattcgttgtagggagctgccctagctaaatcgtggcccaagacttcttaggtcacgaaacttctgaatctgataagctctagaagatggtttcttctgagataacctctgttacagcagctcgtgcacagggccccaagctcttcagagggaagatacttctgccaggggggccaccagatgttgttccttctgaaaatgtcgagtttgatttttctgatgttttcggacctactgcggtccatactcctacagaagtgaatattctcactccagacagtccagcacctgtggttgagtccagcgatgaggtttacaatgaccctgatgtcattgtcaagcgatctcattctcttgttggtccatcatctcttgttagccaatctttgccatttagcaagcttgcactacatgagactgagagctcattggaactttcagagtgctcttccaaagaaaagcaaatttgtcatgtgtcccttagtgacgatgagcttgaagatgtcaaaaaggagaatgagggtgttgggcttgatgatttcgaagtcttgaagcttgttggccaaggtgcatttggcaaagtctatcaggtgagaaagaaaggtacttcagaaatatatgcaatgaaagttatgaggaaggacaaggttgtggagaagaatcatgccgagtacatgaaagctgagagagatatactgacaaaagttgaccatccttttgtagtgcagctgaggtactcgtttcagactaagtaccgactttaccttgtcctcgacttcattaatgggggtcatctcttcttccagctttaccaacagggtttatttagggaggagcttgcacgcatctatactgctgaaattgtatctgccgtagcccacctccatgccaatggtattatgcatagagatttgaagcctgagaacatcttactcgatgctgatggtcatgccatgctgaccgactttggcgtggcaaaggaatttgatgaaaacactagatcaaactctatgtgtggtactgttgagtacatggccccagaaattgttcagggccggggtcatgataaggctgctgactggtggagtgtgggcatccttctttttgaaatgcttacgggcaagccaccgtttgttggtggaaacagagacaagattcagcagaagatagtgaaggagaagataaagctgccgacatatctatcgagtgaagttcactctctgttgaaaggattactgcacaaagaagctggcagacggctgggaagcgggccaggtggcagtgatgaaataaagaaccacaagtggttcaagtcaatcaactggaagaggctggaggcccggcagatccaaccaagcttccgcccaaatgttgctggcaagacctgcatcgcgaacttcgacgagtgctggacgagcatgcccgtcctggactctccagtggccagcccagtcgcagccaacagcaacttcgtagggttcagttatgtgaggcctgccccgttcctgcaaaagccaagtcctcttggctgaggagctacttccgttatcagagaggatagatcctggagttggaatatttattttttttgaacatggagttggaatatttatcttgaggtacctgcgggtacgagtttgcatgtagatttatatttctgggattttgtggaaaacactttgttctagacattagtgatgtatgtgtaaccttattgttgtgttatgctcgaggacaactgctgggcaagtgaccttgtgtaataattaccaaaatttcttactgaagtgtcataattatttgcagcagatgtacaaaaaaaaaaaaaaaaaaaa

SEQ ID NO: 3702 - protein, 481 aa, Panicum virgatum
  misc_feature: Ceres CLONE 1792941
  misc_feature (1)..(476): SWISSPROT Homolog: EC 2.7.11.1 Serine/threonine-protein kinase AtPK19
  misc_feature (30)..(476): SWISSPROT Homolog: EC 2.7.11.1 Serine/threonine-protein kinase AtPK1/AtPK6
MVSSEITSVTAARAQGPKLFRGKILLPGGPPDVVPSENVEFDFSDVFGPTAVHTPTEVNILTPDSPAPVVESSDEVYNDPDVIVKRSHSLVGPSSLVSQSLPFSKLALHETESSLELSECSSKEKQICHVSLSDDELEDVKKENEGVGLDDFEVLKLVGQGAFGKVYQVRKKGTSEIYAMKVMRKDKVVEKNHAEYMKAERDILTKVDHPFVVQLRYSFQTKYRLYLVLDFINGGHLFFQLYQQGLFREELARIYTAEIVSAVAHLHANGIMHRDLKPENILLDADGHAMLTDFGVAKEFDENTRSNSMCGTVEYMAPEIVQGRGHDKAADWWSVGILLFEMLTGKPPFVGGNRDKIQQKIVKEKIKLPTYLSSEVHSLLKGLLHKEAGRRLGSGPGGSDEIKNHKWFKSINWKRLEARQIQPSFRPNVAGKTCIANFDECWTSMPVLDSPVASPVAANSNFVGFSYVRPAPFLQKPSPLG

SEQ ID NO: 3703 - DNA, 2505 bp, Panicum virgatum
  misc_feature: Ceres CLONE 1792946
  misc_feature: Encodes the peptide sequence at SEQ ID NO. 3704
atgtgcgtcttctccgccgcagcgcagaccgaccaccgacccctcctcctcctccccctcctgcgcgccccaccaccaccgcctgcatttattagcctccccctcctctcctccccggctctcgcgccctccctctcgctctctcatcaaccgacgccatccgctcccgcgccggccgcgccgcgcgtcgcatacggtagcaggatttcagaaataatcatacaggggatatggcgacgaattacaaacctaagaacatccttattacaggagctgctggctttatcgcctcccatgttgcgattcgcattaccaagaagtaccccgattacaagatcgtcgtccttgacaagcttgactactgctctaatctgaagaacctgcttcctgtgagctcgtccccaaacttcaagtttgtcaagggagatattgcaagtgctgatcttgtcaacttccttcttgtcacggagaacattgataccataatgcacttcgcagcccagacacacgttgacaattcatttgggaattcctttgaatttaccaagaacaacatttatggtacccatgttcttcttgaggcctgcaagatcactggccagatcaagagattcatccatgtcagcactgatgaggtctatggggagactgatgaggatgcacttgttggaaacaaggaggcatcacagctgctccctacaaatccatatgcagccaccaaagctggagcagagatgcttgtaatggcatatgggagatcctatggcctgccggttatcactactcggggaaataatgtctatggccctaatcagtttcctgagaagcttatcccaaagttcattctcttggccatgagaggggagcccctccctatccatggtgatggaaccaatgtccgtagctacctctattgtgaggatgtcgcggaagcatttgaggtaattcttcatcatggagaagttggacatgtttataatattggaacaaagagagagaggacggtcattgatgtagcaaaagatgtttgcaagcttttcaatttggaagctgacaaagtcattatgtttgtcgagaacagacctttcaacgatcagaggtatttcttggatgatgagaagctcaagagccttggatgggctgagcgcaccccatgggaggaaggcttgaagaggacaatggaatggtatgttgcaaattccgattattggggtgatgtttctggtgcactgctgcctcatccaaggacgttaatgatgcctgggtgtgagggctctgaggagattaaagtaatactcagtcagtttaataacattaagacaaaggtggattcaacatcagatagtgcttcagaaacgcatgccttcaagttcttgatatatggtaggacaggatggatcggtggacttcttggaaaaatatgtgagaagcaaggaattccatatgaatatggaaaaggtcgcttgcaagatcgttcttctctcatcctggatattcaaactattaagccaacacatgtcttcaatgctgctggtgttactggcaggcccaatgttgactggtgtgaatcgcacaagccggacactatccgcaccaatgttgtgggcactttgactctagctgatgtgtgtagggagcatggcttattgatgatgaattatgccactgggtgcatatttgaatatgatgcacatcatccagaagggtcaggtatcggcttcaaagaggaggatgcaccaaattttactggttcgttctactcgaagactaaggcaatggttgaggagctattgaaggagtatgagaacgtctgcaccctacgagtccggatgccaatatcttcagacctcagcaacccccgaaactttgtgacaaagatcagccgttacaacaaggtggtgaacatccctaacagcatgacaatattggacgaactcctgcctatctcagtggagatggcgaaaaggaatctgcggggcatctataatttcaccaaccctggcgtcgtcagccacaacgagatcctggagatgtacaagcagtacatcgaccccagcttcaagtggacaaacttcactctcgaggagcaggccaaggtcatcatcgcaccccggagcaacaacgagatggacgcgagcaagctaaagaaagagttccctgagctgctgtcgatcaaagactctttgatcaagtatgtcttcgagcccaataggaaggtgcctgtaaactgaagagccagcacagccgatactatagaaaatacagcaactcattataagcaagcatgtagaagccatttgtcgcaaacaattcgttagaatgtttattcatcatacttagcagcatatctccactataggttgattcacagctgaatagacaatacatatatctggcaatctgttgatggcagtatgatgattgctcaatttgttgtagaggcttatcgcctattttacggagttcaaatgttcagtctgggtgtaaaaaaaaaaaaaaaaaaaa

SEQ ID NO: 3704 - protein, 666 aa, Panicum virgatum
  misc_feature: Ceres CLONE 1792946
  misc_feature: Great-hit functional homolog of the protein sequence encoded by LOCUS At1g53500
  misc_feature: Great-hit functional homolog of the protein sequence encoded by LOCUS At1g63000
  misc_feature: Great-hit functional homolog of the protein sequence encoded by LOCUS At1g78570
  misc_feature: Great-hit functional homolog of the protein sequence encoded by LOCUS At3g14790
  misc_feature (1)..(243): Pfam Name: Epimerase Pfam Description: NAD dependent epimerase/dehydratase family
  misc_feature: Useful for making plants with altered cell wall content and/or composition
MATNYKPKNILITGAAGFIASHVAIRITKKYPDYKIVVLDKLDYCSNLKNLLPVSSSPNFKFVKGDIASADLVNFLLVTENIDTIMHFAAQTHVDNSFGNSFEFTKNNIYGTHVLLEACKITGQIKRFIHVSTDEVYGETDEDALVGNKEASQLLPTNPYAATKAGAEMLVMAYGRSYGLPVITTRGNNVYGPNQFPEKLIPKFILLAMRGEPLPIHGDGTNVRSYLYCEDVAEAFEVILHHGEVGHVYNIGTKRERTVIDVAKDVCKLFNLEADKVIMFVENRPFNDQRYFLDDEKLKSLGWAERTPWEEGLKRTMEWYVANSDYWGDVSGALLPHPRTLMMPGCEGSEEIKVILSQFNNIKTKVDSTSDSASETHAFKFLIYGRTGWIGGLLGKICEKQGIPYEYGKGRLQDRSSLILDIQTIKPTHVFNAAGVTGRPNVDWCESHKPDTIRTNVVGTLTLADVCREHGLLMMNYATGCIFEYDAHHPEGSGIGFKEEDAPNFTGSFYSKTKAMVEELLKEYENVCTLRVRMPISSDLSNPRNFVTKISRYNKVVNIPNSMTILDELLPISVEMAKRNLRGIYNFTNPGVVSHNEILEMYKQYIDPSFKWTNFTLEEQAKVIIAPRSNNEMDASKLKKEFPELLSIKDSLIKYVFEPNRKVPVN

SEQ ID NO: 3705 - DNA, 1849 bp, Panicum virgatum
  misc_feature: Ceres CLONE 1792947
  misc_feature: Encodes the peptide sequence at SEQ ID NO. 3706
catcatgcatgagcactctctcacacactactacctccctatcttataacgcgatcgatcgaccctgattaaaggtagccaagtgatcatcgtatcactcgagggaggagttaaagaaaaattaaaggaaggtgcggctccgttgaagtggccggctggccggtgagctagctagggagcgagcgagcatgggtaccatcgggttcccggtgacgaggaggagcaggtcgctggtggcgccgtcgtcggcgacgccgcaggagacgctgcggctgtcggtgatcgaccgcgtggcggggctgcggcacctggtgcggtcgctgcacgtgttcgacggccggcgcggcggggaggcggtggtgaataataataagacgccggcgccggcgccggcggagacggtgcgggaggcgctggggaaggcgctggtggactactacccgttggcggggcggttcgtggaggaggacggggaggtgcgggtggcgtgcacggcggagggcgcgtggttcgtggaggcggaggcggcgtgcaccctggaggaggtgaagcacctggaccaccccatgctcatccccaaggaggacctgctgccggagccgccggcgccggacgtcgaccccctcgacatgccgctcatgatgcaggtgaccgagttcgcgtgcggcggcttcgtggtggggctcatctccgtgcacaccatcgccgacggcctcggcgccgggcagttcctcaacgcggtggcggactacgcgcgcggcctccccaggccccgcgtgtcccccgtctgggcgcgcgacctcatcccggcgccgtccaggatcgtgtcgccgccgccgcgcttcgagctgctggacctccgctacttcaccgtggacctgagcccggagcacatcgccaaggtcaagtccatcttcttcgaggcgacggggcagcgctgctcggcgttcgacgtgtgcgtcgccaagacctggcagtcccgcgtccgcgcgctccggctggacggcggcgacccggcgcggcccgtgcacgtgtgcttcttcgccaacacgcggcacctcctgccgcagctgtcggcgcccggcgggttctacggcaactgcttctacacggtgagggcgacgcggccgtgcggcgaggtggcgggcgccggcgtggtggaggtggtgcgcgccgtccgggacgccaaggcgcggctggcggcggacttcgcgcggtgggcagcgggcgggttcgagcgggacccctacgagctcaccttcagctacgactcgctcttcgtctcggactggacgcggctggggttcctggaggcggactacgggtggggcgcgccggcgcacgtcgtgcccttctcctaccaccccttcatggccgtcgccgtcatcggcgcgccgccggcgcccaagcccggcgcgcgcgtcatgaccatgtgcgtcacggagaagcacctgccggagttccaggaccagatgaacgccttcgccgccgggaaccaccagtgacgacgacggcgtgcgcccatcgccattatggatcgatcgatcgtctagcttgctatgcctctctcaagaactgcatgctgagtggatctatttgcatgctgcttgtaatttgtatttcaaattcgccacaactagcgttgcctgccagcaggctctgcccgaaaatggaagcgtctgtaaatcatcgcggatgaaataaaaaccgagatgcacgattaatttgtgcatggctagctagatcgagtttggttgtgtgctagctgcaagtgtgtgtcttattgtctgcgtctgtgctttgtaaaaagaaaatggtcttgcaacgttaaaaaaaaaaaaaaaaaaaa

SEQ ID NO: 3706 - protein, 438 aa, Panicum virgatum
  misc_feature: Ceres CLONE 1792947
  misc_feature (1)..(430): Pfam Name: Transferase Pfam Description: Transferase family
MGTIGFPVTRRSRSLVAPSSATPQETLRLSVIDRVAGLRHLVRSLHVFDGRRGGEAVVNNNKTPAPAPAETVREALGKALVDYYPLAGRFVEEDGEVRVACTAEGAWFVEAEAACTLEEVKHLDHPMLIPKEDLLPEPPAPDVDPLDMPLMMQVTEFACGGFVVGLISVHTIADGLGAGQFLNAVADYARGLPRPRVSPVWARDLIPAPSRIVSPPPRFELLDLRYFTVDLSPEHIAKVKSIFFEATGQRCSAFDVCVAKTWQSRVRALRLDGGDPARPVHVCFFANTRHLLPQLSAPGGFYGNCFYTVRATRPCGEVAGAGVVEVVRAVRDAKARLAADFARWAAGGFERDPYELTFSYDSLFVSDWTRLGFLEADYGWGAPAHVVPFSYHPFMAVAVIGAPPAPKPGARVMTMCVTEKHLPEFQDQMNAFAAGNHQ

SEQ ID NO: 3707 - DNA, 1847 bp, Panicum virgatum
  misc_feature: Ceres CLONE 1792953
  misc_feature: Encodes the peptide sequence at SEQ ID NO. 3708
gactcgtcgcgccagtcagtccacttgctccgccatatattcccctctccgtctctcgtgccgcccgccgccgccgccccgctaggccccgccgcgatggcctcccgatccgccgggaccgtcgggctcctcctcctggccgccatcgcgatcgcgggctctgccgccgccggggcaggggaggggaagtggcgggaggagcaggagcgggaccgggtgccgcgagtgccggggcagggcttcaacaccagcttcgcgcactacgcggggtacgtcgccgtcagcgagccgcgcggggccgcgctcttctactggttcttcgaggccgagaaggacccggggtccaagcccctcgtgctctggctcaacggagggcctggatgctcgtccattgcctatggacttggagaagaagtgggacctttccatgttaatgcagatggaaaaggggtacatatgaacccttattcttggaacaaagttgcaaatttattgtttgttgattcacctgttggtgttggttactcatattcaaacacctctgatgatattttaagaaatggggatgcaaggactgccaaggattcattggcgttcttactgaagtggcttgaacgctttcctcagtacaagggacgtgaattttatttaacaggagagagttatgctggtcactacgttcctcaactggctcaagccataaaaaggtaccatgaggccactggtgacaaatcgattaatctaaagggatacatggtaggaaatgctctcactgatgatttccatgaccactatggaatatttcaattcatgtggactactggcttgatctccgatcaaacatacaagctgctgaacattttctgtgactacgagtcctttgtgcatacatctccacaatgcgataagattcttgatattgctagcactgaagctggaaatattgattcatatagcatcttcactcctacatgccatgcatcttttgcctcctcaaagaacaaagtgatgaaaaggctacattctgttgggaaaatgggagagcagtatgatccatgcactgaaaaacattcaactatttacttcaatctagctgaggtccaaaaggcacttcatgttaatccaatgattggaaagtcaaaatgggagacatgcagtgaagttgttaatactcattgggggggctgcgaaagatctgtgctgcatatctaccatgaacttatacagtatggccttcgtatatgggtgttcagtggagatacagatgcagtgattccagtgacatcaactaggtacagcattgatgctctcaagcttccaacagtaactccatggcatgcttggtatgacgatggtggcgaggttggcggctggactcaagggtacaagggactcacctttgtgactgtgaggggtgcaggccatgaagttcctcttcatcgacccaaacaggctctcacactcatcaaatctttcttggctgggagtccaatgcccgtgcaatccagtgcacacagtgacatgtaatctgtactgctacaactgattcaagagatggccatcatcaaagttccatctcaacccagtcacttgttcgaaccccacttattctgcaacttgctatagtttatgtatcagagcttcagagctactggtaccactgtgccagctaccgtagccttttatttactggctctgctggtgcttgtaccaattatcccgtatgaaaaccggggtaaaaaactgtagaatactattttttccacggaactaacacaccgtgttgaactgttgatgttactgtgagcataagaacaaatttgcatcaaaaaaaaaaaaaaaaaaaa

SEQ ID NO: 3708 - protein, 476 aa, Panicum virgatum
  misc_feature: Ceres CLONE 1792953
  misc_feature (1)..(419): Pfam Name: Peptidase_S10 Pfam Description: Serine carboxypeptidase
  misc_feature (39)..(470): SWISSPROT Homolog: EC 3.4.16.6 Serine carboxypeptidase 2 precursor
  misc_feature (5)..(467): SWISSPROT Homolog: EC 3.4.16.6 Serine carboxypeptidase 2 precursor
MASRSAGTVGLLLLAAIAIAGSAAAGAGEGKWREEQERDRVPRVPGQGFNTSFAHYAGYVAVSEPRGAALFYWFFEAEKDPGSKPLVLWLNGGPGCSSIAYGLGEEVGPFHVNADGKGVHMNPYSWNKVANLLFVDSPVGVGYSYSNTSDDILRNGDARTAKDSLAFLLKWLERFPQYKGREFYLTGESYAGHYVPQLAQAIKRYHEATGDKSINLKGYMVGNALTDDFHDHYGIFQFMWTTGLISDQTYKLLNIFCDYESFVHTSPQCDKILDIASTEAGNIDSYSIFTPTCHASFASSKNKVMKRLHSVGKMGEQYDPCTEKHSTIYFNLAEVQKALHVNPMIGKSKWETCSEVVNTHWGGCERSVLHIYHELIQYGLRIWVFSGDTDAVIPVTSTRYSIDALKLPTVTPWHAWYDDGGEVGGWTQGYKGLTFVTVRGAGHEVPLHRPKQALTLIKSFLAGSPMPVQSSAHSDM

SEQ ID NO: 3709 - DNA, 1500 bp, Panicum virgatum
  misc_feature: Ceres CLONE 1792960
  misc_feature: Encodes the peptide sequence at SEQ ID NO. 3710
accagctcggaattgaagcggcagcgtactggctgtagctagcagctagtagccctactacctcgatcgaccgatcgatagattgatcgctctcgttccttcccccgagtcgaggaagcagaggcggcggctatccatggcggcgttgaggcgggcggcggccgtggcgtgcgtgctggcgctggcgctcggcgcggcggcgcagctgacgccgacgttctacgacgggagctgcccgaggctgcagtccatcgtgcgcgccgggatggccgccgccgtgcagcaggagccgcggatgggggcctccatcctccgcctcttcttccacgactgcttcgtccaggggtgcgacgcgtcggtgctgctggacgactcggcgacgctgacgggggagaagaacgccgggcccaacgccaactccctccgcggctacgaggtcatcgacgccatcaagtcccaggtcgaggccgcctgccccgacgtcgtctcctgcgccgacatcctcgccctcgccgcccgcgacggcgtcaacctgctgagcggcccgacgtgggcggtgccgctggggcggcgcgacacgcgcacggcgagccaggcggcggcgaacagcaacctgccctccccgtcctcgagcgcggcggcgctggtgtcggcgttcgcgtccaaaggcctggacgcgcgcgacctggtggcgctctcgggcgcgcacaccgtggggtcggcgcggtgcgcgagcttccggtcgcgcgtgtacaacgacaccaacatcagcgccgggttcgcggcgaagcgacggcagatctgcccgccgcaaggcggcggcgccgccgacggcaacctggcgccgctggacgcgctgagccccgtgcgcttcgacaacggctacttccgcaacgtcgtggcccagttcggcctgctccactccgaccaggagctcttcggcggcggccaggtggacggcgtcacggcgcagtacgcgcgcaacggcgccgccttcgcgcgggacttcgccgcggccatggtcaagatggggaacatcagcccgctcacggggtccagcggcgaggtccgcgccaactgccggaagcccaactgaggatgggggtcgccgacatggccagctaagaggagtgcgtgggggaaagtgtggagtgcgttggaagggagcggcggcggctgatggtcggagacggtgatgattgaggtgggatttggtgggtggagcggcgctgtcaggggggggggggggggggacgagtcacgaaaggtgtgggtggggcccagcgagccgtgacacatcgaacgcgcgctgcatgcatgcatggcctggccactgcggctgcttttggtttggttgcattctttccttgtaccatatacacagtggcgacgacggtccggtccgagcttgtaagtttgtacgtacgtggtcgattcatgattatttttcagggaggcgacacgaataagaacgtgtatgaaaaatgagctttcttttcc

SEQ ID NO: 3710 - protein, 319 aa, Panicum virgatum
  misc_feature: Ceres CLONE 1792960
  misc_feature: Great-hit functional homolog of the protein sequence encoded by LOCUS At5g05340
  misc_feature (1)..(241): Pfam Name: peroxidase Pfam Description: Peroxidase
  misc_feature (22)..(319): SWISSPROT Homolog: EC 1.11.1.7 Peroxidase 52 precursor
  misc_feature (23)..(319): SWISSPROT Homolog: EC 1.11.1.7 Peroxidase P7
  misc_feature: Useful for making plants with altered cell wall content and/or composition
MAALRRAAAVACVLALALGAAAQLTPTFYDGSCPRLQSIVRAGMAAAVQQEPRMGASILRLFFHDCFVQGCDASVLLDDSATLTGEKNAGPNANSLRGYEVIDAIKSQVEAACPDVVSCADILALAARDGVNLLSGPTWAVPLGRRDTRTASQAAANSNLPSPSSSAAALVSAFASKGLDARDLVALSGAHTVGSARCASFRSRVYNDTNISAGFAAKRRQICPPQGGGAADGNLAPLDALSPVRFDNGYFRNVVAQFGLLHSDQELFGGGQVDGVTAQYARNGAAFARDFAAAMVKMGNISPLTGSSGEVRANCRKPN

SEQ ID NO: 3711 - DNA, 1525 bp, Panicum virgatum
  misc_feature: Ceres CLONE 1792968
  misc_feature: Encodes the peptide sequence at SEQ ID NO. 3712
aatggtctcccccttgacacccgagactcgaatcaaatctgctgccttgccctgccccagctccaaaagcttcagcttcaagcatcggcgacctccacctccttcctcttctcagctcctccagccctcctcactacttggagtagtagcgagctgcaacacagcacggcagagcggagcggagtggagtagggagccgcagctgccgtccccgccgtggccatgcgtctctcagtggtgctcctcgtcgtggccctgctctgcctcagcggcggcggcggcggcggcctcgtggcggcgtccacggacttcaaattcccggcggtgttcaacttcggggattccaactccgacaccggcagccgtgtggcggcggggctcgagtccatcctcccgccctacggctccaccttcttcggcggccccgccggccgcttctgcgacggccgcctcatcctcgacttcctcatggaggcaatggatatgccactcctcaatgcatatttggattctcttggtgcaccaattttccggactggtgttaactttgctcaagctgggtgttcaatcacaccagcaaagccaacatctgttagcccgttttcatttggtcttcagattaagcaattcttttccttcaaggacaaagttactaagctcctatctaaaggagacatgtacaggccatacattcctcaggaagattacttttcagagggactctacatgtttgatattggtcaaaatgatcttgctggtgaattctattcaaaaacagaggatcaagtcattgcatccattccaacaattttgttggaatttgaaactgggctcaagaaactatatgaccaaggtgctaggaagttctggattcacaacacaggccctcttggctgcttacctgaaaacatagccttgtttggcaaagacccatcccagctagatgagcttcactgtgtagcaaagcacaaccgtgctgcaaaacttttcaacttacagctgcatgcactttgcacaaagttgagaggtgaattcaccggagccagcatcacttacgtggacatccacactatcaaatacagcctgatcgccaactactctcgatttgggtttgagcatgccacccaagcatgctgcggatatggtggtccacccctcaactttgatggtaacgtgcgatgtggacagacagtgtctttgaatggtaaattggttaccgcaaaagggtgcagtgacactactgaattcgtcaattgggatgggatacattacacggaagctgcaaatttccacattgcatctcagatactgaccgggaaatactctgatcctccattcgtcgacaagatgccattcgttataaaacctagattctaagtagtagcatacacctgttttctcttcgatcagccactttaacagcattggttgcggatacgatgtatttattacttgttaataatcatatatatgttgctcgatctcagaagggggggaaaatcacgaaaaaaaaaaaaaaaaaaaa

SEQ ID NO: 3712 - protein, 384 aa, Panicum virgatum
  misc_feature: Ceres CLONE 1792968
  misc_feature (1)..(329): Pfam Name: Lipase_GDSL Pfam Description: GDSL-like Lipase/Acylhydrolase
MRLSVVLLVVALLCLSGGGGGGLVAASTDFKFPAVFNFGDSNSDTGSRVAAGLESILPPYGSTFFGGPAGRFCDGRLILDFLMEAMDMPLLNAYLDSLGAPIFRTGVNFAQAGCSITPAKPTSVSPFSFGLQIKQFFSFKDKVTKLLSKGDMYRPYIPQEDYFSEGLYMFDIGQNDLAGEFYSKTEDQVIASIPTILLEFETGLKKLYDQGARKFWIHNTGPLGCLPENIALFGKDPSQLDELHCVAKHNRAAKLFNLQLHALCTKLRGEFTGASITYVDIHTIKYSLIANYSRFGFEHATQACCGYGGPPLNFDGNVRCGQTVSLNGKLVTAKGCSDTTEFVNWDGIHYTEAANFHIASQILTGKYSDPPFVDKMPFVIKPRF

SEQ ID NO: 3713 - DNA, 1577 bp, Panicum virgatum
  misc_feature: Ceres CLONE 1792973
  misc_feature: Encodes the peptide sequence at SEQ ID NO. 3714
cagtgttcggcaactcggcgtcgcgtcgcgggcggcggccacggcggagctccacttccctgctgatccccgaccggcagcagcagctccccccactcccgcgccccgcacgacccctcgccggcgcggacggggcatggcgtccggcgtccgggacccggagcccccgcggccctctcgcgcgctcgcccacctcgcggcgctgctgctgctgctgctgcccgcgctcctcctcgcctcctcctcctcccccgccgccgccgccgccgcgatgcacaacaacaactgggccgtgctcgtatgcacctcccggttctggtttaattatcgacatatggcgaatactctgtctttgtacaggactgttaagagattaggaatacctgatgagcgaatcatacttatgttggcggatgatatggcttgcaatcctaggaacagttatcctgcccaagttttcaacaatgagaaccatcagctaaatctttatggtgacaatgttgaggttgattatcgagggtatgaggtcacagtggaaaactttttgagagttttgactggcagacatgaaagtgcggtaccaagatcaaagcgtctcctaagtgatgaaggaagccatattcttctgtacatgactgggcatggaggtgatgagtttttgaagttccaagattctgaagagcttcagagccatgacttagcagatgcagtgaagcagatgaaggagaaacatagatttaaagagctgctgataatggtagatacttgccaagctgctactctcttttcacagcttcattcacctggtgttttggcgatcggtagcagcatgaagggtgaaaactcttattctcaccatcttgattcggatattggtgtttctgttgttgataggtttacctattatacacttgctttctttgagaaactgaacatgtatagcaatgcctcattgaacagtcttttcaactcatatgatcgttccatgctgatgtctactgcatattatcgaatggatctttatgagcggcccttgaatgaggtgcctgtgacaaatttctttggatcagtcatgaagactctccatacagattcagcctacacaggtttcttgtctgcacatgacgatgaaactcccatgtccatcagagataatcaacatgatcagttcatgtcaaataatgaggctagtgcaagaagatcaaacagagaaaaggaggcacaaataataccccatggatggacagaagttctgcttgaacagctggagggcaagaatagtgacactgttgtgctgtatggtctgggagccatgggtatattgttggcactttcaacctggttatcattgtaggcactatgaagagtattcacacgtcattctcttccacagagcactgaatcatactaaccccctagagactgagatcaaaatagaaaagaacaaaccttggaggttcttttttatttttctcctttttaaatttcgttactatctataagaattggttctaaattgatgtatgtagttcttgtatgcaccttctgttcttatatgttagtactcattgtttcac

SEQ ID NO: 3714 - protein, 405 aa, Panicum virgatum
  misc_feature: Ceres CLONE 1792973
  misc_feature: Great-hit functional homolog of the protein sequence encoded by LOCUS At1g08750
  misc_feature (3)..(160): Pfam Name: Peptidase_C13 Pfam Description: Peptidase C13 family
  misc_feature: Useful for making plants with altered cell wall content and/or composition
MASGVRDPEPPRPSRALAHLAALLLLLLPALLLASSSSPAAAAAAMHNNNWAVLVCTSRFWFNYRHMANTLSLYRTVKRLGIPDERIILMLADDMACNPRNSYPAQVFNNENHQLNLYGDNVEVDYRGYEVTVENFLRVLTGRHESAVPRSKRLLSDEGSHILLYMTGHGGDEFLKFQDSEELQSHDLADAVKQMKEKHRFKELLIMVDTCQAATLFSQLHSPGVLAIGSSMKGENSYSHHLDSDIGVSVVDRFTYYTLAFFEKLNMYSNASLNSLFNSYDRSMLMSTAYYRMDLYERPLNEVPVTNFFGSVMKTLHTDSAYTGFLSAHDDETPMSIRDNQHDQFMSNNEASARRSNREKEAQIIPHGWTEVLLEQLEGKNSDTVVLYGLGAMGILLALSTWLSL

SEQ ID NO: 3715 - DNA, 1819 bp, Panicum virgatum
  misc_feature: Ceres CLONE 1792984
  misc_feature: Encodes the peptide sequence at SEQ ID NO. 3716
gccttcgtgtgctcgatcacctcctccctgcctctcacccggtggccccacggcggccacacgcacacgacactccccaaacacacgcgccgcaccacccccaatcccccgacccctcctccttgacctgactgccctcggcccccgcaggctgttcgacgcttcgccccacccgcgcgccgccacgccatggcctcctccgtctccgccgccgccaaggcatccgccgccttcgcccacaagaaggagctcgccgccgcggcgccgtcgccggcgcagcaccgcgcgggctcgggccgccggagcaagtcatgccgcgtgcgcgccgtcgcctcacccgcgcgcgcgccccgcgccccggcgtccaccggctcggtgaagaccgcgatgacgatgacggagaagatcatggcgcgggcgtcggagcgcgcgggcctggaacccggggagaacgtgtgggtggacgtcgacgtgctaatgacgcacgacgtctgcggccccggcaccatcggcatcttcaagaaggagttcggggaggacgccaaggtctgggaccgcgagaaggtcgtcatcatcccggaccactacatcttcaccagcgacgagcgggccaaccgcaatgttgatatcctcagggacttctgtatggagcagaacatcaagtacttctatgacatcaaggatctcagcaatttcaaggctaatccagactacaaaggcgtctgccacgttgcacttgctcaagaaggccactgccgaccaggcgaggttctccttggtactgattctcatacgtgcaacgctggagcctttggccaatttgcaacaggaattggaaacaccgatgcaggttttgtactgggcactggaaaggctcttctcaaggtgccaccaactataaggtttgtactagatggagaaatgccaccttatttactcgcaaaagatctgattttgcaaattattggtgagatatctgtatctggtgcaacgtacaagtccatggagtttgttggatcaactgtggaaagtctaaatatggaagagcgaatgacattgtgcaacatggttattgaagctggtggaaagaatggtgttgtgcctgctgatgaaactacatttaagtaccttgagagcaagacatccgttgattatgaacctgtctacagtgatgctcaggccagattttttagtgactatcgatttgatgtatccaaactggagccagtagttgccaagccacattcacctgacaaccgtgctctagcaagagaatgcaaagatgtcaagattgaccgagtctatattggttcttgcactggtggtaagacggaggacttccttgctgctgcaaaggtgttcttagcttcggggaagaaggttaaagtccccacgttccttgtccctgcgacacaaaaggtgtggatggacgtatatagcctccctgtaccaggatctggtggcaaaacttgctcccagatatttgaggaggctggatgcgacacaccagctagccctagttgtggtgcttgtttaggtggccctcgcgatacatatgcacgcatgaatgaaccgatggtctgtgtgtccacgacgaacaggaacttcccgggcaggatgggacacaaggaagggcagatctacttggcgtccccgtacaccgctgctgcctcggccctgacggggtatgtcacagatcccagggacttcctcatgtaacgaccttgaaaccacagagttcatgatgtaacagaatgcctgtattagtactgttttttttttatgttgaaccttaatttaaaaaaaaaaaaaaaaaaaa

SEQ ID NO: 3716 - protein, 509 aa, Panicum virgatum
  misc_feature: Ceres CLONE 1792984
  misc_feature (1)..(419): Pfam Name: Aconitase Pfam Description: Aconitase family (aconitate hydratase)
MASSVSAAAKASAAFAHKKELAAAAPSPAQHRAGSGRRSKSCRVRAVASPARAPRAPASTGSVKTAMTMTEKIMARASERAGLEPGENVWVDVDVLMTHDVCGPGTIGIFKKEFGEDAKVWDREKVVIIPDHYIFTSDERANRNVDILRDFCMEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLNMEERMTLCNMVIEAGGKNGVVPADETTFKYLESKTSVDYEPVYSDAQARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 3717 - DNA, 1648 bp, Panicum virgatum
  misc_feature: Ceres CLONE 1793007
  misc_feature: Encodes the peptide sequence at SEQ ID NO. 3718
gttcatggacggcctccttttctttccttcctccctcctccacctccctttctccctccctcgggtctcggccttccctagcagcgccgactggcgagcagcgccgcccttctccaggtcttcgccgcccgttcgccggcatcaatcatccgtcagaaacaagggatgctggattggctctagttgcgtgaaggacatcgtggatacaagggcttgttctcgccatgtctcggtcaccgcacctcccgcctcgctgcccacccttgggtcctcagatcactcgaagggatgacagcttgttcacccagagctgcaggtttccctctggggatccgttcattggtgagccaccatgctggctcgatgatctccttgcagattctgggaaagttcccaactttcctcccctcagaagggcttgtagcgactctgatgctatcttggacgccctgtcgacgttccagagcccgattcatccaatcgaggaaagggatctaagcccaggtggtgaagccgaggacctgttggatgctgttgaaggtggggaaagtggttctgtggttgaggccagctgtgtttatgggccgaattcaccaaggcagaagagtaggctgacaacttcagagagttccatggtaaatgctgtgcttgagaatgtccccagcaaccctttgcagtacctgaccatcgatgcctccagtggcgcgaatggtaatatgaccaatggaactgctgacgccaatgatggttatggcaatcctgatcaagacaagacatttaaaaggcgatcggggcagagatctagagtccggaagcttcaatacattgctgaacttgaaagaactgtcgattcacttcagaacatgggagctgatttggctgtcagagtggcatcactttgccagcttcacaattctctttcaatggaaaacaagcaactgaggatacagatttctactcttcagcatgcaaaactaattaaggatggtcagacgcaggcactaaagaacgaagctgagaggttgaagcaggtgtccacccgtcaccgcaggagcagaagcgtcacttcctgttataacccgagcccttatggagacgcttcaccagtcaattggcagatgcctgacatggcaaagctcagcctggacggcagctcagtctccccgagaggcggctacggtctgtgacagtggccagcaccgacacctcttagaagaaaaatcgaggcagatgacttgtcgctaaccttacccaagcatagatttgagttgaggtcgtaccattgattaggagagtagggcttatcggtcgtcattgcggagaattacagaggttaccagcttagtatacctcgtagagtgctgctgtttgactcccagggttaagaactgacgaagtgaaggaagctttgccgtttagctgttgcgatctgctcgtttgatgctcttccgtgcgctggcaaaatttactgtagctaatgaggtctttgaatgtacaattaggggatgattaggtgcggttaatgtagcatcactgtaaccgattatgatgaaatttgactcattagattcgtctcgaaaagttgcaaccatggaaagatttcgtaaataaattttgtttagcacttcaaaaaaaaaaaaaaaaaaaa

SEQ ID NO: 3718 - protein, 320 aa, Panicum virgatum
  misc_feature: Ceres CLONE 1793007
  misc_feature: Great-hit functional homolog of the protein sequence given in SEQ ID NO 9598
  misc_feature (2)..(48): Pfam Name: bZIP_1 Pfam Description: bZIP transcription factor
  misc_feature: Useful for making plants with altered alkaloid content
MSRSPHLPPRCPPLGPQITRRDDSLFTQSCRFPSGDPFIGEPPCWLDDLLADSGKVPNFPPLRRACSDSDAILDALSTFQSPIHPIEERDLSPGGEAEDLLDAVEGGESGSVVEASCVYGPNSPRQKSRLTTSESSMVNAVLENVPSNPLQYLTIDASSGANGNMTNGTADANDGYGNPDQDKTFKRRSGQRSRVRKLQYIAELERTVDSLQNMGADLAVRVASLCQLHNSLSMENKQLRIQISTLQHAKLIKDGQTQALKNEAERLKQVSTRHRRSRSVTSCYNPSPYGDASPVNWQMPDMAKLSLDGSSVSPRGGYGL

SEQ ID NO: 3719 - DNA, 1883 bp, Panicum virgatum
  misc_feature: Ceres CLONE 1793015
  misc_feature: Encodes the peptide sequence at SEQ ID NO. 3720
acagcaaccatgtacgtgcactgagagtgcagcggcactgagctacctagacacagcatggctccgccgcgcctccaggtgctcgccgccgccgtggccctggccctggcgctggcagccggcggcgccggcgcgttcgagttccaggaggccaccgtggacgccatccagctgggcttccggaacggcagcctcacctcggcggcgctcgtccggttctacctggaccggatcgcccgcctcaacccgctgctccgtgccgtcatcgaggtcaacccggacgcgcccgcgcaggcggcgcgcgccgacgccgagcgcgcggcgtcggggggccgctgcgccgcggggctgcacggcgtccccgtcctgctcaaggacaacatcgccacgcgcgaccgcctcaacaccacggccggctccctcgcgctgctcggctccgtcgtccgccgcgacgccggcgtcgccgcccgcctccgccgcgccggcgccgtcatcctcggcaaggccaacccctccgagtggtccaacttccgacaggtcgatcccggctggagcgcccgcggaggccagaccaagaatccgtacgtcctgtcggtgacaccgtgcgggtcgagcgccgggcccggcgtcgccgcggcggcgaacatggccgccgtgacgctgggatcggagacggccggctccataatctgcccgtcggtgctcaactccgtggttgggatcaaaccgactgtcgggctcaccagccggtcaggcgtcatcccgatcacgcctcgccaagacaccatcgggccaatgtgccggacggtgtctgatgccgtccatgtgctggacgccattgtcggctacgacgagcttgacgctgaggctactggagcagcttccaagtacatcccgcgtgggggttacaggcagttcctgaggatggatggactaaggggcaagaggattggtgtcctcaaagggttctttgagcagtatgagcctgagccccggagggtctatgagaagcatctcagcacaatgaggcatcgcggagccatcttgataaaggaccttgacctcgcagtgaattggaccgatctcgtggaccaaatgggccttctgatgagtgcagagttcaggttgagcctgaatgcttatctgaaggatctgctgtactctccggtccgctccctcgcacaagtcatagcattcaacaatgcacacccagtacatatctctttgcaggagaggcttaaagattttgggcaggccgatctcattgcggccgagaagaccagcggcatcggcgcagcggagagggccgcgctccggcggctcaacgagctgtccgcgggtggcctggagaagacggtgaaagagcaccggctggacgccgtcgtggtggccaacaacgacatctccgccgtcctcgccatcggcggttatcccgggatcgccgtgccggccgggtacagcgaggagggagtccccttcgggatagtcttcggcgggctcaggggctacgagcccaggctgatcgagatggcctacgcgttcgagcaggctaccaaagtcagaaggccgcctgctttcaggcattagcctgacagccagtagcggcatgccgcaagaaattgcgataataaatcggccgcattcgaaggtgcaaatatgctctgtttacagcggctacatcctgattctcgtaggacaagagctggagctcttgtcctttttcagtcaaaactgaatattgttgttgtgaatctcatgttgtagtcatgactgatgagctatggacgttccaggggatactaggtcaaccgcgcgctacgccgcgcccagttgaaattatggagcaaaatagttaatgtatagaaaaaaaaaaaaaaaaaaaa

SEQ ID NO: 3720 - protein, 509 aa, Panicum virgatum
  misc_feature: Ceres CLONE 1793015
  misc_feature (1)..(440): Pfam Name: Amidase Pfam Description: Amidase
MAPPRLQVLAAAVALALALAAGGAGAFEFQEATVDAIQLGFRNGSLTSAALVRFYLDRIARLNPLLRAVIEVNPDAPAQAARADAERAASGGRCAAGLHGVPVLLKDNIATRDRLNTTAGSLALLGSVVRRDAGVAARLRRAGAVILGKANPSEWSNFRQVDPGWSARGGQTKNPYVLSVTPCGSSAGPGVAAAANMAAVTLGSETAGSIICPSVLNSVVGIKPTVGLTSRSGVIPITPRQDTIGPMCRTVSDAVHVLDAIVGYDELDAEATGAASKYIPRGGYRQFLRMDGLRGKRIGVLKGFFEQYEPEPRRVYEKHLSTMRHRGAILIKDLDLAVNWTDLVDQMGLLMSAEFRLSLNAYLKDLLYSPVRSLAQVIAFNNAHPVHISLQERLKDFGQADLIAAEKTSGIGAAERAALRRLNELSAGGLEKTVKEHRLDAVVVANNDISAVLAIGGYPGIAVPAGYSEEGVPFGIVFGGLRGYEPRLIEMAYAFEQATKVRRPPAFRH

SEQ ID NO: 3721 - DNA, 2174 bp, Panicum virgatum
  misc_feature: Ceres CLONE 1793037
  misc_feature: Encodes the peptide sequence at SEQ ID NO. 3722
ttcacccccacccctcattcggccgcccaccgacggacgcgcaagggcgggagcgcggcgactagggttcggccctgcccgccgccggccgcacccaccaacctccgtgcgcctctcggagggcgcgaatcgggccgccttcctcccgaagcaggacgtccgcccgcacctagccagcctgcctcctcccataccctgctccaccaacgcagacgccggcccgcctcctccttccgggcgcgagccatccacggcgtcgacccgtcggctgccatccggattctgtccccacgacggaatcctcttgccccaagccgaggagttcaccatgtctgacttggagtccgtggctgcccttatggagtcgacatgttctaagatagagcagcttcagcaggcttttgctgagctcgaaaggcagagtgctgtctccatgaacctcaagtggaagcagcttgaggaccactttcgtggccttgagcagtcgctcaagaaaaagtttgatgagttgaaagagcaggagaaggagttccaggagactgtcgcgaaatcggagaagatgctggagcagcaggaggcaactgttgtggccaaggaactgacttctttggagaggttgcaggagaaaagggatgctgcgttagctatgatctttagcaagtccaagctggccttacctgttcctgccatcaacccaatggacaaggcactggataatcttggtgtcaagtggcctaaactggcttctgaagagagtatgtgccttcaagttgacagtgctgcagtgaagcctcgttctgagcttgtctcactgtgtgagaaaatgaatgtgaaggggcttcataagttcatatcagacaacaggaaaaacttggcgaccatccgggaggaaattcccagtgcactgaagaaagcgcctcatccttatggcctggtgttggattccctggaagacttttatgctggagataatcttgtattggatggcaaaaaggatggagaccttctgggtgttagaaggacatgcctgatgttgatggagtcacttggacagctacaaactgacaatataactcgtttctcgtcggaggggcacatgcttacaactgatatcaaagagcgagcaaaaaagactgcatatgaatggaagtccaagttggatagtcttgacattgatgctagtaatgggaactgtcttgaagctcatgcatttcttcaactcctggcaacctttggtatttctgctgaatataatgaagatgacctgtgcaaactgctcccatatgtcagtcgtcgtcgtcagacacctgaactttgtcgattgcttgggttgtcacagaaaatgccaggtgtcattggagttctggtggaaactggaaaacctattgatgcgattaatttagcttatgcgtttgagcttactgaacagtttgaaccagtgcaactgcttaaagcatatctgagggatgttaagaaagtgtcacatgctaagaatgccaaaatgtcttccggagcacagaatgagatgaatgaacgtgagctgtctgcactgaaagctgtcattaagtgcattgaggagcacaaacttgaggagcactaccctgtggatccacttcagaaacgggttttgcagctagagaaagcaaaggcagacaagaggagggctgttgaagcagcgaagccacagtccaagaggcctcgcgccaatggatcggcctttgcacctcgtgctaccagctttggtgacaagagcttttatcccgcaaccccagagaggcatccctcctacccttacgagaggcagtttgtgtatggtgctgaggcccatcatccaccaatgatgagctcagcaccttacacgatccaacctgccccggcaccttattatggtaatggctacccagttcagtaccaggtaccgtatatccactaatggagagagccaggtgcaggtgctctttcctaactatgtagctttaacctgctgccctttgttgtagttgtatcagttacttgctagtttgcctagctaaatagtttggaccactcagtgtgtgtgctgtgagtggctattgtgaaaatctggtaactttatgtcctattgacatatgacaatttactccaaatatttagctatgatgaatctctttatgtaaaaaaaaaaaaaaaaaaaa

SEQ ID NO: 3722 - protein, 534 aa, Panicum virgatum
  misc_feature: Ceres CLONE 1793037
  misc_feature: Great-hit functional homolog of the protein sequence given in SEQ ID NO 9612
  misc_feature: Useful for making plants with altered alkaloid content
MSDLESVAALMESTCSKIEQLQQAFAELERQSAVSMNLKWKQLEDHFRGLEQSLKKKFDELKEQEKEFQETVAKSEKMLEQQEATVVAKELTSLERLQEKRDAALAMIFSKSKLALPVPAINPMDKALDNLGVKWPKLASEESMCLQVDSAAVKPRSELVSLCEKMNVKGLHKFISDNRKNLATIREEIPSALKKAPHPYGLVLDSLEDFYAGDNLVLDGKKDGDLLGVRRTCLMLMESLGQLQTDNITRFSSEGHMLTTDIKERAKKTAYEWKSKLDSLDIDASNGNCLEAHAFLQLLATFGISAEYNEDDLCKLLPYVSRRRQTPELCRLLGLSQKMPGVIGVLVETGKPIDAINLAYAFELTEQFEPVQLLKAYLRDVKKVSHAKNAKMSSGAQNEMNERELSALKAVIKCIEEHKLEEHYPVDPLQKRVLQLEKAKADKRRAVEAAKPQSKRPRANGSAFAPRATSFGDKSFYPATPERHPSYPYERQFVYGAEAHHPPMMSSAPYTIQPAPAPYYGNGYPVQYQVPYIH

SEQ ID NO: 3723 - DNA, 1614 bp, Panicum virgatum
  misc_feature: Ceres CLONE 1793039
  misc_feature: Encodes the peptide sequence at SEQ ID NO. 3724
cgtttttcagcggaggaaggggacgaggtggagagcccttcatctatctctccggcggcgaagcaaatcagccatgtgggccacaccacctcagccgtttcccctccaactccggcgaccaccaggtccgccgcctcgtctcttcctcactcgccatcgcagcagccgcctcaaccgcatcgccgcctcacaggatcccctcgccgccctctccaacctgctgtgggggcgcgcgctgcccccggcgcagctcgtcctcgccgtccgccacggctggaccgccgcgtggcagctcctcatgcggcagctcgcgccctcggacccggagaccggagccttcacccgcacgccgtcccgcttccccgccgtcgtagggacgcccagctcccggctccacctctacgtgggcctcccctgcccctgggcccaccgcgccctcgtcgtccgcgcgctcctcgacctcgaggcccgcctcccggtctccgtcgccgtcccgggtgacgacggggcgtggtccttcacgccggacagccccgacgggctctacgggaagcgcaagctccgggaggtgtacgccgtgcggagcggcgggttcgagggcagggcgtcggtgccgatgctctgggacgccgagcgccgcgaggtggtgtgcaacgagagcatcgagatcatcaagttcctctgcggccttgcaaacgccgacggcggcggcctcgacctctggccgccggagctgcgccaggacatcgatcgttggtacggcgtcatctacccgagcgtcaacaacggcgtctacaggtgtggatttgcgcagagccaggaggcgtacgacgccgcggcgagcgagctgttcggcgcgctggacaggcttgaggcccacctcgccggcgcccgctacctgtgcggggacaggctcacgctggccgacgtgtgcctcttcacgacgctgatccgattcgacctcgtgtacaacacgctgttccggtgcaccaggcggaagctggccgagtaccccagcctccacgcctacacgcgcgacatctaccagatgcccaaggtcgccgagacgtgcgacatggaggctatcatggcaggatacttcaagaccctcttccccctcaaccccggcgggatccagcccctcccgccggcgagctgcgacagcgagtcgctcttgaggccgcacggcagggaggccttgtcctctgctgctggcacgccgcttcaagcagctggtgtttcttaattcaggttatcaacattgaacaatgcttctgaagaacggcagaaaagagtttacacgtgctgtaccgtttactgatgcttcacaggatcaaatcacatcagtagtagctgcaatttgcatatccttcgttcgacaagaaatcaaatatgttctcaaaacgtcatcgtgttttcttgtcatctttatgatccagttcttatagataaagatagaatccgtcctgttcagttccccaactgtgaatttccatactacttacaaatccctggtgtatatggcacacctatatggatggacatccaaactttgtaaagcaactcatgagttatgttaaaagctgatttatcagaaaaaaaaaaaaaaaaaaa

SEQ ID NO: 3724 - protein, 390 aa, Panicum virgatum
  misc_feature: Ceres CLONE 1793039
  misc_feature (1)..(96): Pfam Name: GST_C Pfam Description: Glutathione S-transferase, C-terminal domain
MWATPPQPFPLQLRRPPGPPPRLFLTRHRSSRLNRIAASQDPLAALSNLLWGRALPPAQLVLAVRHGWTAAWQLLMRQLAPSDPETGAFTRTPSRFPAVVGTPSSRLHLYVGLPCPWAHRALVVRALLDLEARLPVSVAVPGDDGAWSFTPDSPDGLYGKRKLREVYAVRSGGFEGRASVPMLWDAERREVVCNESIEIIKFLCGLANADGGGLDLWPPELRQDIDRWYGVIYPSVNNGVYRCGFAQSQEAYDAAASELFGALDRLEAHLAGARYLCGDRLTLADVCLFTTLIRFDLVYNTLFRCTRRKLAEYPSLHAYTRDIYQMPKVAETCDMEAIMAGYFKTLFPLNPGGIQPLPPASCDSESLLRPHGREALSSAAGTPLQAAGVS

SEQ ID NO: 3725 - DNA, 2084 bp, Panicum virgatum
  misc_feature: Ceres CLONE 1793050
  misc_feature: Encodes the peptide sequence at SEQ ID NO. 3726
gttcggtcgtccgggagactccagccacccatccggcccggagtaatggatgctctgcgggcatggagggcctccaatctcctcggcttcgcggcctcccgcgttgtcaccgccgcctccgcggctaggccactccgcctccgcctccgttgctgctcttcagctgccgccacgacgaaccagaagcagcagcagccgccgccgccgccgcggctgcctcaggaccgtcgtcgccgtaatgcttccacctccacctccgaccgcgactccatccgcgccatccgcctcaaaaaggttgaggagctaagaggaaagggttatgagccatatgcgtacaagtgggataggactcacacgactaagaagcttcaggaagagtacacccatcttgaaaatggtgaaatctttgaggaggtagcggtctccattgccggcaggattgttgcccgaagggcatttggaaagcttgttttcatgactataagagatgatactgggactattcagctttactgcgagaaagacaacctgacggaggaccaatttgaacaactgaaggcatttattgatattggtgatatcataggtgcaagtggatccataaagaagacagagaaaggggaactatctctttatacgaaaaattttgagatcctcacaaaatccttactcccactaccagacaagtatcatgggttaactgatgtcgacaaacgttatcgtcaaaggtatgttgacatgatcgcaaatcctgaggttgctgatgtattccgcactagagcaaaggttgtttctgaaatccgcaagacaatggaatcatttggtttcattgaagttgaaactccagttctacagggagcagcaggtggtgctgaagctagacctttcataatctatcataactcacttcaaagagatctttacttgaggattgcaacagagctgcatttgaaaaggatgttggttggagggcttgagagggtatacgagattggaagaattttccggaatgaaggcatctctactcgtcataatcctgaatttaccaccattgagatgtatgaagcatattcagactatgaaagcatgatgaaaatggctgaagaaattgttgttcgatgtactatggctactcatggcaagcttaagattgattatcagggaactgaaatttctcttgaaagaccatggaggagggagaccatgcattctcttgtcaaagaagcaactggaatcgacttcaacatcttcgggcaagatgttgaatctgctaaaagtgctgcaagaggactgccagggatcaacacaggaagcaggggaagtacttcactgcaatcctgttcatctgttggacatgttcttaatgaggtttttgagacttttgttgaatctactcttgtacaaccgacatttgtccttgactacccagttgagatatctccattggcaaaaccacatcggagttatgctggcctcactgaacgatttgaactttttatatgtggtcgtgaaattggcaacgcattttctgagctcacagacccaattgatcagaggagacgttttgaaaatcaaataaaacaacacaatgctacacgtgctgcaagggctaaggtcaaatttactgaggatcaaggagatgaggatgattattcctatgaagtttgtttagatgaagacttcttaacttcattagaatatggaatgccaccagcatcaggaatgggcctgggtatcgaccggttagtaatgcttttgacgaactctgccagcataagggatgttattgcctttcctgtcttgaagattcagcaatagatctttcacatttgacgtaagaagagatacactattgggagaaatgtggttgtcaaagcaatcatgggcagccttcgttttgctcttgttttattcatgaagattttacatttgtttccttttagctgatagctagatatggccactgatcaatctataaatcttaatgtactatgagatttttcaacacttgtatcaataatggattccgcatatttcatgggatggaatgaatgcgatacaaaacaaaaaaaaaaaaaaaaaaa

SEQ ID NO: 3726 - protein, 590 aa, Panicum virgatum
  misc_feature: Ceres CLONE 1793050
  misc_feature (71)..(510): SWISSPROT Homolog: EC 6.1.1.6 Lysyl-tRNA synthetase
  misc_feature (76)..(516): SWISSPROT Homolog: EC 6.1.1.6 Lysyl-tRNA synthetase
MDALRAWRASNLLGFAASRVVTAASAARPLRLRLRCCSSAAATTNQKQQQPPPPPRLPQDRRRRNASTSTSDRDSIRAIRLKKVEELRGKGYEPYAYKWDRTHTTKKLQEEYTHLENGEIFEEVAVSIAGRIVARRAFGKLVFMTIRDDTGTIQLYCEKDNLTEDQFEQLKAFIDIGDIIGASGSIKKTEKGELSLYTKNFEILTKSLLPLPDKYHGLTDVDKRYRQRYVDMIANPEVADVFRTRAKVVSEIRKTMESFGFIEVETPVLQGAAGGAEARPFIIYHNSLQRDLYLRIATELHLKRMLVGGLERVYEIGRIFRNEGISTRHNPEFTTIEMYEAYSDYESMMKMAEEIVVRCTMATHGKLKIDYQGTEISLERPWRRETMHSLVKEATGIDFNIFGQDVESAKSAARGLPGINTGSRGSTSLQSCSSVGHVLNEVFETFVESTLVQPTFVLDYPVEISPLAKPHRSYAGLTERFELFICGREIGNAFSELTDPIDQRRRFENQIKQHNATRAARAKVKFTEDQGDEDDYSYEVCLDEDFLTSLEYGMPPASGMGLGIDRLVMLLTNSASIRDVIAFPVLKIQQ

SEQ ID NO: 3727 - DNA, 1982 bp, Panicum virgatum
  misc_feature: Ceres CLONE 1794280
  misc_feature: Encodes the peptide sequence at SEQ ID NO. 3728
attcgtcgccgtccacttgtctcagcagccatctcctcccttccgcatctccgcccccagccatcctccccctccacgccgccggtgacgactccgtcgagccactccgcagcaggcgccggcgaccatgcaccgcgccgtatcgggcctcagcgccctcaagcggcatagggcagatgctcaaatgatgaatattgcaattaggtctgccagcacaagtgttgcacagagctcatcaggcggcttctggacttggttgactggtgcacggtcaaatgcattacctcctccagatttcgcgcttccaggagtgactattcctcctcctctacctgacctcgtggagcctggcaagacaaaaatcacaacactttcgaatggtgtaaaaatagcctctgagacatctgcaggatcatcttgttctgttggagtttatattgattgtggttctgtatatgaggcacctgagacaacaggtgtcagtcagctgttgaagacaatggcctttgcaaccactaccaacaggagtgaattgcgcgttgtgcgtgaaattgaggcgataggtggcagtgccaaagcatctgcaagccgtgagatgatgagctacacttatggagcgctgaaaacatacatgcctgaaatggttgaggtgcttgttgactgtgtacgcaatcctgcttttcttgattgggaggttaaggagcagattttgaggctcaaggcagagcttgcaaaagcatcaagtaaccctgaaaatttccttttggaggctcttcattctactggctattctggtgctttggcaaaccctctgattgcatcagaatcttcgattagcagattaagtacagatgtcctggaacagtttatatttgagaactacactgctccccgaattgttctagctgcatcaggtgttgatcatgatgaattggtatctattgctgaaccgcttctgtctgacattcccagtgtaactggaaccacaaggccgaagtctacttatgttggcggcgaatatagacgaactgcagattcatcgaacacagatgtcgcgttggcatttgaggtccctggtggttggctcaaagaaaaagattttgccactgtatcagttcttcagacacttctgggtggtggtggcacgttttcttggggaaggcagggaaagggattgcattcacgtctaaatcaccttgtaactgaattcgaccaaatcaagtcaatctctgctttcaaggatgttcacagtaacactggcatctttggaattcatacatccactgatgcatcatttgttcctaaagctattgacctggcagccagagagctcacttcccttgcaactcctggacaagttgaccaaagccaactggatcgtgctaaagcctcagctaaatctgcaatattagtgaaccttgaatcaaaggcatcactaacagaagacatggggcgacaagtactggcatttggtgaaaggaaacctgttgagcaccttctcaaggctgttgatggtgttactctgaaagacgtaacaacagttgctgaaaagatcatttcatcaccgctgacaatggcatcccatggaaacgttctgaatatgccaacttacgagtcggtcagtggcaagttcagctcgaaatgagtacatgggcgtttctatttctctgtctggacaagtttaacagcccgtattttccacacctaggccattattctcggtcaaagtttcatcagaaaaataaggaacctcatacaattttgttcgttaaatctttgctcactttgcaattacttgttcccctccacttctttttgcggaaacattcgtccacttggtggttattgctggtgataggccagtcatgtgtttgtaaatttaactgataccggggctactctttcgtttacaaggcccaaagaatgtacaaaataccattgtctggtcctaaaatctttgacaaaaaaaaaaaaaaaaaaaa

SEQ ID NO: 3728 - protein, 505 aa, Panicum virgatum
  misc_feature: Ceres CLONE 1794280
  misc_feature (1)..(147): Pfam Name: Peptidase_M16 Pfam Description: Insulinase (Peptidase family M16)
  misc_feature (1)..(186): Pfam Name: Peptidase_M16_C Pfam Description: Peptidase M16 inactive domain
  misc_feature (1)..(505): SWISSPROT Homolog: EC 3.4.24.64 Mitochondrial-processing peptidase alpha subunit, mitochondrial precursor
MHRAVSGLSALKRHRADAQMMNIAIRSASTSVAQSSSGGFWTWLTGARSNALPPPDFALPGVTIPPPLPDLVEPGKTKITTLSNGVKIASETSAGSSCSVGVYIDCGSVYEAPETTGVSQLLKTMAFATTTNRSELRVVREIEAIGGSAKASASREMMSYTYGALKTYMPEMVEVLVDCVRNPAFLDWEVKEQILRLKAELAKASSNPENFLLEALHSTGYSGALANPLIASESSISRLSTDVLEQFIFENYTAPRIVLAASGVDHDELVSIAEPLLSDIPSVTGTTRPKSTYVGGEYRRTADSSNTDVALAFEVPGGWLKEKDFATVSVLQTLLGGGGTFSWGRQGKGLHSRLNHLVTEFDQIKSISAFKDVHSNTGIFGIHTSTDASFVPKAIDLAARELTSLATPGQVDQSQLDRAKASAKSAILVNLESKASLTEDMGRQVLAFGERKPVEHLLKAVDGVTLKDVTTVAEKIISSPLTMASHGNVLNMPTYESVSGKFSSK

SEQ ID NO: 3729 - DNA, 2401 bp, Panicum virgatum
  misc_feature: Ceres CLONE 1794314
  misc_feature: Encodes the peptide sequence at SEQ ID NO. 3730
aaaacaactcgtcattccattcatcgccactcgccaggtcaggaagcctggacggcggggccaccgatcacacgagcactcttggcacaaccacctccggttatatagcgccggcggccaccgcggcggtggcgcggccgaacgcatgctgcaagagcctgtgggaggggaggcaggtagcgcgcggagtggcggcagctagctggagggagcggagcagagcaaagcaaagctggcggcgaggtcgtggcggtgctcctggtggcgtcgcgggcgtaggagaggagccgccgatgaggctccggcgccggcgccggcgacggggagcgggatgaaggagatacgagtaagcggggcggcgtgcgaagtggacgtgaacgacgacgccgcggtgggcggcggcgtggaggatgcctacggcgaggaccgcgccaccgaggagcagcccgtcacgccgtggaccctcaccgtcgccagtggttacaatttgatgagggacccccgctacaacaagggcctcgccttcacagagagggagcgcgagacgcactacctccgtggccttctgccaccggcaatagtatcccaagagcttcaggagagaaagatcatgaacaatatcagacaataccaggtgcctttgcagcgttacatggctatgatggacttacaggagaacaatgagaggcttttctacaagctcctcatcgacaatgtcgaggaattacttcctgtagtgtacacaccaactgttggtgaggcttgccagaagtatggttccatatttagtcgtcctcagggtctttttatcagcttgaaggagaagggaaagatccttgaggtgctcaagaactggccagagaggagcattcaagttattgtagttactgatggtgaacggattttggggcttggagatcttggatgtcagggaatggggatccctgttggcaagcttgccctttacactgccctgggaggagttcgtccatctgcttgcttacctatcacgctggatgttggcacgaataataaggacctgcttaatgacgaattttacattggcctgagacaaagaagggccactggccaggagtatactgattttctgcaagaatttatgaccgctgtgaagcaaaactatggagagaaagtactcattcagtttgaggattttgccaaccataatgcctttgagctccttgcaagatatggcacaactcaccttgtattcaatgatgatatccagggaaccgcttctgtggttcttgctgggctgattgcagcgcaaaagttacttggtggaacattggcagagcatactttcctcttcctgggtgctggagaggctgggacaggtattgcagaacttatagctctcgagatatcaagacagacaaaagctcctatagaggaatgtcgcaagaaaatctggcttgttgattcaaagggcttaattgtcagttcaagaaaggagtcccttcaacacttcaagaaaccatgggctcatgagcatgaaacaattggcaacctcttagatgctgtcaatgctatcaaaccaacggtgcttattggcacatctggaaaggggcaaactttcacacaggatgttattgaagccatttcctcatttaatgagaggccaattattcttgccctgtccaacccaacatcacagtctgaatgtactgctgaacaagcttacacatggagcaagggtcgagcagtgtttgcaactgggagcccttttgacccagtggagtacgatggcaagatatatgttcccggacaggcaaacaatgcctatatcttcccagggtttggccttggtgtggtgatgtctggggcaattcgtgttcacgatgacatgcttctggcagcctcggaggctcttgctcagcaggtctcagaagagaactttgaaaaggggctcatctatcctcccttctcaaacatcaggaagatctccgcgcacattgcagccaacgttgcagcaaaggcatatgaacttggtttggcaagtaggcgccctcggccgaaggacctggtgaaatatgcagaaagctgcatgtacaaccccgtttaccgcaactaccgctgaattcgaatcgattttagttatgtgcaaccatcagccattgcagaatcacaaaatttcctaagaacactactcgattcagatcctccatgctgtaattaggctgtctctagcagagcagctcacgtcctgttctccccctgtgtgttctgcagtgtttttactttgcgatgtgatgtgaaatgcctccggccaggcttttgtatcctagtcattgtgctactgccgtccttccggagaagggtaaatttggaataataaagtcggatcgacagttttctccaaaaaaaaaaaaaaaaaaaa

SEQ ID NO: 3730 - protein, 589 aa, Panicum virgatum
  misc_feature: Ceres CLONE 1794314
  misc_feature (1)..(254): Pfam Name: Malic_M Pfam Description: Malic enzyme, NAD binding domain
  misc_feature (1)..(589): SWISSPROT Homolog: EC 1.1.1.40 NADP-dependent malic enzyme
MKEIRVSGAACEVDVNDDAAVGGGVEDAYGEDRATEEQPVTPWTLTVASGYNLMRDPRYNKGLAFTERERETHYLRGLLPPAIVSQELQERKIMNNIRQYQVPLQRYMAMMDLQENNERLFYKLLIDNVEELLPVVYTPTVGEACQKYGSIFSRPQGLFISLKEKGKILEVLKNWPERSIQVIVVTDGERILGLGDLGCQGMGIPVGKLALYTALGGVRPSACLPITLDVGTNNKDLLNDEFYIGLRQRRATGQEYTDFLQEFMTAVKQNYGEKVLIQFEDFANHNAFELLARYGTTHLVFNDDIQGTASVVLAGLIAAQKLLGGTLAEHTFLFLGAGEAGTGIAELIALEISRQTKAPIEECRKKIWLVDSKGLIVSSRKESLQHFKKPWAHEHETIGNLLDAVNAIKPTVLIGTSGKGQTFTQDVIEAISSFNERPIILALSNPTSQSECTAEQAYTWSKGRAVFATGSPFDPVEYDGKIYVPGQANNAYIFPGFGLGVVMSGAIRVHDDMLLAASEALAQQVSEENFEKGLIYPPFSNIRKISAHIAANVAAKAYELGLASRRPRPKDLVKYAESCMYNPVYRNYR

SEQ ID NO: 3731 - DNA, 1616 bp, Panicum virgatum
  misc_feature: Ceres CLONE 1794323
  misc_feature: Encodes the peptide sequence at SEQ ID NO. 3732
gcgacagcgacggatacggcggggcggcggccgcggcgacgagatatttccatcatttggactctaggatttaaagaataaagcatgtttatgctttcaaccttctctcggaatatattaatcatcttggaataaaggaggaaacctcttgacttgcggtgtaagcctgcgcgccagcaaggccggatcccgcggcttgtttgcaacctcctccatggctccagctggtgaccggagcgccgctgccccgaaccccacaaactaagttgttgcttgcgttccatcacccaaccacctcccctcccttccctgctctttatatatcccggcgccggcgccagctacccatgtcacacgacgcggctgcgcgccaccccgtcgcaaccccgcaagacgcaggaggagaggaaggaggagaccacccctccggcggccgggccagcttcgagttgttcggcggcgactgccggttctgcgagatgacgcggcagcaccacccgcagtgcgcgcgccggctgcccaagcggatcatcctggtccggcacggcgagagccaggggaacctcgacatgtcggcgtacaccaccacccccgactaccgcatcccgctcacggcgctgggcgccgagcaggcgcgcgccgccggccgcggcatccgcgacgtcgtggcgtcgggcggcggcaactggaaggtctacttctacgtgtccccctacgcgcgcacccgcgccacgctgcgggagatcggctgcgcattcccgcgggaccgcatcatcggcgcccgcgaggagtgccgcgtccgggagcaggacttcggcaacttccaggtcgaggagcggatgcgcgccgtcaaggagacccgccaacgcttcggccgcttcttcttccggttccccgagggcgagtccgccgccgacgtcttcgaccgcgtcgccagcttcctggagtcgctgtggcgggacatcgacatggggcggctggatcaggacccgagctgcgagaccaacctggtgatcgtgtcgcacgggctcacctcgcgggtgttcctcatgaagtggttcaagtggacggtggaccagttcgagcgcctcaacaacttcgaaaactgcgagttcaggatgatgcagctggggcccggcggcgagtactccctcctcgtccaccacaccaaggaggagctcgagcagtggggcatgtcgcgggagatgatcgccgaccagcagtggcgcgcctcaaccaaccgacgcagctgggcccaggagtgctcctccttcatcgactccttcttcgatgaccctaaggattctgagagctcgtccgaggaggaagaagaaaaggagaacggcaagatcgacgaactggactaatcgactctgctctgtccctggttcgctgaaattctttcaactcgatgataatttctagatttcatactctggagtggtggcctagtgagtcattgctgattgctcatttttctttccccaatttgtaatctgttcatagtagctagagattggaatgagcggggagaaattcagaagaacaaaaagaaaactaccaactaaagctttctagatggtcctagttctaaccaaaaaaaaaaaaaaaaaaaa

SEQ ID NO: 3732 - protein, 339 aa, Panicum virgatum
  misc_feature: Ceres CLONE 1794323
  misc_feature (1)..(173): Pfam Name: PGAM Pfam Description: Phosphoglycerate mutase family
MSHDAAARHPVATPQDAGGEEGGDHPSGGRASFELFGGDCRFCEMTRQHHPQCARRLPKRIILVRHGESQGNLDMSAYTTTPDYRIPLTALGAEQARAAGRGIRDVVASGGGNWKVYFYVSPYARTRATLREIGCAFPRDRIIGAREECRVREQDFGNFQVEERMRAVKETRQRFGRFFFRFPEGESAADVFDRVASFLESLWRDIDMGRLDQDPSCETNLVIVSHGLTSRVFLMKWFKWTVDQFERLNNFENCEFRMMQLGPGGEYSLLVHHTKEELEQWGMSREMIADQQWRASTNRRSWAQECSSFIDSFFDDPKDSESSSEEEEEKENGKIDELD

SEQ ID NO: 3733 - DNA, 1572 bp, Panicum virgatum
  misc_feature: Ceres CLONE 1794362
  misc_feature: Encodes the peptide sequence at SEQ ID NO. 3734
acctagctaccacccccgactcccaaccttcaccgttccgttccgcccgccggagatccaggaacctagccccagggggacgggcggcgatgggaggaagggtcgcgatgctcgcggccgtggcggtggttcttgcggcggcgtcagccgccggggccgcggcggagtcgagggaggcggcggccaaggggaagtaccacgcgctcttcaacttcggggactcgctggccgacgccggcaacctcatccagaacggcacgccggagatcctcgccaccgcgcgcctgccctacggccagacctacttcggcaaggccaccggccgctgctccgacggccgcctcgtcatcgaccacctcgcgcaagagttcggcctgccgctgctgccgccgtccaaggccaagaacgccagcttcgcgcacggcgccaacttcgccatcaccggcgccaccgcgctcgacacgccctacttcgtggccaaggggctcggcgacgtcatctggaactccggcgcgctcatgacccaaatccagtggttccgtgatctcaagcccttcttctgcaacaccacccaggaatgcaagaagttctttgccaaggcgctgttcgtggtcggtgagtttggcggcaacgactacaatgcgcccctctttgcagggaagggcatcccggaggcctacaagttcatgccggatgtcatccagggcatctccgacggtgttgaggcattgattgctgagggggcggtggatctgattgtgcctggtgtcatgcccaccggctgcttccctgtgtacttaaacatgctcgaggagccaaaagatgaatatggtgaacgcagcgggtgtatccgccggttcaacacattctcctgggtgcacaatgcacatctcaaggccatgcttgagaagctccgggctaagcaccccaatgtgaggatcatatatggtgattactacacgccagttatccagttcatgcttcagcctgaaaagttcggtttttacaagcaagtgcctagggcgtgttgtggggccccatcgactcctgagagagccatgtacaacttcaatgtcacggccaaatgtggtgagcctggtgcgaccgcatgtgctgatccgacaacccactggagctgggacggcattcacttgacggaggctgcctaccgccatatcgccaaaggctggctatatggcccttttgcggaccaaccaattgtccagtcatcatgagcatgcagctcctgttgtagagtatcaaagtagagcactgaaaaaatggagcggggaaagtagttcttccatacagttccaatgtttgcatacatgtacatctccatttgattgaattcattacggtgggggtacaaaggtgagatagggagggctgtctgtcaaaggcctcatttcttgatttgtcagagggtataaatatgaaaaatgtaacgcacacatgatcatgtatattgtgtcccggaaatgtgatacagactgtctgcttgagcagcttctgattctctgattaaatatgtgccagtcttggaattctcaaaaaaaaaaaaaaaaaaaa

SEQ ID NO: 3734 - protein, 381 aa, Panicum virgatum
  misc_feature: Ceres CLONE 1794362
  misc_feature (1)..(326): Pfam Name: Lipase_GDSL Pfam Description: GDSL-like Lipase/Acylhydrolase
MGGRVAMLAAVAVVLAAASAAGAAAESREAAAKGKYHALFNFGDSLADAGNLIQNGTPEILATARLPYGQTYFGKATGRCSDGRLVIDHLAQEFGLPLLPPSKAKNASFAHGANFAITGATALDTPYFVAKGLGDVIWNSGALMTQIQWFRDLKPFFCNTTQECKKFFAKALFVVGEFGGNDYNAPLFAGKGIPEAYKFMPDVIQGISDGVEALIAEGAVDLIVPGVMPTGCFPVYLNMLEEPKDEYGERSGCIRRFNTFSWVHNAHLKAMLEKLRAKHPNVRIIYGDYYTPVIQFMLQPEKFGFYKQVPRACCGAPSTPERAMYNFNVTAKCGEPGATACADPTTHWSWDGIHLTEAAYRHIAKGWLYGPFADQPIVQSS

SEQ ID NO: 3735 - DNA, 1200 bp, Panicum virgatum
  misc_feature: Ceres CLONE 1794364
  misc_feature: Encodes the peptide sequence at SEQ ID NO. 3736
ataccatttctacaattctactacagagagtacacagaattgtctattgacacttgcacaaacggacgtttgtcatcgcagcgttgatctagaccacatagtagccaagcatcagcgtagagagaggagatggcggcgttagcggcggcgggcggcggcggcgagaggtggagcctcgccggcgcgacggcgctggtcaccggcgggagcaaggggatcgggcacgccatcgtggaggagctggcgcggctcggcgcgcgcgtgcacacgtgctcccgcaacgcggcggagctggaggagtgccgccgccggtgggccgacaagggcctgcaggtcactgtctccgtctgcgacgtcgctgtgcgcgccaacagggcgaagctcatgggcacggtcggggacaccttcgccggcaagctcgatatcctagtgaacaacgcggcacaggtggtggccaagccggcggtggagtgcacggcggaggactactccggcctcatggcgaccaacctggagtcgtgcttccacctcagccagctcgcgcaccctctcctccggaactccgccatcgccggcgggggaagcatcgtgcacatctcctccatcgctagctatctgggctatccgggtgccgtgctctacagcatgtccaaaggaggaatgaaccagctaacaagaagcctggctgccgagtgggcccgcgacagcattcgtgtgaactgcatcgcaccaggcctggtcatgactgacatgatgacgaaagcgcaagacctgggagtcgtggagcaagaatttttaccgaaaattccattgcgccggacgggggagccggcggagatcgcatccgtggtggcgttcttgtgtatgccggcggcctcctacgtctccggccaagtcatctgcgtcgatggcggcagaaccataggtgcttgagctgttccatgggagtgacatgtgggcccacctaactcaggatgatgcggtttggatgatgatttgtccaaaagaaagattgatctttccttcctgtaaaagttgtgtctaaatgagcaccttttttttttttttttgccaaaagacatgctgctctccatgtccatgcagcatcagtatgaaaggtatttggatgctgtttgttcagattcagaagttgatatggttctccgcttcccacggaaataaaaaaaaaaaaaaaaaaaa

SEQ ID NO: 3736 - protein, 267 aa, Panicum virgatum
  misc_feature: Ceres CLONE 1794364
  misc_feature (1)..(171): Pfam Name: adh_short Pfam Description: short chain dehydrogenase
  misc_feature (13)..(262): SWISSPROT Homolog: EC 1.1.1.236 Tropinone reductase 2
  misc_feature (13)..(264): SWISSPROT Homolog: EC 1.1.1.206 Tropinone reductase 1
MAALAAAGGGGERWSLAGATALVTGGSKGIGHAIVEELARLGARVHTCSRNAAELEECRRRWADKGLQVTVSVCDVAVRANRAKLMGTVGDTFAGKLDILVNNAAQVVAKPAVECTAEDYSGLMATNLESCFHLSQLAHPLLRNSAIAGGGSIVHISSIASYLGYPGAVLYSMSKGGMNQLTRSLAAEWARDSIRVNCIAPGLVMTDMMTKAQDLGVVEQEFLPKIPLRRTGEPAEIASVVAFLCMPAASYVSGQVICVDGGRTIGA

SEQ ID NO: 3737 - DNA, 1867 bp, Panicum virgatum
  misc_feature: Ceres CLONE 1794382
  misc_feature: Encodes the peptide sequence at SEQ ID NO. 3738
tccccagagagacgcctcaacccaccccaccccacaagaacacgaagccacatccccatcccactccacccacggtgaggttgagcgatccgagcagatcatccgcgacgcagcaacaggtttgttctctgaactctctgattctttttagcagcagggacgcttgcacagcacaagaaaggtccggttcaagaaggctcttcctttgggtttattagaatcctcagaggaagtttgttcttgggtttggattttttctcacctcatcacacctctcctaggaggaacagagatccagagaaccttttttctcttctggattcttgccgcctttttggccttcgaaagagttattttgcaatacccttcttgttcaccaaaccttttttctttgcacaaacatcgctgtttctctacttttattgaggaacggcattgatttccaaaccttttttctactttgattttgcataaaaaagctccttttatttcttcccgttttcagttctcccaccccctgattcttcttctagctccatccaagcttctccatctagtcataatggccgcagccatagatatgtacaagtactacaacactagtgcacaccagatcgccacctcctcttcttcggatcaggagctcgcgaaagcactcgaaccttttataacgagtgcttcctcatcttcgtcttcctccccctaccactactactcgtcctcttccgccatcacccaaaattcttacttgcctacaccctcctacgtcaacttcgccacctcgcctcttcccaccaccgccgccacctcctcgtcgtctttctcgcagcttcctccactgtactcgtcgccgtacgctgctgcttcggcggcgtcgggcgtgactgggaccatgggcctgaaccagctcggcccggcccagatccagcagatccaggcccagctcatgatgcagcagcagcagaggggcctgtacctgggcccgcgggcgcagccgatgaagcagtccgggtcgccgcccctggcgccggcgcagtcgaagctataccgcggcgtgcggcagcgccactggggcaagtgggtggcggagatccgcctccccaagaaccgcacgcggctgtggctgggcaccttcgacaccgccgaggacgcggcgctcgcctacgacaaggcggcgttccggctccgcggggacatggcgcgcctcaacttcccagccctccgccgcggcggcgcgcacctggcaggcccgctccacgcctctgtggacgccaagctcacggccatctgccaatccctcgccgggtccaagagcggctcccccgacgccgagtcctcggccgcgtccccgccggactcgcccaagtgctcggcgtccacggagggggaggacgagtcggtctccgccggctccccgccttccccgacgcaggtgccgcccgtccctgagatggcgaagctggacttcacggaggcgccgtgggacgagacggaggccttccacctgcgcaagtacccgtcctgggagatcgactgggactccatcctctcgtgaagaatcaactacaactactatagtagtagtagtcagtcagctctgtgtaattttcatttgggttttgcagctgcggtggctcgatggcattttagacatcggccatggcggctgcaagtagcaatgagtaactagcagctagtaagtcgcccagtgttgtgatgatgtagcagtcagtacgtgttaatctcctggttgagctgccggttgttttttctcacggcacggccagtcgagaaggttaagtgtaatcccttgttatctgttgcagcttaatccatgtagcttatgtaaaaaaaaaaaaaaaaaaaa

SEQ ID NO: 3738 - protein, 330 aa, Panicum virgatum
  misc_feature: Ceres CLONE 1794382
  misc_feature (1)..(65): Pfam Name: AP2 Pfam Description: AP2 domain
  misc_feature: The sequence is a functional homolog of  SEQ ID NO 116 in the  11/479,226 US patent application
  misc_feature: The sequence is a functional homolog of  SEQ ID NO 1288 in the  10/374,780 US patent application
  misc_feature: The sequence is a functional homolog of  SEQ ID NO 1434 in the  10/412,699 US patent application
  misc_feature: The sequence is a functional homolog of  SEQ ID NO 1712 in the  10/412,699 US patent application
  misc_feature: The sequence is a functional homolog of  SEQ ID NO 1749 in the  11/479,226 US patent application
  misc_feature: The sequence is a functional homolog of  SEQ ID NO 179 in the  11/479,226 US patent application
  misc_feature: The sequence is a functional homolog of  SEQ ID NO 1948 in the  10/374,780 US patent application
  misc_feature: The sequence is a functional homolog of  SEQ ID NO 256 in the  11/375,241 US patent application
  misc_feature: The sequence is a functional homolog of  SEQ ID NO 6 in the  10/412,699 US patent application
  misc_feature: The sequence is a functional homolog of  SEQ ID NO 722 in the  10/225,066 US patent application
  misc_feature: The sequence is a functional homolog of  SEQ ID NO 906 in the  11/435,388 US patent application
  misc_feature: Useful for making plants with modulated growth and phenotype characteristics
MAAAIDMYKYYNTSAHQIATSSSSDQELAKALEPFITSASSSSSSSPYHYYSSSSAITQNSYLPTPSYVNFATSPLPTTAATSSSSFSQLPPLYSSPYAAASAASGVTGTMGLNQLGPAQIQQIQAQLMMQQQQRGLYLGPRAQPMKQSGSPPLAPAQSKLYRGVRQRHWGKWVAEIRLPKNRTRLWLGTFDTAEDAALAYDKAAFRLRGDMARLNFPALRRGGAHLAGPLHASVDAKLTAICQSLAGSKSGSPDAESSAASPPDSPKCSASTEGEDESVSAGSPPSPTQVPPVPEMAKLDFTEAPWDETEAFHLRKYPSWEIDWDSILS

SEQ ID NO: 3739 - DNA, 2407 bp, Panicum virgatum
  misc_feature: Ceres CLONE 1794384
  misc_feature: Encodes the peptide sequence at SEQ ID NO. 3740
atcccaacaactcgagaacagagcaaagcatcaatcgattgatcgcaagcgaaccggcagcgaggagcagctctcgatttcgaatcgcgatcggagaaggggaggaggtaggagagatggcgagcaagaacggcggcggcaagggggagggcccggcgatcggcatcgacctcggcaccacctactcgtgcgtcggggtgtggcagcatgatcgggtggagatcatcgccaacgaccagggcaaccgcaccacgccctcctacgtgaccttcaccgacaccgagaggctcatcggcgacgccgccaagaaccaggtcgccatgaaccccaccaacaccgtcttcgatgccaagcggctcatcggcaggcgcttctcggacccgtccgtgcaggcggacatgaagatgtggccgttcaaggtcgtccccggacccgccgacaagcccatgatcgtggtcacctacaagggcgaggagaagaagttctcggccgaggagatctcctccatggtgctcaccaaaatgaaggagatcgccgaggcctacctcagcaccaccatcaagaacgccgtcatcaccgtgccggcctacttcaacgactcccagcgccagaccaccaaggacgccggcgtcatcgcgggcctcaacgtcatgcgcatcatcaacgagcccacggccgccgccatcgcctacgggttggacaagaaggccgccagctccggcgagaagaacgtgctcatcttcgacctcggcggcggcaccttcgatgtctccatcctcaccatcgaggagggcatcttcgaggtcaaggccacggccggcgacacccacctgggaggcgaggacttcgacaaccgcctcgtcaaccacttcgtgcaggagttcaagaggaagcacaagaaggacatcagcggcaacccgagggcgctccggcgtctgaggacggcctgcgagagggccaagaggacgctctcctccaccgcccagaccaccatcgagatcgactccctctacgagggcatcgacttctacgcgaccatcactcgggccaggttcgaggagctgaacatggacctcttcaggaagtgcatggagcccgtggagaagtgcctccgcgacgccaagatggacaagtcgcagatccacgacgtcgtgctcgtcggaggctccacccgtatccccaaggtgcagcagctgctgcaggacttcttcaacggcaaggagctctgcaagagcatcaaccccgacgaggccgtcgcgtacggcgccgctgtccaggccgccatcctcagcggcgagggcaaccagaaggtgcaggacctgctcctgctcgacgtcacgccgctctcgctcgggctggagacggctggtggcgtcatgaccgtgctgatcccgaggaacaccaccatcccgaccaagaaggagcaggtcttctccacctactccgacaaccagcccggcgtgctcatccaggtgtacgagggtgagcgcactcggaccaaggacaacaacctgctcggcaagttcgagctgaccggcatccccccggcgccgaggggcgtgccccagatcaacgtgaccttcgacatcgacgcgaacggcatcctgaacgtgtcggcggaggacaagacgacggggaagaagaacaagatcaccatcaccaacgacaagggccggctgagcaaggaggagatcgagcgcatggtgcaggaggccgagaagtacaagtcggaggacgaagaggtgaagcgcaaggtggaggcccggaacgcgctggagaactacgcgtacaacatgcgcaacacggtgcgggacgagaagatcgcgtcgaagctgcccgcggaggacaggaagaagatcgaggacacgatcgaggacgccatcaagtggctggacggcaaccagctcgccgaggccgaggagttcgaggacaaggtgaaggagctggagggcatctgcaaccccatcatctccaagatgtaccagggtgcgggcggcgccgcgggcatggacgaggacgcgcccagcggcggcgccggcaccggcggtggcaacggcgccgggcccaagattgaggaagtggactaagcgagtcgtgacaggtcctgagctggaagtgaagtgatgttgtttgtgcctgcaggttccggggactttgctcgagtgtcctgcctgcgtcatggcgtcttaatccgtctgtggaataatgtggtgttaataggatgttccaaatcttatgtgtcagggtggtgttaggttcagtagagtgaaacgtgtgttaagtagactaaataatccgtaagataagaacatcttacgcatgttcttgtaatcgtctctgcttgagttcaggagtcgatatatatatatcgaagtattgtatttttcaaaaaaaaaaaaaaaaaaaa

SEQ ID NO: 3740 - protein, 656 aa, Panicum virgatum
  misc_feature: Ceres CLONE 1794384
  misc_feature: Great-hit functional homolog of the protein sequence given in SEQ ID NO 9677
  misc_feature (1)..(606): Pfam Name: HSP70 Pfam Description: Hsp70 protein
  misc_feature (1)..(607): Pfam Name: HSP70 Pfam Description: Hsp70 protein
  misc_feature (1)..(607): Pfam Name: HSP70 Pfam Description: Hsp70 protein
  misc_feature (1)..(610): Pfam Name: HSP70 Pfam Description: Hsp70 protein
  misc_feature (1)..(513): Pfam Name: HSP70 Pfam Description: Hsp70 protein
  misc_feature (1)..(607): Pfam Name: HSP70 Pfam Description: Hsp70 protein
  misc_feature (1)..(529): Pfam Name: HSP70 Pfam Description: Hsp70 protein
  misc_feature (1)..(609): Pfam Name: HSP70 Pfam Description: Hsp70 protein
  misc_feature (1)..(607): Pfam Name: HSP70 Pfam Description: Hsp70 protein
  misc_feature (1)..(611): Pfam Name: HSP70 Pfam Description: Hsp70 protein
  misc_feature: Useful for making plants with modulated drought sensitivity
  misc_feature: Useful for making plants with modulated heat sensitivity
MASKNGGGKGEGPAIGIDLGTTYSCVGVWQHDRVEIIANDQGNRTTPSYVTFTDTERLIGDAAKNQVAMNPTNTVFDAKRLIGRRFSDPSVQADMKMWPFKVVPGPADKPMIVVTYKGEEKKFSAEEISSMVLTKMKEIAEAYLSTTIKNAVITVPAYFNDSQRQTTKDAGVIAGLNVMRIINEPTAAAIAYGLDKKAASSGEKNVLIFDLGGGTFDVSILTIEEGIFEVKATAGDTHLGGEDFDNRLVNHFVQEFKRKHKKDISGNPRALRRLRTACERAKRTLSSTAQTTIEIDSLYEGIDFYATITRARFEELNMDLFRKCMEPVEKCLRDAKMDKSQIHDVVLVGGSTRIPKVQQLLQDFFNGKELCKSINPDEAVAYGAAVQAAILSGEGNQKVQDLLLLDVTPLSLGLETAGGVMTVLIPRNTTIPTKKEQVFSTYSDNQPGVLIQVYEGERTRTKDNNLLGKFELTGIPPAPRGVPQINVTFDIDANGILNVSAEDKTTGKKNKITITNDKGRLSKEEIERMVQEAEKYKSEDEEVKRKVEARNALENYAYNMRNTVRDEKIASKLPAEDRKKIEDTIEDAIKWLDGNQLAEAEEFEDKVKELEGICNPIISKMYQGAGGAAGMDEDAPSGGAGTGGGNGAGPKIEEVD

SEQ ID NO: 3741 - DNA, 1630 bp, Panicum virgatum
  misc_feature: Ceres CLONE 1794396
  misc_feature: Encodes the peptide sequence at SEQ ID NO. 3742
attttggaccacagaaatcgaccggtctccctcttgtgtcttgtcccacacctcctcctctcgtaacgcgacagcgacggatacggcagcggcggcggcggcggcggcgagatacttccattggactctaggatttaaagaaataaagcatgcttatgctttcaaccttctcttggagtatattaatcatcttggaataaaggaggaaacctcttgacttgcggtgtaagcctgcgcgccagcgaggccggatcccgtggcttgtttgcaacctcctccatggctccatccagctggtgaccggagcgccgctgccccgaaccccacaaaaataagttgttgcttgcgttccatcacccaaccacctcccctgctctgctctttatatagagtatcccgtcgccggcgccagctacccatgtcacacgacacggctgcgcgccaccccgtcgcaaccccgcaagaagcaggaggagaggaaggaggagaccacccctccggcggccgggccagcttcgagttgggcggcgagtgccggttctgcgagatgacgcggcagcaccacccgcagtgcgcgcgccggctgcccaagcggatcatcctggtccggcacggcgagagccaggggaacctcgacatgtcggcgtacaccaccacccccgactaccgcatcccgctcacggcgctgggcgccgagcaggcgcgcgccgccggccggggcatccgcgacgtcgtggcgtcgggcggcggcaactggaaggtctacttctacgtgtccccctacgcgcgcacccgcgccacgttgcgggagatcggccgcgccttcccgcgggaccgcatcatcggcgcccgcgaggagtgccgcgtccgggagcaggacttcggcaacttccaggtcgaggagcggatgcgctccgtcaaggagacccgccagcggttcggccgcttcttcttccggttccccgagggcgagtccgccgccgacgtcttcgaccgcgtcgccagcttcctggagtcgctgtggcgggacatcgacatggggcggctggatcaggacgcgagctgcgagaccaacctggtgatcgtgtcgcacgggctcacctcgcgggtgttcctcatgaagtggttcaagtggacggtggaccagttcgagcgcctcaacaacttcgaaaactgcgagttcagggtgatgcagctggggcccggcggcgagtactccctcctcgtccaccacaccaaggaggagctcgagcagtggggcatgtcgcgggagatgatcgccgaccagcagtggcgcgcctccgccaaccgacgcagctgggcccaggagtgctcctccttcatcgactccttcttcgatgaccccaaggattcagagagctcgtccgaggaagaagaaaaggagaatggcaagatcaaggaactggagtaatcgactctgctctgccccctggttcgctcaaatcttttcaatttgatgataatttctagtagattctatactatggagtggtggcctagtgagtcattgctgattgctcatttttctttccccaatttgtaatctgttcatagtagctagagattggaatgagcggagagaaattcagaaaaaaaaaaaaaaaaaaaa

SEQ ID NO: 3742 - protein, 337 aa, Panicum virgatum
  misc_feature: Ceres CLONE 1794396
  misc_feature (1)..(173): Pfam Name: PGAM Pfam Description: Phosphoglycerate mutase family
MSHDTAARHPVATPQEAGGEEGGDHPSGGRASFELGGECRFCEMTRQHHPQCARRLPKRIILVRHGESQGNLDMSAYTTTPDYRIPLTALGAEQARAAGRGIRDVVASGGGNWKVYFYVSPYARTRATLREIGRAFPRDRIIGAREECRVREQDFGNFQVEERMRSVKETRQRFGRFFFRFPEGESAADVFDRVASFLESLWRDIDMGRLDQDASCETNLVIVSHGLTSRVFLMKWFKWTVDQFERLNNFENCEFRVMQLGPGGEYSLLVHHTKEELEQWGMSREMIADQQWRASANRRSWAQECSSFIDSFFDDPKDSESSSEEEEKENGKIKELE

SEQ ID NO: 3743 - DNA, 1687 bp, Panicum virgatum
  misc_feature: Ceres CLONE 1794397
  misc_feature: Encodes the peptide sequence at SEQ ID NO. 3744
aaaccccctccccctcgtccgcgtcgtcgcttctctgtatcgggttccgctcctcatggccgggctcgccgctggcctgggagcgcgcccctccgccgccttcgaggctagctgcttccggccactagcttcccccgtccgctccgggagattgatagtgccaaagcgatgcttcactgtgtcaagtaggctgacgtgggtggaagatgagctcatggaaataagaaagtcacaagagcaaagttcagcgaaatcaaagaaaaggccacctttgaggcgtgggaaggtctccccacaacttcctgtaccagagcacattccaaggccatcgtatgttggttcaaaagggctgccagaactatgcaagggtcaactgcacgatgctcaaggaattgctggaatgagagctgcttgcaaacttgctgcccgtattcttgactttgctgggactttagttaagccatcagttaccacaaatgaaatcgacactgcagtgcataatatgatcattttggctggtgcttatccttctccacttggctatcgtggattccctaaaagtatatgtacatcagtaaatgagtgtgtctgccatgaaatacctgattcaacacagctgcagactggggacattataaatattgatgtaaatgtgttcttgaatggataccatggtggtacctccagaacatttgcatgtggacaggtggatgattctatcaagcattttttgaaggcagctgaagaatgcttggagaagagcatttctgtctgcagggatggtgtgaactacagaaaaattggcaagaaaataagcaagcttgcttatttttatggctattatgtggtggagcgctttgttgggcatggaattggaactatgtatcattctgagcctcttatccttcatcatgcaaacgaaaactcagggcggatggttaagggtcaaatatttacaattgaacctatacttacgatggagaaaacagagtgtgttacatgggaagatggatggacgactgtcaccgctgatggtagctgggctgctcagtttgagcataccatattggtcacaaggaatggcgcagaaatactgacaaaactttgagtttatctcctgctgatcctagtcagaagtgacgatgagatggttatgcagcagcatcaccctccagcctaatatctgaaatatctactaaaatgttctagatgtgtttgtaggcccacatatggcaaggttttcccctatgtagcaaccgggcaagagatgtggggcgcacaactgcatctgtttgttattgctgttcacctgctggctgctgtagtaatattgcagggtggaagtcctgtctgacacattcatcactaatgaagcttctagaaaattgctgtatatgaaattagctgtagttcagtttgttacaagtacgctacctatcttagcaagttgcaaccttggtcgcaatggtttccttcggcctggatctgcggttgtagaatctgttgcgttacactgtctgataactcaagctgcgccatgcaccacataagatggctggttgaactgtcgaaatgcaggctgaactcttgaaagttgaagaacttccagagaaaaggttttgtatttcagagacttctttttcaattatcggtgtctttgcccctttaaaaaaaaaaaaaaaaaaaa

SEQ ID NO: 3744 - protein, 350 aa, Panicum virgatum
  misc_feature: Ceres CLONE 1794397
  misc_feature (1)..(236): Pfam Name: Peptidase_M24 Pfam Description: metallopeptidase family M24
  misc_feature (20)..(349): SWISSPROT Homolog: EC 3.4.11.18 Methionine aminopeptidase 1B, chloroplast precursor
  misc_feature (54)..(348): SWISSPROT Homolog: EC 3.4.11.18 Methionine aminopeptidase 1C, chloroplast/mitochondrial precursor
MAGLAAGLGARPSAAFEASCFRPLASPVRSGRLIVPKRCFTVSSRLTWVEDELMEIRKSQEQSSAKSKKRPPLRRGKVSPQLPVPEHIPRPSYVGSKGLPELCKGQLHDAQGIAGMRAACKLAARILDFAGTLVKPSVTTNEIDTAVHNMIILAGAYPSPLGYRGFPKSICTSVNECVCHEIPDSTQLQTGDIINIDVNVFLNGYHGGTSRTFACGQVDDSIKHFLKAAEECLEKSISVCRDGVNYRKIGKKISKLAYFYGYYVVERFVGHGIGTMYHSEPLILHHANENSGRMVKGQIFTIEPILTMEKTECVTWEDGWTTVTADGSWAAQFEHTILVTRNGAEILTKL

SEQ ID NO: 3745 - DNA, 2041 bp, Panicum virgatum
  misc_feature: Ceres CLONE 1794398
  misc_feature: Encodes the peptide sequence at SEQ ID NO. 3746
gtctcgcaccgtcgcggccacccacatcagcctctcgagggccggaccccttcgttcttccgagcgcagtcgatccgtcgtcggctccgcctcctccgatcgccgatccgttcctaggtgtgcctcagctatgcagttcagcagtgtgtttcccctggagggaaaagcatgtgtgagtccagtgaggagggaaggttctgggagtgagagggtgaggattggggattacagcagcaccaggcagaacagggcattaaggaggatgtgttttggtgctaggggcaccacaaatagcgctcaatgtgtgctcacttcagatgctggcccagacactcttgttgtccaaacatccttcagaaggaatcatgctgatccaaacgaagttgccgctgtcatactgggtggtggtactgggactcagcttttccctctcacaagcacaagggccactcctgctgttcctatcggaggatgttacaggcttattgatatccccatgagcaactgtttcaacagtggcataaacaagatattcgttatgactcagttcaactcaacttctcttaaccgtcacattcaccgcacataccttggtgggggaatcaacttcactgatggatctgttgaggtgctggctgcaacgcaaatgcctggggaggctgctggttggttccagggcacagcagatgctgttagaaaatttatctgggtacttgaggattattacaagcacaaagctatcgaacacattttgattttgtcaggagatcaactctaccgtatggattacatggagcttgtgcagaagcatgtagatgacaatgcagacattactttatcatgcgctcctgttgaagagagccgcgcttctgactatgggctagttaagttcgacagttcaggccgtgtaattcaattctctgagaaaccaaagggcgctgacttggaagaaatgaaagtggataccagctttctcaattttgccattgatgacccaactaaatatccctatattgcttcaatgggagtttacgtgttcaaaagagatgttcttctaaaccttctaaagtcgaggtatgctcaactgcatgactttggttctgaaattctgcccaaagctttacatgagcacaatgtgaaggcatatgtcttcactgactactgggaggacattggaacaatcagatcattctttgacgcaaacatggccctctgcgagcagcctccaaagtttgagttttatgatccgaaaactcccttcttcacttcacctcggtacttgccgccaacgaagtcggataaatgcaggattaaagacgcgatcatttcccacggctgcttcttgcgtgaatgtaccattgagcattctattgtcggtgttcgttcgcgcttaaactctggatttgagctcaagaatactatgatgatgggtgcagatttgtacgagaccgaagacgagatttcgaggctactgtcagagggcaaggtccccattggcgtaggggagaacacaaagataagcaactgcatcatcgatatgaacgctagggttggaaggaacgtttccatcacaaacagtgagggcgtccaagaagctgaccggccggaggaaggatactacatcagatccgggatcgtggtgatcctgaagaactcaaccatcaaggacgggaccgtcatatagaggccaccctgggtacaaagtttggccatcgtcatgggaatttggggtgtgtgaccttgacttcagatgaggaacaagtacagatcaaggaagatcggttagagctggccagattgatgatcaagagaaagatgttgcggtagtatcggcactggtcgttcttcctcggttacatgtcgtagcaacgcaaaataagctggccgagtaaaggtgcagcaacttttggggaatcggatcgttggtgcatcgtgtaaataaactcggacgcaatacttggaattttcctgtcatcttcccatgtctgtgactctgttcatccatattctctgaacctttcaaaaaaaaaaaaaaaaaaaa

SEQ ID NO: 3746 - protein, 517 aa, Panicum virgatum
  misc_feature: Ceres CLONE 1794398
  misc_feature (1)..(280): Pfam Name: NTP_transferase Pfam Description: Nucleotidyl transferase
  misc_feature (1)..(517): SWISSPROT Homolog: EC 2.7.7.27 Glucose-1-phosphate adenylyltransferase large subunit 1, chloroplast precursor
  misc_feature (1)..(517): SWISSPROT Homolog: EC 2.7.7.27 Glucose-1-phosphate adenylyltransferase large subunit, chloroplast precursor
MQFSSVFPLEGKACVSPVRREGSGSERVRIGDYSSTRQNRALRRMCFGARGTTNSAQCVLTSDAGPDTLVVQTSFRRNHADPNEVAAVILGGGTGTQLFPLTSTRATPAVPIGGCYRLIDIPMSNCFNSGINKIFVMTQFNSTSLNRHIHRTYLGGGINFTDGSVEVLAATQMPGEAAGWFQGTADAVRKFIWVLEDYYKHKAIEHILILSGDQLYRMDYMELVQKHVDDNADITLSCAPVEESRASDYGLVKFDSSGRVIQFSEKPKGADLEEMKVDTSFLNFAIDDPTKYPYIASMGVYVFKRDVLLNLLKSRYAQLHDFGSEILPKALHEHNVKAYVFTDYWEDIGTIRSFFDANMALCEQPPKFEFYDPKTPFFTSPRYLPPTKSDKCRIKDAIISHGCFLRECTIEHSIVGVRSRLNSGFELKNTMMMGADLYETEDEISRLLSEGKVPIGVGENTKISNCIIDMNARVGRNVSITNSEGVQEADRPEEGYYIRSGIVVILKNSTIKDGTVI

SEQ ID NO: 3747 - DNA, 2118 bp, Panicum virgatum
  misc_feature: Ceres CLONE 1794410
  misc_feature: Encodes the peptide sequence at SEQ ID NO. 3748
actcacctcagcgccgcctttgccgtcttgctctgcctctccgcggcgcagcagagcaatggcgctcccacggcgcgccctcctcgtcgccgggatgctcgccgcagcgctgccgctcctcctccttcgcccggcagaggcggggactgtgggcgtgaactacggccgggtggcgaacaacctgccgaacccggcggcggtggtgcagctgctcaagcagcagggaatcacgcaggtgaagctctacgacaccgaccccaccgtgctgcgcgcgctcgccaacaccggcatcaaggtggtggtcgcgctgcccaacgagcagctcgccgccgcggcgtcgcgcgcctcctacgcgctcctctgggtgcgccggaacgtggcggcctactacccggccacgcagatccagggcatcgccgtggggaacgaggtcttcgccaccgccaagaacgtcacggcgcagctcgtgccggccatggtcaacgtgcacgctgcgctggcccggctcaacctcgacaaggccgtcaaggtgtcgtcccccatcgcgctcaccgcgctcgcgacgtcgtacccgtcctcggccggcgcgttccgggaggacctcgcgcagcccgtgatgaagcccctgctcgacttcctggcgcagaccggctcctacctcatggtcaatgcctacccgttcttcgcctactccggcaatgcgggcgacatctccctcgactacgctctgttccgccccaatgacggcgtgcaagaccccgggaacggcctcaagtactacaacctcctcgacgcccagctcgacgccgtcttcgcggcggtgagcaggctagggaactacaatggcgtgcgcgtggtggtctccgagacggggtggccgtccaagggtgacgccagcgaggtaggcgcctcggctgccaacgccgcggcgtacaacggcaacctggcgcgccgcgtgctctccggcaacgccggcacgccgcgccgtccggacgccgacatcgacgtgtacctcttcgcgctcttcaacgagaaccagaagcccggcccgacatccgaacgcaactacggcgtgttctacccgaaccagcagaaggtgtacgacgtcgagttcgtcctcggcggcggcggcggcgcggcgggcggcggcagccagggcagcggcggcctcggctggcagaagaacggcggcccagccagcggcaacccgcccagcggggtcaaggtcacgacgggggaggcgtggtgcgtggcgaacgcgatggtcggggagcagcggctgcaggcggcgctcaactacgcgtgcggcgagggcggcgcggactgcaaggccatccagcccggcgcggcgtgcttcgagcccaacaccatggtggcgcacgcctcctacgccttcaacgactactaccagcgcaagggccggtccatcggcacctgcgacttcgccggcgccgcccacgtcgtcaaccagtcaccgaagatgggcaagtgcgacctcccatcgacggtctgaactctgaagaactgaaacaacagtggcgaggattccaggccggccagcagccatcggcggatgttggaatctttgcgccctttcaccctttctttactctgctgcagccttgactagtagaaaaccaacaccgctgtagcagtacgcctttcttttttgcagccttggctgatggggggtacctttgtttagtctactatgtaactatgctactgttataagctgattagtataggttaattaatggcttagcctttgctcccatgttatgtgacccactagggtttgtctcggccctcgagtgatctgtttgactcctgctccatcactgtctgagaatatttgtgccggaaatggtgcttagcttagcgtggacgacagtgtacactaggtaggtagcactcgagtagagaaacccatgatagtgggtgcggcgtctcccgtgcggcgtcagtgtttggccttttattagcaccaccccctactcctgaaaaactttaattagctaactgtctagtagttgtagtttggcgagcatcttgactacaacaccatgggaatgagaattggaaagtctttaaggtaaaaaaaaaaaaaaaaaaaaa

SEQ ID NO: 3748 - protein, 484 aa, Panicum virgatum
  misc_feature: Ceres CLONE 1794410
  misc_feature: Great-hit functional homolog of the protein sequence encoded by LOCUS At2g05790
  misc_feature (1)..(322): Pfam Name: Glyco_hydro_17 Pfam Description: Glycosyl hydrolases family 17
  misc_feature: Useful for making plants with altered cell wall content and/or composition
MALPRRALLVAGMLAAALPLLLLRPAEAGTVGVNYGRVANNLPNPAAVVQLLKQQGITQVKLYDTDPTVLRALANTGIKVVVALPNEQLAAAASRASYALLWVRRNVAAYYPATQIQGIAVGNEVFATAKNVTAQLVPAMVNVHAALARLNLDKAVKVSSPIALTALATSYPSSAGAFREDLAQPVMKPLLDFLAQTGSYLMVNAYPFFAYSGNAGDISLDYALFRPNDGVQDPGNGLKYYNLLDAQLDAVFAAVSRLGNYNGVRVVVSETGWPSKGDASEVGASAANAAAYNGNLARRVLSGNAGTPRRPDADIDVYLFALFNENQKPGPTSERNYGVFYPNQQKVYDVEFVLGGGGGAAGGGSQGSGGLGWQKNGGPASGNPPSGVKVTTGEAWCVANAMVGEQRLQAALNYACGEGGADCKAIQPGAACFEPNTMVAHASYAFNDYYQRKGRSIGTCDFAGAAHVVNQSPKMGKCDLPSTV

SEQ ID NO: 3749 - DNA, 2768 bp, Panicum virgatum
  misc_feature: Ceres CLONE 1794494
  misc_feature: Encodes the peptide sequence at SEQ ID NO. 3750
tactcatcttctcgcccataattttccccaaatccctaacttccccaatcctcaaaatttcctcaaactctgaatttcccctaaatcaaagttcactgtcggatctctcggatcgccaccacgagcagaggaatttcgtgatacatgtgctacgaatgccatggaggaggaggtgcgtggagagttgaatccactacttcaaactatagagtttgctccttcaacatctgatccaaatcaaaagcttgatttggtgcagccttccgatcccaatcagaaacctgcgaaaaagccaactcgtcaatgggctgcgtggacgcggcaggaagaggagaatttcttcaatgctctgcgtcaagttggaaaaaattttgagaagattacacaccgtgttcagagtaaaaacaaggatcaggtcaggcattactactatcgtcttgttcggcgcatgaagaaactactgggtcctggattcttacttgatgcaaaaaactccaaggataccattgctgctatgctccgttggtggtctctgctcgaaaaatttaactgcagtgcatcgaagctgcatctgaagcctcggagattcaaaacatttgtagaagcattggtaaatcaactgcaaaaggacagaaataagtctagacgaaagtgtccaagagtggatatgtgcatatcttctccatctccaattgtcagcaagtgtcctgggaatgagtctttccctgtaaaattcttgccagttgaagctcaaaatggtagcagagtggcatctcctaaaggggcatttttcaagcggatgccagaaacaaattgtagcaagtcaggagcgactaaaggagacctctctgccacaagaaccgtgaaacaaaaaaggagggcaggtggtgttgttgcatctgctgcatacaaaaaatgggagagagcagccatggcaggtgtttctttagttgctgatgcagctgaggagcttgaacgcaacgccattaatcctgacgtgttatgtaatgttgatgcaagaacactggcatcttcatcagacaaactttctactgttgatggcattagcacaaaccagatgaaggaagcagattcacaagcacctgcgaagctgaagctgcagttatttccaataaatgaagctacacggaaggcattggagaaggatgaacataatccacatctggagctcacattaagttctaggaagaaaatatcatctgtgctagaacacctgaaccgcaaatggggtaactcaaacatcgcatctggagagcttattctttttccatattgtgctcatcaagaggatttagctacatatcagagttggacaacaagagatactgttgcagtagctgatgtgtttctttctgtgaatagcccttctgttttccgtttaaggtatggttggttttcccttgttgagcttgaagcaggagtaagtgaaatatctttaacccattttgagaactgcatgataccggaagacatccaggtcaaatcgccctcaggagataaggcttgtgtgcaaaagggtggtactttgctcagtaacagtattcttgagcaatatccttgtagttcaaaagatcagtcagcactattgcatactaccccatcttgtacaggcaaaaacacagagcttccagagcagcccaccagtgcacccccctctcagtttggcagccagaagcaagtgcaggctcctgtaactcaagcttttgaggatgatcaaggaatgaattgtgctgcaatatccgaagaagagtgggcagatacccttactgatatcagtgttgggtacttattgactgaaacatccaagggtgctcatttggactgtataggaacttctagcataaaaaatgatttgttccttgagaatccgtgcagctatgactcgtttgatgctgctgttgcccttcatgtctctcgttttcaagcatcagagcagccagcccatactccccattcaaccatctggggagcagaagaaacatgtgatgggttcagttttaatttgtcagcctccaggaatcaagaaggctcaaacactccatctagcagctctcctgatactgacaatgaagctcatccattacattcagaagggtttaaaggttttcttcaggacttgactgaaggagaggctgctggtgataatccttataatgatgatgccaaaggcagggaggagttgtgtgctaaatcaccacctcgaaatgaagacactaatgaattgaaggatcagtctctagctgacatatattggcctgattcactcggaccactggacttggacataccgtccgtgagatatcaagccgatgacctactcataggggacagtcaaaatagttggaatcgcatgatggcaaatagtcttgatgcattccggaacctgtcgttcttctcctcggtggataagaacgactcgattccatcgatcatgtagaactggtgtttagggttccatcacaacttgctgccttgggtggtaaggaaccgccggtgctgcatttcgctgaagagggagctttatattgtccaagcgagctgtgcgctgctgatccaagtatccaacagatgcggactcgctgcattggagagggacgcatatgttgttgtaacttgtaagataacataatggatgtgctaacctgtgttttccatgtaaattgtggtgatcttgtacaaaagcacatacaagcgcttggttacaataaagcttctcctgcagtgtataaaaaaaaaaaaaaaaaaaa

SEQ ID NO: 3750 - protein, 765 aa, Panicum virgatum
  misc_feature: Ceres CLONE 1794494
  misc_feature (1)..(46): Pfam Name: Myb_DNA-binding Pfam Description: Myb-like DNA-binding domain
MEEEVRGELNPLLQTIEFAPSTSDPNQKLDLVQPSDPNQKPAKKPTRQWAAWTRQEEENFFNALRQVGKNFEKITHRVQSKNKDQVRHYYYRLVRRMKKLLGPGFLLDAKNSKDTIAAMLRWWSLLEKFNCSASKLHLKPRRFKTFVEALVNQLQKDRNKSRRKCPRVDMCISSPSPIVSKCPGNESFPVKFLPVEAQNGSRVASPKGAFFKRMPETNCSKSGATKGDLSATRTVKQKRRAGGVVASAAYKKWERAAMAGVSLVADAAEELERNAINPDVLCNVDARTLASSSDKLSTVDGISTNQMKEADSQAPAKLKLQLFPINEATRKALEKDEHNPHLELTLSSRKKISSVLEHLNRKWGNSNIASGELILFPYCAHQEDLATYQSWTTRDTVAVADVFLSVNSPSVFRLRYGWFSLVELEAGVSEISLTHFENCMIPEDIQVKSPSGDKACVQKGGTLLSNSILEQYPCSSKDQSALLHTTPSCTGKNTELPEQPTSAPPSQFGSQKQVQAPVTQAFEDDQGMNCAAISEEEWADTLTDISVGYLLTETSKGAHLDCIGTSSIKNDLFLENPCSYDSFDAAVALHVSRFQASEQPAHTPHSTIWGAEETCDGFSFNLSASRNQEGSNTPSSSSPDTDNEAHPLHSEGFKGFLQDLTEGEAAGDNPYNDDAKGREELCAKSPPRNEDTNELKDQSLADIYWPDSLGPLDLDIPSVRYQADDLLIGDSQNSWNRMMANSLDAFRNLSFFSSVDKNDSIPSIM

SEQ ID NO: 3751 - DNA, 1652 bp, Panicum virgatum
  misc_feature: Ceres CLONE 1794512
  misc_feature: Encodes the peptide sequence at SEQ ID NO. 3752
atcctcctccgattttctccccaagattcttcccgtgcacgtctccagtccccgaattggctcttccatccgccaaaaatccgccgtgcctcgccgtcagcgacctcaccgccggcgaagggatacaccaccagacacggccgcaccaacccgaagtcttctctcgtcgggaggcgcggtcacctcctagcccgtctccgcctcctactggtgctgcactggcgtggaccggggactggagatccatccgggctcggattgcctctctcgctggtacatttgggagaatgggggtttaccttagcactccaaaaactgagaagctatctgaagatggtgaaaatgataagcttaaattcggcctttcatctatgcaaggatggcgtgcaactatggaagatgctcactcggctttgctagatcttgataacgatactgccttctttggcgtttttgatggacatggaggaaaagtagttgccaagttctgtgcaaaatatctacacagagaagttctaaacactgaagcctatgcagctggtgacctgggtgctgctgtccacagagctttcttcagaatggatgagatgatgcaaggtcaaagaggatggcgggaacttcaagcacttggagataagataaatcagtttactggcataatagaaggcctgatttggtcccctaaaggaagtgattcaaacgatagacataatgattgggcttttgaggaggggccacattctgattttactgggccaaattgtgggagtacagcctgtgtagcattaatcaggaataggcaactcattgtggcaaatgctggtgattcacgctgtgtcatctcaaggaatggccaggcatacagtttgtccagagaccataaaccagagcttgatgcagagagagaaaggatacaaaatgcagggggttacatccaaatggggcgtgtaaatggaactttaaacttgtcaagggctattggagacatggaatttaaacaaaacaagttcttgacccctgataagcaaattttgacctcaaatcctgacataaacattgtggagctttgtgatgatgatgactttcttgttttggcgtgtgatggcatttgggactgcatgtcaaaccaacagttggttgatttcatccatgagcatataaacacagaggaaagactttccgcagtatgtgaaagagtgcttgatagatgcctggctccatcgaccatgggcggtgagggatgcgataacatgacgatgatcctggtgcagttcaagaagccgattactccgaacaaggacgagggtggtgcagaacagtcagctggagacacagaacgctctgagacacatgcggccgaggagaatggctcgtgatgaacaggtatagtgaggaaatggctcttgaagcataggcctgatgctggacctggccgaagcaggtgtacaatgttgcaatgtacataccaaccatgtgtcgaattggcgtgaacgctattctttgccccattgttgtctctttgtctgtaaccctacttgctgttgtcgtccggttgttattttggccatctgacatcacctaactgtacatttgtgggtggaatggtgttgcaatagctcattttctttggtcaaaaaaaaaaaaaaaaaaaa

SEQ ID NO: 3752 - protein, 362 aa, Panicum virgatum
  misc_feature: Ceres CLONE 1794512
  misc_feature (1)..(301): Pfam Name: PP2C Pfam Description: Protein phosphatase 2C
  misc_feature (156)..(362): SWISSPROT Homolog: EC 3.1.3.16 Protein phosphatase 2C isoform gamma
MGVYLSTPKTEKLSEDGENDKLKFGLSSMQGWRATMEDAHSALLDLDNDTAFFGVFDGHGGKVVAKFCAKYLHREVLNTEAYAAGDLGAAVHRAFFRMDEMMQGQRGWRELQALGDKINQFTGIIEGLIWSPKGSDSNDRHNDWAFEEGPHSDFTGPNCGSTACVALIRNRQLIVANAGDSRCVISRNGQAYSLSRDHKPELDAERERIQNAGGYIQMGRVNGTLNLSRAIGDMEFKQNKFLTPDKQILTSNPDINIVELCDDDDFLVLACDGIWDCMSNQQLVDFIHEHINTEERLSAVCERVLDRCLAPSTMGGEGCDNMTMILVQFKKPITPNKDEGGAEQSAGDTERSETHAAEENGS

SEQ ID NO: 3753 - DNA, 1650 bp, Panicum virgatum
  misc_feature: Ceres CLONE 1794513
  misc_feature: Encodes the peptide sequence at SEQ ID NO. 3754
acgctacgccaccggtcaccccctcccccctccgcctcctaaccctagaatcttcgagaagcacccggcgaggagcgcgccgccgcggcgcttctggaagcttctggaaggaggggagagagagagagagagagagagagagagagagagagagagagagaggggagggccccgcagcggcggcggcggagatgggggcgtcggatctggaccggcagatcgagcagctgaagcggtgcgagccgctcacggaggcggaggtcaaggcgctctgcctcaaggccatggagatcctcgtcgaggagagcaacgtccagcgcgtcgatgcccccgtcaccatttgtggagatatccatggacaattctatgacatgaaagagctcttcaaggttggaggtgattgcccaaagacaaactatctgttccttggggattttgttgaccgaggattctattctgttgaaacatttttgcttcttttggctttaaaggttaggtatccggatcgtataactttaatacgaggaaaccatgagagcaggcagatcacacaggtttatggtttttatgatgagtgccttcgcaaatatggctcagtcaatgtctggagatattgcacagatatattcgactatttaagtttgtctgcgcttatcgaaaacaaaatatttagtgtccatggaggcctttctcctgctatcacgacactggaccagataagagtaatagatcgcaagcaagaagtacctcatgatggggccatgtgtgaccttctatggtcagatccagaggatgctgtagatggttggggattgagtcctcgaggtgcaggattcctctttggcggaaatgtagtttcatcatttaaccactcaaacaacatagattatatttgccgtgcgcatcaactcgtcatggaagggtataaatggatgttcaataacaagattgtaactgtatggtctgctcctaattactgctacaggtgtggcaatgttgctgcaatcctggagctggatgagaaccttaataagcagtttcgtgtatttgaagctgcaccacatgaatcaagaggtgttccttctaagaggcctgcaccagattactttctgtgatgctgcacattcaacgcctgagcttgctgcctaatttatgctttcaagcactggcaccggcaggcaagctttgcggatgatgtcccatgttataagaagcgctcaggtcttacaagggtccttgcctgaaggtgctttcaggatgtctaaatctagtgtgtcacgttctcctttcaggtctttggtttgtaagagagttgatgctggcatccagtttttcacagaatagctcccatttgagcttgagaaatgatcctatgaaggtgggtttcatgggaggtgtgcactagtatgatgtaaattttgtcgtggtgcctcatccctaagaaaacccgttgctagaatctggagtggttacactggaacctgcaggaaattttgtagctgacattcgcaagctgttaggaggaaatcctgtggtccagtaatgtaacatttgcgactagaacttgactgaaatatctgcatgtaatggttgtaatgcaacatgctctcgcagctttactaatttaagtaaaaaaaaaaaaaaaaaaaa

SEQ ID NO: 3754 - protein, 307 aa, Panicum virgatum
  misc_feature: Ceres CLONE 1794513
  misc_feature (1)..(197): Pfam Name: Metallophos Pfam Description: Calcineurin-like phosphoesterase
  misc_feature (4)..(307): SWISSPROT Homolog: EC 3.1.3.16 Serine/threonine-protein phosphatase PP-X isozyme 1
  misc_feature (4)..(307): SWISSPROT Homolog: EC 3.1.3.16 Serine/threonine-protein phosphatase PP-X isozyme 2
MGASDLDRQIEQLKRCEPLTEAEVKALCLKAMEILVEESNVQRVDAPVTICGDIHGQFYDMKELFKVGGDCPKTNYLFLGDFVDRGFYSVETFLLLLALKVRYPDRITLIRGNHESRQITQVYGFYDECLRKYGSVNVWRYCTDIFDYLSLSALIENKIFSVHGGLSPAITTLDQIRVIDRKQEVPHDGAMCDLLWSDPEDAVDGWGLSPRGAGFLFGGNVVSSFNHSNNIDYICRAHQLVMEGYKWMFNNKIVTVWSAPNYCYRCGNVAAILELDENLNKQFRVFEAAPHESRGVPSKRPAPDYFL

SEQ ID NO: 3755 - DNA, 2157 bp, Panicum virgatum
  misc_feature: Ceres CLONE 1794522
  misc_feature: Encodes the peptide sequence at SEQ ID NO. 3756
aacacacagcgcacacattgttcctggccatcttcttcgtccttcgcctcgatctagagctcgatcgcgagcaactcgaatccggccgggtagctgctcgcgtcgatcgatcagagcctggacggacgaagtctggccatggccatggcgctctcctcctcctcctccgctcttccgtgctccctcctcatagcggcactgatgctcctcgcctccatcacccaagtgcaaggcatcaccagatactacgacttcaatgtgacaatggccaacgtgactcggctgtgcgccaccaagagcatcgtcacggtgaacgggcagttccccggccccaagctcgtcgccagggaagccgaccgcgtcgtcgtccgcgtcaccaaccacgcccagcacaacatctcgctgcactggcacggcatccggcagctgcggacgggctgggcggacggcccggcgtacatcacgcagtgtcctatccagacggggcagagctacgtgtacaacttcaccatcaccgggcagcgcggcacgctgtggtggcacgcccacatctcctggctccgcgccaccgtctacgggcccttggtcgtcctccccaagctcggcgtgccctacccgttcccggcgccctacaaggaggtccccgtcatcttcggtgagtggtggcaagcggacacggaggtggtgatcaagcaggcggtccagaccggcggcggaccgaatgtctccgacgcccacaccatcaacggcctcccaggaccgctttacaactgctcagccaaagacacgtacaaactcaaggtgaagcccgggaagacgtacatgctgcgcctcatcaacgccgcgctcaacgacgagctcttcttctccgtcgccaaccactcgctcaccgtcgtcgaggtcgacgccgtctacgtcaagccgtttaccgtcgacaccctgatcatctccccgggccagaccaccaacgtgctcctcaccgcgaagccgttctacccgggcgccaactactacatgtccgccgcgccctactccaccgccaggtcgggcaccttcgacaacaccaccgtcgccggcatcctcgagtacgagtaccccgacgccgcccccgccgcgccgagcttcaacaaggccctgccgctgcacaagccggcgctgccggcgctcaacgacaccaacttcgtcggcaacttcacggcgaagctccgcagcctcacgacgccgcagtaccccgcggccgtgccgacggcggtggacaggaagttcttcttcacggtggggctgggcacgcacccgtgccccgccaacacgacgtgccagggccccaccaacacgacgcagttcgcggcgtccgtgaacaacgtctccttcgtgctccccaccagggcgctgctgcactcgcacttcaccggcctgtccaccggggtctactcgccggacttccccgtgtcgcccctgacgccgttcaactacacggggacgccgcccaacaacaccaacgtggccagcgggaccaagctgatggtgatcccgtacggcgccagcgtggagctggtgatgcagggcaccagcatcctgggcatcgagagccacccgctgcacctccacggcttcaacttcttcgtcgtcggccaagggtacggcaactacgaccccgtcaaggacccggccaagttcaacctcgtcgaccccgtcgagcggaacaccgtaggcgtgccggccggcggctgggtggccatccgattccttgcagacaaccccggtgtctggttcatgcactgccatttggaggcacacacgtcgtggggcctgaggatggcatggctggtgctcgacggcagcctcccgcaccagaagctgctccctccaccgtccgatcttcccaagtgttaaccggactcgctctctcctgccggttgcttcaaaaggaattgtgaattagacctgatcagaaacgacgtttttttttctttttactttcttcattgccaactgcaattctttcagacttccattctaattagtccgttcctagctgacctggatttttgtaattttttctccttctatttgtttgcaactttgtaacgacaatgttttggtactcttgaatcaataaaccatgcgtgacctcaccaaaaaaaaaaaaaaaaaaaa

SEQ ID NO: 3756 - protein, 584 aa, Panicum virgatum
  misc_feature: Ceres CLONE 1794522
  misc_feature: Great-hit functional homolog of the protein sequence encoded by LOCUS At5g60020
  misc_feature (1)..(153): Pfam Name: Cu-oxidase Pfam Description: Multicopper oxidase
  misc_feature (1)..(135): Pfam Name: Cu-oxidase_2 Pfam Description: Multicopper oxidase
  misc_feature (1)..(117): Pfam Name: Cu-oxidase_3 Pfam Description: Multicopper oxidase
  misc_feature (16)..(584): SWISSPROT Homolog: EC 1.10.3.2 Laccase-17 precursor
  misc_feature (16)..(584): SWISSPROT Homolog: EC 1.10.3.2 Laccase-2 precursor
  misc_feature: Useful for making plants with altered cell wall content and/or composition
MAMALSSSSSALPCSLLIAALMLLASITQVQGITRYYDFNVTMANVTRLCATKSIVTVNGQFPGPKLVAREADRVVVRVTNHAQHNISLHWHGIRQLRTGWADGPAYITQCPIQTGQSYVYNFTITGQRGTLWWHAHISWLRATVYGPLVVLPKLGVPYPFPAPYKEVPVIFGEWWQADTEVVIKQAVQTGGGPNVSDAHTINGLPGPLYNCSAKDTYKLKVKPGKTYMLRLINAALNDELFFSVANHSLTVVEVDAVYVKPFTVDTLIISPGQTTNVLLTAKPFYPGANYYMSAAPYSTARSGTFDNTTVAGILEYEYPDAAPAAPSFNKALPLHKPALPALNDTNFVGNFTAKLRSLTTPQYPAAVPTAVDRKFFFTVGLGTHPCPANTTCQGPTNTTQFAASVNNVSFVLPTRALLHSHFTGLSTGVYSPDFPVSPLTPFNYTGTPPNNTNVASGTKLMVIPYGASVELVMQGTSILGIESHPLHLHGFNFFVVGQGYGNYDPVKDPAKFNLVDPVERNTVGVPAGGWVAIRFLADNPGVWFMHCHLEAHTSWGLRMAWLVLDGSLPHQKLLPPPSDLPKC

SEQ ID NO: 3757 - DNA, 2245 bp, Panicum virgatum
  misc_feature: Ceres CLONE 1794523
  misc_feature: Encodes the peptide sequence at SEQ ID NO. 3758
ccccccccccccctgttcctctcgctcttatccccacccacccgcctcgctcgctctacaagaaagcgaccaccaccgcgctgcaccaccaccaagagtcaactggcgagtgattgagtgcctacgggaagcttcgatccctgagcagagttcaagcaggaggaggaggaggaggagatgaacgtcgacttcggcgcgcccaaggagctcgcggggggcctgcagcagcgcagggccctctaccagccccgcctcccgccgtgcctccagggcccgacggtgcgggcggagtacggcgacgcgaccaccaccatcgaccccagctgcgccaacgtcgtcgcgcaggccttcccgaacaccttcggtcagccgctcgtcagcttcgtcgcgccggccgacgccaccgccgccgcggcggaggagcggccctcgatcagggtgggcgtggtgttctccgggaggcagtcgccgggtgggcacaacgtcgtgtggggcctgcatgacgctctcaaagcctacaatcctcagagcgtgctctacggatttgttggtggcactgaggggttgtttgcaaacaaggcattggagatcactgacgatgttcttacttcctacaagaaccagggtggtttcgatttgctcggcaggagtatcgatcagatccgcacaactaagcaagtgaactctgcaatggcaacatgccgcagtctgaacttggatgggctggtcatcattggaggtgtgacctccaattcagatgctgcacagctttcagagatccttatccaaaataactgtaagaccaaggttgttggtgtgccggtttcattgaatggtgatctcaagaaccagtttgttgaaacaaccgttggatttgatacagtttgcaaggtaaattcacagcttgtaagcaatgtttgcctcgatgcaatctcagctggaaagtactattatttcgttcgtctgatgggacgaaaagcatcccatgttgccttcgaatgtgcacttcagtcacacccaaacatgctcatcttaggagaggaggtggcattgtcaaaactcactctgatggagattataaacaagatatgtgatggagtgcaggcaagagcagaattagggaaataccatggtgttctagttattccagaaggactaatagaaagcattccagaaatgtatgctcttattcaggaaatcaatatccttcacaacaataatgttcctgtggctgagatgtcatcgcaattgtctccatgggcagctgccctgttccagttcctgccacccttcatcagaagagagctgctccttcaccaagaatcagataactccgcacagttgtcccagattgacacagagcaactattagctcacttagtggaaacagagatgataaagagaacaaaagaaggaagatacaagggacggaagttcagttcggtctgtcatttcttcggatatcaggctcgaggatctataccatcaaattttgactgcgactatgcttatgctcttggacgtatctccctgcatatgattgcagctggactgactgggtacatggcaactgtggctaatctaaaggaccctgtagacaaatggagatgtgctgctgctcctttaactgcgatgatgagcgtcaagaggcatttacgtggccctggagcaatccctataggaaggccttccatccatccttctccaattgacctgaaagggaaggcttatgagttgctgcgagagaaggcttcaagcttcctcctggatgacttctaccggacccctggaggcattcagttcgaagggcctggttcagatgcaaaacccatcacacttaccattgagaaccaggattacatgggtgatattgagatactgaaagagtgtctcagcaaggtgagggccatggtgaagccggggtgcccccgggagatcctcaaggcggcaattagttccatgttgtcgttgacggacgtgctgacagtgatgtcccaccccctcaacgctgagctgcctctctaccatttcaagtgagcgtgggtgtcagcctgcctgcgtctgggttgttgtagagtgattccagtttgtaacagcagcaaattctggttcttgagctgccggtattcggtaggttttttgttctgttttccttttctgagtgagaagcactggggttcatgccaatagcccaataaacactggaacagcacttgatacgacactgtagttactgctggatcgg

SEQ ID NO: 3758 - protein, 619 aa, Panicum virgatum
  misc_feature: Ceres CLONE 1794523
  misc_feature (1)..(277): Pfam Name: PFK Pfam Description: Phosphofructokinase
  misc_feature (1)..(281): Pfam Name: PFK Pfam Description: Phosphofructokinase
  misc_feature (1)..(614): SWISSPROT Homolog: EC 2.7.1.90 Pyrophosphate- -fructose 6-phosphate 1-phosphotransferase alpha subunit
MNVDFGAPKELAGGLQQRRALYQPRLPPCLQGPTVRAEYGDATTTIDPSCANVVAQAFPNTFGQPLVSFVAPADATAAAAEERPSIRVGVVFSGRQSPGGHNVVWGLHDALKAYNPQSVLYGFVGGTEGLFANKALEITDDVLTSYKNQGGFDLLGRSIDQIRTTKQVNSAMATCRSLNLDGLVIIGGVTSNSDAAQLSEILIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIINKICDGVQARAELGKYHGVLVIPEGLIESIPEMYALIQEINILHNNNVPVAEMSSQLSPWAAALFQFLPPFIRRELLLHQESDNSAQLSQIDTEQLLAHLVETEMIKRTKEGRYKGRKFSSVCHFFGYQARGSIPSNFDCDYAYALGRISLHMIAAGLTGYMATVANLKDPVDKWRCAAAPLTAMMSVKRHLRGPGAIPIGRPSIHPSPIDLKGKAYELLREKASSFLLDDFYRTPGGIQFEGPGSDAKPITLTIENQDYMGDIEILKECLSKVRAMVKPGCPREILKAAISSMLSLTDVLTVMSHPLNAELPLYHFK

SEQ ID NO: 3759 - DNA, 2327 bp, Panicum virgatum
  misc_feature: Ceres CLONE 1794535
  misc_feature: Encodes the peptide sequence at SEQ ID NO. 3760
gcgattaggcaaggcagtcaggggcgttcgggtaacttctcccgaccgcggcacgagctggcactggcgccaataaacaaaggggggcaccacgccaacccgcgattcgcccccaaattcgcgattccccgccccgctccggctgagattccgtccgcgtcgagcccccgttccccgaatcggccgcggatccgagccgcccgcgccgccggcttactatcggataatatgttgttcacacatgagaagaatgctgaccaatttgatgttctttcttatggtaacatgaggagactagacagtagtggagattctgaggaatccaattttcgaaatggctgtaaggacagttcttcaatttctcctgagaatttcagcttcccttggctcgctgtagagaattgccaatctgccgcactaaatcatgacaagcggcctcattctgatgtcaagccatgccaagttgcttgcaaacgtccaaagcaaacagaccacgatgcctggttatattcctttggggaacaccctttcaccagggaggccgaaatatctgcttcagctttggctgatgaattagtcaagaccagacaaccggatcacattccagcaagtaatggtgccacaacctgcagtgttagttcaggcatcccttgtcctaaccgcgagcaatcagttggagtggaaaacttacacttgcctgattgggtgacttctttccctggttattttgaagattgtgtgccagttgctgaatataacctggttggtgacattgattcgcctgttcatgagcacctccctagaaagactgtaccaattggacctgagcaccaggctgtcattccagaatggagaccccgagtgggtgtatctggtggttctggtttttgtgctgatctgggttgtaattctgcatctacttcagaacctgtttcccaaggttatgactgtgagaatgacaagtgggtcaaggactgtgtcattccaatatcatcttgctcatctcctgtagattgggttggagacagcaaaatagattgtgactgcagcgatgaaggttctgttaggtgtgccagacagcatgttattgaagcaaggggatctctcaaaatgagtttgggacaagacaagtttcgtgagttaggtctttgtgaaatgggagaggatatcgctcagagatggactgaggatgaggagaagcgattcgaaagagttgttttctcaaatcctgtctccttgggaaaaaacttttgggatcacctccctcatgcatttcctagtaaaactagtaaggatcttgttagctactactttaatgtcttcatgctccggaagagggctcagcagaacaggtcagacctgttgcgagtggacagtgatgatgatgaactgcatggtgactgtccagtacctgggcaggaggaagaggattctgcagtgaagtcccctaaacttgaatatttcatcaacaattctctgcccatagagggtaaccataaagaatatgaaggagaacatattgctcgaccttctttccatggggaggaaattgaaaatgcaggagagtgcagacatctaccaaaccagatgcctctgtattcaactgcagagaatatagaacatatctacaaccaagatgagctgcaagcatcgtttgacggctgacacaatggagctcatgctctgatgctcctaaaggagctcagtttgctcaccgaatcatcctacaagaaaccttgggaaccaaggtgcatctgtgtagatgttgtacagagggtattccaataatctggagtactgttttctccaacagagattacattgaagtattgcttctcaagcaagttatgaaaaagaactgtgaacagcaatctagtaatgcatagccagaacttctgcagaagcttgaatatgacatctccttgagactgttgctctgctcgactggaattctgctctgagatgctgtgacgtgccgtggctcatgtagctgaaacatccggccgcttatccattaagtggacatggattgtggaagcctcatggagatgtacattcttcagcatgtcgagcctttctactgcattttgtgaagtgcatgtggatccaaactgggcttccacggggtttttgtttctcccccacattcgttgaattaatactattgtatgtacaatatatcgtgttgtgttcatgtaaaaagtcattattcgcgggatgccctatgtattcatgtccagatattgtaaccgcacattataaagttgctgctatccggataatctgacgctttgtcaagcggcattcaaaaaaaaaaaaaaaaaaaa

SEQ ID NO: 3760 - protein, 478 aa, Panicum virgatum
  misc_feature: Ceres CLONE 1794535
  misc_feature (1)..(51): Pfam Name: Myb_DNA-binding Pfam Description: Myb-like DNA-binding domain
MLFTHEKNADQFDVLSYGNMRRLDSSGDSEESNFRNGCKDSSSISPENFSFPWLAVENCQSAALNHDKRPHSDVKPCQVACKRPKQTDHDAWLYSFGEHPFTREAEISASALADELVKTRQPDHIPASNGATTCSVSSGIPCPNREQSVGVENLHLPDWVTSFPGYFEDCVPVAEYNLVGDIDSPVHEHLPRKTVPIGPEHQAVIPEWRPRVGVSGGSGFCADLGCNSASTSEPVSQGYDCENDKWVKDCVIPISSCSSPVDWVGDSKIDCDCSDEGSVRCARQHVIEARGSLKMSLGQDKFRELGLCEMGEDIAQRWTEDEEKRFERVVFSNPVSLGKNFWDHLPHAFPSKTSKDLVSYYFNVFMLRKRAQQNRSDLLRVDSDDDELHGDCPVPGQEEEDSAVKSPKLEYFINNSLPIEGNHKEYEGEHIARPSFHGEEIENAGECRHLPNQMPLYSTAENIEHIYNQDELQASFDG

SEQ ID NO: 3761 - DNA, 2458 bp, Panicum virgatum
  misc_feature: Ceres CLONE 1794570
  misc_feature: Encodes the peptide sequence at SEQ ID NO. 3762
aacgggctgacgaagtttagcatcgaccatgtccaagccgaggttggacggcaaggtggccatcgtcaccggcggcgcgagcggcatcggcgaggcggcggcgcggctgttcgcgtcgagcggcgccacggtggtgatcgcggacatccaggacgcgctgggcgaggcggtggccgcgtcggccgggtgcacgtacatgcggtgcgacgtgacggacgaggcgcaggtggaggcgacggtgggcgccgtggtggccgcgcacgggcggctggacgtcatgctcagcaacgccggcgtgctgctcccgacggggtccgtgatggacatggacctggcggagctggaccgcgtgatggccgtcaacttccgcggcgccgcggcgtgcgtgaagcacgcggcgcgcgccatggtgccgccgaacggcgcccgcggcggcgccatcgtgtgcacggcgagcgtggcgtcgctccagggcgggttcgggccggcgtcgtacacggcgtccaagcacgcgctgctgggcctggtgcgcgccgcggcgggggagctcgggcgccacggcgtgcgcgtcaactgcgtgtccccaggcggcgtggccacgcccatgagctgcgcgctcatgggcgtcgggccagaggagatggaggccatgacgtgtgccctcaacgtgctacgcgggaaggtgctgcgggcggaggacgtggcggaggcggcgctgttcctggcgtccgaccaggcggggttcatcagcggtcacaacctcgtcgtcgacggcgccaccaccgccgtcaaccctgccgtgctgcacaccgtcggactgtgaacgccgaccgtaccctgtgttatttgccgttgtcattgatctggtccttgtgtttctttgttcatacacctctgcacaatgtcatgaatgtaacagtaatgcacaccattgtattgtagaacactagaactcagaaaaaaaagaaagcgacacaaccgcgcccgcgccgcgaccacaccgcctcctccgcccagcctcctgcacccggccgattcgtcgagctcggcgccccgcctcacctcgctccccctgcctccttccttccctccctccctgccgccgcgcgcacccctgcatgcgagcgcgccgccgccagccgcaggcgtccggaaccggaacggcatggacaagtacgaggaggttcgcgacatcgggtcgggcaacttcggggtggcgcggctgatgcgcaaccgggagacccgagggctcgtcgccgtcaagctcatcgaacgcggccaccggatcgacgagaatgtgtaccgcgagatcatcaaccaccgctcgctgcggcacccgaacatcatccagttcatagaggtgatcctaactccaagacatcttgcgattgtgatggagtatgcagctggtggggaactctttgatcgaatcgtcgatcgtgggcggtttagtgaggatgaggccagatatttcttccagcagttgatctgtggagtgagctattgccatcacatgcaaatatgccatagagatttgaagctggagaatgttctcttggatggcagcccagctccacggctcaagatatgtgattttggctactcgaagtcatcagtactacattcaaggccaaaatcagcagtggggaccccagcatatattgcgccagaggtgctttctcggcgggagtatgatgggaagcttgcagatgtatggtcctgtggagtcactctttttgtcatgcttgtgggagcttacccatttgaagaccaggatgatcctaaaaatattagaaagaccattcagcgaatagcagcaattcaatataagatcccagacaatattcacatatctgatgagtgccgagagctcatttcccgcatctttgtcagcaatccctcgaggagaatcaccatgagggaaataaaaagccatccgtggttcctgaaaaacttaccgagggagctcacagaagcagtgcagttatcctacttcaggagggacaacagtgtccctgctttctcggaccaaacaaccgaagaaatcatgaagatcgtcaaggaggcaagaaccatgccaaaatcatctcgatcaggctacggctacagtgacgagttctcagatgaagaggaaaaggaagaggagaacgaacccaaagtggaggaggaggaggaagaagatgagtgtgataagagagtcagggaggttcgtgagagtggggagcttgatatggcctcactgcgcatctaaatctgctgcttgtgaggtggttggatgtagataatttgctttattatcttctgaactgtgtagaatgtatgcaattctgggttcagttattgtagtctatttaagccttttccaccctgtaatatatattttgatgaactgtatgtgtggtataaggtttgttctaaaggagtaaggttttgtacagaaaaaaaaaaaaaaaaaaaa

SEQ ID NO: 3762 - protein, 361 aa, Panicum virgatum
  misc_feature: Ceres CLONE 1794570
  misc_feature (1)..(357): SWISSPROT Homolog: EC 2.7.11.1 Serine/threonine-protein kinase SAPK7
  misc_feature (1)..(361): SWISSPROT Homolog: EC 2.7.11.1 Serine/threonine-protein kinase SAPK4
MDKYEEVRDIGSGNFGVARLMRNRETRGLVAVKLIERGHRIDENVYREIINHRSLRHPNIIQFIEVILTPRHLAIVMEYAAGGELFDRIVDRGRFSEDEARYFFQQLICGVSYCHHMQICHRDLKLENVLLDGSPAPRLKICDFGYSKSSVLHSRPKSAVGTPAYIAPEVLSRREYDGKLADVWSCGVTLFVMLVGAYPFEDQDDPKNIRKTIQRIAAIQYKIPDNIHISDECRELISRIFVSNPSRRITMREIKSHPWFLKNLPRELTEAVQLSYFRRDNSVPAFSDQTTEEIMKIVKEARTMPKSSRSGYGYSDEFSDEEEKEEENEPKVEEEEEEDECDKRVREVRESGELDMASLRI

SEQ ID NO: 3763 - DNA, 1215 bp, Panicum virgatum
  misc_feature: Ceres CLONE 1794581
  misc_feature: Encodes the peptide sequence at SEQ ID NO. 3764
atcgcggcacaaagcagcccaatcgcatctcctccgccccctccccgcgccgccgctcgccggagcccgcgcctccgcccgcgacgccacctgcagatacctgaatggctgccgcaaggggcattaaccagcttctgaggagaactctccagaaccagtcatctggttcatcgctgctttcttcgtttcggggaaagcatgaagagtcctctgctggactcagagcattggctcttcttggagttggtgcctccggtcttttcagttttgctacaatagcatctgcagatgaagctgagcatggcttggcagccccagattacccctggccacatgctggaatcatgagctcttatgatcatgcatcaattcggcgtggacaccaagtttacacacaagtttgtgcctcttgtcactccatgtccttgatttcgtaccgtgatttggttggggtagcgtatactgaagaggaaacaaaggcaatggctgctgagattgaggtagttgatggtcctaatgatgagggtgaaatgttcacccgccctggtaaactgagtgaccgcttcccacagccctatgcaaatgagcaagcagcccgatttgcaaatggtggtgcataccctccagacctcagtcttatcacaaaggcgaggcacaatggtcagagctacgtttttgctctccttactggttatcgtgagccacctgctggagttcagattcgtgagggtctgcattacaatccctacttccctggtggtgccatagccatgcccaagatgcttaatgatggagctgttgagtatgaggatggtactcctgcaactgaagcccagatgggtaaggatgtcgtatcattcctttcgtgggcagctgagcctgagatggaagagagaaagctgatgggagtgaagtggatcttcctactgtcactagcgcttctccaagctgcctactaccggcgcatgaggtggtcggtcttgaagtcgcgcaagctggtcctggatgttgtcaactgaggactacattttccttttttatttgaaatatgtcgagccttcaagggggagcattcaaaataatggatttgtgatgtacaattttgccactggggctaggttccatgcctagaatttattttgttttctttatactctgctgcaaaagcattctctccaagggagcatttcgtttcaaaaaaaaaaaaaaaaaaaa

SEQ ID NO: 3764 - protein, 304 aa, Panicum virgatum
  misc_feature: Ceres CLONE 1794581
  misc_feature: Great-hit functional homolog of the protein sequence given in SEQ ID NO 9571
  misc_feature: Useful for biocontainment applications
  misc_feature: Useful for making plants with modulated biomass
  misc_feature: The plant is abnormally small.
  misc_feature: The plant produces a reduced number of seeds.
MAAARGINQLLRRTLQNQSSGSSLLSSFRGKHEESSAGLRALALLGVGASGLFSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQSYVFALLTGYREPPAGVQIREGLHYNPYFPGGAIAMPKMLNDGAVEYEDGTPATEAQMGKDVVSFLSWAAEPEMEERKLMGVKWIFLLSLALLQAAYYRRMRWSVLKSRKLVLDVVN

SEQ ID NO: 3765 - DNA, 1840 bp, Panicum virgatum
  misc_feature: Ceres CLONE 1794648
  misc_feature: Encodes the peptide sequence at SEQ ID NO. 3766
gactcactcccgattctccctccctctctctcttccccatccgggccaaccaaccctagcgcggcggcgatggcgtcggacccgcccccggacgacgcggccacggccccggcggcgaacggccacggccacggcaacggcaacgccccgcccccggcgaagcgcccccgggcggtgatctcggcggccgagatccgcgccgagttcgcgcaccacgacgccgccgtcgcgcgcgtcaacaacggcagcttcggctgctgcccggcctcggtcctcgccgcgcaggcccgctggcagggcatcttcctcgcgcagcccgacgccttctacttccacggcctccagcaggggctgctccgctcgcgcgccgccgtcgccggcctcgtcggcgccggcgacgtctccgaggtctccctcgtcgacaacgccaccaccgccgccgccatcgtcctgcagcacgccgcctggagcttcgccgagggccacttcgcccgcggggacgccgtcctcatgctccactacgcctacggcgccgtcaagaagtccatccacgcctacgtcgcgcgcgcgggggccaccgtcgtcgaggtgcccctcccgttccccgtcgcgtccgccgacgcgattattgccgagttccgggccgcgctcgccgtcgccaaggaaggggggcggagggtccgcctcgcggtcatcgaccacatcacctccatgcccagtgttgtcatcccgatgaaggagctcgttgccatctgccgcgaggagggcgtcgacaaggtgtttgttgacgcagctcactctattggccaggtccctgtggacgtgcgtgacattggggccgatttctacacaagcaaccttcataaatggttcttctgcccccctgccgttgcctttctgcacacccgcaaggatgatccgatagcctcccagcttcaccaccctgttgtctcgcatgagtatgggaatgggttgcctatggagagtggatggattgggacacgggattacagtgcccagcttgttgtgtctgaagctatcgatttcgtaaatcgatttgagggagggattgaggggatacgcagtcggaaccacgagaaagtgattgagatgggtaggatgcttgctgaggcgtgggggacatttcttggctcgccaccagaattgtgcgggagcatggttatggtggggctgccaggttgccttggcgttgagagtgatgatgatgcaatgagagtgaggactatgttgaggaaggatttccaggtggaggtgccaatatactataattcaagaagggtggaagggcaagagatggcaaaggacaagagtggtgatccagtgacagggtatgtgaggatctcacaccaagtttacaatgtcagggaggactacgagagactaagagatgctatcaataaacttgtttctgaagggttcaccagctgcaagttgcggccttcagagaagcaagaataggagtgatgaccttctagccaggcagcagtccacccgaagatgctgtggctgactacttaagtgtgggtcgggtcaatgcagccagcgcctcatcgtgatgtctctcccatggcatagacaagccagttgatgaatgtagtgtaccttcaggaactgacatgtgttgtatttggcgttcagtgtatgtaacaataatgcctggcatgtcttcttccctcttattttccttttctgctgtaagctgagaataatctgaatgtaaggtgatttacagctgctgtaggctgatttctggttaccgatcatattgatcgtcaaatacatcaaaatggcagtggattaaaaaaaaaaaaaaaaaaaa

SEQ ID NO: 3766 - protein, 469 aa, Panicum virgatum
  misc_feature: Ceres CLONE 1794648
  misc_feature (1)..(396): Pfam Name: Aminotran_5 Pfam Description: Aminotransferase class-V
MASDPPPDDAATAPAANGHGHGNGNAPPPAKRPRAVISAAEIRAEFAHHDAAVARVNNGSFGCCPASVLAAQARWQGIFLAQPDAFYFHGLQQGLLRSRAAVAGLVGAGDVSEVSLVDNATTAAAIVLQHAAWSFAEGHFARGDAVLMLHYAYGAVKKSIHAYVARAGATVVEVPLPFPVASADAIIAEFRAALAVAKEGGRRVRLAVIDHITSMPSVVIPMKELVAICREEGVDKVFVDAAHSIGQVPVDVRDIGADFYTSNLHKWFFCPPAVAFLHTRKDDPIASQLHHPVVSHEYGNGLPMESGWIGTRDYSAQLVVSEAIDFVNRFEGGIEGIRSRNHEKVIEMGRMLAEAWGTFLGSPPELCGSMVMVGLPGCLGVESDDDAMRVRTMLRKDFQVEVPIYYNSRRVEGQEMAKDKSGDPVTGYVRISHQVYNVREDYERLRDAINKLVSEGFTSCKLRPSEKQE

SEQ ID NO: 3767 - DNA, 1171 bp, Panicum virgatum
  misc_feature: Ceres CLONE 1794658
  misc_feature: Encodes the peptide sequence at SEQ ID NO. 3768
gagcggcgcggcgcatcccatcccaccaccccctctctcgcccccgacccgtcgcaatggccgccgcggccgcgatctccgcgcccccagggcctccccgcctcgcgctccacctccacctccacccctccccctctccctccccctccccctcctccgcctccccgctcccgatgcgcgctctccccgccctccgccgccgcctccgcccgctcaccaccgccgtccgcgccgtcaagcaggacgcggccgtctggacgcccgcgcccgtctccgcggtcggcgcagccaccgccgacggctccatcttccacgtcgccgtcgacctctccgacgccgcgggcctcgcggagtcctacacggcgccggggcagtacctccaaatccgcgtgccctccggcggcggggaggagatcaagccggcgttcatggccgtcgcctcgccgcccggcgccggggcgcggttcgagttcctcgtcaagtccgtgccggggaccaccgcggagcgcctctgcgggctccgcgacggggacgtggtggagctcggcgcggtcatggggaaggggttccccctcgagaggataacgccgccggatgccgcgcagaccgtgctcatcttcgccgccgggacggggatcagtactattcgttcacttgtcgagtttggttttggtgccaacgaaagagcggatgtgagactttattatggtgccagaagtctgaagactatggcatatcaggataggtttaagaattgggagtcagcaggacttaaaataatccgagtgctatcacaaccggatgatagttggaaaggtgaacgtggatacgctcagcacgctttcttgagagccaagaacatagtaaatccatcttctacgggagcagtgctatgtggacagaggcaaatgcaagaggaagtcacgacggcccttgttgcggacggtgtatcgcaggataaaattttgaccaacttctagaaacgatctccggcctcctgtattgtactgctattcatttggcctcgttttgtaaattttattcttagacctcactgtcatgttccatgaatatatatatcaacctaacgtcagagaggaacaaggccctactattttttttgttttattcgttgaatgtattagcagagcaaaaaaaaaaaaaaaaaaaa

SEQ ID NO: 3768 - protein, 307 aa, Panicum virgatum
  misc_feature: Ceres CLONE 1794658
  misc_feature (1)..(102): Pfam Name: FAD_binding_6 Pfam Description: Oxidoreductase FAD-binding domain
  misc_feature (1)..(106): Pfam Name: NAD_binding_1 Pfam Description: Oxidoreductase NAD-binding domain
MAAAAAISAPPGPPRLALHLHLHPSPSPSPSPSSASPLPMRALPALRRRLRPLTTAVRAVKQDAAVWTPAPVSAVGAATADGSIFHVAVDLSDAAGLAESYTAPGQYLQIRVPSGGGEEIKPAFMAVASPPGAGARFEFLVKSVPGTTAERLCGLRDGDVVELGAVMGKGFPLERITPPDAAQTVLIFAAGTGISTIRSLVEFGFGANERADVRLYYGARSLKTMAYQDRFKNWESAGLKIIRVLSQPDDSWKGERGYAQHAFLRAKNIVNPSSTGAVLCGQRQMQEEVTTALVADGVSQDKILTNF

SEQ ID NO: 3769 - DNA, 1657 bp, Panicum virgatum
  misc_feature: Ceres CLONE 1794690
  misc_feature: Encodes the peptide sequence at SEQ ID NO. 3770
atctccacacccgtcggccgtcgccatctgctgaggagtgaggagttcgagctcgagctcgagctctgagtaaccggcggcccgacccaaggaccgccccgtgctccacaggggggatccggctgatgcggcggcaatgggcgtctgggattccatcctccccggcggcggccggcgcttcatcaagcgcaaggacagcgacgccggcgaggcaggtagggcactagaggaactgaggggctcactgtataatgacttccatacttcagaaggggccaagcgccagcagcagaggttttgtggccctatcattgcgctgacgttcaactttgtagttgccgttgggatcatcatggcaaacaaaatggtgatgggcactgttggatttaatttcccagttgcactgtcgttaattcattacctctttgcttgggctctaatggctgtcatcaaggcattatacttgctgccaattgctcctccttcgaaatccactcctttctcctcattatttgctttgggtgctgtcatgtctttctccactgggcttgccaatatcagcttaaagcataatagtgttggtttctatcagatggctaagatagctgtaactccaacaatagttgtagcagaatttattcttttccggaaaaaagtttctcttcaaaaggttgtcacgctggttgttgtctcatttggtgtggctattgcaactgttactgatttggagttcaatttttttggtgcttgtgtagcactagcttggattattcctagcgctgtgaacaaaatcctgtggtcaaatttacaacagattggaaattggacagctcttgcgttaatgtggaagacgaccccaattaccatatttttctttattgttttgatgccattgctggatcctccaggtcttttgtctttcaattgggattttaagaacagcagtgcaattattatatctgctttgtttggttttcttcttcagtggtctggtgctttggcacttggtgcaacttcggctctcgctcatgttgtgctaggtcaattcaagacaattgttattatgctctctggttatctggtatttaactctgatcctggattcaccagcctctgcggagctatcattgccctcgctgggatgtcagtgtatacttacctagggatgaaagggtcaggtaccagtggtaggagaaattccttaaattcacggccaaattctcatttgctgaagtccaaggttattacagatggagaaaagcaggaaacaaggactgtcgattctgtataagttttcgaattgccatcctgcatggtttaagaatccattggaagcagcactgaagaggcagtaggagagcgaaagtttaacactttgagtagcaggtttataaaaaaaacactctgcgtagccgtactttgagttcgcgttctctaattcttgcttattcatagagtgctattattcttattggtcaactttattcgttgttgatcagatttgttgatgtaggattggttctagttttaggaaattttggtgaattgttctacccttgtgtcatgttatttgtattgtggattctgtttattagaaaatggatgaacaacagctgacagggagccctggttgaattaaaaaaaaaaaaaaaaaaaa

SEQ ID NO: 3770 - protein, 384 aa, Panicum virgatum
  misc_feature: Ceres CLONE 1794690
  misc_feature (1)..(139): Pfam Name: TPT Pfam Description: Triose-phosphate Transporter family
MGVWDSILPGGGRRFIKRKDSDAGEAGRALEELRGSLYNDFHTSEGAKRQQQRFCGPIIALTFNFVVAVGIIMANKMVMGTVGFNFPVALSLIHYLFAWALMAVIKALYLLPIAPPSKSTPFSSLFALGAVMSFSTGLANISLKHNSVGFYQMAKIAVTPTIVVAEFILFRKKVSLQKVVTLVVVSFGVAIATVTDLEFNFFGACVALAWIIPSAVNKILWSNLQQIGNWTALALMWKTTPITIFFFIVLMPLLDPPGLLSFNWDFKNSSAIIISALFGFLLQWSGALALGATSALAHVVLGQFKTIVIMLSGYLVFNSDPGFTSLCGAIIALAGMSVYTYLGMKGSGTSGRRNSLNSRPNSHLLKSKVITDGEKQETRTVDSV

SEQ ID NO: 3771 - DNA, 1784 bp, Panicum virgatum
  misc_feature: Ceres CLONE 1794720
  misc_feature: Encodes the peptide sequence at SEQ ID NO. 3772
aaccaaacacggccataaacatccgtcgcccccggtgcgctctccttttctctgcgctgccccccgttcctttctcctccagcaagtaaacccccgtctccatagcaccgcaccgccgccatgccgaccgttagcgtgaaatggcagaaggaggtctttccaggcatagagattgacactagccagccgccgattgttttcaagagtcagctatacacactaacgggtgtaccacctgaacgccaaaaaattatggtgaagggtggaatattgaaggatgatgcagattggtctactttgggagtgaaagatggtcaaaaattgatgatgataggaacagctgatgaaattgtgaaagctccagagaaaggtccagtatttgttgaggatctaccagaagaagagcaagtgatcgcactggggcacagtgctagtctttataaccttgggaatacatgctacatgaattccacattgcaatgtctgcattctgttccagagctgaagtcagcgctgctaagctattcagatactggaagaggtaatggcattgaccaagcctctcataatttgactcttgcaactcgtaatacctttggtgagcttgatcaaagtgttcgtcctgttgcacctctacaattcttgcagacgttgcgtaaaaaatttccacaatttgcccagcagcacaataatgtctacatgcaacaggatgcagaagaatgctggacacagctggtgtatacactttctcaaactcttacatcagatgcaagtgaatctgcagctctttcaatgaagcaactatttgggatagatctcgtgagcagggtccactgtgtagaaagtggtgaggagagcacggagacggaatcagtttattccctgaagtgtcatatatctcaagatgtgaaccaccttcatgagggacttaagcatggcttgaagacagaacttgagaaagtttcacctgcactgggtcgcactgcaatttatactagagagtcgagaataaatgagctgcccaggtacttgactgtgcagttcgtacgtttcttttggaaaagggaatcaaaccaaaaggcaaagattttacgcaaagttgattaccctctggaactggatgtttatgatttttgctcagatgaactgaagcagaaactccaagctcctcgacagatgctgagagatgcagaaaatgcaaagtttggattgaaaacagaggcgaaagctagcagctcaaaagaaaatgaggggtcatcaagtaccgctggggactcatccaacatggacattgacaaagctgatccttctgtaccaaagaaacaattgactggtgtctacgatttagttgctgtattgacacacaagggaagaagtgcagactctggccactatgttggctgggttaaacaagataacggaaagtggatcgagtttgatgacgacaacccaaacattcgcaaggaggaagatattttgaaactatctggaggaggtgactggcacatggcttatatctgcctgtacaaagctcgtgtggctgaatcgaagagctagaggtctcttggctacactggatcgacacctctcatgcagcgaatgacttagcttgtttttgggccgcatgagtgatgtgtcaattatttttccagttggataagtggctactctggaattatcttcaatctctgtggcctgcgttcacctggatatgtatttttagaaagtcaagacgggtacattacgcgttacttttcaaaatatagaacaaaaagatttggcgc

SEQ ID NO: 3772 - protein, 478 aa, Panicum virgatum
  misc_feature: Ceres CLONE 1794720
  misc_feature (1)..(375): Pfam Name: UCH Pfam Description: Ubiquitin carboxyl-terminal hydrolase
MPTVSVKWQKEVFPGIEIDTSQPPIVFKSQLYTLTGVPPERQKIMVKGGILKDDADWSTLGVKDGQKLMMIGTADEIVKAPEKGPVFVEDLPEEEQVIALGHSASLYNLGNTCYMNSTLQCLHSVPELKSALLSYSDTGRGNGIDQASHNLTLATRNTFGELDQSVRPVAPLQFLQTLRKKFPQFAQQHNNVYMQQDAEECWTQLVYTLSQTLTSDASESAALSMKQLFGIDLVSRVHCVESGEESTETESVYSLKCHISQDVNHLHEGLKHGLKTELEKVSPALGRTAIYTRESRINELPRYLTVQFVRFFWKRESNQKAKILRKVDYPLELDVYDFCSDELKQKLQAPRQMLRDAENAKFGLKTEAKASSSKENEGSSSTAGDSSNMDIDKADPSVPKKQLTGVYDLVAVLTHKGRSADSGHYVGWVKQDNGKWIEFDDDNPNIRKEEDILKLSGGGDWHMAYICLYKARVAESKS

SEQ ID NO: 3773 - DNA, 1582 bp, Panicum virgatum
  misc_feature: Ceres CLONE 1794731
  misc_feature: Encodes the peptide sequence at SEQ ID NO. 3774
acgccaatttggctcgtctcggtgcgccgccccccgctgctgagtgctgaccacccactcgccggtgatctgatggcggcggcgccgcgtgcaccgccgcgcgcgctctccgcggagccgtggaagaccgcgctcggcgccgcggccctctccgcgccgcgacggggtgctagggttcgcgcggcgcggccacgggaggagaatttcgataaccatcgcttgctgatgtcatctaatatgaattcaaggtcattggtgtgcgcgccatgcaattgtgctcaaatggctttggccgacacaagaattgcttatcaacctgatgttgacaagcatgctggagttctggcctatgaactggtccaaggaaaccttgtgcagtggaattcatttatggacaaatcaatacctgatccaccaacagctgttctccttcatggcatccttgggagcaggaaaaactggggatcttttgcgaagaggttggctcaggaattcccaatgtggcagtttctcttggttgatttgcgatgccatggcgactcagcatcaactaagaagcgcggcccacacactgttgccgcaactgctcttgatgttctaaagctgttagtgcagctcaggctaacccctcgggttttggttggtcacagctttggtggaaaagtggccttgagtatggtagaacaagctgcaaaaccacttgctcgtcctgttagagtatgggtccttgatgctactcctggcaaagttcgtgctggaggagatggcgaagatcaccctgcagaactaattgaattcctcaggagaatgcctacgcaggtttcttcaaagcaggaggttgtcgatgctcttgttaaagaacaattttctatggatgttgcacggtgggtggccacaaatctacgccggagcagtccattaggtcagcaaccatcttcaagcttttcatggacttttgatctaaatggcatctcggagatgtacaagtcttatgaagatactaacttgtggaggattgtagagaatgtaccaaggggtgttcatattaattttctaaaagcggaacaaagtttgcatagatgggctcttgaggacctccaaagaattcatactgcagaagaatttgctgcagatgagggtggaggagttgaaatgcacgtgcttgaagatgctggacactgggttcatgctgacaacccagatggtctgtttcggattctttcatcgaccttccgaatcgagactactataagaggaatgcaagactaagtaccaaaccttaattgatccagcaatggtatgagatgaggcaatgacatgaatagaagtgtatattacaacgagggggaaaccatcagcgatgatgctaactgctaccattggcgcggttgttcatttgttcattcttttcctgtatggcgtctgtaacatgatagtcatctacatttgtgctgtttcttcgaggaacaacctgtaatttacaaattttatcagttatacactgaatgtatcaggaacatttccaacttgtctcattaataaacattgaacttttcagttgtaaaaaaaaaaaaaaaaaaaa

SEQ ID NO: 3774 - protein, 398 aa, Panicum virgatum
  misc_feature: Ceres CLONE 1794731
  misc_feature (1)..(127): Pfam Name: Abhydrolase_1 Pfam Description: alpha/beta hydrolase fold
MAAAPRAPPRALSAEPWKTALGAAALSAPRRGARVRAARPREENFDNHRLLMSSNMNSRSLVCAPCNCAQMALADTRIAYQPDVDKHAGVLAYELVQGNLVQWNSFMDKSIPDPPTAVLLHGILGSRKNWGSFAKRLAQEFPMWQFLLVDLRCHGDSASTKKRGPHTVAATALDVLKLLVQLRLTPRVLVGHSFGGKVALSMVEQAAKPLARPVRVWVLDATPGKVRAGGDGEDHPAELIEFLRRMPTQVSSKQEVVDALVKEQFSMDVARWVATNLRRSSPLGQQPSSSFSWTFDLNGISEMYKSYEDTNLWRIVENVPRGVHINFLKAEQSLHRWALEDLQRIHTAEEFAADEGGGVEMHVLEDAGHWVHADNPDGLFRILSSTFRIETTIRGMQD

SEQ ID NO: 3775 - DNA, 2154 bp, Panicum virgatum
  misc_feature: Ceres CLONE 1794766
  misc_feature: Encodes the peptide sequence at SEQ ID NO. 3776
atagcattccattcctcccacctcggtagattcgactcgtcgccttcctcctccctcccccagccctgccctgcatggagccaggcgcgccgtggcgcgatccgcgccaggggtacgcctacggggtcggatcggcgctgcagatgcagctgcagcagcgggccgacgcggccgccggtggaggggtgctcaagaggagcctcggcgagctggagaggtggcagcaccagcagcagcagcacgtcgcggcgcagcaggcgctctacctgcgcgccgtgaggcagcgcaccgccgcggcggcggatatcgccgccttgctgggcggggggccgacccagccgctggttctctccgggtccagctacggaggggtcctggcgtcgccttcgtccacgctgtcgtcgctcacgaccgcgtcgagggctgcggtgccgctgttgcacccgcacccccagccgcagccgcagcggcaggtgccgctcatgacgtcctcgccgcagacgcaggccttcggcctgtcgagggcgccgccgcctcagccggcggcttcgagcgagctgttcattttgcaggagctggagaagcagctgctgaacgacgacgacgacgagccggtggcggcgatgagcggcaccggctccgcggtgaccaactccgagtgggaggagacgatacagcagctcaactccatcaccgccgcgccgtcgccagggctccctgcagccgcggccccgaacaataacaacgccaacgcggggatgacgaggtcgccttccaactcgtcctcctccacggcatcttcctccgcgtcctgctcgccgccgaccccgggggccgcgtcgcggcagctgctgtctgaagccgcggtcgctctcgccgacggcaaccacgaagcggcggccacccatctggccgccctgaagcgcgcggccaaccagcacggcgacgcggagcagcggctgattgccatgatggtggccgcgctgtcctcccgcattgtcccgaccgtctccgccctagctcaacacctcgccgagctctgcggcgccgagcagcgcgccgggtcccagctccttcacgacatctccccgttcttccgcctcgccctccaggccgccagcgtcgccatcgtcgaagctgtgggcgaccaccgcgccatccacctcgtcgacttcgacgtcagcctccagcagcacgcggccctcatccagtacctcgctgaccgccgcgtgccgggcacctccctgaaggtcaccgccgtcaccgacccgggctcgccgtacacgcagtctcaaactgctacgctcaccgccatccgggaaccgctgaagcagctcgccgagcgagctggcatcgagtaccgctttgaagtggtccgctgcagagcagcagagctggatgcgtccaggctcggctgcgcgcccggggaggcgctggcagtcaacctggccttcgcgctctcgcacgtccccgacgagagcgtttctccggcgaacccccgggacgagctcctccgccgcgtccgcgcgctgagcccgcaggtggtggcgctcgtggagcaggagctgaacacgaacacggcacctttggccgcgcgcttcacggacgcgtgcgcgcactacggcgccatcctggagtcgctggacgcgacgctggggcgggagagctcggagaagaaggccagggccgaggcggccctggcgaagaaggcggcgaacgcggtcggccgtgagggccccgaccgcctggagcggtgcgaggtcttcggcaagtggcgcgcccggttcggcatggcggggttccgcccggtggcgctcggcccgggcattgcggaccaggtcgccgcccgcgtcggcccggcgccgcccgggatcaccgtcaaggcggagaacggcgtgctccggctctgctggatggggcgcgtggtgaccgtcgcctccgcgtggcgctagaccaccgccgggcggagccggccggcggcccgcgcgcgccattattaccgccaccaattcgtcagttacttaattcgcgcaattcctttactcgtttctcttttttaccttgattgggtgatgagagtttgtcattgatctggtaaaatccttccttagctgtagcgactcataattcttataaaaaaaaaaaaaaaaaaaa

SEQ ID NO: 3776 - protein, 625 aa, Panicum virgatum
  misc_feature: Ceres CLONE 1794766
  misc_feature (1)..(290): Pfam Name: GRAS Pfam Description: GRAS family transcription factor
MEPGAPWRDPRQGYAYGVGSALQMQLQQRADAAAGGGVLKRSLGELERWQHQQQQHVAAQQALYLRAVRQRTAAAADIAALLGGGPTQPLVLSGSSYGGVLASPSSTLSSLTTASRAAVPLLHPHPQPQPQRQVPLMTSSPQTQAFGLSRAPPPQPAASSELFILQELEKQLLNDDDDEPVAAMSGTGSAVTNSEWEETIQQLNSITAAPSPGLPAAAAPNNNNANAGMTRSPSNSSSSTASSSASCSPPTPGAASRQLLSEAAVALADGNHEAAATHLAALKRAANQHGDAEQRLIAMMVAALSSRIVPTVSALAQHLAELCGAEQRAGSQLLHDISPFFRLALQAASVAIVEAVGDHRAIHLVDFDVSLQQHAALIQYLADRRVPGTSLKVTAVTDPGSPYTQSQTATLTAIREPLKQLAERAGIEYRFEVVRCRAAELDASRLGCAPGEALAVNLAFALSHVPDESVSPANPRDELLRRVRALSPQVVALVEQELNTNTAPLAARFTDACAHYGAILESLDATLGRESSEKKARAEAALAKKAANAVGREGPDRLERCEVFGKWRARFGMAGFRPVALGPGIADQVAARVGPAPPGITVKAENGVLRLCWMGRVVTVASAWR

SEQ ID NO: 3777 - DNA, 1653 bp, Panicum virgatum
  misc_feature: Ceres CLONE 1794772
  misc_feature: Encodes the peptide sequence at SEQ ID NO. 3778
gctcaacaagaaatacctgctgcacagtggccggctggctgttcagtgctcactccgttagcccatcgcgcaccacagagctgagctcagtgagcggccggtgtctcgcgcaccgccggctccattcgcccgtttaagagacctagctacgtgagctccctctcttctcttgtataattgtatccatcagctctctcccacagtcccactctgcttctgctgctccttcatcagacactcgacggccacaagcttgcattggtgcctcgctcgcacggccatgaggcttccgggggaccgttgctccccctcgccggcggcgttggcggcgcggtggtccctcgcgctcctggccgccgtcttcgggggcggcggcccgccggcggcgctcggctgctacacgcgcatcttcagcttcggcgactcgctgacggacacgggcaactacgtccgcctgacggccacgacccacagcccctacggcgcgccgccgtacgggcggacgttcttcggccgccccaccggccgcgccagcgacggccgcctcgtcatcgacttcatcgcggaggagttcgggctggcgaacgtgacggcgatccagacgggcacggcgccggcggacttccgggacggcgccaacttcgccatcatctcggccaccgccaacaacggcaccttcttcgcgggcaacggcatgaacatcaaccccttctcgctcgacacgcagatgctctggttccggacccacctccgccagctcgcgcaagccgcggcgggggcggcggcggggccggggcagcagcagcagctggccaacgccagcgccggcgcggtgctgggcggcgcgctggtggcgctgggcgagatcggcgggaacgactacaacctggccttcgcggggggcgtgccgcgggacacggtgcgccgcttcgtgccggccgtggtggacaagctggcggcggccgtcgaggagctcgtcgccatgggcgcgcgcgcgttcgtggtgcccgggaacctgcccttcggctgcgcgccgctctacctgcgccggttcggcggcgacgccgcctactgggactacgacgcctcgacggggtgcctcgcctggttcaaccgcttcgccgagtaccacaaccgggtgctcaccgcgcggctggacaggctccgccgccgccacccgggcgtcaccatcgtctacgccgactggtacggcgccatgatgagcatcttccgcgccccccgggacctaggtttcaccaacgccctgacgagttgctgcggcaaccagacggtgccgtgcggcaagcccgggtgccgcgtctgcgacgacccgtcgacgtacgggtcctgggacggcacgcacccgacggaggcggtctacaaggtgatcgccgacggggtgctgcacgggccgtacgcgtccccggtccctctcgccgggacctgctgagaatcgaagcagacttctctctgtctccggctccggatggtcctctcatccttgcaagatccattgttacataaatatggttaagctgtagtagaatggtaacacatcagagttacgtgtgtagctgcaatgacgtttacagacaacttcgtctcaggtacagtaaggttgacagatttcactaaaaaaaaaaaaaaaaaaaa

SEQ ID NO: 3778 - protein, 389 aa, Panicum virgatum
  misc_feature: Ceres CLONE 1794772
  misc_feature (1)..(56): Pfam Name: Lipase_GDSL Pfam Description: GDSL-like Lipase/Acylhydrolase
MRLPGDRCSPSPAALAARWSLALLAAVFGGGGPPAALGCYTRIFSFGDSLTDTGNYVRLTATTHSPYGAPPYGRTFFGRPTGRASDGRLVIDFIAEEFGLANVTAIQTGTAPADFRDGANFAIISATANNGTFFAGNGMNINPFSLDTQMLWFRTHLRQLAQAAAGAAAGPGQQQQLANASAGAVLGGALVALGEIGGNDYNLAFAGGVPRDTVRRFVPAVVDKLAAAVEELVAMGARAFVVPGNLPFGCAPLYLRRFGGDAAYWDYDASTGCLAWFNRFAEYHNRVLTARLDRLRRRHPGVTIVYADWYGAMMSIFRAPRDLGFTNALTSCCGNQTVPCGKPGCRVCDDPSTYGSWDGTHPTEAVYKVIADGVLHGPYASPVPLAGTC

SEQ ID NO: 3779 - DNA, 1785 bp, Panicum virgatum
  misc_feature: Ceres CLONE 1794784
  misc_feature: Encodes the peptide sequence at SEQ ID NO. 3780
agccgcacaacagggcacccaacgacaccggcctattgcgttgaaccgcccgcgatggcgctcgctgtgtcctccccggcgccgcacgtggccgtggtagcgttcccgttcagctcccacgcggcggcgctgttcaccatcgcgcgcgcgctggccgccgccgcggcgcccgtgggggccacactctcgttcctctccaccgcgggctccatcgcgcggctccgcggggcggccggcgccgagctcccggggaacctgcgcttcgtggaggtcccggacggcgccgggacgcccgcggcgaaggggcccgtgccggtgccgatgccgcggaagatggagctgttcatggccgccgcggaggctggcggggtgaaggccgggctggaggcggcccgcgccgcggcgggcggtgctagggtgagctgcgtggtcggggatgcgttcgtgtggcccgcggcggaggcggccgctgcggtgggggcgccgtgggtgccggtgtggatagccttgtcgtccgcgctcctggcgcacctccgaaccgacgcgctctgggcggacgtcggcgaccaggccgcgagcagggccgacgagctgctggtctcgcacccgggccttggcagctaccgcgtcagcgacatccccgacggcgtcgtctccggcgatttcgactacgtcatcagccgcctcctccaccgcatggggcagctcctcccgcgcgccgccgcccccgccgtggcgctcaacaccttcctgggcctcgacccgcccgacgtcaccgcggccctcgacgagacgctcccgaactgcctcccgctcggcccctaccacctcctccttcccgaggacacaaccgccgctgcgtcgccagcagccggcgacccgcacggctgcctcgcctggctggacgcgcacccggcgcgctccgtggcgtacgtaagcttcggcacggtggcgtcgccgcaccccgacgagctccgcgagctggcggcgggactggagtcctccggcgcgccgttcctgttgtccctgcgcgaggactcgtggccgctcctgcccgcggggttcctggcccgcgccgcggccggtggcgccggatccgggctcgtggtcccctgggcgccgcaggtggccgtgctgcgccacgagtccgtgggcgcgttcgtgacacacgccgggtgggggtcggtgctggaggccatgtccagcggcgtgcccatggcgtgccgccccttcgtcggggacaaccggatgatcgcgcggtctgtggcgagcgtgtgggggatcggtgcggcgttcgagggcgccacgatgacgcgcgccggggtggccgccgccgtgggggagctgctgcgcggggaggaaggggcgaggatgagggccagggcgcaggagctgcaggccgcgatggccgcggcgttcgcgcctggcggcgcgtgcaggaggaacttcgacaagttcgtggagatagtctgtcgcgtgtgaactcctgttgccggattcgtacctgttgtcggccggtcgaactgtttacgtattcgtacctgttgtcggccggtcgaactgtttacgtattcagaggtgcctgtacggaaatccaataagacgatcgcgcgctacgtggcttcgtggcgcgcgacgttgcctgtctcccatgtgatagccaacttaataatttgctttcttcttttcctttcctttttttttttgctttacgctctgtaatagcatgtgtcatcatttgtttttagattttctcttaccttccaaaaaaaaaaaaaaaaaaaa

SEQ ID NO: 3780 - protein, 475 aa, Panicum virgatum
  misc_feature: Ceres CLONE 1794784
  misc_feature: Great-hit functional homolog of the protein sequence given in SEQ ID NO 9323
  misc_feature (1)..(445): Pfam Name: UDPGT Pfam Description: UDP-glucoronosyl and UDP-glucosyl transferase
  misc_feature (6)..(474): SWISSPROT Homolog: EC 2.4.1.115 Anthocyanidin 3-O-glucosyltransferase
  misc_feature: Useful for making plants with modulated flowering time
  misc_feature: The plant flowers significantly late compared to wild-type.
MALAVSSPAPHVAVVAFPFSSHAAALFTIARALAAAAAPVGATLSFLSTAGSIARLRGAAGAELPGNLRFVEVPDGAGTPAAKGPVPVPMPRKMELFMAAAEAGGVKAGLEAARAAAGGARVSCVVGDAFVWPAAEAAAAVGAPWVPVWIALSSALLAHLRTDALWADVGDQAASRADELLVSHPGLGSYRVSDIPDGVVSGDFDYVISRLLHRMGQLLPRAAAPAVALNTFLGLDPPDVTAALDETLPNCLPLGPYHLLLPEDTTAAASPAAGDPHGCLAWLDAHPARSVAYVSFGTVASPHPDELRELAAGLESSGAPFLLSLREDSWPLLPAGFLARAAAGGAGSGLVVPWAPQVAVLRHESVGAFVTHAGWGSVLEAMSSGVPMACRPFVGDNRMIARSVASVWGIGAAFEGATMTRAGVAAAVGELLRGEEGARMRARAQELQAAMAAAFAPGGACRRNFDKFVEIVCRV

SEQ ID NO: 3781 - DNA, 2058 bp, Panicum virgatum
  misc_feature: Ceres CLONE 1794829
  misc_feature: Encodes the peptide sequence at SEQ ID NO. 3782
ttcccggcttcccgagagattccgcgaccgctcttgctcgcgcggtgtcctcatcagcgaaagtgaacgacagcgacgcggcggagaattagcagcgaccagaggatccatggaatcacgtcagtgaatagcacaagtcctcacccaccctcgctcgtggtcactggtcaccactcaccaccaccgcgcggcgggagcagccagccggtcgcttgctccccgcagagcagaggcatggcgccgccgctcagcagcttctccgtgctccgacgaagccgagcgcaccgggagccgcggctgctcttcttcttgctcgccgtcatcgccggcggcgtagtcgtgccaaggagcgcctccgcgatcacccggcgcgacttccccgaggggttcgttttcggcgccggctcatcggctttccaggtggaaggggcagctgcagaggatggaagggcacccagcatttgggacaccttcacccatgaaggttactcgtacgatggatccactgcagatgtttcagcagatcagtatcaccactacaaggaagacgtaaagcttatgcatctgatgggtttagatgcgtacagattctcaattgcttggcccaggcttattcctgatggaagaggagagatcaacccaaaagctttggaatactacaacaatctcatagatgaactgatactgcacgggattgaacctcatgtcaccatctaccattttgatcttcctcaggtccttcaagatgaatacggtggactcctcagccccagattcgtagaagattacaccgcgtttgcagaagcctgcttcaagaacttcggggacagggtgaagcactgggtcaccgtcaacgagcccaacatagagcccatcggcggctacgacaacggatcccagccgccgcggcgctgctcctatcccttcggcgagaactgcaccggcggcaactcgtcgacggagccgtacatcgccgcgcaccacctcctcctcgcacacgcctccgcagtgtccctgtacaggatcaagtacgagccaattcaaagaggccaggtagggatcactctgctgggctggtggcacgagcctgccaccaacacgtcacaggatgcagctgctgcgtcgaggatgaacgactttcacatcggatggttcatgcacccgttggtgttcggggactacccgccggttatgaggagcagggtgggcgaccggctgccgcgtctatccgcggaggagtcggcggcggtgcgcggggccttcgacttcgtcggcttcaaccactacctcatcctacgagtccggtcggccggggaggaggaggattccggacagagaccgagggactactacgttgatgcggccgtccaggatccactcgaggccatcacggagggccgcatcgagtctccgccatgggcgctggggaagctgctggagcacctgaaggtgaagtacggcaaccctcccgtcgtcatccatgaaaatgggataggagacgccccggacggcacggcgggcgccatcgagtacgacgacgagttcaggtccgagttcctgcagagctacctggaggtgctctaccagtccatacggaacgggtcggacgcgcggggatacttcgtgtggtcgttcctggacgtgttcgagttcctcttcgcctacaggctgcgcttcgggctgtgtggggtggacatggccgccgcggcgcgcacgcggtacgcgcggagctccgcgcgctggtacgccggcttcctccgcggcggcgagctccggccgccgccgccggctcttcccgccaggcggccgtacgccgctgcgtgaggagtcatcgtcgaagatactgtggaaaggacgacagggaggccactcgagacgggtcgagaataaaaagattcgtgtagcggcacgcaccacgtccgatgatgacgtgtcaggtgctacccgctgggttggaactgtactaactacgcgcgcatgaaccgtcagccattgatgaagctgcaaataaataatgaaataagtaaaaggttgatcgaaaaaaaaaaaaaaaaaaaa

SEQ ID NO: 3782 - protein, 529 aa, Panicum virgatum
  misc_feature: Ceres CLONE 1794829
  misc_feature (1)..(457): Pfam Name: Glyco_hydro_1 Pfam Description: Glycosyl hydrolase family 1
MAPPLSSFSVLRRSRAHREPRLLFFLLAVIAGGVVVPRSASAITRRDFPEGFVFGAGSSAFQVEGAAAEDGRAPSIWDTFTHEGYSYDGSTADVSADQYHHYKEDVKLMHLMGLDAYRFSIAWPRLIPDGRGEINPKALEYYNNLIDELILHGIEPHVTIYHFDLPQVLQDEYGGLLSPRFVEDYTAFAEACFKNFGDRVKHWVTVNEPNIEPIGGYDNGSQPPRRCSYPFGENCTGGNSSTEPYIAAHHLLLAHASAVSLYRIKYEPIQRGQVGITLLGWWHEPATNTSQDAAAASRMNDFHIGWFMHPLVFGDYPPVMRSRVGDRLPRLSAEESAAVRGAFDFVGFNHYLILRVRSAGEEEDSGQRPRDYYVDAAVQDPLEAITEGRIESPPWALGKLLEHLKVKYGNPPVVIHENGIGDAPDGTAGAIEYDDEFRSEFLQSYLEVLYQSIRNGSDARGYFVWSFLDVFEFLFAYRLRFGLCGVDMAAAARTRYARSSARWYAGFLRGGELRPPPPALPARRPYAAA

SEQ ID NO: 3783 - DNA, 2140 bp, Panicum virgatum
  misc_feature: Ceres CLONE 1794833
  misc_feature: Encodes the peptide sequence at SEQ ID NO. 3784
aacgccggctaccaacgacaagccgaggccagctccgatggcggcggtcgcggcgaggcggctccgtgtgctcaattgccgcggctccctctcgccggcgctctccacggcggcgccgcggtccccgcgagatccgcgcgcgctgtgcacgctctccaccacgctgcggtccggcgccggcgaggacgagatcgagcgcatccgccgcgagttcgaggacgccaagcgcaactacctcagcatccccgccgcaatcaaggacatgcccaagatgaacccgcaaggcatctacgtgaacaagaacgtcaagctggatgacctgcacgtctacggcttcgactacgactacacgctctcccactactccgagcacttgcagtgcctcatctacgatctcgccaagaagcacttggtcgatgagttgaaatatccagagagctgcttgaagtacgagtatgaccgctcttttcctatcaggggcctttactatgacagactcaaaggctgccttctcaagcttgatttctttggttctattgaaccagatggttgcttctttgggcggaggaagctgagtttgagtgagataaaagagctctatggcacaaggcatattggcagagaccaagctcgccaacttgttgggctgatggatgtcttctgttttagcgaggcatgtctccttgctgatattgttcaacactttatagatgccaaactggagtttgatgcctcttatgtatatgaagatgtaaatcaatcgattcagcatgtccacagaagtggtttaattcacaggcaaattctttctgagccccagaaatttctaataaaaaaaagccaggtgttccgtttcttaaagatgctaagagagaaaggaaaaaagatgtttcttcttaccaattcacctttccatttcgtggatggagggatgcgttatttgctggaggaccagcattttgatggaaattcctggagggaactgtttgatgttgtgattgcgaaggcaaataaaccaactttttataactcagaccacccattcagggtgtatgacactcaaaaggacaccttagcttttactgcagttgacaagtttctgccagatcaagtatactaccacggctgtttgaaatcatttctgcagatcacaaagtggagaggtccagaggtgatatactttggtgatcatcttttgagcgacttgagaggaccttcaaaagctggttggcgaacagctgctgtaattcgagaactcgaggatgaaatagaaatacagaacggtgatagctaccggttccaacaggcaaaattgagtataattcatgatcttcttgggaaagtccatgcaaccgtggttagcaccgagaaaggccaagtttacagagcattacttgatgaattgaatgcagaaagacgacaatgccgatctgggatgcgagatctgttcaatagctcttttggtgcaacttttcttacagatacaggaagggaatcatcatttgcctatcacattcatcaatatgcagatatttacacaagcaagctcgagaacttcttatcatatgcccctgaaccttggcttcatccacctcatgacataaagatcatgccacacaacgcgaaggtcccagcaagccttttcagtacctcttagttcattctaccttttttggttggagaaggtagtacccattatggtttctgtgtgagaccacgtgacaggactgtggactgctgcggccttcgcttaggttaggaataaagcaccggagatgcatgtccagcagaccaagcagcaagctagcagtcattctggtttgccatgaaaatgcagccatgtgagtaggtgactcttttgcctgtatgaggaagcttctagctgccgctcaaaaaaaaaagaagaagaaaagcttctgtctgagaagcctgcttccttttgttcaacttctatggatattcttaatagtaaagatgaacccgatgccctaacaatctgtatgactgtcaaatgtcaattggagttacatgcaacctatcttgtcttccagtttacttcccatcgagcagaaaatattttggactcggaggaacattttagggtaaattatcaaacatctaaaaaaaaaaaaaaaaaaaa

SEQ ID NO: 3784 - protein, 539 aa, Panicum virgatum
  misc_feature: Ceres CLONE 1794833
  misc_feature (1)..(376): Pfam Name: 5_nucleotid Pfam Description: 5' nucleotidase family
MAAVAARRLRVLNCRGSLSPALSTAAPRSPRDPRALCTLSTTLRSGAGEDEIERIRREFEDAKRNYLSIPAAIKDMPKMNPQGIYVNKNVKLDDLHVYGFDYDYTLSHYSEHLQCLIYDLAKKHLVDELKYPESCLKYEYDRSFPIRGLYYDRLKGCLLKLDFFGSIEPDGCFFGRRKLSLSEIKELYGTRHIGRDQARQLVGLMDVFCFSEACLLADIVQHFIDAKLEFDASYVYEDVNQSIQHVHRSGLIHRQILSEPQKFLIKKSQVFRFLKMLREKGKKMFLLTNSPFHFVDGGMRYLLEDQHFDGNSWRELFDVVIAKANKPTFYNSDHPFRVYDTQKDTLAFTAVDKFLPDQVYYHGCLKSFLQITKWRGPEVIYFGDHLLSDLRGPSKAGWRTAAVIRELEDEIEIQNGDSYRFQQAKLSIIHDLLGKVHATVVSTEKGQVYRALLDELNAERRQCRSGMRDLFNSSFGATFLTDTGRESSFAYHIHQYADIYTSKLENFLSYAPEPWLHPPHDIKIMPHNAKVPASLFSTS

SEQ ID NO: 3785 - DNA, 1448 bp, Panicum virgatum
  misc_feature: Ceres CLONE 1794841
  misc_feature: Encodes the peptide sequence at SEQ ID NO. 3786
tagccccctgctcttcctcctttctcgtctctcggccggcgtcgctcccccactccttccctgctccgccgccgggcggctcctctccctctccttccgccgcggatccatggcgatgtggagggcggccgcgaggcagctggtcgaccgggcgctcggcgcaagggccgcgcacacgtctgcagtcagcaagaagatcgtgggggtgttctacaaggccggcgagtacgccgacaagaaccccaacttcgtcggatgcgtcgagggggcactcggcatccgcaactggctcgagtcacagggccatcgctacattgtcaccgatgacaaggagggccccaacagtgaactggagaagcacattgaagacatgcatgtcctgattaccaccccgttccacccagcttatgttactgcagagaggattaaaaaggcaaagaaccttgagcttcttctcacggctggaattggctccgatcatatcgatttgccagcagccgctgctgcaggcttaacggtagcagaggttactggaagtaacaccgtctccgtggcggaagatgagctcttgcgcattctgattctggtcagaaacttcttgcctgagtatcaacaggtggttcagggagagtggaacgtcgcaggcattgctcacagagcttatgatcttgaaggaaaaactgttggaactgttggggccggtcggatcggcaggctcttgcttcagcgtcttaagcccttcaactgcaacctgctttaccatgacagacttcagatcgacccagagcttgagaaggaaattggtgccaagtttgaagaggacctggatgctatgcttccaaagtgtgatgtggttgtgatcaacaccccacttaccgagaaaacaagaggcatgtttaacaaagagaggatcgcaaagatgaagaaaggtgtaattgtcgtgaataatgctcgaggagcaatcatggatactcaggcagttgcagacgcttgttccagtggtcacattgctgggtacggtggtgatgtgtggttcccccagccagcaccgaaggatcacccctggcgctacatgcctaaccatgccatgaccccccacatatctggaactacaattgatgctcagctgcggtatgccgagggtgtgagggacatgctggataggtacttcaagggtgaggacttccccgtgcaaaactacatcgtcaaggaaggccagctcgcaagccagtaccagtgatcgcgcacgccataggccagagctgtatccttcttttctgtgagatttgcgaggaagaaactgttgttccatcgctgtatgagtagaagttgttgtcacatagacatgtgggccaccggaaataaacaagcgaaagagatgccttcctggcattgcgtcgtggagatgaataaatatttcttgcctctaaaaaaaaaaaaaaaaaaaa

SEQ ID NO: 3786 - protein, 376 aa, Panicum virgatum
  misc_feature: Ceres CLONE 1794841
  misc_feature (2)..(315): Pfam Name: 2-Hacid_dh Pfam Description: D-isomer specific 2-hydroxyacid dehydrogenase, catalytic domain
  misc_feature (1)..(376): SWISSPROT Homolog: EC 1.2.1.2 Formate dehydrogenase 1, mitochondrial precursor
  misc_feature (2)..(376): SWISSPROT Homolog: EC 1.2.1.2 Formate dehydrogenase, mitochondrial precursor
MAMWRAAARQLVDRALGARAAHTSAVSKKIVGVFYKAGEYADKNPNFVGCVEGALGIRNWLESQGHRYIVTDDKEGPNSELEKHIEDMHVLITTPFHPAYVTAERIKKAKNLELLLTAGIGSDHIDLPAAAAAGLTVAEVTGSNTVSVAEDELLRILILVRNFLPEYQQVVQGEWNVAGIAHRAYDLEGKTVGTVGAGRIGRLLLQRLKPFNCNLLYHDRLQIDPELEKEIGAKFEEDLDAMLPKCDVVVINTPLTEKTRGMFNKERIAKMKKGVIVVNNARGAIMDTQAVADACSSGHIAGYGGDVWFPQPAPKDHPWRYMPNHAMTPHISGTTIDAQLRYAEGVRDMLDRYFKGEDFPVQNYIVKEGQLASQYQ

SEQ ID NO: 3787 - DNA, 1635 bp, Panicum virgatum
  misc_feature: Ceres CLONE 1794853
  misc_feature: Encodes the peptide sequence at SEQ ID NO. 3788
aattcaatccgaatccaatcgatagcagaggaggggagagcactgcacacgcacaggcagcaggctgcaggcaatggcgccggggccttccgccgcgctgctcctgctcttgtgctccgtcgccgcggtggccttctcccagcagctgcaggccaacgccgccggcacgccggacggctccgaggagtggggctacgtccaagtccgacccaaggcgcacatgttctggtggctctaccacagcccgcagcgcgtcgacgacggcaggacgccatggccgaccgtgctctggctgcagggaggcccgggcgcctccggcgtcgggtacggcaacttcatggagatcgggccgctggacgaggagctcaagccccgcgccaccacctggctcgccaaggccgacctcctcttcgtggacaaccccgtcggcaccggcttcagctacgtcgacggcggcgacaagggcctgatggcgcgcacggacgccgaggcggcgcgcgacctcaccacgctgctctgcgcgctctaccgcgacaagccccgcctccgggcgagcccgctctacatcgtggccgagtcctacggcggcaagttcgccgtcaccacggcgctggcggcgctcagggccttcgaccagggccgcctccgggccaacctcgccggggtggccctcggagacagctggatctcgcccctcgacttcgtgatgtcgtgggggccattgctgtaccaagtgtcgagggtcgacgagaagggcctgcagcaatgcaacagtgtgtcagcgaagatcaaggaccagttggagaagaagcagttcacggacgccgaggcgtcgtggtcggagctcgagaacgtcgtcatcgccaactccaactccgtcgacttctacaacttcctcaaggacgacgcgggggaggacgccacggcggccatggtctcgacgacgacggcgcagcggcagcggtcgaccctgtcgtccttctccttcaggaggaagaatggctactcggggtacctcgagtccacggccgcggcctcagcgcgggagggcggcttcgacggcttcatgaacacggtcatcaagaagaagctcggcatcatccccaagaatctctcgtggggagagcagtctggcgatgtctttgacgctatggctggggacttcatgaagcccaggatccaggaggtggatcagctgctcaagctcggcgtcaatgttaccatctacaacggccagctcgatctcatctgcgcgaccaaaggcaccatggactgggttcagaagctcaagtgggacggcctcagcaacttcatcaactcacccaggacgcccatctactgcagcaaggaaggccagtccggcacccaagcctttgtcaagtcgtacaagaacctcaaattctactggatactcggagctgggcacatggtacccatcgacaacccttgtcctgcactcaagatgctggctgacattacgcgatctcctgcaaaataggagtaggagcacaggatggagtacagagcctgacaccaattcttcaagattcttttcctgtttaattaattttgtaatactgcattcagttttcttaatttacacagatacagttataaaaaaaaaaaaaaaaaaaa

SEQ ID NO: 3788 - protein, 474 aa, Panicum virgatum
  misc_feature: Ceres CLONE 1794853
  misc_feature (2)..(428): Pfam Name: Peptidase_S10 Pfam Description: Serine carboxypeptidase
MAPGPSAALLLLLCSVAAVAFSQQLQANAAGTPDGSEEWGYVQVRPKAHMFWWLYHSPQRVDDGRTPWPTVLWLQGGPGASGVGYGNFMEIGPLDEELKPRATTWLAKADLLFVDNPVGTGFSYVDGGDKGLMARTDAEAARDLTTLLCALYRDKPRLRASPLYIVAESYGGKFAVTTALAALRAFDQGRLRANLAGVALGDSWISPLDFVMSWGPLLYQVSRVDEKGLQQCNSVSAKIKDQLEKKQFTDAEASWSELENVVIANSNSVDFYNFLKDDAGEDATAAMVSTTTAQRQRSTLSSFSFRRKNGYSGYLESTAAASAREGGFDGFMNTVIKKKLGIIPKNLSWGEQSGDVFDAMAGDFMKPRIQEVDQLLKLGVNVTIYNGQLDLICATKGTMDWVQKLKWDGLSNFINSPRTPIYCSKEGQSGTQAFVKSYKNLKFYWILGAGHMVPIDNPCPALKMLADITRSPAK

SEQ ID NO: 3789 - DNA, 1664 bp, Panicum virgatum
  misc_feature: Ceres CLONE 1794893
  misc_feature: Encodes the peptide sequence at SEQ ID NO. 3790
aatcatcgagcaacacaaggggggaatcggaatcggtcgcctcccctcctctccagctatcctctcctccccccaccaccaacccttcttcctcttccggctcccctctctttctctctctagtatctcctaccgccgccgccgactgtcctcatcctctcgtagctcccccctgccggctgcaagcagcagcagcagcctttgttccgctcagctccctgctcgcgcggccggccggatcggcggcctagtccccttgctgcgccggcggtttccgcccagatctgagccgctcgcccgcccacaaaggccccgtcttcctcccaaagccgccgccttccgcgatggcctcgtcgcccacggcggcccccggggcgtcctactggtgctaccagtgcgaccgcttcgtgcgcgccgcgccgcagcaggagggcgccggcggcgactccccgtccgccgccgtcgcctgcccggcctgcggcggcggcttcctcgaggagatgggcgcgcccccgccgcgggccgcctacctccgccgcccgcgcacgcaccaccaccaccacgacgtcgcggcggccgccgacctgcgcctccgccgcgcccgccgcggcggggccggcgggggcgccggcgccgacacccgcgcctcgcccttcaaccccgtcatcgtgctccgccgctcccccgccggcggggacgccaacgacgccgccgccgcagccagcagcttcgagctcttctacgacgacggcgccggctcgggcctccgcccgctccccgagagcatgtccgacttcctcatgggctcggggttcgagcgcctcctcgaccagctcgcgcagatcgaggccggcggcctcgcccgcgcgcgcgacaacccgccggcctccaaggccgccgtcgagtccatgcccgtcgtcgccgtcgacgccgcccgcgtcgccgccgactcccactgcgccgtctgcaaggagcccttcgagctcggcgccgaggcgcgcgagatgccctgcacccacatctaccacgccgactgcatcctgccctggctcgcgctccgcaactcctgcccggtctgccgccacgagatgcccaccgacgcgccgcgcgcgggggcgcgggccgccggcgagggcgccgacgaggaggccaccgtcggcctcaccatctggaggctccccggcggcggcttcgcggtcgggaggttcgccggcgggaggaggcccgaggagagggagctccccgtcgtgtacacggagatggacggcgggttcaacaacggcggcgcgccgaggaggatctcctgggggtcaaggcagagcccctccacggagaggggcgccatcaggcgcatcctgcgcaacgtcttcgcctgcttcgggcgcggccactcttcttcgcgggcctcgtcctcccaatcccacacgatgccggagctcaacgacgcggcgtccgaccggagcgccgccttcagccatgggtcaaggagccggagcacgagctggcggctcgaggacggccacgccgatgccatggtgcagagataaaaactacggcacaaaaagcttgttgcttgcttgcttgtttcattcatgtatttacttactgcttagtacttagaagaagaagaagaaacacgaaggatttgtagaacagagcgatcg

SEQ ID NO: 3790 - protein, 400 aa, Panicum virgatum
  misc_feature: Ceres CLONE 1794893
  misc_feature: Great-hit functional homolog of the protein sequence given in SEQ ID NO 9294
  misc_feature (1)..(41): Pfam Name: zf-C3HC4 Pfam Description: Zinc finger, C3HC4 type (RING finger)
  misc_feature: Useful for making plants with altered Lignin content
  misc_feature: Useful for making plants with altered alkaloid content
  misc_feature: Useful for making plants with altered lutein content
MASSPTAAPGASYWCYQCDRFVRAAPQQEGAGGDSPSAAVACPACGGGFLEEMGAPPPRAAYLRRPRTHHHHHDVAAAADLRLRRARRGGAGGGAGADTRASPFNPVIVLRRSPAGGDANDAAAAASSFELFYDDGAGSGLRPLPESMSDFLMGSGFERLLDQLAQIEAGGLARARDNPPASKAAVESMPVVAVDAARVAADSHCAVCKEPFELGAEAREMPCTHIYHADCILPWLALRNSCPVCRHEMPTDAPRAGARAAGEGADEEATVGLTIWRLPGGGFAVGRFAGGRRPEERELPVVYTEMDGGFNNGGAPRRISWGSRQSPSTERGAIRRILRNVFACFGRGHSSSRASSSQSHTMPELNDAASDRSAAFSHGSRSRSTSWRLEDGHADAMVQR

SEQ ID NO: 3791 - DNA, 1493 bp, Panicum virgatum
  misc_feature: Ceres CLONE 1794898
  misc_feature: Encodes the peptide sequence at SEQ ID NO. 3792
aaaagagcttgtgtgtgtgtgtagagagagggagaggtgtgcgcaggcgcgcagcagcatcctcaaccatggcctctgctcctgctgctatataagagccggggggctcctctgcttcccaatcccctccatcctggtcccatgcttcggtccacgcacacgcccagccccaccagcggcagcggcagctcggcggcgccggcgtccggctccggcgccaggatggtcggcggcgccggcgcggcgggcagcggcgcgccgagcggggccagcaagctgctgcagatcctcaacgtgcgggtggtgggcagcggcgagcgcgtggtggtgctgtcccacggcttcgggacggaccagtcggcgtggagccgcgtgctcccctacctcacccgcgaccaccgcgtggtgctctacgacctcgtctgcgccggcagcgtcaacccggagcacttcgacttccggcgctacgacacgctcgactcgtacgtcgacgacctgctcgccatcctcgacgcgctccgcatcccgcgctgcgccttcgtcggccactccgtctccgccatgatcggcatcctcgcctccatccagcgccccgagctcttcaccaagctcatcctcatcggggcctcgcccaggttcctgaacgacaacgactaccacggcgggttcgagctgccggagatccagcaggtgttcgacgcgatggcggccaactactcggcgtgggcgacggggtacgcgccgctggcggtgggcgcggacgtaccggcggcggtgcaggagttcagccgcaccctcttcaacatgcgcccggacatctccctccacgtctgccgcacggtgttcaacacggacctccgcggcgtgctgggcatggtgcgcgcgccctgcgtggtggtgcagaccacccgcgacgtctccgtcccggcctccgtcgccgcctacctcaaggcccacctcggcagccgcaccaccgtcgaattcctccagaccgagggccacctcccgcacctcaacgcccccggcctcctcgcccaggtgctccgccgcgcgctcgcccgcttctagcgaagcgacctcaaggcggcgatcactatttttaccgcccgcccccatttttaccctcgctctgccgagaatcaaaaatggcgcgacccgcgcgcgccgttgctgctgctgctgtgtgtgccatgactgtagtactagaacttgttctggtgcccgaattgttttttttttttactttttactggagcagtcgtactggtactccgcatcttgccttcttcccctgcactgccactgcgccgaaggacagaaaagcgggcctcctagcgccacggggcgtgtactcgcgacggtgcaggagtttgttccagcttccgaagcctcgtcccatctgcaagcgtaggctgtaatttttctctctttttattactgctcctagtttactgctatgatatgagattgggatctcctgacctgattaagtg

SEQ ID NO: 3792 - protein, 308 aa, Panicum virgatum
  misc_feature: Ceres CLONE 1794898
  misc_feature (1)..(218): Pfam Name: Abhydrolase_1 Pfam Description: alpha/beta hydrolase fold
MLRSTHTPSPTSGSGSSAAPASGSGARMVGGAGAAGSGAPSGASKLLQILNVRVVGSGERVVVLSHGFGTDQSAWSRVLPYLTRDHRVVLYDLVCAGSVNPEHFDFRRYDTLDSYVDDLLAILDALRIPRCAFVGHSVSAMIGILASIQRPELFTKLILIGASPRFLNDNDYHGGFELPEIQQVFDAMAANYSAWATGYAPLAVGADVPAAVQEFSRTLFNMRPDISLHVCRTVFNTDLRGVLGMVRAPCVVVQTTRDVSVPASVAAYLKAHLGSRTTVEFLQTEGHLPHLNAPGLLAQVLRRALARF

SEQ ID NO: 3793 - DNA, 1936 bp, Panicum virgatum
  misc_feature: Ceres CLONE 1794908
  misc_feature: Encodes the peptide sequence at SEQ ID NO. 3794
ccttcctgcactccagtccttcccccaacgaccccgccgtgtggcggaggcattcgagccgacgcggcgactccaccccgtccccatggcgaccacccgccgtgcgtcgcgcttccccttccccttcgccgccgcaaccctccttcttgtgctacttctcgcgggcggcggcgcggcggacgacgcctccagcgacgacgacgcggggggcccgcggacgcccggctgctccaacaagttccagctggttaaggtgaaaaattgggtgaatgggactgaaggtacaactgttgttggcttaagtgcaagatttggagcccccttgcctagagatatgcaagaagctcaaaaatcatttgctatcctcacaaatccattcgactgttgctccaacttgacatcaaagttaacagattctgttgctttagcaacacgtggggaatgtgctttcactgctaaagcaaagactgctcaggcaggtggtgcggtcggtttactagttatcaatgatgatgaagagctttacaagatggtttgcagtgagaatgacacttctattaatgtgacaatacctgttgtcatgataccacagtcagcaggaaagaagttgaaggacttcctagatcatggagcaagtgtggaagttcagttatattcaccaaatcgacctattgtggacctttcagcatgcttcctgtggataatggctgtaggaaccatagtctgtgcttcactctggtctgaacttgttgcatgcgagcaggttgatgaccgttataatcagctgacccgaaaggatggacctaacacgggaacaaactatagagaagataaagagatctttgagatcagcgccaagggtgctgttgtttttattataatagcttcagttttcctcctcctcctgttctacttcatgtcatcttggttcgtttgggtcctaattgtattattctgcattggtggtattgagggtgtgcatgtttgcttggtcacacttctagctaggattttcaaggattgtgggcaaaagactgtacaacttccctttcttggggaggtcttaatcatatctgttggaactgtaccattttgtgtggtctttgcaattctctgggctgtgtatcggcatgcttcatttgcttggataggccaagatatcctcggcatatgtttgatgataactgtacttcagatggcacgcttaccaaatatcagggttgcatcagcacttcttagtgctgcgtttgtgtatgacatattttgggttttcatttcacctcttatattccatgaaagcgtcatgattgcagttgctcgtggtgataacacaggggaatcaattccgatgctcctaaggatacctcgcttctttgatccatggggtggttacgatatgataggctttggtgatattattttccccggattgcttgttgcattcagctatagatttgacagggcaagcaaaaagggtatcttaaatggatactttctgtggctgactgtgggatatgctgttggcctcttccttacctatcttgcgcttttcctgatggacgggcacggccaacctgcgttgctgtacctggttccatgtacattagggcttattgttatccttggttgggtaagaggtgacctacacgacttgtggaactatggaaaaggtcgaactgaaaacgtggtcgatgaaccttgagaagtgaaattctgactaatgataccggagtgctggtgacatccatattattcaatcgacggattatcagagatgtatagaattaccttgattgaaaagtttttacgtgtcttttctcctttgtagtatatagtttaagaatgtattattcaggggctgggtacactggaactgccggtgttgtcatattaattcggaaaagacgaggtttgataaaaaaaaaaaaaaaaaaaa

SEQ ID NO: 3794 - protein, 538 aa, Panicum virgatum
  misc_feature: Ceres CLONE 1794908
  misc_feature (1)..(282): Pfam Name: Peptidase_A22B Pfam Description: Signal peptide peptidase
MATTRRASRFPFPFAAATLLLVLLLAGGGAADDASSDDDAGGPRTPGCSNKFQLVKVKNWVNGTEGTTVVGLSARFGAPLPRDMQEAQKSFAILTNPFDCCSNLTSKLTDSVALATRGECAFTAKAKTAQAGGAVGLLVINDDEELYKMVCSENDTSINVTIPVVMIPQSAGKKLKDFLDHGASVEVQLYSPNRPIVDLSACFLWIMAVGTIVCASLWSELVACEQVDDRYNQLTRKDGPNTGTNYREDKEIFEISAKGAVVFIIIASVFLLLLFYFMSSWFVWVLIVLFCIGGIEGVHVCLVTLLARIFKDCGQKTVQLPFLGEVLIISVGTVPFCVVFAILWAVYRHASFAWIGQDILGICLMITVLQMARLPNIRVASALLSAAFVYDIFWVFISPLIFHESVMIAVARGDNTGESIPMLLRIPRFFDPWGGYDMIGFGDIIFPGLLVAFSYRFDRASKKGILNGYFLWLTVGYAVGLFLTYLALFLMDGHGQPALLYLVPCTLGLIVILGWVRGDLHDLWNYGKGRTENVVDEP

SEQ ID NO: 3795 - DNA, 2018 bp, Panicum virgatum
  misc_feature: Ceres CLONE 1794911
  misc_feature: Encodes the peptide sequence at SEQ ID NO. 3796
ccaagatcacactcgccgagctagctcactctcagcactagtaactcccccacagtgccagtgccagtgccagtgccacccagccagcagcatgggctcgccggcggcgcgccagctgaggcagctcaagccgctgtaccagcacgtggtgaaccacttcgtggccgtgctcgcggcgccgctggccgtggcggccgccgtcagcgcggggcgcgccgggcccggggagctgctcgccaggctgcaggcgctccgggcggcgcaccttctcctcgccgccttcgtccccgccgccgcggcggcgctgtacctcctgctgcgcccgcggccggtgtacctggtcgactacgcctgcttccgcacgcggcccaactgccgcgtccccttcgccaccttcctggagcacgccaagctggtgaccttcgtcgagggcgcctccatcgacgagcgcagcgtccggttcatgacgcggctgctggagcgctcggggctcggggaggagacctgcctgccccccgcgcaccactacatcccgccctaccggaacatggaggcgtcgcgcgccgaggtggagctggtcatcttctccgccatcgacgacctgctcgccaagaccgggatcagcccgggcgccatcgacatcctcgtcgtcaactgcagcctcttcgcgcccgtcccgtccttcacggacatgatcatccgccggtacgggatgcgggaggacatccggaacgtgcacctgtccgggatggggtgcagcgcggggctcatctccgtggggctggcgcgcaacttcctgcaggtggcgccccggggcgcgcacgcgctggtggtgtccacggagaccatcacgcccaactactacgtgggcaaggagcgcgccatgctcctgcccaactgcctcttccgcatgggcggcgccgccgtgctgctgtcgacgtcgcgcgccagggcgcggttccggctcgcccgcgtggtgcgcacgctcacgggcgccggcgacagcgcctaccggtgcgtgttccaggaggaggacggcgagggccaccgcgggatcaacctgtccaaggacctgatgaccatcgccggcgacgcgctcaaggccaacatcaccgccatcggcccgctggtgctgccggcgtcggagcagctgctgttcgcgctctccttcatcgcgcggcgcgtgctcaacaaccgccgcgtcaagccgtacctcccggacttccgcacggcgttcgagcacttctgcatccacgcggggggccgcgccgtcatcgacgagctgcagcgcagcctggggctgtcggaccaggacgtggaggcgtcgcggatggctctgcaccggttcggcaacacgtccagcagctcggtctggtacgagctggcctacatcgaggccaagggccggatgcgcaagggcgaccgcgtgtggatgatcggcttcgggtccgggttcaagtgcaacagcgcggcgtgggagtgcatggcgccggcgcgctccgccgaggggccgtgggaggacagcatctgccgctaccccgtcgacatcccggaggtgctcaagcactagccagccgccgccgccgcctgatttgcatccgtcggcggcgcgagcatgtagtgtcggtctcccccgctcttgaaaccggcagaccggccgcgcgcgtgccggccggtgacgaggaaagaagacggtctccgacgtgacagcgcgcgtgttgttggtgccgggcggccaggccgggcgcgttgaatgccgaggctggcgcgtccatgtgtgcgctcctccccggaccccggaggcgggggctggtggttgcgcgcgggcacgccggggagggttaaaacttaaaatccccggccatttacacacgtagtacagtactcgtcgtcctcatttgtacccttcctttctgtcttttcgcttcctttttttactacagtacctcatttgtttgggtcaccaccactaataattttaattttacgtttgtctgtaaaaaaaaaaaaaaaaaaaa

SEQ ID NO: 3796 - protein, 492 aa, Panicum virgatum
  misc_feature: Ceres CLONE 1794911
  misc_feature (1)..(293): Pfam Name: FAE1_CUT1_RppA Pfam Description: FAE1/Type III polyketide synthase-like protein
  misc_feature (53)..(486): SWISSPROT Homolog: EC 2.3.1.- 3-ketoacyl-CoA synthase 1
MGSPAARQLRQLKPLYQHVVNHFVAVLAAPLAVAAAVSAGRAGPGELLARLQALRAAHLLLAAFVPAAAAALYLLLRPRPVYLVDYACFRTRPNCRVPFATFLEHAKLVTFVEGASIDERSVRFMTRLLERSGLGEETCLPPAHHYIPPYRNMEASRAEVELVIFSAIDDLLAKTGISPGAIDILVVNCSLFAPVPSFTDMIIRRYGMREDIRNVHLSGMGCSAGLISVGLARNFLQVAPRGAHALVVSTETITPNYYVGKERAMLLPNCLFRMGGAAVLLSTSRARARFRLARVVRTLTGAGDSAYRCVFQEEDGEGHRGINLSKDLMTIAGDALKANITAIGPLVLPASEQLLFALSFIARRVLNNRRVKPYLPDFRTAFEHFCIHAGGRAVIDELQRSLGLSDQDVEASRMALHRFGNTSSSSVWYELAYIEAKGRMRKGDRVWMIGFGSGFKCNSAAWECMAPARSAEGPWEDSICRYPVDIPEVLKH

SEQ ID NO: 3797 - DNA, 2377 bp, Panicum virgatum
  misc_feature: Ceres CLONE 1794914
  misc_feature: Encodes the peptide sequence at SEQ ID NO. 3798
cgcgctggtgccctccccccgccccgccccgccgccctttctcgtcgggccttggcgcctcgccggtgcgcgcgtgcgtgtgcgaggggcggcgactgaactcaggtcctgttcgctatccggagcggacgctgaccacatttactcctccatcgctgctccgcgagtctctttcaaattccccagaggatcagagataaagatcatcagatcaactatctgaaggaatttcttttatagaaattttcagaatgactagcacaaatatctcttgggcatgccttctattgctatgttttgcttcgattggagatgcagaatacatgaagtacaaggacccaaagcagcctatcaacacaagaatcaaggatcttcttggtaggatgacccttgctgaaaaaattggccaaatgacacagatagaacggcaggttgcatctgcagatgtcatgaaaaagtacttcataggtagcatcttaagtggtggcggaagtgttcctgctccccaggccagtccatcaatttgggttaacatggtaaatgaattccagaaaggtgccttatcaacacgtctaggaattcctatgatttatgggattgatgctgttcacggtaataacaatgtctacaacgccaccttattccctcacaacatcgggcttggagctacaagggatcctgacctcgtaagaaggattggtgtagcaactgctcttgaagtgcgggcaacaggcattcaatatacttttgctccatgtattgcggtttgcagagatccaagatggggacgatgctatgagagctacagtgaagatcacacaattgtccagcagatgacagatattatccttggcttgcagggagagatcccagtcaatcataccaagggagttccatatgtagccggaaaggataaagttgccgcttgtgctaaacactttgttggtgatggtgggactcataatggaatcaatgagaataacactatcattgatgaacatggactgctaagcattcacatgccaccatattatgactctatcataaagggtgttgcaactattatggtgtcatactcaagcttgaatggtgtaaaaatgcatgccaaccatgatctagtcactggctacctgaagtccaaactacattttagaggttttgtgatatcggactggctaggaatagaccgtatcacatcacctcctggtgcaaactatacttattctgtgcaagctggaataaatgcggggattgacatggtcatggttccatacaattacactgaatacattgacgatctgacatctcttgtccgcaagggtatcgtcaatatgagcagaattgatgatgctgtgaggcgaatccttcgagtcaaatttacgatgggtctgtttgagaacccattagctgatcttagctttgcagatcagcttggaaagaaggagcatagggaattggccagagaagctgtcaggaaatcacttgttctcttgaaaaatggaaattctcccaatcagcaattcttacctcttccaaagaaagctagaaggatccttgtagctggaagccatgctagcaatttgggctaccagtgtggaggatggtcaattcaatggatggggggcaccgggaatatcacgaccgggacaacaattcttgatgccataaagtccactgttgccgactcaacgcctgtcgtctactccgagaatcctgacgacagtttcatgaagcataatgacttctcattctctatcattgttgttggagagccaccttattctgaaacagtaggtgacagcactgacctcactatactagaccctggtccagacacgatcagaactgtgtgctctgcagttaaatgtgtggtggttatcgtctctggtcgtcctgttgtgattgaaccatatgttccacttacggaagcgcttgttgctgcttggctacctggcaccgaaggtcagggtgtcgctgatttactcttcggggactatggttttactggaaagctcccacgcacctggttcaagtctgtggaccagctgcccatgaatgtgggagatccgcactatgatccactctatcctttcagctttggtttgacaataaattcatcattgccagggttttctggtgttaacaatctgggagatacgaagcaaagagtgatacatgttgtactgtgctctctactgtcattgatactgatcaatgatttgggcataggcgtatttcaacacccagctgcccgtatgtagtctttgtatgattaaccatgtctaatgttgccttgttgatgatgcctctgcaaaatgccgttgctgaccattaattaatcagtctattatttcctcaaaaaaaaaaaaaaaaaaaa

SEQ ID NO: 3798 - protein, 669 aa, Panicum virgatum
  misc_feature: Ceres CLONE 1794914
  misc_feature (1)..(212): Pfam Name: Glyco_hydro_3_C Pfam Description: Glycosyl hydrolase family 3 C terminal domain
  misc_feature (1)..(238): Pfam Name: Glyco_hydro_3 Pfam Description: Glycosyl hydrolase family 3 N terminal domain
MTSTNISWACLLLLCFASIGDAEYMKYKDPKQPINTRIKDLLGRMTLAEKIGQMTQIERQVASADVMKKYFIGSILSGGGSVPAPQASPSIWVNMVNEFQKGALSTRLGIPMIYGIDAVHGNNNVYNATLFPHNIGLGATRDPDLVRRIGVATALEVRATGIQYTFAPCIAVCRDPRWGRCYESYSEDHTIVQQMTDIILGLQGEIPVNHTKGVPYVAGKDKVAACAKHFVGDGGTHNGINENNTIIDEHGLLSIHMPPYYDSIIKGVATIMVSYSSLNGVKMHANHDLVTGYLKSKLHFRGFVISDWLGIDRITSPPGANYTYSVQAGINAGIDMVMVPYNYTEYIDDLTSLVRKGIVNMSRIDDAVRRILRVKFTMGLFENPLADLSFADQLGKKEHRELAREAVRKSLVLLKNGNSPNQQFLPLPKKARRILVAGSHASNLGYQCGGWSIQWMGGTGNITTGTTILDAIKSTVADSTPVVYSENPDDSFMKHNDFSFSIIVVGEPPYSETVGDSTDLTILDPGPDTIRTVCSAVKCVVVIVSGRPVVIEPYVPLTEALVAAWLPGTEGQGVADLLFGDYGFTGKLPRTWFKSVDQLPMNVGDPHYDPLYPFSFGLTINSSLPGFSGVNNLGDTKQRVIHVVLCSLLSLILINDLGIGVFQHPAARM

SEQ ID NO: 3799 - DNA, 1412 bp, Panicum virgatum
  misc_feature: Ceres CLONE 1794926
  misc_feature: Encodes the peptide sequence at SEQ ID NO. 3800
actcaccatttccatctttcctcttcttcgccggcgccaggcccgcatcgccgaacctcccactttagcttctctccaccgaagcacgccggccggagaattcatccagacttggcactgagcgaatccttttcctgttaattgcggattcttctcctgcggtcttgcggaagacatggcggggttcggatggagagtcggttgcaaggtgcagagatggggtcggagttgcttccggggcttctcttctgctgcgattccgtctcagctggagaatgtaggattcataggactcgggaatatgggatcccatatggcaaggaacctgattacggctggatataaagtgactgttcatgatataaatgaaaattcgatgaagaaattctcagaagatggaatccccacaaagcagtctccacttgaagtttcagagtcgagtgatgtcgtgattaccatgcttccttcctcttcccatgttttagaggtatacaatggaactaatggcttgcttggcggtggtagccaccttggaccttggttgtacatagattcatctacagttgatccgcaaacatcaagaaagatatcgatggccatatcaagatgtcatttaaaagaaaataaaggctacgctgaaaacccaatgattctggatgctccggtgtctggaggtgttcctgctgcagaagctgcgaagctaactttcatggtgggaggtctagaggaagcatatttagcagccaagcccctacttctctcaatggggaaaagggcaatctactgcggtgggactggaaatggctcggctgcaaagatctgtaacaacatggcaatggcgatcagcatgcttggggtctcggaggccttcgctcttggtcagaatcttgggatcaaagcaagcactcttacagacattttcaattgctcaagtgctcgctgctggagtagcgacacatataacccagttcccggagttatggatgacgtgccatcatcgaggaactatcacggtggtttcacctccaaactaatggctaaagatttggatttggccatggcctctgcatctggagtcggcttcaaatgtcccatgggctctgaggcacatgaaatttaccgaaagctctgcggggatggctgcgaactcaaggacttctcatgtgcattccgccattactatgctggcaaggatgaagagtgaccttgttgtagttactctagcaaacttgccgcgtgttcaagtgaatcaaacaaaaataaagtttctggactggttccagtgtaaatctgtaaagttgtactgagacacggtgtctttgtataggaattccctttgtaaactgtttgttggtttgcttctcggcaatcggcaatagactgttctgagccaaaaaaaaaaaaaaaaaaaa

SEQ ID NO: 3800 - protein, 342 aa, Panicum virgatum
  misc_feature: Ceres CLONE 1794926
  misc_feature (1)..(175): Pfam Name: NAD_binding_2 Pfam Description: NAD binding domain of 6- phosphogluconate dehydrogenase
  misc_feature (35)..(334): SWISSPROT Homolog: EC 1.1.1.31 3-hydroxyisobutyrate dehydrogenase, mitochondrial precursor
MAGFGWRVGCKVQRWGRSCFRGFSSAAIPSQLENVGFIGLGNMGSHMARNLITAGYKVTVHDINENSMKKFSEDGIPTKQSPLEVSESSDVVITMLPSSSHVLEVYNGTNGLLGGGSHLGPWLYIDSSTVDPQTSRKISMAISRCHLKENKGYAENPMILDAPVSGGVPAAEAAKLTFMVGGLEEAYLAAKPLLLSMGKRAIYCGGTGNGSAAKICNNMAMAISMLGVSEAFALGQNLGIKASTLTDIFNCSSARCWSSDTYNPVPGVMDDVPSSRNYHGGFTSKLMAKDLDLAMASASGVGFKCPMGSEAHEIYRKLCGDGCELKDFSCAFRHYYAGKDEE

SEQ ID NO: 3801 - DNA, 1666 bp, Panicum virgatum
  misc_feature: Ceres CLONE 1794946
  misc_feature: Encodes the peptide sequence at SEQ ID NO. 3802
tgagctcccacagccaccgagctgtcgttcttgaaccttgatccccagttccccaccatgacgagctctcaggtgcgcgtcctcaacatcagccatgtccgtcccgtccaaacggacggcgcgtcgccgccggtccaaggcgagcacaagctgtccttcatggacctgctccagatctccaagacaatccagcgcctgttcttcttcgacggccccgacctcccgccgttcccgacggtcgtgagcgcgctgcggtcctccctcaccgccacgctcgcggtcttccccccgctcgccggcgagctggctttccgccccgtctccggctccggcgacgtcgtcatcgactcctccccccgccgccatcgcctcctgccctcctccccgggcgtcaggttcgtcgaggccgagttcgccggcggcgccgacgccatgcgccgcctggcccgggtcgacgcgcatgacgcggaggcgttcgcgcggctcgtcccagagctgctcgaggcccggaggctgcccgccccggtcctcgccgtgcaggtcacgaggcccgcggccggcgccggcgccgtggcggtcggggtgtcgatcgcgcacgcgatggccgacggccacgcggtgtggcagttcctgcgggcgtggtccacggcgtcgcgggagggccccgcgtccctcgccgcgccgggcttcgtgccgccgacgtttgaccgggcgggcatccggcaccccaagtccgccgagctggtccgctccgtactcagcagggtcgcaccggcgctgcccctgctcaggccagcgtcgtcgaagccggagatcatggagccgagcaggaggaccttcttgctccgcgccgaggagatccggtccctgaagcagcacatcctcgaacggagcggagcagccagccgcgggaacggcgagccgcccgagccgccgagcacctacgtcgccgtcacgtccctggcgtgggcgtccgtcgcccgggcgacgccagccatgctcgacgccgacgacgcccacctcatggtcagcgcggactgccggcgccgcctgcgcctgccgctcggcaacggcttcttcgggacctgcgtcaaggcgggccacgcgcgggcccgcgcgggggacctgcgcggcgcggccggcgtcgcgcgcgccgccgcggccatccggcgcgcgatccgcgcgcacctcgaggagggcgacccgctgtcggacgccgagggctggctggcggcgtacggcgccgtgcccaaggagaggctcgtgacggtggggtcgtccaaccggttcgcggcgtacgagacggacttcgggtggggcgcgccgcgccgcgtcgagctggtgtccctgttcgcgccgcggatggtgacgctgctcggcgcgagggacggcggcgtgcatgtgtcggtggcgctcgacggggccacgatggacgccttcgcggccagcttcgccgtcccggctcccgtcccggcggctggcgctgtgtccgtagcacgatagctgcggccgtgtgaagttcggggcatggggttcgctttttgtttcactgaaccttttttattttgaaatgcttgtttcattgagcctgttcacacttatggtcctctaaattcatcatccaaaaaaatatttatattctgatcaaaaaaaaaaaaaaaaaaaa

SEQ ID NO: 3802 - protein, 481 aa, Panicum virgatum
  misc_feature: Ceres CLONE 1794946
  misc_feature (1)..(465): Pfam Name: Transferase Pfam Description: Transferase family
MTSSQVRVLNISHVRPVQTDGASPPVQGEHKLSFMDLLQISKTIQRLFFFDGPDLPPFPTVVSALRSSLTATLAVFPPLAGELAFRPVSGSGDVVIDSSPRRHRLLPSSPGVRFVEAEFAGGADAMRRLARVDAHDAEAFARLVPELLEARRLPAPVLAVQVTRPAAGAGAVAVGVSIAHAMADGHAVWQFLRAWSTASREGPASLAAPGFVPPTFDRAGIRHPKSAELVRSVLSRVAPALPLLRPASSKPEIMEPSRRTFLLRAEEIRSLKQHILERSGAASRGNGEPPEPPSTYVAVTSLAWASVARATPAMLDADDAHLMVSADCRRRLRLPLGNGFFGTCVKAGHARARAGDLRGAAGVARAAAAIRRAIRAHLEEGDPLSDAEGWLAAYGAVPKERLVTVGSSNRFAAYETDFGWGAPRRVELVSLFAPRMVTLLGARDGGVHVSVALDGATMDAFAASFAVPAPVPAAGAVSVAR

SEQ ID NO: 3803 - DNA, 3173 bp, Panicum virgatum
  misc_feature: Ceres CLONE 1794949
  misc_feature: Encodes the peptide sequence at SEQ ID NO. 3804
ctactccgtttctctctcctcactttctcctttttttactgcacttctctctctctcctcacacccccggcgtcgtccctcacaccccagcagcttcgtcgtctcctctccctccccaacaatctcgaaccggatagatagatcggccctatctttgcctcctcccgggcgactcggccgcaagctcgccgctttcctctcgatcttccgcgccttcccgttttgggccctgctccgcatggggattccggagatcttcggggcggttcggtgctgagatggttcgccgcatcacgcgctgctgtgactcgcaacagttcttccgatccgaggagccccgatgatgaacagcatgccgatctcttcgtcccctgcgccaggagtcgacggcggcgcggtggcagccggcacgccaaggatgaatgcgacggctgcggccgctgtcgcagagatggcgaggcatctcaccgtcgacacggatgacgccttcgccggcctgctggagctcgccgctgacgacgacgcggaggggctgcgccgcgcgctggagcgcgccccgccggccgccgccgatgaggccggcctctggtatggccgccggaaggttctggagcatcgcaccccgctgatggtcgccgcgacctacgggagcctcgctgcgctccgcctgctggtttctctcccgtccgtcgacgtcaaccgccgctccggcaccgatggcaccactgccctccactgcgccgcctctggtggctcccggacggcggttgaggccatcaagctgctgctcggtgcaggggcagacgctgacgccacggatgactctgggcgccgtccggctgatatgatctctgtgccgccgaagatgtttgacgccaagtttgccctccaagatcttcttggatgcccgaagcctgagcacggcatgctccgggtggtgacaaggtccaccaactcgatctcatcacccgtttcatcccccactgcagaggatgcacgctctccatctgctgctgtgatgatgacgacaaagtttgctgacctgcctagggttgcgacatcggagaagaaggaatatccagtggatccatcccttccagatatcaagaacagcatctatgcctctgatgagttccgcatgtactcgttcaagatccgcccttgttcgcgggcatactcgcatgactggaccgagtgcccctttgtccatccaggagagaatgctcggcgccgggacccccgcaagtaccactacagttgtgtgccatgcccagacttcaggaaaggcgtgtgccgccgcggtgacatgtgtgagtatgctcatggagtatttgagtgctggctccatccagcacagtaccgtacacggctttgcaaggatggtacaagctgtaaccggcgtgtctgtttctttgcccacacaactgatgagctccgcccactgtatgtctccactggatctgctgtaccatccccaagggcttcagcaacagctgcaatggagatggctgcagctatgggcttgatgcctggttccccatcatctgtttcagcagtgatgtctccatttacaccaccaatgtccccttcaggcaatgggatgcccccttcattggggtggcagcagccaaatgttccaacattacaccttcctggcagcagccttcagtcgagcaggctccgaacatcacttagtgcaagggatatgcctgctgatgactactccctgatgcaggatcttgattcacagcttatgaatgatctgtgctattcacgtctcagttcatccacagggaaccactctgctcgaaccaagtccctgaatccgtcaaacctggatgatctcttctctgccgagatggtctcatccccgaggtatagtaatgctgaccagggtgctatgttttcaccttctcacaaggctgctatcctgaatcagttccagcagcagcagcaagcactgctttctccaatcaacactggggtatattcaccaaaggctatggacaaccagcagttgccttcacactcatccctgttgcaagcatcacttgggatatcctcccctggcctgatgtctccacggtgtgttgaatctggttccccaatgaactcccacctagctgctgctcttgttcagcgtgagaaacagcagcagcagcagcagacaatgaggagtctcagttctcgtgaccttgggcctagtgcagcacgagcatcagctcttgttggctcccctctaagctcatcatggtccaagtggggatctccttcagggacaccagattggggtgtagatggtgaagaattgggtaagctccgccgctcatcgtcctttgagctgaggtctggtggtgatgaccctgatctctcttgggtacatacactggttaaggaatctccgccagagaagcaagttaccatggctgaatccattaactctgttggaccctcacagctaatgcctcccggcatgaacaacggtgaaggttctggtctgagcacacagcttgatggacacgaccaagctgcggttataggagcattgcttgagcagatgcagcttgatcggcaggttggtagtctagcaacataagcctgcaataagcctggaaggtgtgaggataatatattcttgtctaatgatttcgtattttttccccgtcaattgaggtattcaacaaagatggatagctgaaggtggtgattcagagattggtttttctttaattttggaggtaaatcatatacattattgaggttccagtaggttaaagagtgaagtttctcggttggggttgttccaaggccaacccaggtagaatcgcaccccggcagcatcagttcatcgatcagaagttatctattttgttaattaaccctgttaagaaaaagaaggcttgttcgccatgtcagaattctttcctttccctagtggtgtttattactttattttgttcattatgatattgatacttgatgtactgatggtgtaagtggttacttgggatcctataatcctgtcaagttaaaaggttttttttttcacccttcacaaattgtcgcggattatcatgcagccttgttttggttagaccttgaggcctgcataatccccttggatgatattttcaataatgtaatattgtttttaaaaaaaaaaaaaaaaaaaa

SEQ ID NO: 3804 - protein, 751 aa, Panicum virgatum
  misc_feature: Ceres CLONE 1794949
  misc_feature (1)..(26): Pfam Name: zf-CCCH Pfam Description: Zinc finger C-x8-C-x5-C-x3-H type (and similar)
  misc_feature: The sequence is a functional homolog of  SEQ ID NO 230 in the  10/412,699 US patent application
  misc_feature: Useful for making plants with modulated growth and phenotype characteristics
MMNSMPISSSPAPGVDGGAVAAGTPRMNATAAAAVAEMARHLTVDTDDAFAGLLELAADDDAEGLRRALERAPPAAADEAGLWYGRRKVLEHRTPLMVAATYGSLAALRLLVSLPSVDVNRRSGTDGTTALHCAASGGSRTAVEAIKLLLGAGADADATDDSGRRPADMISVPPKMFDAKFALQDLLGCPKPEHGMLRVVTRSTNSISSPVSSPTAEDARSPSAAVMMTTKFADLPRVATSEKKEYPVDPSLPDIKNSIYASDEFRMYSFKIRPCSRAYSHDWTECPFVHPGENARRRDPRKYHYSCVPCPDFRKGVCRRGDMCEYAHGVFECWLHPAQYRTRLCKDGTSCNRRVCFFAHTTDELRPLYVSTGSAVPSPRASATAAMEMAAAMGLMPGSPSSVSAVMSPFTPPMSPSGNGMPPSLGWQQPNVPTLHLPGSSLQSSRLRTSLSARDMPADDYSLMQDLDSQLMNDLCYSRLSSSTGNHSARTKSLNPSNLDDLFSAEMVSSPRYSNADQGAMFSPSHKAAILNQFQQQQQALLSPINTGVYSPKAMDNQQLPSHSSLLQASLGISSPGLMSPRCVESGSPMNSHLAAALVQREKQQQQQQTMRSLSSRDLGPSAARASALVGSPLSSSWSKWGSPSGTPDWGVDGEELGKLRRSSSFELRSGGDDPDLSWVHTLVKESPPEKQVTMAESINSVGPSQLMPPGMNNGEGSGLSTQLDGHDQAAVIGALLEQMQLDRQVGSLAT

SEQ ID NO: 3805 - DNA, 2081 bp, Panicum virgatum
  misc_feature: Ceres CLONE 1794997
  misc_feature: Encodes the peptide sequence at SEQ ID NO. 3806
gtatgcatcgctgaatgcgatctcaacgtccgttttgcaggctcttctgaattctgatcccttccctcgcacgcttggggcagttaccttcgcgcggaggtgggcagctgaactaggcgcgccgtggacatggcggcgtggtctaggatcgggaggggcgcgcagctgtcgctgtcgcagtccctgtcgaggatcgtctcggagggcggcgcgcctccggcgggggcggcgtccgcgctgcgcggtgccgctgcgctgtcacgcgcccgggggcagcacgcgtcgtcgctccacagcctcgcgttcgcggggctcgcgggcaggagcgacgccgccggggcccacctcctcccgccgaccggcaccaggggcatcggcaccacgcccacgaggctgcaccccgcgtcgtcggcggcggtggcggcggagctctcggacgcggagacgagggagcccgaggccgcggcggcgcctcctcctcctcgccacatgccgaggctcgggccgacgaagcccggggagaagccccgcttggtggtgctgggcaccgggtggggggcgtgccggctgctcaaggacgtggacacgagcgcctacgacgtggtgtgcgtctccccccggaaccacatggtgttcacgccgctgctcgcgtccacctgcgtcggcacgctcgagttccgctccgtcgtcgagcccgtcagccgcatccagtcggcgctcgccacccgcccgggctcctacttcttcctcgcctcctgcaccggcgtcgacacgcgggcgcacgaggtgctctgcacggccgccgccggcgacgggctgcccagcgagccgtaccacttcaagatcgcctacgacaagctggtgatcgccagcggcgcggagccgctgacgttcaacatcaagggcgtcaaggagagcgccatcttcctccgcgaggtcagccacgcgcaggagatccgcaggaagctgctcaccaacctcatgctctccgagaatccaggcttgtctgaggaggagaaggcgcggctcctgcactgcgtggtcgtcggcggaggccccaccggcgtcgagttcagcggcgagctcagcgacttcatcatgcgcgacgtgcgggagaggtacgcgcacgtcaaggactacgtcaaggtcaccctcatcgaggcaaacgagatcctgtcatcgttcgatatcggcctgcgtcagtacgcaacgaatcatttgtcaaagtatggagtcaagctggtgcgaggcatcgtgaaggaggtgaagccctcggagatcaccctgagcgacggcacccgcgtgccctacggcctgctggtctggtccacgggcgtcggcccgtcggagttcgtcaagtccctggacctgcccaagtcgcccggcggcaggatcggcgtggacgagtggctccgcgtgccctcggccccggacctgttcgcgctgggcgactgcgcgggctttctggagcagaccggcaagccggtgctcccggcgctggcgcaggtcgcggagcgggagggccggtacctggcgcggctgctcgggagggtcgcggcgcagggcggcagcaaggcgcactgcatcggcaaggccgagctcggggagcccttcgtgtacaagcacatcggcagcatggcgtcggtcgggcggtacaaggcgctggtcgacctcagggagaacaaggacgccaagggggtgtcgatggcgggcttcatcagctggctcatgtggcggtcggcgtacctgacgcgggtggtgagctggaggaacaggttctacgtggcggtcaactgggcgacgacgctcgtgtttggcagggacaacaccaggatcggctgacgaggatgcagttctactagaacgtcggctgtgctcctctgaataatccacgggagcagcagactgactgtcattttcgttcttttatttttttctgttccttgttcatccacgttagagaattttagtattctatatattgacttcttatacggttatagcggatcaaactatcacattttccacgagaagtatgaaacatgaacagaatttttgttgaaaaaaaaaaaaaaaaaaaa

SEQ ID NO: 3806 - protein, 570 aa, Panicum virgatum
  misc_feature: Ceres CLONE 1794997
  misc_feature (1)..(313): Pfam Name: Pyr_redox_2 Pfam Description: Pyridine nucleotide-disulphide oxidoreductase
MAAWSRIGRGAQLSLSQSLSRIVSEGGAPPAGAASALRGAAALSRARGQHASSLHSLAFAGLAGRSDAAGAHLLPPTGTRGIGTTPTRLHPASSAAVAAELSDAETREPEAAAAPPPPRHMPRLGPTKPGEKPRLVVLGTGWGACRLLKDVDTSAYDVVCVSPRNHMVFTPLLASTCVGTLEFRSVVEPVSRIQSALATRPGSYFFLASCTGVDTRAHEVLCTAAAGDGLPSEPYHFKIAYDKLVIASGAEPLTFNIKGVKESAIFLREVSHAQEIRRKLLTNLMLSENPGLSEEEKARLLHCVVVGGGPTGVEFSGELSDFIMRDVRERYAHVKDYVKVTLIEANEILSSFDIGLRQYATNHLSKYGVKLVRGIVKEVKPSEITLSDGTRVPYGLLVWSTGVGPSEFVKSLDLPKSPGGRIGVDEWLRVPSAPDLFALGDCAGFLEQTGKPVLPALAQVAEREGRYLARLLGRVAAQGGSKAHCIGKAELGEPFVYKHIGSMASVGRYKALVDLRENKDAKGVSMAGFISWLMWRSAYLTRVVSWRNRFYVAVNWATTLVFGRDNTRIG

SEQ ID NO: 3807 - DNA, 1726 bp, Panicum virgatum
  misc_feature: Ceres CLONE 1794999
  misc_feature: Encodes the peptide sequence at SEQ ID NO. 3808
ctatatggttataggatgccatccagcattacaggcagaggcagcccaagaacgcggcttcattccaagaaaacagttgccggccgcattcatggacggcggcggcgtccgggtcgtctcccggcgcatggtgcgcccgttgacgccgccgccgccgatggcgaacggcaacggctgccatccacccaaggcggaggtcgaggtgatccacctcacgccctgggacctacgcctcatcagcatcgactacatccagaagggcatcctcctgcccaggcctccggtctccggcgccagcctcgtcaacgccctccagtcctcgttcgcgcgcgccctgcgcctcttctatcccttcgccggccggctcgccgccgaggagcttggcgacggcaccgtgtccatcttcctgcggtgcaccggcgagggcgccgagttcgtgcacgccgtggcgccgggggtcgccgccgcggacatcgtctcctcgctctacacgccgcccgtagtctgggagttctacccgctggcacgggttctcggcgccgacgccgccatcggaccgctccccgtgctggccgtccaggtcaccgagctcgccgacggcgtgttcttcggcatgaccttgaaccactccgtcggcgacggcaccgccttctggcacttcttcaacacctggtcggagatccaccgagccggcggcgacctgcgcggcggtctctccacgccgccgccggtgctccagcggtggttcctcgagacctgccccgtgccgatccccatgccattccgcaagctggagcacatcgtgaagcgattcgagcgcacggcggtgcaggagtgcttcttcaccttctccggcgcgagcgtcaggaagctcaaggcccgggcgaactgcgagatggccatggccggcacggccgacgccgccatctcgtcgctccaggcggtcctggcgcacctctggcgcgccgtgtgccgcgcccggcgcctgccgccggagcagggcacgttctactcggtggtcgtcgggtgccgggggcgcgtcggcggcatccccccgggctacgtcggcaacgccatggtgttcggcaggggggcggccaccgccggcgagatcgaggagaaggggctgggctggacggcgtggctcctgaaccgtgccgtggcgtcgttcgacgaggcgagcatgagggagtcgctggagcggtgggtccgggagccggacttcacgtacgtgggcaacctgtcgtccggcggcacggcgctggtgacggggagctcgccgcggttcgacgtgttcgggaacgacttcgggtgggggaagccggtggccatccggagcggcgccgggaacaaggtcgacggcaaggcgacggtgttcgaggggccggagcggggagggagcatgtcgctggaggtgtgcatcgccccggacgcgctggagaggctcgtcgccgacgaggagttcatggacgcggtgagcatgccggggttgttgaccgcgccgtgcagcattaatcacatcgttgacaagctgccgtgatgcacatgcccatgcatgctgcacgcagacagcctcgacggttgatgatgaagaatcaacactcgtggttcgtttattttagctagttattaagtatactagctccgtttcaaattgtagttcgtttgatttttttttgaaattaaatttgaccacttgttttattcaaaaaaaaaaaaaaaaaaa

SEQ ID NO: 3808 - protein, 511 aa, Panicum virgatum
  misc_feature: Ceres CLONE 1794999
  misc_feature (1)..(454): Pfam Name: Transferase Pfam Description: Transferase family
MVIGCHPALQAEAAQERGFIPRKQLPAAFMDGGGVRVVSRRMVRPLTPPPPMANGNGCHPPKAEVEVIHLTPWDLRLISIDYIQKGILLPRPPVSGASLVNALQSSFARALRLFYPFAGRLAAEELGDGTVSIFLRCTGEGAEFVHAVAPGVAAADIVSSLYTPPVVWEFYPLARVLGADAAIGPLPVLAVQVTELADGVFFGMTLNHSVGDGTAFWHFFNTWSEIHRAGGDLRGGLSTPPPVLQRWFLETCPVPIPMPFRKLEHIVKRFERTAVQECFFTFSGASVRKLKARANCEMAMAGTADAAISSLQAVLAHLWRAVCRARRLPPEQGTFYSVVVGCRGRVGGIPPGYVGNAMVFGRGAATAGEIEEKGLGWTAWLLNRAVASFDEASMRESLERWVREPDFTYVGNLSSGGTALVTGSSPRFDVFGNDFGWGKPVAIRSGAGNKVDGKATVFEGPERGGSMSLEVCIAPDALERLVADEEFMDAVSMPGLLTAPCSINHIVDKLP

SEQ ID NO: 3809 - DNA, 1618 bp, Panicum virgatum
  misc_feature: Ceres CLONE 1795025
  misc_feature: Encodes the peptide sequence at SEQ ID NO. 3810
aacccgagctcccccttctccagtctcctcgcccttctccagttctcctccgctcgtcttcttttattaagcacacagttcttgcgccccggaaatagtaaccggaaagagagaagaaaaaccccctcactccactccagtctccagtacactcacgcacacagagagagcaaggcgatcatgagaaacctcaggaacatccctagtagctctcagttgtactaggaggcgcttggatcggcgctggggaagaagacaaggcgaccatggtgatggtcctcggtggtggccacagcaagacggacgagaaccgtcaccggaggcgccaccaccgcctctccccgtcgccctttccccggctgcccctcccctgatcgagaaccctctgtgatccttccttccccttggctctggagcagaccagccttcttttcttggaatctctgagaatttcgcgtgaagtcgagcgactggccatgaagagaccgagcagctccgtctccggcggcggcggcggcggcagcggcagtcccggcctccttccgccggttgttcacagtgatgacggctttggcggcgtcggggtggaggaggccgacgaggacatggtgctgtgcggcggcggcggcggcggggaaaagaagcggcggctgagcacggatcaggtgcgcgcgctggagcggagcttcgagacggagaacaagctggagccggagcggaaggcgcggctggcgcttgacctcggcctgcagccgcgccaggtcgccgtctggttccagaaccgccgcgcgcggtggaagaccaagcagctggagcgcgactacgccgcgctgcgccactcctacgacgcgctccgcgccgaccacgacgccctccggcgcgacaaggacacgctcctcgcggagatcaaggagctgaaggcgaagctgggcgacgaggacgcggcggcgagcttctcgtccgtgaaggaggagccggcggcgtccggcgtcgagccccccgccgcggcggcgcagggctcgtccgacagcgactcgagcggggtggtgaacgacgcggatatgatggccgcgccggagaaggccagcgtccaccccccggcgggcgccgccgccggggccgaggccttggtgcccggcgcggcgctccaccacggcgaggtgttcttccacgggcacccgctgaaggtggaggacgacgaggcggcgttcctgggcgacgacgacgccgcgtgcgggggcttcttcgccgacctgcagccgccgccgtcgctgccgtggtggaccgagcccacggagcactgagcctagagccgggccgggccgacgaggcgttctcgggaataaaagaactcggcagggaaggggggcgtttctgcaaattttgtaaaatggaagtgtacctagtccttttttgtcattccagtactgcgtcgcccgcagctggcgctcggctcccctctcgtagagttgtatacggggccgtttagggcctgtttagttccatccggaaacgcaaaaatacaaaaaaaatataaaaaaacacatcatatcgaatatttcgacatatgcatggagtactaaatgaagtctatttataaaaaaaaaaaaaaaaaaaa

SEQ ID NO: 3810 - protein, 275 aa, Panicum virgatum
  misc_feature: Ceres CLONE 1795025
  misc_feature (1)..(55): Pfam Name: Homeobox Pfam Description: Homeobox domain
MKRPSSSVSGGGGGGSGSPGLLPPVVHSDDGFGGVGVEEADEDMVLCGGGGGGEKKRRLSTDQVRALERSFETENKLEPERKARLALDLGLQPRQVAVWFQNRRARWKTKQLERDYAALRHSYDALRADHDALRRDKDTLLAEIKELKAKLGDEDAAASFSSVKEEPAASGVEPPAAAAQGSSDSDSSGVVNDADMMAAPEKASVHPPAGAAAGAEALVPGAALHHGEVFFHGHPLKVEDDEAAFLGDDDAACGGFFADLQPPPSLPWWTEPTEH

SEQ ID NO: 3811 - DNA, 1572 bp, Panicum virgatum
  misc_feature: Ceres CLONE 1795049
  misc_feature: Encodes the peptide sequence at SEQ ID NO. 3812
gaggatgtttaggtgtcaagagtctgggttgggtggtagggtgcagcgggttcgccgattgtcttggggttctggttgactgtcaggcgcaggatcgatccgtagtagtaggagtaagcgtcgcaaagttgcttggactttctttctgacttgtggatgcttcgatcttgtttgttaagattgcagatcattcaacataaatggctgacggagaggacattcagccccttgtctgtgacaatggaaccggaatggtcaaggctggctttgctggagatgatgctccacgtgctgttttcccaagtatagttggtcgtccacgccacactggtgtcatggttgggatgggacagaaggatgcctatgttggtgatgaggcccaatccaagaggggtatcctgactttgaagtaccccattgagcatggaattgtaagcaactgggatgacatggaaaagatctggcaccacaccttctacaatgagctccgtgtagcaccagaagagcacccagttcttcttactgaggctcctcttaaccctaaagccaacagggaaaagatgacacagatcatgtttgagaccttcagtgttccagccatgtatgttgctattcaagccgtcctttcactatatgctagtggccgaaccactggtatcgtcctggattctggagatggtgtcagtcacacagtgccaatctatgaaggttatgctctgccgcatgccattctacgtctcgatcttgctggtagggacctcactgattccctcatgaagatcctgacggagaggggctactctttcacaaccactgctgagcgggaaattgtccgtgacatcaaggaaaagcttgcatatgtcgcacttgactatgagcaagaactcgagactgccaagagcagctcctcagtcgagaagagctacgagctgcctgatgggcaggtgatcaccattggtgcagagcgcttcaggtgtcccgaggtcctcttccagccatctttcatcggcatggaatctcctgggatccacgagacaacctacaactccatcatgaagtgcgacgtggatatcaggaaggacctgtacggcaacattgtcctcagtggtggatccaccatgttccctggcatcgccgaccgcatgagcaaggagatcaccgctcttgctccgagcagcatgaagatcaaggtcgttgctccgccggagaggaagtacagtgtttggatcggaggatcaatccttgcatctctgagcacattccagcagatgtggatctcgagggaagagtatgaagaatctggcccagctattgtccacaggaagtgcttctagtcgccacctagccttattccccgtcctggaaagtggaaatatattggttttgatgacttgtctgtgggtgtatctactctactatggctcgcggttttttttgtatatgcatatatacatatcctgtaacaatgtggagtcagttgggtactgtatttagtatgtagtttgtcttgatgcgttgattgaattattggattctacgggtacttggatgcaaaaaaaaaaaaaaaaaaaa

SEQ ID NO: 3812 - protein, 377 aa, Panicum virgatum
  misc_feature: Ceres CLONE 1795049
  misc_feature: Great-hit functional homolog of the protein sequence given in SEQ ID NO 9451
  misc_feature: Great-hit functional homolog of the protein sequence given in SEQ ID NO 9534
  misc_feature: Great-hit functional homolog of the protein sequence given in SEQ ID NO 9536
  misc_feature (5)..(137): SWISSPROT Homolog: EC 2.7.10.2 Tyrosine-protein kinase transforming protein Fgr
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSFIGMESPGIHETTYNSIMKCDVDIRKDLYGNIVLSGGSTMFPGIADRMSKEITALAPSSMKIKVVAPPERKYSVWIGGSILASLSTFQQMWISREEYEESGPAIVHRKCF

SEQ ID NO: 3813 - DNA, 1579 bp, Panicum virgatum
  misc_feature: Ceres CLONE 1795058
  misc_feature: Encodes the peptide sequence at SEQ ID NO. 3814
atcctcctcctgaactcggtcgtctctttctcatcatcgcccccctgctcctcctcccaccttcctccttataccaaccaaattgacctcgccgcgctgcctgccgggccgccgcatcctcctccccgctcccgcgttcgtcgcaaggcgccgccgccgccgcgggtctcctcaagccaccaccgcaccggtccccccgcttcgaacgaccgcgccgccgaacccatctcctggcctctcttccaccgaggcgcggcaaattcctgcctcctagtcgtcgtcggcgtcggcgtcgttaacatcgttatcctcgctggtggtgctggacttgcgtgggcggcagatccacccgagctcggattgatttcgtcctttgctgtagtgccagtaactgaaccaaaaacacttttagggaagctgggagaatggatcagccttgcatggctgctatcaatagccaacctttggtggctgatgttgaggtagtgaagaaagccagtggggacatgcctgcaacaatgggaagtggatgcttcgactgcaacatctgccttgattttgcagcagaacctgtggttaccctctgtggtcacctttactgctggccttgtatctatgagtggctgcgccctgggatggagtcaactgccagtgacaacagcagctcagcaaggcggcagtgccccgtatgtaaggcaacactctccccggatacactagtaccactctatggccgtggagggagctcaaagaaatcgctgaatggcgtgtccatcccgcgccgtcccatggtgcaccgggagactgttgagcatcataacacacagagcaatgtcaatgaccagcaccaccaccagagcatggaaaccaaccctccgcaccagccattgcggcacgagcactaccatcccagtcccactgggttcgacttcatctaccctccggcaccactaggacgtggcttgatccactcaactgccggaggggtgctcggagggatggcagaggctgtgctcccgttggtgctcggtggccagcttccagcaagcatgtactatacgagcccttaccatgtcgcggcacagaacgtgaatcccaggctaaggcggcatcagatggagattgagaggtccctccaccagatctggttcttcctcttcgtgttcgtggtgctgtgcttgctcttgttctgagacaagactgtgacctgggcacctctctgtagatatcgaaagtgggagagaggatactaatggatgatgcgtatagtgaagagggtaatggggttgtgtcgataagcatgtgcgtaagcatgctgataatagagttgtattatgatgagacatggaggtaaaatgcagatttcatacttctcgtcttcatgtcagctgttactttttttttttttttgcttgcttgtccggcctgtcaccatcggctggttaggttgcctacttgacgtatcggcatgttaagttagcatcatgttgttcattggttggtgtcacttccaagggcatttggatctgtatataaataaaaaatgatgtttggctaccaaaaaaaaaaaaaaaaaaaa

SEQ ID NO: 3814 - protein, 255 aa, Panicum virgatum
  misc_feature: Ceres CLONE 1795058
  misc_feature: Great-hit functional homolog of the protein sequence given in SEQ ID NO 9603
  misc_feature (1)..(51): Pfam Name: zf-C3HC4 Pfam Description: Zinc finger, C3HC4 type (RING finger)
  misc_feature: Useful for making plants with altered alkaloid content
MDQPCMAAINSQPLVADVEVVKKASGDMPATMGSGCFDCNICLDFAAEPVVTLCGHLYCWPCIYEWLRPGMESTASDNSSSARRQCPVCKATLSPDTLVPLYGRGGSSKKSLNGVSIPRRPMVHRETVEHHNTQSNVNDQHHHQSMETNPPHQPLRHEHYHPSPTGFDFIYPPAPLGRGLIHSTAGGVLGGMAEAVLPLVLGGQLPASMYYTSPYHVAAQNVNPRLRRHQMEIERSLHQIWFFLFVFVVLCLLLF

SEQ ID NO: 3815 - DNA, 2157 bp, Panicum virgatum
  misc_feature: Ceres CLONE 1795063
  misc_feature: Encodes the peptide sequence at SEQ ID NO. 3816
ctctcgccatttgctttcgcgggcgcctccgccaattcctctccgccgcttcttcctcccatcccagcctccctccctccgccctcacaccttttctgcgtcgcctgattctccccgcgcccgatttttccatttcttccccttttcctgtcgagttcttggggaacgccgacaagagattttctttgttttttgcgtctcctgggcgatcccggtcacggaggcggcagatttcctcgggttcgacctctgctttctgttgttgctgccgccgccggtgccggctgcttctgtcctgggcgctccgagcgcaccaggccgccaaggggaaccggagatttgagctctgggcccggctcatggcgtctctggcgctggtcgaggaaagggatggattagactcatctgggttgccaattgacaaaaggcggccgttggatgctgccaaatctcctctgatggatgatgcaatgcaaccaaaggaggggatggatgggtaccctgtcaaggttcggaagccttacaccatcacaaagcagagggagaagtggacggaagaagagcatgagaagttcctggaggcactaaagctttatggtcggtcttggcgccagatacaagaacacattggcacaaagactgctgtccagattcggagccatgctcagaagtttttctccaaggtggtgcgtgagcctggtgcaagtaacataatcgagattccacccccaaggccaaagagaaaaccactgcatccataccctcgcaagtgtgctgattccagcaccatggcaaatcctgcaatgggccagccaaagcttgcctccatttcatcgtcatctggttctgaccaagagaatggttcacctgtgtctgtgctgtctgcgatgcagtcggatgcttttgggtcatctgtatccaatccatcaacagggtgtacatcccctgcatcatcggatgatgggaataatgtcccttcctttgtgaatgaggaaaatttacttactcagcaaatcgaggatgatcagtctggtcaggaaataaagctggacaacagcgatggtgacttatctgaagaggattcatcatcaggagtgcaagaaacaagtttgaagctgttcgggaagacagttatcattccagacacaaagaaagtatgttcctcggatgggggatgtggagatggtgaaaaaagatctcaatcttctaagcaagaaacgtcgcaggcatcctcaattggagggatcgcagcataccctgcccataatggatggctgcttccttaccattcttttcagtttcatatgggcgagtctggggatgctaagatttcccctcttcatgtatggtggccttactatggttttccagtcagcgatccaagaggatttggtatggggcatatcgaaggtacctgtgagagtgataccgacaataagagcccttcggttgaatccagttcagactgcttgagctatgttcagacaacggcgcctaccaactgcaaagttgtcaaggagtcactaggaggagcaattcaggtgtcggagccagctctaagttttgagctgaaaccgagcgcgaattcagccttcgtaagagtgaagcccggaagcaacagaggtcaatctgtaagaggatttgtgccatataaaaggtgtaaagtcgaataacccagccagatatttctctgcagctaatttaactgagatcaattaattctgaacagtagagagcagctgcgcacgttcttgttcctgcgtagggtgcgcacctatgtagtaccgatacggataggcgtatcagtatcagcccgatacggatacgtggatacgtcaaatttctgcaaaacttaaaggcacaaaggtgtatcggatacggatacgggtcatgttgaagtatcggggttacagaggtgcgcaccattttttacttgcagagaggcagagactggccatgtatgtgtatcattgtttcctgcctgcagcttaatgtaagatgctgcaggcagttgccgttaaggtagactgaagaaaggccgatctctagcctgttatgttgttgtataaggaaaccagattttgtttgttgaactcttgttcaaagttaattgctaatggaaactgatgatttatagaaaaaaaaaaaaaaaaaaaa

SEQ ID NO: 3816 - protein, 437 aa, Panicum virgatum
  misc_feature: Ceres CLONE 1795063
  misc_feature (1)..(46): Pfam Name: Myb_DNA-binding Pfam Description: Myb-like DNA-binding domain
  misc_feature: The sequence is a functional homolog of  SEQ ID NO 12 in the  10/225,066 US patent application
  misc_feature: The sequence is a functional homolog of  SEQ ID NO 156 in the  10/225,066 US patent application
  misc_feature: The sequence is a functional homolog of  SEQ ID NO 1636 in the  11/479,226 US patent application
  misc_feature: The sequence is a functional homolog of  SEQ ID NO 1889 in the  11/479,226 US patent application
  misc_feature: The sequence is a functional homolog of  SEQ ID NO 2560 in the  10/374,780 US patent application
  misc_feature: The sequence is a functional homolog of  SEQ ID NO 2676 in the  10/374,780 US patent application
  misc_feature: The sequence is a functional homolog of  SEQ ID NO 804 in the  10/412,699 US patent application
  misc_feature: Useful for making plants with modulated growth and phenotype characteristics
MASLALVEERDGLDSSGLPIDKRRPLDAAKSPLMDDAMQPKEGMDGYPVKVRKPYTITKQREKWTEEEHEKFLEALKLYGRSWRQIQEHIGTKTAVQIRSHAQKFFSKVVREPGASNIIEIPPPRPKRKPLHPYPRKCADSSTMANPAMGQPKLASISSSSGSDQENGSPVSVLSAMQSDAFGSSVSNPSTGCTSPASSDDGNNVPSFVNEENLLTQQIEDDQSGQEIKLDNSDGDLSEEDSSSGVQETSLKLFGKTVIIPDTKKVCSSDGGCGDGEKRSQSSKQETSQASSIGGIAAYPAHNGWLLPYHSFQFHMGESGDAKISPLHVWWPYYGFPVSDPRGFGMGHIEGTCESDTDNKSPSVESSSDCLSYVQTTAPTNCKVVKESLGGAIQVSEPALSFELKPSANSAFVRVKPGSNRGQSVRGFVPYKRCKVE

SEQ ID NO: 3817 - DNA, 1477 bp, Panicum virgatum
  misc_feature: Ceres CLONE 1795064
  misc_feature: Encodes the peptide sequence at SEQ ID NO. 3818
gcgcgaatctcaaccagcagccacaagcttcgcctccccgagcgctccccgccactcccgactgccgctaacggatagcaacacccgggcgagctgagcaacagcacgcctgcaatcttcttcttcggatccgagaaggagctgcccaggggaaaaaaaaaacagaatgcaggcgttcctctcctcgtcgatccccgccacctcgtactcgaggtcgtccttcctgccgcagccgcctcaggctcccgtgaagctcgccctcccgtcgtcgggacccagggccgccgccgtcgcgaggagaacggaggcggggcgcccggcggcaggccggtgcgtggcggcgtccgcgtcctcgtccccggccacggccgccgccgcggccgcggcggaggtgcccgcggccatgaaggcctgggcgtacggcgcgtacggggacgccggcgtgctcaagctcgacgaggccgcggcggtgcccgccgtgggcgagggccaggtgctcgtcaaggtcgccgccgcggcgctcaaccccgtcgacgccaagcgccgggccggcaagttccaggccaccgactcgccgctcccgaccgtgccggggtacgacgtggccggcgtcgtcgtgaaggtgggcggcggggtgaagggcctcaaggaaggcgacgaggtgtacggcatgatcagcgagaagcccctggacgggcccaagcagtcgggctcgctggcggagtacaccgccgtcgaggagaggctgctcgcgcccaagccccagggcctcgacttcgctcaggccgccggcctgccgctcgccatcctcaccgccaacgagggcctcgagagggcggggctcgccgccggcaagtccgtcctcgtcctcggcggcgccggtggcgtcgggtcccttgccatccagctggcgaagcaagtgtacggcgcgtcgaaggtggccgccacggccagcaccaagaagatcgagctgctcaagagcctgggcgccgacgtcgccattgactacaccaaagagaacttcgacgagctgcctgacaagtacgacgtcgtcttcgatgcagtaggtcaggacgacaaggctgtgaaggtggtgaaggaaggcggcagcgtggtggtcctcaccggagccgtcaccccgccagggttccggttcgtggttacctccaacggctccaccttggagaagctcaacccctacctcgagtccgggaaggtgaagccgctcatcgacccgaccgggccgttccccttctcgcaggttgtggaggctttctcctaccttgagaccggaagagcaaccggcaaagtagtcatttctcccgtcccatgagagctgtagactgcagagagtttgttgtttgttcactggccatttgagtgccgacctgagatccccgagtgtcaaatattctaaagggacgtttatttcagtacagttcatagaattacaaagtaaaaaaaaaaaaaaaaaaaa

SEQ ID NO: 3818 - protein, 388 aa, Panicum virgatum
  misc_feature: Ceres CLONE 1795064
  misc_feature (1)..(92): Pfam Name: ADH_N Pfam Description: Alcohol dehydrogenase GroES-like domain
MQAFLSSSIPATSYSRSSFLPQPPQAPVKLALPSSGPRAAAVARRTEAGRPAAGRCVAASASSSPATAAAAAAAEVPAAMKAWAYGAYGDAGVLKLDEAAAVPAVGEGQVLVKVAAAALNPVDAKRRAGKFQATDSPLPTVPGYDVAGVVVKVGGGVKGLKEGDEVYGMISEKPLDGPKQSGSLAEYTAVEERLLAPKPQGLDFAQAAGLPLAILTANEGLERAGLAAGKSVLVLGGAGGVGSLAIQLAKQVYGASKVAATASTKKIELLKSLGADVAIDYTKENFDELPDKYDVVFDAVGQDDKAVKVVKEGGSVVVLTGAVTPPGFRFVVTSNGSTLEKLNPYLESGKVKPLIDPTGPFPFSQVVEAFSYLETGRATGKVVISPVP

SEQ ID NO: 3819 - DNA, 1585 bp, Panicum virgatum
  misc_feature: Ceres CLONE 1795066
  misc_feature: Encodes the peptide sequence at SEQ ID NO. 3820
acagttaggccccgtctggggctgcgtccgcggcggcggcggcggcgatgaagcggccgctgcggcgctccttcgcggtgctcctcttcgtcgtgctcgtcggcgcggcctcgttctccgccgcactccgccgcgccgtggcgcccgcgcccgcgcgggagccgcccctcccgctcgacccggcgcgcctcaacgccacgctgctccgcctcgccgccgtcgatccctcggaggccccgctgcggcgggacgtggacgagctcctcgagggccgcctcccggcctccgcggcgcccgcccgcgcgtggcgccgcgaccggctcctccacccgctccacctccaccaccaccgcttcccgctgccccgccgcggccgctacccggacgaggatcacgacaccctgctccacccgctcccgcgccacgagcagcagctccacatcgaccccgccctccgccgcgcgctccgctcctggcaccgcctccgccgctacgatcccgctgtcctcggcagcctcccctccctcctctccctacccggccgcatcccatcctgcgcagttgtcggcaacagcggcatcctcctcagggcgaaccacggcgcactcatcgactcccacgacgccgtgttccgcctcaacaacgcccgcatcgcagggtacgccgctcacgtcggcagcaagaccaacttttccttcatcaacagcaacgtccttcacctctgcgcgcgccgacccggctgcttctgccacccctacggccatggcgtccccatcctgctctacatctgccaggccgcccatttcctcgacatcgcagcctgcaacaccacctcatcctctcgccacggctcccccatctcctgcaccgacgcccgcctcgacgtcctctgcgcccgcatcgtcaagtactactccctccgccgattcgtcgcggagactggccgcgcggccgaggattggaaccgcgcacacgacgccgccatgttccactactcgtccgggatgcaggccatcatggtcgcggtaggagtttgtgacagagtcagcgtgttcagcttcgggaaatcctccgatgcaaagcaccattaccatagcaaccagaaggcggagctggatctccatgactacgaggcggagtacgccttctatcacgacctcgccgagcacccgcaggtagtccccttcctcaaggatgctggattcgccgtcccgcccgtcgtcttctaccattaggccagcttcgtagagcgcggcatgtgctcgacgttatgtggcaccggtgttttttttctttcttttcgggtgtttccactggtaagtacgttgtaaaacttgttgtgtcggtgggtttatctattttgattagatgaaataggcaaattcaggtagaaaagttttcgtgtgctgttggagttggaagttgtatatgggatttaggctaatcgatggtatagaaggattgcttgggtttttggcttcagcaggatcggaggcagggtctggaattgtaatcttagactgatatttcaatttattacgaaacaaactgtatatcttatacacaaaaaaaaaaaaaaaaaaaa

SEQ ID NO: 3820 - protein, 395 aa, Panicum virgatum
  misc_feature: Ceres CLONE 1795066
  misc_feature (1)..(282): Pfam Name: Glyco_transf_29 Pfam Description: Glycosyltransferase family 29 ( sialyltransferase)
  misc_feature (170)..(218): SWISSPROT Homolog: EC 2.4.99.4 CMP-N-acetylneuraminate-beta-galactosamide-alpha-2, 3-sialyltransfer ase
MKRPLRRSFAVLLFVVLVGAASFSAALRRAVAPAPAREPPLPLDPARLNATLLRLAAVDPSEAPLRRDVDELLEGRLPASAAPARAWRRDRLLHPLHLHHHRFPLPRRGRYPDEDHDTLLHPLPRHEQQLHIDPALRRALRSWHRLRRYDPAVLGSLPSLLSLPGRIPSCAVVGNSGILLRANHGALIDSHDAVFRLNNARIAGYAAHVGSKTNFSFINSNVLHLCARRPGCFCHPYGHGVPILLYICQAAHFLDIAACNTTSSSRHGSPISCTDARLDVLCARIVKYYSLRRFVAETGRAAEDWNRAHDAAMFHYSSGMQAIMVAVGVCDRVSVFSFGKSSDAKHHYHSNQKAELDLHDYEAEYAFYHDLAEHPQVVPFLKDAGFAVPPVVFYH

SEQ ID NO: 3821 - DNA, 431 bp, Panicum virgatum
  misc_feature: Ceres CLONE 1795068
  misc_feature: Encodes the peptide sequence at SEQ ID NO. 3822
ccatcgaaacagcgacgatcccgagctgatagcttcttgccgcgctgctttctcagctcctcggtccgtccaaagaagatggcagcagggcagttgaaggccaagatcctcgcggcggccgcggccgccgttgtcgtcgcctcgtctctggtcggcacggcctccgcggccgacgcgcccgccccggcgcccacgtccggcgccacggccgccgcgccggccttcgcggcggtgtccgtcgccgtgtctgctttcggctacctcttctgctaggcggcccgggcagcagggtgcaggcgtgtgcgtgcggggccgcccgccgcgcaccgcccctgatgatgtgcgcgcccacatgtttgtactacgacttcaatattggttgttttacatgggtgtaaagtgtaattcgtcaaaaaaaaaaaaaaaaaaaa

SEQ ID NO: 3822 - protein, 64 aa, Panicum virgatum
  misc_feature: Ceres CLONE 1795068
  misc_feature: Great-hit functional homolog of the protein sequence encoded by LOCUS At5g56540
  misc_feature: Useful for making plants with altered cell wall content and/or composition
MAAGQLKAKILAAAAAAVVVASSLVGTASAADAPAPAPTSGATAAAPAFAAVSVAVSAFGYLFC

SEQ ID NO: 3823 - DNA, 1630 bp, Panicum virgatum
  misc_feature: Ceres CLONE 1795087
  misc_feature: Encodes the peptide sequence at SEQ ID NO. 3824
gaaaacccccgagcagccgacacacaccagcacacagcacgagcgaagagacgcggccatggcgatggccccgccgcccgcctgctcgctcctccgggtcgctgcggctgcgcccatttccgccgcctccacctccgtttccactccgcggggccccggtttactcccttccccgcgttccgcttccgcccgccgccacctcaccacggcatggtccccaaaggccgcggcctcggcgtctgtcgaaatccaggatgagtacgcggatgagatggacgcggtgaacattgcgcaggacgtcacccagctaattggaaaaacaccaatggtgtatctcaataatgttgttgaccgttgtgtggctaatatcgctgcaaagctcgagtacatgggcccttgccgaagcgtcaaagataggattgggttaagcatgattaatgatgctgaagagaagggattaatttctccaaataagaccatcttggtagaaccaaccgctggcaatactggtatagtcattgcttctgtggctgcagctagaggatacaagctgatagctactatgccttcatcaatagacatcgagagacgcattcttctacgtgcatttggagcggagattgtgctatctgatcctaccaaaggactaaaaggagcttttgataaagcaaaggaaatagttttgaggacaccaaatgcatatatgtttcagcagttcaacaacgaggcaaatagtgagatccactttcaaaccacaggcccagaaatatgggaagacacactgggtactgttgacatacttgttgcaagcatagggacaggtggtaccattactggcacagggcgctacttaaaaaggatgaacaaggatattaaggtcattggggtagagccagctgaaactagtgtgatctctggtgacaacccaggttacattccaagtatattagatgttcagttgattgatgaggttgtgaaggttagcaccgcagaagccgtcgaatctgctagggaacttgcactaaaagagggcttgctggttggtatttcttcaggcgcagcagcagttgctgctattaatgttgccagaagacctgaaaatgctggaaagctgattgcggtcattttccccagcttcggggagagatatctctccagcatcctattccgcccaatatatgactcagttcgaagaatgaggaagaaataggcagccttttacaacttaaatagagtgacccttccctcctctaaacgtgacaggcttccacggcatgacaaacatgaaagagtaaagaccctggtagattgcaacaagcagggtacaaaggtttgaactgggagaacaccaatcatagggccttgaagctgcatagagtttcttgcaattgagctgcaggccgcagcttggttcaggacagactgcctcacgtttagaacctgccgctacaaccttggtgaaacatgcataatggggtgctgcagttagcttagaatctttctttcagtagcctaggactggggataaaccagatttgtaatctgatagactgatacgcacttgagctgatcctagtaagcaatttattggcacattctttttcctactgaaaaaaaaaaaaaaaaaaaa

SEQ ID NO: 3824 - protein, 383 aa, Panicum virgatum
  misc_feature: Ceres CLONE 1795087
  misc_feature (54)..(381): SWISSPROT Homolog: EC 2.5.1.47 Cysteine synthase, chloroplast/chromoplast precursor
MAMAPPPACSLLRVAAAAPISAASTSVSTPRGPGLLPSPRSASARRHLTTAWSPKAAASASVEIQDEYADEMDAVNIAQDVTQLIGKTPMVYLNNVVDRCVANIAAKLEYMGPCRSVKDRIGLSMINDAEEKGLISPNKTILVEPTAGNTGIVIASVAAARGYKLIATMPSSIDIERRILLRAFGAEIVLSDPTKGLKGAFDKAKEIVLRTPNAYMFQQFNNEANSEIHFQTTGPEIWEDTLGTVDILVASIGTGGTITGTGRYLKRMNKDIKVIGVEPAETSVISGDNPGYIPSILDVQLIDEVVKVSTAEAVESARELALKEGLLVGISSGAAAVAAINVARRPENAGKLIAVIFPSFGERYLSSILFRPIYDSVRRMRKK

SEQ ID NO: 3825 - DNA, 1843 bp, Panicum virgatum
  misc_feature: Ceres CLONE 1795093
  misc_feature: Encodes the peptide sequence at SEQ ID NO. 3826
accacacacgccgcaccttcgcttccccttcgcctccgtctctcctctccccgcgcagatctagcgatggcggcggcggcggcggcggcggcggcgggcggcgaaccggcgtggggggaggcgcccgcggggcggcgccggcccaagaccaagatcgtctgcacgctcggcccggcctcgcgctccgtcgagatgatctcgcgcctgctgcgcgccggcatgtccgtcgcgcgcttcaacttctcccacggctcccacgagtaccaccaggagacgctcgacaacctccacgccgccatggagcgcaccgggatcctctgcgccgtcatgctcgacaccaagggtcccgagatccgaactggatttttgaaagatgggaagcctgttcaattgaagaagggtcaagaaatcacaatttccacagattataccattgagggtgatgagaaaatgatatcgatgagctacaagaagctcgcggtggatctgaaagcaggcagtgtcatattgtgtgctgatggtaccatcactcttactgtgcttcactgtgataaagagcaaggcttggttcgctgccgttgtgagaacacttctatgcttggtgagaggaagaatgttaatcttccaggagttattgttgatctcccaacactcactgacaaggacaaggaggatatccttaagtggggtgtcccaaacaagattgacatgattgccttgtcgtttgttcgcaagggttcggatcttgtggaggttaggaaggtacttggcgagcatgccaagtccataatgctgatgtcaaaggttgagaatcaagagggagtagctaactttgatgatatcctggcaaactctgatgcgtttatggtggcaagaggtgatttagggatggaaattcctatagagaagattttctttgcgcagaaggtgatgattttcaagtgcaacattcagggcaagcctgttgttactgccactcagatgttggaatctatgatcaaatctcctcgccctactcgagcagaagcaactgatgttgcaaatgcagtgcttgatggcagcgactgtgtcatgcttagtggtgagacagctgctggggcatatccagagctggctgtgcagactatggccaagatctgcttgcaagcggagtcttgtgttgactatggtgctgttttcaaatcaatcatggcctcagctccaattccaatgagcccattggagagccttgcatcatcagctgtccgcacagcgaactctgccaaggcagcactgatcttggtcctgaccaggggaggaacaactgctaggcttgtggccaagtataggccatccatgccgatactatctgtcgtggttccagagctgaagaccgactcctttgactggacctgcagcgatgaggggccagcaaggcagagcctcattgtgaggggtgtgatcccaatgctgagtgccgccactgccaaggccttcgatagtgaagccactgaagaagctgtcggttttgccatcgagaatgcaaaggctatggggctatgcaacagcggcgagtctgttgtggccctgcatcggatcgggactgcatccgtcatcaagctcttgactgtgaactaggggacggggaaggaacaccattttgcctgggtgtgatttttgtgagtctgcttaagcataccagcttatccacagtttttgttgccaaagatagtgactttgggttttggtaccttggggctgtgagaatttatcatttagaggttaggcatttaaacaatcaccaaccaatatagctacttattgctactgctactatattattgaaaaaaaaaaaaaaaaaaaa

SEQ ID NO: 3826 - protein, 516 aa, Panicum virgatum
  misc_feature: Ceres CLONE 1795093
  misc_feature (2)..(347): Pfam Name: PK Pfam Description: Pyruvate kinase, barrel domain
  misc_feature (1)..(341): Pfam Name: PK Pfam Description: Pyruvate kinase, barrel domain
  misc_feature (18)..(515): SWISSPROT Homolog: EC 2.7.1.40 Pyruvate kinase, cytosolic isozyme
  misc_feature (24)..(515): SWISSPROT Homolog: EC 2.7.1.40 Pyruvate kinase, cytosolic isozyme
MAAAAAAAAAGGEPAWGEAPAGRRRPKTKIVCTLGPASRSVEMISRLLRAGMSVARFNFSHGSHEYHQETLDNLHAAMERTGILCAVMLDTKGPEIRTGFLKDGKPVQLKKGQEITISTDYTIEGDEKMISMSYKKLAVDLKAGSVILCADGTITLTVLHCDKEQGLVRCRCENTSMLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGSDCVMLSGETAAGAYPELAVQTMAKICLQAESCVDYGAVFKSIMASAPIPMSPLESLASSAVRTANSAKAALILVLTRGGTTARLVAKYRPSMPILSVVVPELKTDSFDWTCSDEGPARQSLIVRGVIPMLSAATAKAFDSEATEEAVGFAIENAKAMGLCNSGESVVALHRIGTASVIKLLTVN

SEQ ID NO: 3827 - DNA, 762 bp, Panicum virgatum
  misc_feature: Ceres CLONE 1795101
  misc_feature: Encodes the peptide sequence at SEQ ID NO. 3828
gattccatccatcgccgccgaaatcccattgacctctctcgcgcttcgccaagctctcaagttttctcacaacggcggcggcggcgatggatgaggtcatcgaggccgtgaacaaccttagcatctccgggggaggggccgcggcggccggggacggcgcggaggggcacaagaagaaccgcatccaggtctccaacaccaagaagcccctcttcttctatgtcaacctcgccaagaggtacatgcagctgcacaacgaagtggagctctcggccctcggcatggccattgcaacggtgatgactgttgcagaaattctgaaaaataatgggcttgctgtcgagaagaagatcatgacatctactgttgatgtaaaagatgaaactaggagccgccctatccagaaggccaagattgaaatattgctcggcaagacggagaaatttgatgagctgatggctgcggctgcggaagagagggaggctgctgaggctgaagagcaaagctaaatacctgcagggcccctgttgtagcttattttactgttctggagctagatttgctcagttcttagtcgaatcagaagagtcgtgtgcttgtataatcaattaagggtgcagcttatttagtgcgcttttacttgattcattagttctggatggtacaacttgtgttcagtatgatactcctgttttctccagtccctatttccattcagaagatattctcttgttctgctcgtaaaaaaaaaaaaaaaaaaaa

SEQ ID NO: 3828 - protein, 140 aa, Panicum virgatum
  misc_feature: Ceres CLONE 1795101
  misc_feature: Great-hit functional homolog of the protein sequence encoded by LOCUS At2g34160
  misc_feature: Useful for making plants with modulated nitrogen use efficiency
MDEVIEAVNNLSISGGGAAAAGDGAEGHKKNRIQVSNTKKPLFFYVNLAKRYMQLHNEVELSALGMAIATVMTVAEILKNNGLAVEKKIMTSTVDVKDETRSRPIQKAKIEILLGKTEKFDELMAAAAEEREAAEAEEQS

SEQ ID NO: 3829 - DNA, 1976 bp, Panicum virgatum
  misc_feature: Ceres CLONE 1795104
  misc_feature: Encodes the peptide sequence at SEQ ID NO. 3830
acagcagagcaatcaggcgaactactagagctagctaaacctcggagccatcccccccgcgagcgagacaccctcgaggcctcctccgatcgcagcctcgcaatcccccccccccccccaccatggcgtcgcacatcatcctgccgccggaggacgccgacgagaaccaccaccgggaggaggaggaggaggagcgggaggagctggggcacgacggcggggagcgcgcgcccccggagcagccgcccaaggcggcgctgccgttctcggccacgtgcgtgcggatctcgcgcgactcgtacccgaacctccgcgccctgcgcaacgcctcctccgtcagcctcgccgacgccgcctacgtcaagatctccgagggcgacttcgggtacgtgctcgacgacgtgccgcacctcaccgactacgtccccgacatcccgacttatcctaatccgttacaagaccatccagcctattcaactgtcaagcagtacttcgtcaatgaagatgatactgtaccgcaaaaggtggttgttcagaagaacagccggcgtggcgtccacttccgtcgtgctgggcctcgtcagaggatttattttggtcccgatgaagtaaaagcctgcattgtaacttgtggaggcctctgcccagggcttaacactgttatcagagaacttgtgtgtggcttgtcacacatgtacaacgtcaacagcatctttggaatacagaatggatacaaagggttttattctagcaactaccttcccctgacaccgaagagtgtcaacgacatccacaaaaggggtggtacaattcttgggacatcacgaggtggtcatgatacaaagaagattgttgataacattcaagatcgtgggattaatcaggtgtatatcattggaggagatggaactcagaagggagcatacgatatattcaaggaaatccgaaaacgtagcctgaaagtttctgtggctggagtccccaagacaattgataatgacattgcgattatcgacaagtcctttggttttgatacggctgtggaagaggcccagcgtgccattgattcagctcatgtcgaagcttgcagtgctgagaatggaataggcttagtaaaactgatggggcgctatagtgggttcattgcgatgtgtgctactcttgctagtcgagatgtggactgttgtttgattccggagtctccattttatatggatggagaaggtgggctgcttgaatatatagaaaggaggctgaaagagaacaagcacatggttatcgttgttgccgagggagcagggcaggatcttatcgcaaaaagtatagccaaatcagatcaacaagatgcatccggaaataagctgctgcttgatattggtctttggttgactcacaagataaaggattacttcaagactaaaaagatggagatgacgattaaatacatagatcctacatacatgatccgtgccattccaagcaatgcatcagacaacgtgtactgcacacttctggctcacagcgctatccatggtgcaatggcagggtacagcttcaccgttggaatggtcaacggtagacatacctatatacctttctatagggtgacatccacaaggaacaaggttaagatcaccgacaggatgtgggccaggctgctatcgtcgactaaccagccaagtttcttaagtcagaaggacatcgatgaagcgatggaggatgataggcttgccaacaggccaccactgccgatgggcgccaaccatcgtgtggcgagctccttcgagcagtcctcttctacttcttccaacggagagatctaagtgattgctggcgccccgggaatgtgtacatgagctgttaagctttgccacgcttatcaattttgctttttatgtgcatatgccttgcgtatgaggacgcatggatactatcctgatacccagagcaataaaatgaacaccggtgcggtgatc

SEQ ID NO: 3830 - protein, 566 aa, Panicum virgatum
  misc_feature: Ceres CLONE 1795104
  misc_feature (1)..(254): Pfam Name: PFK Pfam Description: Phosphofructokinase
MASHIILPPEDADENHHREEEEEEREELGHDGGERAPPEQPPKAALPFSATCVRISRDSYPNLRALRNASSVSLADAAYVKISEGDFGYVLDDVPHLTDYVPDIPTYPNPLQDHPAYSTVKQYFVNEDDTVPQKVVVQKNSRRGVHFRRAGPRQRIYFGPDEVKACIVTCGGLCPGLNTVIRELVCGLSHMYNVNSIFGIQNGYKGFYSSNYLPLTPKSVNDIHKRGGTILGTSRGGHDTKKIVDNIQDRGINQVYIIGGDGTQKGAYDIFKEIRKRSLKVSVAGVPKTIDNDIAIIDKSFGFDTAVEEAQRAIDSAHVEACSAENGIGLVKLMGRYSGFIAMCATLASRDVDCCLIPESPFYMDGEGGLLEYIERRLKENKHMVIVVAEGAGQDLIAKSIAKSDQQDASGNKLLLDIGLWLTHKIKDYFKTKKMEMTIKYIDPTYMIRAIPSNASDNVYCTLLAHSAIHGAMAGYSFTVGMVNGRHTYIPFYRVTSTRNKVKITDRMWARLLSSTNQPSFLSQKDIDEAMEDDRLANRPPLPMGANHRVASSFEQSSSTSSNGEI

SEQ ID NO: 3831 - DNA, 1510 bp, Panicum virgatum
  misc_feature: Ceres CLONE 1795111
  misc_feature: Encodes the peptide sequence at SEQ ID NO. 3832
gccgaactttcgctctcctccgtcgctcgccgcctttctggactctggttcctcgttctctctcctcctaggttcctacctgacccccccccccccccccaatggaggctctcgcgggcaccgcctcctcctccattctcccggtccgccaccagcctgcccgcctggcgccgcagtccctcgcgctccgccctagccgcagcgctcccctccgcgccgcggccggcggcggcggcggcaaggacgaagcccagggcgcccccgccgccaatgggtcacccgtcctcaagctgaagagcgaatcaagtcaaaatggagttatactgatcgcggctgacaagtcgcagaaggcttcatcaaccaataccagtactgactcgagcggatccagagcaggcctgtttagaacacctatatcaggtggtgtgcagagcgcaacttttgcacatagtttgcctccgccggctttggctgttcgcaatttgatggaacaggcacgctttgctcacctgtgctctgtcatgtctggcatgcatcaccgccgcactggatatccatttgggtcacttgtcgactttgctaatgattcaatgggccacccaatattttcgctgtcacccttagcgatccatacgaggaacttgctgtcagatccaagatgcacgcttgttgtccaggtgcctggatggagtggactgtcgaatgcacgagtcacaatatttggtgatgtttaccctttgccagctgaccaacaggaatgggcccataagcaatatgtagcaaaacatcagcagtgggcatcacaacagtggggaaatttttactattacaggatgcacaacataagtgatatatacttcattggaggctttggaactgttgcatgggtagatgttaaggagtacgaaactactcaacctgacaaggtagcagttaatggggctgagcaaagtttaaaggagttgaatgcgattttctctaaaccacttcgagagttcttttcatcagaaggggaggttgatgacgctgctgttatatcagtagatagcaaaggcatagatatacgggttcgccagggtgctcagttcaatattcagaggctagcatttgatgtaccagacaaggttctgactctagaggaagccaagagagcactccacaagataattgcgacgagcagcaaatagagtgaacaaggttgcagaagctgacttcactcattttttgaatgctgtaaggtttcagtgcaatcggataatggctgggaattatgtagtgtcgcaagaagcaggcattggtgaagagtgaaaacggcggctgtgttgctaataatgagatgatatctctccacatgtggcaaagattgtatatatgcccgtgttgctatatcaataatgatgattatgcggttgctgctcagtaaatcggacaatcttgttgttggcatggaggaaataatctatttctggctttctggctggttatcagcgaaaaaaaaaaaaaaaaaaaa

SEQ ID NO: 3832 - protein, 361 aa, Panicum virgatum
  misc_feature: Ceres CLONE 1795111
  misc_feature (1)..(100): Pfam Name: Pyridox_oxidase Pfam Description: Pyridoxamine 5'-phosphate oxidase
MEALAGTASSSILPVRHQPARLAPQSLALRPSRSAPLRAAAGGGGGKDEAQGAPAANGSPVLKLKSESSQNGVILIAADKSQKASSTNTSTDSSGSRAGLFRTPISGGVQSATFAHSLPPPALAVRNLMEQARFAHLCSVMSGMHHRRTGYPFGSLVDFANDSMGHPIFSLSPLAIHTRNLLSDPRCTLVVQVPGWSGLSNARVTIFGDVYPLPADQQEWAHKQYVAKHQQWASQQWGNFYYYRMHNISDIYFIGGFGTVAWVDVKEYETTQPDKVAVNGAEQSLKELNAIFSKPLREFFSSEGEVDDAAVISVDSKGIDIRVRQGAQFNIQRLAFDVPDKVLTLEEAKRALHKIIATSSK

SEQ ID NO: 3833 - DNA, 1945 bp, Panicum virgatum
  misc_feature: Ceres CLONE 1795122
  misc_feature: Encodes the peptide sequence at SEQ ID NO. 3834
atatcgccagggccaccattccaccaagctcttccccttgctcagcacttcagcagtcagcagcggcctccccatcagaagcctagctagcagctcttcctcgccccaacagccgtttcccagatctttttcagcaccggcactccaccagggcacagcaagggcatctactctgcacttcgcctgatccagtccaaccggagagggtggaaaccattggactctgcatagaagcttcctgatatttctaagggacgataaggcagggaatgagtacaaccaaggtgaagagacgtgtggggaagtatgagctcggtcggaccataggtgaaggcacattcgcaaaggtcaggttcgcgaaggacactgagacaggcgaacctgtagctatcaagatcatagataaggagaaggtcctcaagcacaagatggttgagcagattaagcgagaaatttcaacaatgaagttgatcaagcatcctaatgttgttcgcatatatgaggtgatgggaagtaaaacaaagatatacattgtgttagaatttgctacagatggtgagctctttgacataattgctaaccatggtcgaatgagggaagatgaggcaaggaggtatttccaacaattaatcaatgcagttgattattgtcatagcaggggtgtgtaccaccgggatctaaaacctgaaaatttactgctcgattcgtatggaaacctgaaggtctccgactttgggctgagcgctctatctcagcagatcaaggatgatggattgctgcatacaacttgtggaactccgaactacgttgcaccagaggtccttgaagatcaaggttatgacggcgcaatggctgatttgtggtcatgtggagttatcctgtttgttctgctagcagggtatttgccttttgaggactctaatcttatgatgttgtataagaaaatatcaaatgcagaatttacatttccaccgtggacgtcttttcctgcgaagaggttgttaacaagaatccttgatccaaatccaatgacgagaataacaatccctgaaatattagaggatgagtggttcaaaaagggctacaagcgccccgaatttgacgaaaaatatgacaccacattggatgatgtggatgctgtcttcaatgattcagaagagcaccacgtgacagaaaagaaagaagaagagccagtagctctgaatgcatttgaactgatttcaatgtcagcaggcctaaatcttggaaacttattcgactcagagcaggaattcaaaagagaaacaaggttcacctcaaaatgtccacccaaggaaattgtccgcaagattgaggaagcagcaaaacctctaggatttgatgttcagaagaaaaattacaagttgaggctcgaaaaggtgaaagcagggaggaaaggaaacctcaatgttgctactgagatactacaagtcgcaccctctcttcatatggtagaagttcgaaaagcaaaaggcgacactctggaattccataaattcttcaagaacctttccaagaccttaaaggatgttgtctggaaatctgaggatctgcaaatgcaacctgctgcttagcagaacctcaggagaggaaggatggaaaagtatttgtgtctcattcttccaagcagattccattttggtagcctactagcctggatcagcaaatctgttctccgaataatatatgtaatggtgtgtggcccggcaaattgtgctggtcctccactactgttgtaaatgcagcattttgagaggtaattgcttgctgtagactgtagttggagtgaagcttgttcagtagattttgtcagtatgtgagctttgtaaatccatgtatgcctatgaatcatgttgaaacataatgcacaaaatctgcgaaatgaagccaagtatggtttttgcatcaaaaaaaaaaaaaaaaaaaa

SEQ ID NO: 3834 - protein, 440 aa, Panicum virgatum
  misc_feature: Ceres CLONE 1795122
  misc_feature (4)..(433): SWISSPROT Homolog: EC 2.7.11.1 CBL-interacting serine/threonine-protein kinase 24
  misc_feature (5)..(432): SWISSPROT Homolog: EC 2.7.11.1 CIPK-like protein 1
MSTTKVKRRVGKYELGRTIGEGTFAKVRFAKDTETGEPVAIKIIDKEKVLKHKMVEQIKREISTMKLIKHPNVVRIYEVMGSKTKIYIVLEFATDGELFDIIANHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMMLYKKISNAEFTFPPWTSFPAKRLLTRILDPNPMTRITIPEILEDEWFKKGYKRPEFDEKYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFFKNLSKTLKDVVWKSEDLQMQPAA

SEQ ID NO: 3835 - DNA, 1250 bp, Panicum virgatum
  misc_feature: Ceres CLONE 1795141
  misc_feature: Encodes the peptide sequence at SEQ ID NO. 3836
gcgctcgaccgcgacgtgaagcctctggtgctgacgacggaggggtcttggaggcgtagctgggacccacctgccgtctccgatgggcttcgccggccgggtgtccgcgctgctcctcttcctggtcgccggcgcggtcgcctccgaccagatcttcaccgcctcaggtgttccatttgggcggagttcgcgtgtgccgaggtaccgggtagagttccatccagttgattcgccctaccaaccggagaatggccaggaatcagtaccaatggctagccatgaggggaaacattatacgtgctttctaccagttgaagaaactaaaaccatgaagtcaattctcccacaaaatgcaactaatgttataataggaagtgacaggagaattaagccaaaggagccagatgagctgcttgagcctctcaaggatcagtgtttctacaggcacgaaggttggtggtcttatgagttctgttatcatgggaaaatccgacaggttcatgtagaaggtgataagcttattcaagaatatgttctaggtgaatatgatgatgatgcaactattgcttaccatgaaaatagcacgtctgaattcgctgacgatgaccatcatgtcaaagatatttctaggagatatcatgtccacttgtacacaaatgggactgtatgtgatctcacagacataccccaggagactgaggttagatttgtctgctcggaacccactgtcctgatcagttcgatcaaggagatctcttcctgcaaatatgttgtaacaattcaaagcccgatgctttgcaaaaacccgctgttccatcaagaaaaacgcaacctctccatccactgcaacaagttgcctactgaaacagaatcaactgtcattgtggacgatgactcgctgccaaaagaagcgcagatctccatcattcctgatcaggatgaacttcatggtttcacagcttatgccacttgacttccctccaataaagtatgtctgatgtagaagaaacaattattttggaggcgcagtggcaactgagaacactatctttactgtcccatgaaaccctgcagtggcacatggtgctccttgtaaagcaggctgagattactgtctacaaagctaattataggggaggattacgaaggaagagagtttctctgtattagtaaagaaacaattttgagacactaacatttgcttgaaatgtctataaaatggattgctgcaaaaaaaaaaaaaaaaaaaa

SEQ ID NO: 3836 - protein, 296 aa, Panicum virgatum
  misc_feature: Ceres CLONE 1795141
  misc_feature (1)..(78): Pfam Name: PRKCSH Pfam Description: Glucosidase II beta subunit-like protein
MGFAGRVSALLLFLVAGAVASDQIFTASGVPFGRSSRVPRYRVEFHPVDSPYQPENGQESVPMASHEGKHYTCFLPVEETKTMKSILPQNATNVIIGSDRRIKPKEPDELLEPLKDQCFYRHEGWWSYEFCYHGKIRQVHVEGDKLIQEYVLGEYDDDATIAYHENSTSEFADDDHHVKDISRRYHVHLYTNGTVCDLTDIPQETEVRFVCSEPTVLISSIKEISSCKYVVTIQSPMLCKNPLFHQEKRNLSIHCNKLPTETESTVIVDDDSLPKEAQISIIPDQDELHGFTAYAT

SEQ ID NO: 3837 - DNA, 989 bp, Panicum virgatum
  misc_feature: Ceres CLONE 1795150
  misc_feature: Encodes the peptide sequence at SEQ ID NO. 3838
aaatctcgcgtttaacttctcccgagtcgcctcccccgaatccccaatctcgcaaaccccaatctcgccgccgccgccgccgccatgtctcgccgctatgacagccgcacgacgatcttctcgccggaggggcgtctctaccaggtggagtacgcgatggaggcgatcggcaacgccgggtcggccctcgggatcctggcggccgacggcgtggtcctcgtcggcgagaagaaggtgacctccaagctcctccagacctcccgatccgccgagaagatgtacaagatcgactcccacctcgcctgcgccgtcgccgggatcatgtccgatgccaacatcctcatcaacaccgcccgcctccacgcccagcgctacgcgctcgcctaccaggagcccatccccgtcgagcagctcgtccagtccctctgcgacaccaagcagggctacacccagttcggaggcctccgccccttcggggtctccttcctcttcgccgggtgggacaagcaccacggcttccagctctacatgagcgatccatctggcaactacggcgggtggaaggccgctgctgttggggctaacagccaggccgcgcagtccatgctcaagcaggactacaaggacggcttgacccgcgaggaggccgtcgccctcgcgctcaaggtcctcagcaagaccatggattccaccagcttgaccgccgagaagctggagctggccgaggtgttcctgcagcccggcaccggggaggtgcagtaccaggtgtgctcccctgaggcgctggggaagctgcttgccaagtccggcctcacgcagccagcacctgaggcttaatgtgctggattgctgtggcttgtgatgcctatttctgctcttagatatagtttgagcagttatgcttctgttgtctgaactaagatatccgagaattatgtgttttaattttatgttcagcatgcttgatccaaaaaaaaaaaaaaaaaaaa

SEQ ID NO: 3838 - protein, 250 aa, Panicum virgatum
  misc_feature: Ceres CLONE 1795150
  misc_feature (1)..(250): SWISSPROT Homolog: EC 3.4.25.1 Proteasome subunit alpha type 4-1
  misc_feature (1)..(250): SWISSPROT Homolog: EC 3.4.25.1 Proteasome subunit alpha type 4-2
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALAYQEPIPVEQLVQSLCDTKQGYTQFGGLRPFGVSFLFAGWDKHHGFQLYMSDPSGNYGGWKAAAVGANSQAAQSMLKQDYKDGLTREEAVALALKVLSKTMDSTSLTAEKLELAEVFLQPGTGEVQYQVCSPEALGKLLAKSGLTQPAPEA

SEQ ID NO: 3839 - DNA, 1637 bp, Panicum virgatum
  misc_feature: Ceres CLONE 1795152
  misc_feature: Encodes the peptide sequence at SEQ ID NO. 3840
gcaactcgcaattccagcacgattcggacgtcatctccttcctcccgtcccgtctccagtctccccacctcttccgccgccgtcccagccgccgccgccgcggcgaaaccctaggccccgctgagcaaagcccacgcgggtcgcactgcggtagcctctcgggagatggagtacggcgtcgcctctcacggcgccctcctcgccgccgcgccgctcgcgggtcagcggccccgtctacccctctcgccgccgccgtcaccgccgtctattcagatccagaatcgtctttattccatatcgtcactcccactaaaggctaggccagtgagaagatgcagagcttctgtagcaagtaactactcgcaaacatctgaaatagttgatttggactgggagaaccttggttttgggcttgttcaaactgactacatgtacattacaaaatgcgggcaggatgggaaattttctgagggtgaattggtgccgtttggacccatagcactgaacccatcttctggagtcctgaactatggacagggattgtttgagggcctaaaggcatataggaaacctgatgggtccatcttattatttcgcccggaggaaaatgctttgaggatgcaaactggtgctgagaggatgtgcatgcctgccccttccgttgagcagtttgttgatgttgtaaaacaaaccgttctagcaaataagagatgggtacctcctactggcaaaggttctctgtatattagacctctacttatgggaagtggggctgttcttggtctggcacctgctccggagtatacatttattatatttgcctcccctgttggtaactactttaaggaaggtttagcaccaataaatttgatagttgaagacaagtttcatcgtgccactcctggtggaactggaagtgtgaagaccattggaaattatgcttcggtgttgatggcacagaaaattgcaaaggagaaaggttattctgatgttctctacttggatgtggttcacaaaaaatatcttgaagaagtttcttcatgtaatatttttgttgtcaagggcaatgttatttctactccagcagtaaaaggaacaatattacctggcatcacaaggaaaagtataattgatgttgctgtgagcaagggcttccaggttgaggagcggcttgtgtccgtggatgaattgcttgatgctgatgaagtgttctgcacgggaactgctgttgtagtgtctcctgttgggagtatcacatatcaagggaaaagggtggaatatgggcaccaaggtgttggcgtcgtgtctcagcagctgtatacttcactgacgagtctccagatgggtcaaacagaggactggatgggctggactatgcaactgaactagcatcaggccatgtgcatatcgaatctgccttcctcgcatagatgggtttgcaagatctccgtctagatcaatgatgtggtcataagtagctctgtacccttcagttttttagcatctgtcggagtgtggctcgtgctatatattccgtaggtgttggtgcattgcgtcagcttaaactataattgcatgtacccttcagttctgtttttggactagcattgcattggcaaaaaaaaaaaaaaaaaaaa

SEQ ID NO: 3840 - protein, 407 aa, Panicum virgatum
  misc_feature: Ceres CLONE 1795152
  misc_feature (1)..(289): Pfam Name: Aminotran_4 Pfam Description: Aminotransferase class IV
  misc_feature (29)..(407): SWISSPROT Homolog: EC 2.6.1.42 Branched-chain-amino-acid aminotransferase 3, chloroplast precursor
  misc_feature (55)..(407): SWISSPROT Homolog: EC 2.6.1.42 Branched-chain-amino-acid aminotransferase 5, chloroplast precursor
MEYGVASHGALLAAAPLAGQRPRLPLSPPPSPPSIQIQNRLYSISSLPLKARPVRRCRASVASNYSQTSEIVDLDWENLGFGLVQTDYMYITKCGQDGKFSEGELVPFGPIALNPSSGVLNYGQGLFEGLKAYRKPDGSILLFRPEENALRMQTGAERMCMPAPSVEQFVDVVKQTVLANKRWVPPTGKGSLYIRPLLMGSGAVLGLAPAPEYTFIIFASPVGNYFKEGLAPINLIVEDKFHRATPGGTGSVKTIGNYASVLMAQKIAKEKGYSDVLYLDVVHKKYLEEVSSCNIFVVKGNVISTPAVKGTILPGITRKSIIDVAVSKGFQVEERLVSVDELLDADEVFCTGTAVVVSPVGSITYQGKRVEYGHQGVGVVSQQLYTSLTSLQMGQTEDWMGWTMQLN

SEQ ID NO: 3841 - DNA, 1841 bp, Panicum virgatum
  misc_feature: Ceres CLONE 1795165
  misc_feature: Encodes the peptide sequence at SEQ ID NO. 3842
aactcgacgctcaaacaagcctgcgctcaaatccagttcctgcctcgtccgctctcctcttccctcctcccctccttccgcgcggtgtgctcttcgcttctccccgcgcctagggtttcctcctcctcctcccccagagcaggcctgcactaccccaaccgccacggcgtcgtccccttcccgccgctagagactcccgaaccgcggtccgtctgaatcgcatcttcccttcgcctcccctgccggcccgccccagaggggaaccctgcgctccccgatcggtcattgttgcctgggtagatacgagcggcggcggcggcgatctctggacgtaccgcgggaagcggaggtaggccaggccggcgagggggcagagcggagggcgccctaccgtccttcgactcctgcggtcctgccgcgcgtcgcgggcttctgtatattccatttggaacccccacaccccaaaacaaatccaaccatggatccacaaaattggccaatccagtcgttggagcacaaaccaggctggatttcctcttcttcctctccagtctccagtctccatgaattgttggatcctgctgtcactggagcccacagagctcgcgcgttaccagcagagaccgttcctccatgctggatcagtggatcaccgcttgctgctgacagcaccaggcgaggggccaccaaatttacccccacagtggaggaggggaggagcttctgataccgcatgtgctgaattctgggcaaaggtgttcttctggtacttcaggatttctaagtgaagttgctgaagaagtgactttaaggtgtctgccactttcgctcccatggcaaccaatgagaacctcccaccaaatgtgatcagacagttggctaaagaattgaagaatcttgatgactcacctccggaagggatcaaagttagtgttaatgatgatgacttcaccactatttttgctgatattgagggcccagctggaactccatacgagaatggagtattcaggatgaagctgttattatctcgtgacttccctcattctcctccaaaaggcttcttcttgacaaaaattttccatccaaacatagcaactagtggtgagatatgtgtgaacacactaaagaaggattggaatcctagtcttggattaagacacattctgctggtagtgagatgccttctgattgaaccatttcctgaatctgccctcaatgaacaagctggaaagatgctacttgaaaattatgaggagtatgcacggcatgcaaggctatacactggtatccatgcgctcaagcctaagaacaagtcgaagagtggagctatttctgagtcaaccacagctctaaatgtgggccagtccaataccgttctcggtgagaacacacctttggcatcagcagcgatatctacctctgctgcggcgaaagcattaggtaaaaactcacaggatcagaatgctgctacgtctgatcctgttgtaggagcatccactgcacccaagaaggatgtgccacatgccgccaaagttccagttgataagaagaagctggatgcaaggaagaagagcttgaagagattgtagtcgaataatcctgggtggtgaggggtgcttagtggtagataaaataatgatgccttcactagtgctagattcaacagatgccgggtagaactgaagaaaagtgaagaggacaaacagcgcgagaggcatcccatggctggcggtctgtggtctccgctgggactcgggacaaactgtctgtgcaattacagttattcatttgtttggaagaatacttgccttttttcagaaaaaaaaaaaaaaaaaaaa

SEQ ID NO: 3842 - protein, 252 aa, Panicum virgatum
  misc_feature: Ceres CLONE 1795165
  misc_feature (1)..(154): SWISSPROT Homolog: EC 6.3.2.19 Ubiquitin-conjugating enzyme E2 S
MATNENLPPNVIRQLAKELKNLDDSPPEGIKVSVNDDDFTTIFADIEGPAGTPYENGVFRMKLLLSRDFPHSPPKGFFLTKIFHPNIATSGEICVNTLKKDWNPSLGLRHILLVVRCLLIEPFPESALNEQAGKMLLENYEEYARHARLYTGIHALKPKNKSKSGAISESTTALNVGQSNTVLGENTPLASAAISTSAAAKALGKNSQDQNAATSDPVVGASTAPKKDVPHAAKVPVDKKKLDARKKSLKRL

SEQ ID NO: 3843 - DNA, 2024 bp, Panicum virgatum
  misc_feature: Ceres CLONE 1795169
  misc_feature: Encodes the peptide sequence at SEQ ID NO. 3844
atctcttctccagttcccctctttggagggccttgttgtttgtaaccttgtttggggttggaagagagagaccttcttcttccccacgaatccaagcatctttccctagttcctctggagttgccatgccattttggtattgccatgccatgccagcctaaaatcgcgaccttttttattgattggtatttctactgccagtactagaaaaaccccaccgcaccgacagcgcagccgtgatgcgatgcgatgcgagaggcatcgtcctgcttccaaatccaataccccccccccccccctgcgagggatgtgatgtccttgtagaggaaaggaaaggggaggggaggaggaaatcttgtcgatccaaaaagcaagggaagccgggactagaaggagagcgctgccgcttggactctctcaacgacgccgacgccggccatggccatggccaagcacaagcagcgccgggtgtaccaagcctggagaggcaacaacataatcttgtgtggtggaaggttgatctttggaccagatgccaaggccactctcttatctttcgctctaatcgcaatccctgttgctgtcttctgcgtctttgtggccagggatctcatacacatatttcctgcatataatgcaggctatgcaattcttgctgtcaccataggccttacaatttatgtactgttactgctcttgcttacctcatctcaagatccaggtattgtaccacggaattcacacccacctgtggaagagttttctcatgatgcttcagctccacatactcttcagtttcctcgagtaaaagaggttatggtcaatggtgtgcctgtgaaagtgaaatactgtgaaacttgcatgatataccggcctcctcgctgctcccactgctccaaatgtgataactgtgttgagcgctttgatcatcactgcccttgggttgggcagtgtattggagagcgaaattaccggtacttcttctgttttgttttgtcggcggcagtcctgtgtatctatgtatgtgcaatgtgtggattgtacatcaagcttctcatgagtaggggtcaccattcattggtgaaggccattaaagaatctccagcttcattggcagtcatggcatattgtttcgtttgcttctggtttgtcggcggtctcactgggttccattcttaccttatcgcgacaaacaagacaacgtatgagaatatcaagtacaagtacagcaaccaaccaaacgtgtatgaccgcggttttgtgcgcaactgtcatgagttctggtgcacaaaaaggaagccttctaagatcaacctacgagctattgttcaagaggaacatgaggcagcacagccacagatcagctattccaatgtgccagaagatgatgcacctcatcgtccgcgagccaaggttgaggatgatctagaaataggtctcgacgttctgaagtctccgaggcgcccgacagatgaacttagtgatgaagaattggagtctggaagcaatggtgttaaatatcgcacaccagattcagacactgacatccctgtaaccagaactaagactgagatcttcggtgaagttagggatctggacttgtcggttagtaatgctgcattaccatcgtctcctcagcagaaacaacaccctgatgaactttgttgatggtttacgaatgtgcctgttcattgaaatttactttgcacgttttcatatagcagacaccaacaactcgtttaagttatccaagagggatgtgaatgattggatttgaaggcatatgttctcatttgccatctgtttttaggaatttagccagttgcttgatcaatcatagaattttatgtgtaaaaaccccagtttatggaaggttttagatgtttataggaattgtttgaaattcttcaggagtgtatgaggcgattcataactgtacataatttttatgacgatatggccactggtatgtataatgtgtcctttccaaaatgtggatttgcgaaaaaaaaaaaaaaaaaaaa

SEQ ID NO: 3844 - protein, 409 aa, Panicum virgatum
  misc_feature: Ceres CLONE 1795169
  misc_feature (1)..(65): Pfam Name: zf-DHHC Pfam Description: DHHC zinc finger domain
MAMAKHKQRRVYQAWRGNNIILCGGRLIFGPDAKATLLSFALIAIPVAVFCVFVARDLIHIFPAYNAGYAILAVTIGLTIYVLLLLLLTSSQDPGIVPRNSHPPVEEFSHDASAPHTLQFPRVKEVMVNGVPVKVKYCETCMIYRPPRCSHCSKCDNCVERFDHHCPWVGQCIGERNYRYFFCFVLSAAVLCIYVCAMCGLYIKLLMSRGHHSLVKAIKESPASLAVMAYCFVCFWFVGGLTGFHSYLIATNKTTYENIKYKYSNQPNVYDRGFVRNCHEFWCTKRKPSKINLRAIVQEEHEAAQPQISYSNVPEDDAPHRPRAKVEDDLEIGLDVLKSPRRPTDELSDEELESGSNGVKYRTPDSDTDIPVTRTKTEIFGEVRDLDLSVSNAALPSSPQQKQHPDELC

SEQ ID NO: 3845 - DNA, 1753 bp, Panicum virgatum
  misc_feature: Ceres CLONE 1795172
  misc_feature: Encodes the peptide sequence at SEQ ID NO. 3846
gaccaccgcttcgtctcatcctcgtcgcccccccctgcgccctcccctctcgctcgctcgccagcggccgcttaataaatcaccagccctctgccccggccaccgaaagcaatcaccccaccacggattaaacaaagcgcgcacccaatcaacgcggcgacgcactcgcatcgcacctcgcaaccgtatctccccgagccgtgttgggggaggaagaggagtggggagccccgatccagtcccatccagccagccgaatcccctcgccgccgccgccgccgccgccgccgccctctccttcctctaaaaccctagcgtgagcggggatgaagatccagtgcaacgcgtgcggggccgcggaggcgcgggtgctctgctgcgcggacgaggcggcgctctgcgcggcctgcgacgaggaggtgcacgccgccaacaagctcgcggggaagcaccagcgggtgccgctgctctcggacgccgacgccgccgccgccgcggcgcccgccgtgcccaagtgcgacatctgccaggaggcttctggatacttcttctgcctagaggaccgtgcactgctttgtagagattgtgatgttgctatacacacggtaaattcatttgtttcggtgcatcagagattcctgctaactggagttcaggtgggccttgatcctgccgatccagttccacccattgctgaaaaccgtgttaatgccactagtggctcggtatatcaaccagcaaaacatcttccaaggagaaacacaacagttcaattttcaggtgaaggcactgcttctgttcccagcaaaaagttaataaatggagactattcaagacagaattctgttccaacagtcagtacgggagtggttgattggacaacgcacaatggtgcaattcaatccggagaatctccgcctgagtacatgtcagaggaaaatccaacacttctgcaatctagccagaccacagcagtcttttccaatcaaattaacagcgatagtgatcaggcctacaacttgccattctcgggtggtaatgggtcagacagcctaccagactggcctgtggatgagttcttcactaactcagaatatggcccaaacttcagcttttcggagcatggttcttcaaagagtgacaatgctaagctggggagtgctgcgggatctccacaatgccgtttagctgaaggcttcgttgctgaggaactattaggccaggttcctggattggtaaccgataaatatatgggccgagtacctgagaattcatgggcagtccctgaggttccctcaccaccaacagcatcggggctcaattggcatgggaatttgcatttcactgcatatgacagcaccatgtttgttcctgaaatctcctccctccagagctctcaagatcaattcgctgtaccttccggtttccagcgccggaggagacagtattgagtgacaacaagagcactagacaccactctcttttagacaatcttgagagaggcctcttgctgggccaaacgacgggaaaggatcaggactgggtgatcattcccacttcaatgaattatccggtagccaggtttaaagtgtgttgtaatgcctcaaagttgtccatcttccaaatattcgagcttccctagtgaatcgttgtggtgttgagtttgtgtatatagcgaaataaagaggagcaccagtaacatcataattaatggcacatgaagttccttctccaaaaaaaaaaaaaaaaaaaa

SEQ ID NO: 3846 - protein, 374 aa, Panicum virgatum
  misc_feature: Ceres CLONE 1795172
  misc_feature: Great-hit functional homolog of the protein sequence given in SEQ ID NO 9212
  misc_feature (1)..(48): Pfam Name: zf-B_box Pfam Description: B-box zinc finger
  misc_feature: Useful for making plants with altered Lignin content
MKIQCNACGAAEARVLCCADEAALCAACDEEVHAANKLAGKHQRVPLLSDADAAAAAAPAVPKCDICQEASGYFFCLEDRALLCRDCDVAIHTVNSFVSVHQRFLLTGVQVGLDPADPVPPIAENRVNATSGSVYQPAKHLPRRNTTVQFSGEGTASVPSKKLINGDYSRQNSVPTVSTGVVDWTTHNGAIQSGESPPEYMSEENPTLLQSSQTTAVFSNQINSDSDQAYNLPFSGGNGSDSLPDWPVDEFFTNSEYGPNFSFSEHGSSKSDNAKLGSAAGSPQCRLAEGFVAEELLGQVPGLVTDKYMGRVPENSWAVPEVPSPPTASGLNWHGNLHFTAYDSTMFVPEISSLQSSQDQFAVPSGFQRRRRQY

SEQ ID NO: 3847 - DNA, 1756 bp, Panicum virgatum
  misc_feature: Ceres CLONE 1795173
  misc_feature: Encodes the peptide sequence at SEQ ID NO. 3848
tcccaacccctcgttttttcccaacctcttttctgaattccagccttccagcccacgcccattcctggactgctccccaaacggtcaaagccagagccgatcgcgcgcggcggcgataacgagaactcgagaaggtagcggaaccggggggaggagggagagccgccggcgagcagcaatgccttactgcgaggtgggcaggtacgcggacggcgacaagtgggagggcgtccggctcttctaccgccgctacggccgcggcgccaccaaggtgatcctcatcatcggattggcggggacgcatgactcgtggggcccgcagataaagggattgaccgggtcgctggagcccgccgccgacgagcccccgcggccggacgaggaggccggcgccggagccgccggcgcggcggaggcggcgcccgcggaagggggtgatgccggcgatggcatcgaggtctgctgcttcgataaccgcggcgtcggccgcagctccgtgccccctaacaaatcctactactcgacggcgatcatggcgaaggatgccttggccttgatggatcatttggggtggaagaaggcacatgtctttggccactctatgggtgcgatgatttcttgcaagctagcagcgatagcgcctcacaggctgtgttcactggcattgcttaatgttaccgggggtggctttcagtgtttcccaaaggtagatgggcagatgctatctcttgcattccgtttcttaagagcgaaaactccagaggaaagagcgcttgtggacttggaaacccattatacaaaggaataccttgaggagactgtcgggtcatgtactagaagaatgatcctttatcaagaatatgtgaagggcatatcttcaacaggaatgcaatctaattgtggttttgaagggcaagttaatgcatgctggacacacaacatgagtacaaaagaattagagacaatacggtctgccggttttctaatttcagttattcatggaaggtacgatataattgcacaattgtgtcatgcaaaacgtctagcagaaaggcttcttcctgctgctaggatggtagaacttcatggtgcacatcttgtgagccatgaaagaccagatgaggtgaacaatgcgcttatggatctaataaaggctaccaaatctgcggtgaaacctgaagagtggtcggcccagcctgagaatgtatcagaaaccggggcactgatatccgggagacccattaccgtgacgatgcgtacagatgaaggtgcaaacgccaccaatgctgccgtagcagtctataacttgcttggcaagctgcaactaagctttctttatctcataggggtgatagtcatggggtttgagcacatgaggaacattgtaaaggtaatgaagccagtaagggtggcagcaattgagtcataattcatcataagaaacaaggacatgtaagttattctcggtaccttgtgggagctcgagttgatatctcacttctccccaatacttcggagatgatggttttagagtagcatctccaacaaatgtggaacttttctgagaaaacgcttgctcatatataggagaataataggacacaagaaaatcgacgaaaccatactaggcacctggacagaagtgtcgcagggcccggtgatgtatgtacctgcaagaaagaatctgcagcctgtatcagtttcacagccatttcaaatcgattcttcgttgcttcaaaaaaaaaaaaaaaaaaaa

SEQ ID NO: 3848 - protein, 416 aa, Panicum virgatum
  misc_feature: Ceres CLONE 1795173
  misc_feature (1)..(231): Pfam Name: Abhydrolase_1 Pfam Description: alpha/beta hydrolase fold
MPYCEVGRYADGDKWEGVRLFYRRYGRGATKVILIIGLAGTHDSWGPQIKGLTGSLEPAADEPPRPDEEAGAGAAGAAEAAPAEGGDAGDGIEVCCFDNRGVGRSSVPPNKSYYSTAIMAKDALALMDHLGWKKAHVFGHSMGAMISCKLAAIAPHRLCSLALLNVTGGGFQCFPKVDGQMLSLAFRFLRAKTPEERALVDLETHYTKEYLEETVGSCTRRMILYQEYVKGISSTGMQSNCGFEGQVNACWTHNMSTKELETIRSAGFLISVIHGRYDIIAQLCHAKRLAERLLPAARMVELHGAHLVSHERPDEVNNALMDLIKATKSAVKPEEWSAQPENVSETGALISGRPITVTMRTDEGANATNAAVAVYNLLGKLQLSFLYLIGVIVMGFEHMRNIVKVMKPVRVAAIES

SEQ ID NO: 3849 - DNA, 1531 bp, Panicum virgatum
  misc_feature: Ceres CLONE 1795184
  misc_feature: Encodes the peptide sequence at SEQ ID NO. 3850
accccgcccctctcccctgtctctctcctcgctccccacgctacgcatcgcctcgtctcctcgggagccggcagcggcgcagcgccccgcgagcacgggaagggagggagcggggatgaggatgctgtcgaaggcgtgctcgatcgtggcctcctcccttccgcgctgctcctcctcctccgccgcccccacgatgagggggcagccgtccttgctgcccagcgtgcggaagcaatggctcgggaagcccctgctgtacggaatcggctccctgttggtcatgccgctgaggacgctgcacggagtagggcgtgtgtttggcgcagggaggttcctctgcaacatgaccagcgtctcatcatcccttcaaattgagcttgtaccatgccttcgagataactatgcatatatcctgcacgacgttgatactggaacagttggagtggtggacccttctgaggctatgcctattataaatgcattggaaaagagaaatcagaacttgacctatatactgaatactcatcatcactatgaccatactggtgggaacttggaactgaaggcaaaatatggtgcaaaggttattggttctgaaaaggaccgggatagaattcctggcattgacatcggtcttaaggagggtgacacatggatgtttgctggtcatcaagttcttgtactggaaactcctgggcatacatcaggtcatgtgtgctattattttgctggttctggagccatatttacaggtgacactttgttcggtctatcatgtggaaagctttttgaagggactccacagcagatgtattcctcacttcagaaaattatagctctgcctgatgagacgaaagtatactgtgggcatgaatatactttgagtaattcaaaatttgccctgagtgtagaaccaggaaataaagaattacaggaatatgctgcaaatgtagctgagttgcgcaataagaatatacccacggtgccaacaacaattgggagagagaagcaatgcaatcctttcctgcggacctccaatccagaaattaagagaactctgtccattccagatcatttcgatgaagatcgggtgcttgaagttgtccgtcgagcaaaagataacttctgactaacaaaaggaaactcttgtgacatgaccaactatcttgttaaagttcggacaaagaaacacctgaaacacaagaaatgtaggaaagaaaggtatataagtttgggcttagattttgaaatgcttcggcaaaattgtgtcgaatgtatgtagcttgggcagtgcttgtctatagcagccagtgatttttttttgtctactgcaaataaacatgttctgctatcatctacgttgtaaaaaaaaagtgagttagctgttcgatagttaatttcagtttttgcagttcaatacattattaactttgctgtgtttgtattgtcttgatggtctgtttggcaatggtgattactcgctgaatgtactgatgatgtgacattgcacgaaaaaaaaaaaaaaaaaaaa

SEQ ID NO: 3850 - protein, 337 aa, Panicum virgatum
  misc_feature: Ceres CLONE 1795184
  misc_feature (1)..(159): Pfam Name: Lactamase_B Pfam Description: Metallo-beta-lactamase superfamily
  misc_feature (1)..(337): SWISSPROT Homolog: EC 3.1.2.6 Hydroxyacylglutathione hydrolase 1, mitochondrial precursor
MRMLSKACSIVASSLPRCSSSSAAPTMRGQPSLLPSVRKQWLGKPLLYGIGSLLVMPLRTLHGVGRVFGAGRFLCNMTSVSSSLQIELVPCLRDNYAYILHDVDTGTVGVVDPSEAMPIINALEKRNQNLTYILNTHHHYDHTGGNLELKAKYGAKVIGSEKDRDRIPGIDIGLKEGDTWMFAGHQVLVLETPGHTSGHVCYYFAGSGAIFTGDTLFGLSCGKLFEGTPQQMYSSLQKIIALPDETKVYCGHEYTLSNSKFALSVEPGNKELQEYAANVAELRNKNIPTVPTTIGREKQCNPFLRTSNPEIKRTLSIPDHFDEDRVLEVVRRAKDNF

SEQ ID NO: 3851 - DNA, 1915 bp, Panicum virgatum
  misc_feature: Ceres CLONE 1795212
  misc_feature: Encodes the peptide sequence at SEQ ID NO. 3852
aaaaaggcggtcgataacttgttccgagtcccatctcccttgatcttcccttccatcctcccctaacgttgccggcgggagagacaatcgaaccagccagcggaacccgatccccacccccgacgccaaggccgccgccgagagccgcttcctctccctccgctcccccgcggcgagacgaccgcgccggcgcccgtccgatcggaccacgcgtggcccctttgttctactataagctataaatgattccatgggaactccagacgaaatgatggcatactcttccctgtccaaaatcgataccagtcagaaccagagagctgctctgtccaatggagttgctggaaacaactaccaagctcacgattatctctatgagccatcatttgaaccagacttcccagagtatgattcacgggatgacccattcaccccaacacgagctagtccaaaagttgatctgaagactgttcttggtgggctggtttcaataatcacgggtgcaaacaagagtgaggatgattcatcacagcagcgaagtttcagcacagacatctcgtttcttggatctgacaagaatggcgatgtcgatgtgcatccatccgtctgtgttccaagtgcaccaccactacttgaagcaaacgctttgcaatttagtgcatacagggaggttttgcttgcagatccaccagagtggttgccagatagctctgctaatgcgtgcctgcagtgcaacttgcctttcacagctctgactcgtggaagacaccattgccggttctgtggaggtatattctgcaaagattgttccaaggcaaggtgtttgctgcccatgaaattcagaattcgtgatcctcagagagtttgtgattcttgctacgagaggctcgatccccttcagggcttattgatcaactacaatagtaactccatgcagccagcaaaacacgatgtcatggattggacaagcactagaagctggttgaacatgcctgtcggtgtatcaatggagtatgaaatatacaaggccacaaacacaatgaagaaatattgtcaggttgcaaggttaaaccctgagaagtccatcccatcatctattctcaagggagcaaagggacttgcaattctaacagttgccaaggcgggtgcagttgtaacatacaaagttggcactggtcttgtagttgctcgcagatcagatggatcatggtctgccccatcagcaattttatctgttggattgggatggggagtacagattggtggagaactgacggactttatcattgtgcttcatgaccgtaaagctgtcaaggcattcagcagtcgcattcatctttctcttggggcgggattaagtgctgcagcagggccagtaggcagagcctttgaggcagatgttcgggccagtgagaaaggttctggaatatgctacacttacagctgcagcaaaggtgcgttcgtcggggcttcactggaagggaacgtcgtgacaaccagatcagagaccaatcttcgtttctatggcgatgcttatctgaccacaactgacatcctgtttgggagagtggagaggccccgagccgcccagcccctgtactcagctctagactatcttttcgccagaatggtctgctagtccatttagattggtgcaatactctgctgcatgcccacggtcgttagcttgcagccatatacataaaacagatcataccaggaaaatcctaaaaaaaaagaaagatgacagggaaaaaagtgtaccttttgttggatggttgcacattcactgcagtactagatatctagtcgacacttgtaaatattggcagatatgctgtcctttgccggtttggactcattcatgcaatggaagactgataaatttgttggtcaaaaaaaaaaaaaaaaaaaa

SEQ ID NO: 3852 - protein, 462 aa, Panicum virgatum
  misc_feature: Ceres CLONE 1795212
  misc_feature (1)..(69): Pfam Name: FYVE Pfam Description: FYVE zinc finger
MGTPDEMMAYSSLSKIDTSQNQRAALSNGVAGNNYQAHDYLYEPSFEPDFPEYDSRDDPFTPTRASPKVDLKTVLGGLVSIITGANKSEDDSSQQRSFSTDISFLGSDKNGDVDVHPSVCVPSAPPLLEANALQFSAYREVLLADPPEWLPDSSANACLQCNLPFTALTRGRHHCRFCGGIFCKDCSKARCLLPMKFRIRDPQRVCDSCYERLDPLQGLLINYNSNSMQPAKHDVMDWTSTRSWLNMPVGVSMEYEIYKATNTMKKYCQVARLNPEKSIPSSILKGAKGLAILTVAKAGAVVTYKVGTGLVVARRSDGSWSAPSAILSVGLGWGVQIGGELTDFIIVLHDRKAVKAFSSRIHLSLGAGLSAAAGPVGRAFEADVRASEKGSGICYTYSCSKGAFVGASLEGNVVTTRSETNLRFYGDAYLTTTDILFGRVERPRAAQPLYSALDYLFARMVC

SEQ ID NO: 3853 - DNA, 2238 bp, Panicum virgatum
  misc_feature: Ceres CLONE 1795238
  misc_feature: Encodes the peptide sequence at SEQ ID NO. 3854
ctggcgcccgcgcgatatttccctggccctcctcgccgcccgcccgccttctactcgtacctgagcgagcgagcctccactccacccgacctgcagtccgccactcccgcggtcccgccaccccgcttcgccttcctcccgcggctgtagcgagcgcaaggtcaccactgaatggctgcagcaatgggttcaatatctgcctatggttcttaccaaacaaataggcccagtgcactgaagcagacacctcacatgcaattccaacaatgttgtagaggtggagttaggttcgtaagcaatcattcccaatccgtgcgaagtaagacacggctgtccaaaagaagagccacaaataatggaattcgtccaaagactaccaggtctcaggcacctattgtatgttccactggaatgaccataatttttgttgcaactgaagtacacccatggtgcaaaactagtggcctcggtgatgttgtaggaggactgcccccagctctggctgccatgggacaccgggtcatgacgatagctcctcgctatgatcaatacaaggatgcatgggatacaaatgtccttgttgaggtaaatgttggtgacacagtagaaactgttcgcttcttccactgctacaaaagaggagttgatcgtatttttgttgatcaccctatgtttcttgaaaaggtatggggcaagactggtgcaaaattgtatggtcctactactggaagtgattatagagataaccagttgaggttctgccttttgtgccttgctgctttggaggctcccagagttctcaatctcagcaattctgaatacttttctggaccttatggtgaagatgttgtcttcgtagcgaatgattggcacactgcagttctgccctgctatctgaagagcatgtataagccaaatggaatttatgcgaatgctaaggttgctttctgcattcacaacattgcctatcaaggtagatttgccagagcagacttcgaagttcttaatctacctgacagtttcttgccttcatttgattttattgatgaacatgttaagcctgtactagggagaaagattaactggatgaaggcagggattgttgagagtgatctggttctaacagttagtccacattatgtcaaggaactcacttctggcccagacaaaggtgttgagttggatggtgtccttcgcacaaagcccctcgaaactggaattgtaaatggcatggatgtttatgaatgggatccttcaacagataagtacatcagtgtgaaatatgatgcaacaacggtaactgaagcaagggctctcaataaagaaaggttgcaagctgaagttggattgcctgtggactccaacatccctgttatagtttttgttggccgtcttgaagaacagaaaggatcagacatacttatttcagccattccggaattcgtgggcgagaatgttcagataattgttcttggtacagggaagaagaaaatggaggaggaattgacgctgctagaagtgaaatatccaaacaatgccagaggcatagcgaaattcaacgtcccattagcacatatgatgtttgctggggctgacttcatcattgtcccaagtaggtttgagccctgtggtctcattcagttgcaagggatgagatatggagtgatccccatctgttcatcaactggaggacttgtagacacggttaaggtgggtgtcaccggattccacatgggtcccttcaatgtcgagtgtgaaactgtcgatacagctgacgtcgcagcagtggcatcaactgtcacacgcgctctggaacagtacgccaccccggtgttccatgagatgattcagaactgcatggtgcaggacctgtcctggaaggggcctgcaaagaagtgggaggaggtgcttcttggcctcggggtcgagggaagtgaggcgggcatcgagggcgaggagatcgcccctcttgccaaggaaaatgtggccactccctgaagcctcacgtgcctgtgaaatatgcattaagcattatgacatgttgagccagtcacaggcataggttaaaatttcttagccttccatgacatgttgagccagtcacaggcaaagccactagtttcacgcctctacgtcatgtgtaatataatgcttgatattctaaagaaggcgtgcctggtttggttcatgcgccacgttagctggatgtttcgacctgaaaaaaaaaaaaaaaaaaaa

SEQ ID NO: 3854 - protein, 608 aa, Panicum virgatum
  misc_feature: Ceres CLONE 1795238
  misc_feature (2)..(261): Pfam Name: Glyco_transf_5 Pfam Description: Starch synthase catalytic domain
  misc_feature (37)..(608): SWISSPROT Homolog: EC 2.4.1.242 Granule-bound starch synthase 1, chloroplast precursor
  misc_feature (39)..(608): SWISSPROT Homolog: EC 2.4.1.21 Granule-bound starch synthase 1, chloroplast precursor
MAAAMGSISAYGSYQTNRPSALKQTPHMQFQQCCRGGVRFVSNHSQSVRSKTRLSKRRATNNGIRPKTTRSQAPIVCSTGMTIIFVATEVHPWCKTSGLGDVVGGLPPALAAMGHRVMTIAPRYDQYKDAWDTNVLVEVNVGDTVETVRFFHCYKRGVDRIFVDHPMFLEKVWGKTGAKLYGPTTGSDYRDNQLRFCLLCLAALEAPRVLNLSNSEYFSGPYGEDVVFVANDWHTAVLPCYLKSMYKPNGIYANAKVAFCIHNIAYQGRFARADFEVLNLPDSFLPSFDFIDEHVKPVLGRKINWMKAGIVESDLVLTVSPHYVKELTSGPDKGVELDGVLRTKPLETGIVNGMDVYEWDPSTDKYISVKYDATTVTEARALNKERLQAEVGLPVDSNIPVIVFVGRLEEQKGSDILISAIPEFVGENVQIIVLGTGKKKMEEELTLLEVKYPNNARGIAKFNVPLAHMMFAGADFIIVPSRFEPCGLIQLQGMRYGVIPICSSTGGLVDTVKVGVTGFHMGPFNVECETVDTADVAAVASTVTRALEQYATPVFHEMIQNCMVQDLSWKGPAKKWEEVLLGLGVEGSEAGIEGEEIAPLAKENVATP

SEQ ID NO: 3855 - DNA, 1913 bp, Panicum virgatum
  misc_feature: Ceres CLONE 1795243
  misc_feature: Encodes the peptide sequence at SEQ ID NO. 3856
gaacaaccaaactttctccgttcccctgctcgccttcgccccgctggtgctgacctctttccgccgccgaatcctcctcagcccgcgccgtggtccctccttctctgccggatcccccggccgccggccgccgcgcctagcggggttggagatccgcctgtcccgggaccgtctggtgtctaggtttttgcttggcaagatggcgaacatccgggcgcttctagtcggcttgtcgcgtgcaagggattccttagctgaggctggccgatgtgcttccatgaggccgtcactcctagcatcagtgggtggacattacaaggttcccatgccagcccgttggttctcaacagggcttcctccacatctggtggttgggatgccagcattgtcccctactatgaaccaaggtaacattgcaaaatggagaaaacaggaaggagataagatagaggttggtgatgtgatatgcgagatagaaaccgacaaagccactcttgaatttgaaagccttgaagaagggtatctggccaaaattttagcacctgaaggttcaaaggatgttcaggttggacagccaattgctgtcacggttgaagagcttgatgatattaaaaatatacccgccgatacatcgtttggaggtgaacaaaaggaagaacagtcagcagaaagtgcaccaaaaactgatgcagctaatgcgtctgaacaaagctcagtagtgagccgaatcagtcctgcagctaagttactcatcaaggtacatggactggatgtgtcatcactgagagcatcaggccctcgtggcacccttctgaaaggggatgttctggctgcactgaagtcaggctcaatttcaatcccagccaaagaacagaaggctccagcgacgccttcatctcagccaactcgtaatgcccaggctcaaccagccactacttcacaaaaggccgatacatatgaagatattccgaatagtcagatacgcaaggttattgcaaaaaggttgcttgaatcaaaacagactactcctcatttatatctatccaaagatgttgtacttgatcccttgctcgctttcaggagcgaactgaaagagcaacatggcattaaagtttcagtaaatgatatcatcataaaagctgtggcaattgccttgcggaacgttcctgaagcaaatgcctactggaacagtgagaaggaagaagcccaaaagtgtgattcagttgatatatctattgctgttgccacagagaagggtctgatgactccaattataagaaatgctgatcaaaagactatatcagcaatatcctcagaggttaagcagctggctgagaaggcaagagctgggaaacttgcacctaatgaatttcagggggggactttcagtatctcaaatcttgggatgtaccctgtggaccatttctgtgcgatcattaatcctccacagtctggcatcttagctgttggtagaggtaacaaggttgttgagcctgttgtggacagtgatggaaatgagaaggccgctgcagttacaaaaatgagcttgacgctgtctgctgaccatcgtgtgtttgatgggcaagtaggagggaaatttttcacggagctggcatcgaatttcagcgacattaggagactgctactgtaaatggaaggaggtggctatcgtgttttgaagaattctttgcgggcgatctgctccagaaaagagaacatttagatgcaagttggggcccagttgcttgatcgacagcccatacagaagtaaccaattttgtaataattctaataagaaagcattggcacctccacggtgattctttttccccgtttaacgtttgttgggaggcggcaaggcatgtcctgagaacttttaacatggttaaagacaaaaaaaaaaaaaaaaaaaa

SEQ ID NO: 3856 - protein, 483 aa, Panicum virgatum
  misc_feature: Ceres CLONE 1795243
  misc_feature (2)..(234): Pfam Name: 2-oxoacid_dh Pfam Description: 2- oxoacid dehydrogenases acyltransferase (catalytic domain)
  misc_feature (49)..(483): SWISSPROT Homolog: EC 2.3.1.12 Dihydrolipoyllysine- residue acetyltransferase component 1 of pyruvate dehydrogenase complex,
MANIRALLVGLSRARDSLAEAGRCASMRPSLLASVGGHYKVPMPARWFSTGLPPHLVVGMPALSPTMNQGNIAKWRKQEGDKIEVGDVICEIETDKATLEFESLEEGYLAKILAPEGSKDVQVGQPIAVTVEELDDIKNIPADTSFGGEQKEEQSAESAPKTDAANASEQSSVVSRISPAAKLLIKVHGLDVSSLRASGPRGTLLKGDVLAALKSGSISIPAKEQKAPATPSSQPTRNAQAQPATTSQKADTYEDIPNSQIRKVIAKRLLESKQTTPHLYLSKDVVLDPLLAFRSELKEQHGIKVSVNDIIIKAVAIALRNVPEANAYWNSEKEEAQKCDSVDISIAVATEKGLMTPIIRNADQKTISAISSEVKQLAEKARAGKLAPNEFQGGTFSISNLGMYPVDHFCAIINPPQSGILAVGRGNKVVEPVVDSDGNEKAAAVTKMSLTLSADHRVFDGQVGGKFFTELASNFSDIRRLLL

SEQ ID NO: 3857 - DNA, 1574 bp, Panicum virgatum
  misc_feature: Ceres CLONE 1795244
  misc_feature: Encodes the peptide sequence at SEQ ID NO. 3858
atcatgtccactggccacccgtgagctcgactccactgagcagtgagcagcacacagcacagtagcagcagccgcaggcgttatcggctatcctcctcccttcactcctcctgcgacccaagccagcctccccatggctgccgcccacctcctcgccgcctccgcctcgtcctcctccaccgccgccttccgcccccctctccgcctccgctccccgacgcacactcctcatctccgccttaaccgcactgggaggcgccccttcccggtggtccgcgcggccgagaccgacgctaaagacgcgaagcccaaggcgccggagaaggcgccggcggcgggcgggtccagcttcaaccagctgctcggcatcaagggcgccaagcaggagaccgacatttggaagatacgtcttcaacttactaaaccagttacatggcctccgcttgtctggggagttctctgtggagcagctgcctctggaaatttccattggacggttgaagatgttgcaaaatctattgtctgcatgataatgtctggcccatgccttacaggatacacgcagacaattaacgactggtatgatcaagacattgatgcaattaacgagccttatcgccctattccatcaggtgctatatcagaaaatgaggtaattactcagatctgggtgctattgttagctgggcttggactgggtgctttgttagacgtgtgggcagggcacgattttcctattgttttttatcttgctgtgggtggttccttactatcctacatatattcagcaccacctctcaagctcaagcagaatggatggattgggaactttgctctgggtgcgagttacattagcttgccctggtgggctggtcaggcgttgttcggaactcttactcctgatatcgttgttctgacaactttgtacagcatagcagggctagggattgctattgtaaacgactttaagagcatcgagggggatagagctctggggcttcagtcacttcctgttgcttttgggatggaaactgcaaaatggatatgcgttggagcaattgacatcactcaattatctgttgcaggctacctgttgagcactggcaagctatattatgccctggcgctgcttggactgacaattcctcaggtggtcttccagttccagtacttcctgaaggaccctgttaagtacgatgtcaaatatcaggcaagcgcgcagccgttctttgtactgggcctgctggtgacggctctggcaaccagccactgaatactgatgaaaacatccaacctagacttatgctcgttcgtattcaggtgtgatgagataagatttcagcgtccgtgtaggtcacattgtgtaagtgtaagctccttgtgagcagggcggggtcgggaaaaaagaaaaatcaattttgtgaagttcaggtgatgcagcagccacgcaggtgatagaaggaaagattagcgatattctctgctgttgtagtaggttcagtagatacacgttaactgagacgcttaagactattgtgcaattgtccgcggctcaaaaaaaaaaaaaaaaaaaa

SEQ ID NO: 3858 - protein, 379 aa, Panicum virgatum
  misc_feature: Ceres CLONE 1795244
  misc_feature (1)..(274): Pfam Name: UbiA Pfam Description: UbiA prenyltransferase family
MAAAHLLAASASSSSTAAFRPPLRLRSPTHTPHLRLNRTGRRPFPVVRAAETDAKDAKPKAPEKAPAAGGSSFNQLLGIKGAKQETDIWKIRLQLTKPVTWPPLVWGVLCGAAASGNFHWTVEDVAKSIVCMIMSGPCLTGYTQTINDWYDQDIDAINEPYRPIPSGAISENEVITQIWVLLLAGLGLGALLDVWAGHDFPIVFYLAVGGSLLSYIYSAPPLKLKQNGWIGNFALGASYISLPWWAGQALFGTLTPDIVVLTTLYSIAGLGIAIVNDFKSIEGDRALGLQSLPVAFGMETAKWICVGAIDITQLSVAGYLLSTGKLYYALALLGLTIPQVVFQFQYFLKDPVKYDVKYQASAQPFFVLGLLVTALATSH

SEQ ID NO: 3859 - DNA, 1633 bp, Panicum virgatum
  misc_feature: Ceres CLONE 1795248
  misc_feature: Encodes the peptide sequence at SEQ ID NO. 3860
gattcccccatcagcctcacctcccctccactacctctccgagcagccaagggagagggacgagctctgcaagggagggaaagccgcgcggcacaagaggcaaaccctagcacacaaagacccactttctccggagcaagccaagccggatagcatagcatccgcatcgccggcgcacccaccatgatcttcccccctgccttcctggattcctcgagctggaacgataaccagcagcagcagcagcagcaggctcatcaccaccaggttgcggccagcggaggtggcggcgagggcaatcatgaccttctccagccatcaatcatggggggagcgcttcccgaaggtggtgctggcggcggcggcacctccgggcagcaggtggggccggcgaagccgatatccatggccgagcgggcgcggctggcgaggatcccgctgccggagccggggctcaagtgcccccgctgcgagtccaccaacaccaagttctgctacttcaacaactactcgctgtcgcagccgcgccacttctgccgcgcctgccgccgctactggacgcgcggcggcgcgctccgcaacgtgcccgtcggcgggggctaccgccgccacgccaagcgcgccaagcccaaggcggcgtccgcggcggcctccgggacggcgtcggccgccacagccgcgctggctcccgccgggtccacgtcgtcagccgcctgcaccacgaccaacgtgcccgcgctccccggccccgccatgctaggcggcaatctgtccatgctgccaccgctgctgcgcctcgccgacttcgacgccatgagcctcggctcgagcttctccgggatggggaagccgttcctcgacggcgcgggaggctactcggtgggtggcggcagcggtcccgggctggagcagtggagggtgcagcagatgcaaagcttcccgttcctgcatgcgatggaccagggcccgctggggccacctctggcgatgacaatggcgcccgggatgttccagttaggtctagacagtggtgatggccgtggtggcggcggtggcgccggtggggaaaacgggtcgggagagctccacgtgatgcaagccaagagggaaggcggcggctacccagcaagaggcatctatggcgatcaccacctcgccgctgccggttacgcttcctattccaacaatgctgctacaggtaaccatctcttgtaatggtcgagcttaagtgatcagagccagctaccatgatcgttaagttggtcctacaactagctagagacagagtgtgtgatggtattgtgatatagaaaaggctagcatgcatttgcaatgttttcttcttcaagaactggtggagagggagagggagagggagaaggatgatggtgctccatttggacatggacgagccatatgctggatcatgcacaagtattatctatagctgcaaggttagctcgcatgatcgcttgttttatgtttcttctttctttctttttttcctatgatctcggatccgatccctttaggttttcactgtcgagcatttggggtgaagtaatgtgtactgctgttgatcattttgttcatggaaacacctatcatatgtcaaaaaaaaaaaaaaaaaaaa

SEQ ID NO: 3860 - protein, 343 aa, Panicum virgatum
  misc_feature: Ceres CLONE 1795248
  misc_feature (1)..(63): Pfam Name: zf-Dof Pfam Description: Dof domain, zinc finger
  misc_feature: The sequence is a functional homolog of  SEQ ID NO 2768 in the  10/374,780 US patent application
  misc_feature: The sequence is a functional homolog of  SEQ ID NO 410 in the  10/225,066 US patent application
  misc_feature: Useful for making plants with modulated growth and phenotype characteristics
MIFPPAFLDSSSWNDNQQQQQQQAHHHQVAASGGGGEGNHDLLQPSIMGGALPEGGAGGGGTSGQQVGPAKPISMAERARLARIPLPEPGLKCPRCESTNTKFCYFNNYSLSQPRHFCRACRRYWTRGGALRNVPVGGGYRRHAKRAKPKAASAAASGTASAATAALAPAGSTSSAACTTTNVPALPGPAMLGGNLSMLPPLLRLADFDAMSLGSSFSGMGKPFLDGAGGYSVGGGSGPGLEQWRVQQMQSFPFLHAMDQGPLGPPLAMTMAPGMFQLGLDSGDGRGGGGGAGGENGSGELHVMQAKREGGGYPARGIYGDHHLAAAGYASYSNNAATGNHLL

SEQ ID NO: 3861 - DNA, 1518 bp, Panicum virgatum
  misc_feature: Ceres CLONE 1795271
  misc_feature: Encodes the peptide sequence at SEQ ID NO. 3862
gtcctcctcccaactcccctcccatggccatggcggccgtgtcgcggcgtcacctccctccctgacccccacctctataaataccgtcgcgcaccaatggcggtccagccatcgcaacaaggcagctgctagctagctagtgctggttacgtcctcatctccgaagctgaggtgcaggtaaggtagtgcggcagcaagcgacgacaatggcggcggcgaccaacggcggggcgcccctggtggtgttcgacttcgacaagaccatcgtcgactgcgacagcgacaactgggtcgtcgacgcgctcggcgccaccgaacgcttcgacgaactcctccgccacctcccctggaaccacgccatcgtaaggacgcacgcatcctcagctcgttcgtgctccctgatcgatcctgccgccgagcaatcaccaacctcaccatggccgcatcaggacgcgatgatgggggagctgcacgcggcgggcaggacggcggaggacgtgcgggcctgcctccgggcggcgccgctgtccccgcacgccgccgcggccatcagggccgcgcacgcgcgcgggtgcgagctccgggtcctcagcgacgccaacgccttcttcatcgacgccgtcctcgcgcaccacggcctcgccggctacttctccggcaccgacaccaacccggccagcgtcgacgccgccggccgcctcaggatccggccctaccacgagttcgccgcccccgccgccggccacgggtgcgcgctcccatcctgcccgcccaacatgtgcaagggcaaggtgatggagaggatactccaagaggaagaggaaacggccgccgcggcgaggcggccgaggagggccgtggtgtacctcggcgacggccggggcgactactgcccgtcgctgaagctgcgcgagggcgactacgtgatgccgcgggcagggtaccccgtgtgcgacctcatcgcggcctcgccgcaggccgccgccgtgcgcgggtgggacggattcgaggacctcgccagggtgctgctcggcatcgtcgacgccgagatcgcccgcgccgcggcggagcagggcgaggcccccgccgccacgtcgaacgtcgtcgtcggcgccgtcgtgccggactgccgcacgctgccgctgccggcgcgtcaggaggcggcgctcctcccgcaggcggtccgcgtgcccaactgatcggtggggccaaggcaggcgtgccagcaaataactctactccaccctgaaccctccattgatttacttggagatgacgcagggattctgcctgcagcatctgctgcttcaccacaaactgaaagcctttcagtgtgtaccatgatatataatactgtaccatccagagccaaacatgagacatgttctcatgttgttcgtttctaagagcatgtctattgaataaggaagcaggtgttgctgtaatttaactgtaattttgagtgagataatctgacaaaatggaagccttgctgttgaaaaaaaaaaaaaaaaaaaa

SEQ ID NO: 3862 - protein, 330 aa, Panicum virgatum
  misc_feature: Ceres CLONE 1795271
  misc_feature (38)..(240): Pfam Name: Put_Phosphatase Pfam Description: Putative Phosphatase
MAAATNGGAPLVVFDFDKTIVDCDSDNWVVDALGATERFDELLRHLPWNHAIVRTHASSARSCSLIDPAAEQSPTSPWPHQDAMMGELHAAGRTAEDVRACLRAAPLSPHAAAAIRAAHARGCELRVLSDANAFFIDAVLAHHGLAGYFSGTDTNPASVDAAGRLRIRPYHEFAAPAAGHGCALPSCPPNMCKGKVMERILQEEEETAAAARRPRRAVVYLGDGRGDYCPSLKLREGDYVMPRAGYPVCDLIAASPQAAAVRGWDGFEDLARVLLGIVDAEIARAAAEQGEAPAATSNVVVGAVVPDCRTLPLPARQEAALLPQAVRVPN

SEQ ID NO: 3863 - DNA, 2461 bp, Panicum virgatum
  misc_feature: Ceres CLONE 1795272
  misc_feature: Encodes the peptide sequence at SEQ ID NO. 3864
aagaagagcagcaccaaccagtgcatcaccagctcttctccagcacaaagccactccaaatcagccggccatcacccacgcctgcttctgatctccgatctctcgaggcctactagtgcttccggttcaattcccccccttcatctttgcaatggagtgcaagaacggccgcgtcgccaacggcgactccctgtgcgtggcgacgccgcgcgccgacccgctcaactgggggaaggcggcggaggagctcatgggcagccacctcgacgaggtgaagaggatggtggccgagtaccgccagccgctggtgaagatcgagggcgccagcctccggatcgcgcaggtcgccgccgtggccaacggcgccggcgaggcccgcgtcgagctcgacgagtcggcgcgtgaccgcgtcaaggccagcagcgactgggtcatgaacagcatgatgaacggcaccgacagctacggcgtcaccaccggcttcggcgccacctcccaccgccgcaccaaggagggcggcgcgctccagcgggagctcatccggttcctcaacgccggcgccttcggcaccggcaccgacggccacgtcctgccggccgaggcgacgcgggcggccatgctcgtccgcatcaacaccctcctccagggctactctgggatccgcttcgagatcctcgaggcgatcgccaagctgctcaacgccaacgtcacgccgtgcctgccgctccggggcaccatcaccgcgtccggcgacctcgtcccgctgtcctacatcgcgggcctcgtcaccgggcgcgagaactctgtggccgtcgcgccagatggcagcaaggtgaacgccgccgaggcgttcaagattgccggcatccagggcggcttcttcgagttgcagcccaaggaaggcctcgccatggtcaacggcacggccgtgggctcaggacttgcctccaccgtgctcttcgaggccaacattctcgccatccttgccgaggtcctatccgccgtgttctgcgaggtcatgaatggcaagccggagttcaccgaccacctcacccacaagctgaagcaccacccgggacagatcgaggccgcggccatcatggagcacatcttggagggcagctcctacatgaagcatgccaagaagctcggcgagctcgacccgctgatgaagccgaagcaggaccggtacgcgctccgcacgtcgccgcaatggcttggcccccaaattgaggtcatccgcgccgcgaccaagtccattgagcgcgagatcaactccgtcaacgacaaccccttgatcgatgtctcccgcggcaaggcgcttcacggtggcaacttccagggcacgcccatcggcgtgtccatggacaacacccgtctcgccctcgccgccatcggcaagctcatgttcgcgcagttctcggagctcgtcaacgactactacaacaacggcctgccctccaacctgtccggcgggcgcaacccaagcttggactacgggttcaagggcgccgagatcgccatggcgtcgtactgctcggagttgcagttcctgggcaacccggtgaccaaccatgtccagagtgccgaacagcacaaccaggacgtgaactcgctcggcctcatctcctccaggaagacggccgaggccatcgaaatcctgaagctcatgtcctcgacgttcctgatcgccctgtgccaggccgtggacctgcgccacatcgaggagaacgtcaagagcgccgtcaagagctgcgtgatgacggtggcgaagaggaccctgagcaccaactccagcggtggcctccacgtggcccgcttctgcgagaaggacctgctccaggagatcgagcgcgaggcggtgttcgcctacgccgacgacccctgcagcgccaactacccgctcatgaagaagctgcgcaacgtgctggtggagcgcgccctcgccaacggcgcggccgagttcaacgccgagacatccgtgttcgccaaggtcgcccagttcgaggaggagctgcgcgctgcgctgcccaaggcggtggaggcggcccgggcgtccgtcgagaacggcacggcggcgatacccaacaggatcgccgagtgccgctcgtacccgctctaccgattcgtgcgcgaggagctcggcgcggtgtacctgactggcgagaaggcgaggtctcccggcgaggagctgaacaaggtgctcgtcgcaatcaaccagggcaagcacatcgaccccctgctcgagtgcctcaaggagtggaacggcgagccgctgcccatctgctgaacagagaagagggtgtttcaagactctattctttagtaaataatgcgatttattcctgatttatgtttgttgctatgctttgaaagagttgttattgcaagcagcaagttgtaagttttgaagtgttgtgaatcatatttgcagtttaatttaaaaaaaaaaaaaaaaaaa

SEQ ID NO: 3864 - protein, 712 aa, Panicum virgatum
  misc_feature: Ceres CLONE 1795272
  misc_feature: Great-hit functional homolog of the protein sequence encoded by LOCUS At2g37040
  misc_feature: Great-hit functional homolog of the protein sequence encoded by LOCUS At3g10340
  misc_feature: Great-hit functional homolog of the protein sequence encoded by LOCUS At3g53260
  misc_feature (2)..(490): Pfam Name: PAL Pfam Description: Phenylalanine and histidine ammonia-lyase
  misc_feature (1)..(712): SWISSPROT Homolog: EC 4.3.1.5 Phenylalanine ammonia-lyase
  misc_feature (20)..(712): SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MECKNGRVANGDSLCVATPRADPLNWGKAAEELMGSHLDEVKRMVAEYRQPLVKIEGASLRIAQVAAVANGAGEARVELDESARDRVKASSDWVMNSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLVTGRENSVAVAPDGSKVNAAEAFKIAGIQGGFFELQPKEGLAMVNGTAVGSGLASTVLFEANILAILAEVLSAVFCEVMNGKPEFTDHLTHKLKHHPGQIEAAAIMEHILEGSSYMKHAKKLGELDPLMKPKQDRYALRTSPQWLGPQIEVIRAATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKRTLSTNSSGGLHVARFCEKDLLQEIEREAVFAYADDPCSANYPLMKKLRNVLVERALANGAAEFNAETSVFAKVAQFEEELRAALPKAVEAARASVENGTAAIPNRIAECRSYPLYRFVREELGAVYLTGEKARSPGEELNKVLVAINQGKHIDPLLECLKEWNGEPLPIC

SEQ ID NO: 3865 - DNA, 2387 bp, Panicum virgatum
  misc_feature: Ceres CLONE 1795274
  misc_feature: Encodes the peptide sequence at SEQ ID NO. 3866
gcgttatccgcgatcccacgcgcgacgcctccccatcgcgactccacttctccctcgcgactctcctccctagggccgccgcacacgccgccgccgacttccgcaggatctgccgcgtctcgccgcaaaaggaaagctctgtggggagggggagggaggagaagacgacgacgacgtgcatcaattggatcgggaaggatctgtaagatgatactcaagggaagaagtgaggagccatgcagaaagccaatgtctcagtgatcaccggtagcgtcctcatcaaaggccttttgcaaaattatgcgatcttcatgggctgattcagttgcgaacgccgaggaatcggcgcccgcgactgttactgctcctgctcctgctgctaatcatcagagtgggcgccccaccctcagcacatacgtccctcctcatctccgtggtcgctcaggtggtccaccctctgagaaccaggcagtgcctgctgcagctcctgcaccagctgagctacggtcagctgctgcgcagccttcaggctacgcagctgttgttggtggcaactctcgttggtctggccctgctggcgttggtggtagcagcgccgtagttggtcctcgccagggtggtgggggcgggggtagtggtcgaggtggcggcggcggttggaactctcgccctgggtgggaccgtagagatcgcgaaccaaacccctttgccaatactgaggccgcagatgttgattttgagagtcaggagaacacgggcatcaactttgacgcatatgaggatattcctgtggagacaagtggccatgacgtccctccaccagtcaacacctttgcagagattgatttgggcgacgcactgaatgagaacatacgaaggtgcaagtatgtgaagccaacaccagtgcagcgacatgccattcctatcgccattgcaggtagggatctcatggcttgtgcccagacagggtctggaaagactgcagcattctgtttccctatcatcagtggtattttaaagtcacggccacctcagaggcaaagaggttccaggacagcttatccactggcgctgatattgtccccaactcgtgagctgtctatgcaaattcatgaagaagcaaggaagttttcataccaaactggtgttagggtggttgttgcatatggtggagcaccaatacatcagcagctgagggaacttgaaagaggtgttgaaatccttgtggcaactcctggtcgtttgatggatctgctggagagggctagagtatcactacaaatgataaaatacttaactcttgatgaagctgatcgaatgctcgatatggggtttgaaccacagatacgcaagattgttgatcagatggatatgccccctcgtggtgcgaggcagactatgctgtttagtgccacctttccaaaagaaatccagcgtctggcttcagatttccttgccgactacatcttccttgctgttggaagagttggttccagtactgatttgattgctcagagggtcgagtttgtacttgaggcagacaaaagaagttatctgatggaccttcttcatgcacaaaaagctaatggtgcccatgggaagcaagctcttactttggtctttgtggagacgaagaggggagctgatgctcttgaggactggttgttcaaaaatgggttcctggcaacaagtattcatggtgacaggacacaacaggaaagagagtctgcattgagatccttcaagagtggagctactcccttactcgttgcaactgatgtggctgctcgtggacttgacatacctcatgttgctcatgtcatcaattttgaccttccaaatgacatagatgactatgttcatcgtattgggaggacaggacgagcggggaaatctggtttggcaactgcattcttcaatgagggcaactcatcactggcaaagcctctgtgtgagctaatgcaggaagctaaccaggaggttcctccatggcttgagcgatatgcagcccgttcatcctatggaggtggcggtgggaggaaccgccgatcaggtggtgctcgatttggtggccgtgacttccgccgtgaccgggacttcaggggaggtggcagtggtggaggatatggtggtggcagcagtggatatggtggtggaggttatggcggcggtggatatggtggcggctatggtggaggtgcaacaagttcctgggattaaatactgtttcgtagtcaccagtgagaattgaactgaattcgtattctattgatgttaactgaaacagatgtggagtttgtagtcaactctagggtggttggtatggtgctggagaaaggcccctatttaccttgttaatggttggtcaaaaaaaaaaaaaaaaaaaa

SEQ ID NO: 3866 - protein, 639 aa, Panicum virgatum
  misc_feature: Ceres CLONE 1795274
  misc_feature (1)..(181): Pfam Name: DEAD Pfam Description: DEAD/DEAH box helicase
MRSSWADSVANAEESAPATVTAPAPAANHQSGRPTLSTYVPPHLRGRSGGPPSENQAVPAAAPAPAELRSAAAQPSGYAAVVGGNSRWSGPAGVGGSSAVVGPRQGGGGGGSGRGGGGGWNSRPGWDRRDREPNPFANTEAADVDFESQENTGINFDAYEDIPVETSGHDVPPPVNTFAEIDLGDALNENIRRCKYVKPTPVQRHAIPIAIAGRDLMACAQTGSGKTAAFCFPIISGILKSRPPQRQRGSRTAYPLALILSPTRELSMQIHEEARKFSYQTGVRVVVAYGGAPIHQQLRELERGVEILVATPGRLMDLLERARVSLQMIKYLTLDEADRMLDMGFEPQIRKIVDQMDMPPRGARQTMLFSATFPKEIQRLASDFLADYIFLAVGRVGSSTDLIAQRVEFVLEADKRSYLMDLLHAQKANGAHGKQALTLVFVETKRGADALEDWLFKNGFLATSIHGDRTQQERESALRSFKSGATPLLVATDVAARGLDIPHVAHVINFDLPNDIDDYVHRIGRTGRAGKSGLATAFFNEGNSSLAKPLCELMQEANQEVPPWLERYAARSSYGGGGGRNRRSGGARFGGRDFRRDRDFRGGGSGGGYGGGSSGYGGGGYGGGGYGGGYGGGATSSWD

SEQ ID NO: 3867 - DNA, 2082 bp, Panicum virgatum
  misc_feature: Ceres CLONE 1795282
  misc_feature: Encodes the peptide sequence at SEQ ID NO. 3868
agaaccctcgcccgccttctcttccttcttttgtacgccaggccaacctacccctcctacaggacagccgccgccgccgcccccaaaaccctagctagtgctagtctagcagaggcaaccatggccaccatccccaccaccgattccgcccttctcctcggctcatccgctctccacagggccaggcgggcctcggcggcccggctgcccggagccaaccgccgtcgcccccaggccctggtgcgcgcgtccgccaaggagattgccttcgaccagggcgccagagcctccctccaggccggcgtcgagaagctcgccgccgcagtcggcgtcaccctcggccccagaggaaggaatgttgtcttggatgagtttggaacccccaaagtggtcaatgatggagttaccattgctcgtgctattgagctcgctgatcccatggagaatgctggtgcctcattgattcgtgaagttgctagcaagacaaacgactcggctggcgatgggaccacaactgcatccgttctcgccagggagatcataaaattgggtatgttgagtgttacttcaggggcaaacccggtgtctattaagaagggcattgataagactgttcaaaaattggtggaggaacttgagaagaagtccaggcctgtgaagggtggtggagatattaaagctgttgctgctatatcagctggaaatgatgaattcgttgggaccatgatcgctgaagctattgacaaggttggccctgatggtgtgctctcaatcgagtcgtcgtcatcatttgagaccacagttgaagttgaagaagggatggagcttgacagaggatatatctcccctcagtttgtcaccaaccctgagaaatcaactgtggagttcgaaaatgctcgaattctcgtcactgaccagaagatatcatcgataaaagaaatccttcccttgttggagcaaactacgcagttaagagcaccacttctaataattgcagaggatgtaagtggtgaggctttggcaactttagttgtcaacaagcttagaggaatcctaaatgtggctgcaatcaaagctcctggtttcggtgagaggcgtaaagctcttcttcaagacattgctattgttacaggtgctgaatatcaatccaaagatcttggcttactagttgagaagacaacagttgagcagctgggcatagctcgcaaagtgacgatctccagctcgtcgacgacgattatagcagatgctgcaagcaaagatgatatccaggccagaattgcgcagctgaagagagagctttctcagacggactcgacatatgactctgagaagcttgcggagagaatcgcaaagctttctggtggcgttgctgtgataaaggttggtgcttcgactgaggcggagcttgaggaccgcaagctccgcatagagaatgcaaagaatgcaacttttgcggccatcgaggaaggtattgtacctggagggggtgcagcctacgttcatctatcaacatttgtgccggctatcaaggagaagttggatgatcctgaagagcgccttggtgctgatatcattcagaaggcccttgtagcacctgcagcactgatagcgcacaatgctggggttgaaggtgaggtgattgtagataaaatcaaggagagcgaatgggagtatggttacaatgccatggctgacaaacacgagaacttggtagaggctggtgtgatcgaccctgccaaggtcacgagatgcgccctgcagaatgccgcgtcagttgctggaatggtgctgaccacccaggctattgtcgtggagaagccgaagaagaaggctcccgcagctgctggggcacctgagggttcatttgccatgtaatgcgagaataaattttactaggcctgttgggggtggggtggggggatgcaaatctttgagcaaggggagaggagagagaaccggaatctgtgtcttgatctgttgccgaagctgataaactcttttatcctgaattgtttcgctaagctggcggagtgggcagataataaatttattataaatcaaaaaaaaaaaaaaaaaaaa

SEQ ID NO: 3868 - protein, 585 aa, Panicum virgatum
  misc_feature: Ceres CLONE 1795282
  misc_feature: Great-hit functional homolog of the protein sequence given in SEQ ID NO 9402
  misc_feature (1)..(502): Pfam Name: Cpn60_TCP1 Pfam Description: TCP-1/cpn60 chaperonin family
  misc_feature: Useful for making plants with modulated nitrogen use efficiency
MATIPTTDSALLLGSSALHRARRASAARLPGANRRRPQALVRASAKEIAFDQGARASLQAGVEKLAAAVGVTLGPRGRNVVLDEFGTPKVVNDGVTIARAIELADPMENAGASLIREVASKTNDSAGDGTTTASVLAREIIKLGMLSVTSGANPVSIKKGIDKTVQKLVEELEKKSRPVKGGGDIKAVAAISAGNDEFVGTMIAEAIDKVGPDGVLSIESSSSFETTVEVEEGMELDRGYISPQFVTNPEKSTVEFENARILVTDQKISSIKEILPLLEQTTQLRAPLLIIAEDVSGEALATLVVNKLRGILNVAAIKAPGFGERRKALLQDIAIVTGAEYQSKDLGLLVEKTTVEQLGIARKVTISSSSTTIIADAASKDDIQARIAQLKRELSQTDSTYDSEKLAERIAKLSGGVAVIKVGASTEAELEDRKLRIENAKNATFAAIEEGIVPGGGAAYVHLSTFVPAIKEKLDDPEERLGADIIQKALVAPAALIAHNAGVEGEVIVDKIKESEWEYGYNAMADKHENLVEAGVIDPAKVTRCALQNAASVAGMVLTTQAIVVEKPKKKAPAAAGAPEGSFAM

SEQ ID NO: 3869 - DNA, 1498 bp, Panicum virgatum
  misc_feature: Ceres CLONE 1795284
  misc_feature: Encodes the peptide sequence at SEQ ID NO. 3870
attcttctctcttgttcggttgttccactcccaatcttcactcacagtccgccggctccgatctcaagtcccatggcgctctccatctccacgcctacctcctcctccctccttccggcttcccgtcaggtgggcaggtggagtccattggcgcggtcggctaagcctatgtctttcagcctctggaggtcgcctctggcggcgcggtccgccgccggcaacgcacgagcttcccccgtcgacgaggtcgtcactgagctcgacgcggtggccggattcagcgagatcgtgccggacactgtcgtgttcgatgatttcgagaggttcgcacccacagcggccacggtgagctcctcgctgctgcttggaatctctgggctcccggataccaagttcaagagtgcgatagatactgcactggcagatggtgagtgcaacacattggagaagcccgaggacaggatgtcctgttacctcaccaaggccctggcaaacgttggtgctggactggctcagcaagtccctggatgcgtttcgactgaaatagatgctcggttggcttatgacacccagggcattatccagagggtgcatgaactgttgaatctatacaaccaacatgatgtctcaactgaccgcctgctatttaaaattcctgctacatggcaaggtatagaggcctcaaggttgcttgaatctgatggaattcagacacatttaacatttgtgtacagtttcgcacaagcggcggcggcagcacaaactggtgcatctgttgtgcagatatttgtggggcgattgcgggattgggcaaggaatcactctggtgacccagagatagatgaagctttgaagaagggagaagatgctggccttgctttggcgaagaaagtatatgcctatattcacagaaatgggtataaaacaaagttgatggctgctgccatacggaacaagcaggacgtgttcagccttcttgggattgattacatcattgcacctctgaaggtactgcagtctctggaagaatctgtcactgatcctgatgtgaagtacagttatgtcccaaggttgactcctgctattgggaagacatacgagttcactgaagaggagcttttgaagtgggaccagttgagtcttgcagctgcgatggggccagccgctgaagaactgcttgcttcaggattggagggatatgcgaaccaagcacggcgtgttgaggagctcttcgggaagatctggccacctccaaatgtttaaagatgccttgctgggcctcggttttcagttccaacagagataataacaacaggcaagggccgtgctatcctgacattggccttccgcttcgaagaacacttctcttgcctgccaccggttccccaatgtgctttaccaatcagtctcaaaatgttgtgtaaaaaacatctttgcctcttttggatatgatacgatgtgcctcaagtgttgcattaaaaaaaaaaaaaaaaaaaaa

SEQ ID NO: 3870 - protein, 396 aa, Panicum virgatum
  misc_feature: Ceres CLONE 1795284
  misc_feature (1)..(317): Pfam Name: Transaldolase Pfam Description: Transaldolase
MALSISTPTSSSLLPASRQVGRWSPLARSAKPMSFSLWRSPLAARSAAGNARASPVDEVVTELDAVAGFSEIVPDTVVFDDFERFAPTAATVSSSLLLGISGLPDTKFKSAIDTALADGECNTLEKPEDRMSCYLTKALANVGAGLAQQVPGCVSTEIDARLAYDTQGIIQRVHELLNLYNQHDVSTDRLLFKIPATWQGIEASRLLESDGIQTHLTFVYSFAQAAAAAQTGASVVQIFVGRLRDWARNHSGDPEIDEALKKGEDAGLALAKKVYAYIHRNGYKTKLMAAAIRNKQDVFSLLGIDYIIAPLKVLQSLEESVTDPDVKYSYVPRLTPAIGKTYEFTEEELLKWDQLSLAAAMGPAAEELLASGLEGYANQARRVEELFGKIWPPPNV

SEQ ID NO: 3871 - DNA, 1016 bp, Panicum virgatum
  misc_feature: Ceres CLONE 1795288
  misc_feature: Encodes the peptide sequence at SEQ ID NO. 3872
aagccggcgacggaaagagcgacaaggcagcaggagagtaggacgcgccgaccgatctgctgcgtagaggaggggatcgccggagaggagagcagagatgttcctggtggactggttctacggggtgctggcgtcgctggggctgtggcagaaggaagccaagatcctcttcctcggcctcgacaacgccggcaagaccaccctcctccacatgctcaaggacgagcggctcgtacagcaccagccgacgcagtaccccacgtcggaggagctgagcatcggcaagatcaagttcaaggccttcgacctcggcggccaccagatcgctcgccgcgtctggaaggactactacgccaaggtggatgctgtcgtgtacttggtggatgctgttgacaaggaacggtttgccgagtcaaagaaagagcttgatgctcttcttgcagatgactcgcttgcgaacgttcctttcctcatactgggcaataagattgacatcccgtacgcagcttcagaggaggagctgcgctactaccttgggctgagcaacttcacaaccggaaagggcaatgtgaacttgtctgactccaatgttcgccccctggagatcttcatgtgcagtgtggtgcgcaagatgggctacgacgaaggcttcaaatggatgtctcagtacatcaagtgaagcgccgcacacctctgtccatagcactggcgtaggtgctctcgcaggtggtcggagtcaggtctggtcgtcacactatggagaaatcctcagctgtatgaaaaagtttatggtagctagtggtaggcaaatcctgtaagtttgtgttaatcctagatatgtgatggggtcgattttcttttctgattgcttgtgagtgacggtcacagtaaaaaaaaaaaagcggtttctggaaccgctgccaggcagcgagaagtattccagcttatgtaatcacgttacttcaaccagtgaaatatctggtagcagctttggtgaaaaaaaaaaaaaaaaaaaa

SEQ ID NO: 3872 - protein, 193 aa, Panicum virgatum
  misc_feature: Ceres CLONE 1795288
  misc_feature (1)..(188): Pfam Name: Arf Pfam Description: ADP-ribosylation factor family
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAVDKERFAESKKELDALLADDSLANVPFLILGNKIDIPYAASEEELRYYLGLSNFTTGKGNVNLSDSNVRPLEIFMCSVVRKMGYDEGFKWMSQYIK

SEQ ID NO: 3873 - DNA, 2090 bp, Panicum virgatum
  misc_feature: Ceres CLONE 1795299
  misc_feature: Encodes the peptide sequence at SEQ ID NO. 3874
agcaaaagcgccccctccagtcccgcctccgcccccccgcccaaaaccctagcccctcgctccagtcccccccgccccaaaccctaggcggcctcgcgatcccggggtcccgggcccaatggcgtcgccggacctgttccagaacgtcgccttctccgacgtctccgcggccgccgcgccggcggccgagggggccacggccgcgttcggcgtcgccgcggccaccggcggcccgcgcctcagcctcgtgaaggctgggaagcccgaggtggagcccacgatcgagatcgacctctccgacgcccagatatttaagctggggccgagtgagtggctgtgcttgtgtggcgagtcggaggctaaggctggcgtcgaggagaagtcattttcaagagcaattaaggttgttcttaggacagaagctgagagcaaagccttctctttagcttttcaacgatggaaacaccaagttattagtggaaaagctggtgagccgttggagaatggatcaataattgcttcgaaaagcaaatttgatacaaaaattgaggcatcatcagcaaagatgtatttccactactatggtcagctcttacatcagcaaaatatgttacaagattttgtgaggacaggaacatattatgctgcggtaatggaaaaccgttctgactttgagggccgagttgtggtcgatgttggagctggtagtggtattctttcattatttgctgcccaggctggtgccagacatgtttacgcggttgaggcatctgaaatggctgaacatgctcaacggctaatctctgggaacccatctcttggtcaacggatcacggtcatcaaaggcaaggttgaggaagtagaacttccagagaaggctgacatactgatttctgagcctatgggaactcttttggttaatgagaggatgctggaatcctatgttatagctagggacagattccttgctccagatggtaaaatgtttccaacgacaggaaggattcacgtggctcccttttctgatgaatacctttatgttgaaatggcaaacaaggctctcttttggcagcagcacaacttttttggtgttgatcttacaccattacatggttcggctttccaggggtatttttcacagcctgttgtggatgcatttgaccctagattattgatttctccaccaacatatcatacacttgattttactagcatgaaggaagaggagctttacaagattgatattcctcttagttttgtagcttctgttggcactagagtacacgggttagcttgttggtttgatgtattgttcaatgggagcactgtgcaaaggtggcttaccactgctccaggttcacctaccactcattggtaccagctgcgatgtatgctttcacagccattgtatgtcatggctggccaagaaataactggtcgccttcatctggtagcccacagttctcaaagctacacaatttacttgactatgtcagctaaaatgtggggtgtgggtgcggatcaaggcggtatcctacagacatccacaggtaaacttgaactcaaggagccgtactacaggttgtctcagccacaatcctacgtgttgcagcaagatcagcagcagcagcaattaccatgtttgcagccacagggatctaagcagcaaatgcaggaagggcttagcccaggcatcactatagatcaagtagaccaggagtgtggccttcactaaatatcgtggaaacctgagttgcatgctttgcttccagcaacgagctcaggtctgtacaacagtttcagtgtgccccttagcctttgtttttaggcgttagctaccacaggctaacaccacgttcgagatgtaagatcattcttgagttgtgcagctgcagccaattgtgctcttgtctgctccgttacttgcaagggagtaaaaaaaacagcaattataaagtgtatcttgtttcaggcgaagctaaacagcggaggcatctactaactaggacagttgtatgttgtttcctctattcttgttactagaaattaaattgtttggttttgaatacgaaaaaaaaaaaaaaaaaaaa

SEQ ID NO: 3874 - protein, 538 aa, Panicum virgatum
  misc_feature: Ceres CLONE 1795299
  misc_feature (1)..(99): Pfam Name: Methyltransf_11 Pfam Description: Methyltransferase domain
  misc_feature (1)..(97): Pfam Name: Methyltransf_12 Pfam Description: Methyltransferase domain
  misc_feature (4)..(76): Pfam Name: MTS Pfam Description: Methyltransferase small domain
  misc_feature (136)..(488): SWISSPROT Homolog: EC 2.1.1.125 Histone-arginine methyltransferase CARM1
MASPDLFQNVAFSDVSAAAAPAAEGATAAFGVAAATGGPRLSLVKAGKPEVEPTIEIDLSDAQIFKLGPSEWLCLCGESEAKAGVEEKSFSRAIKVVLRTEAESKAFSLAFQRWKHQVISGKAGEPLENGSIIASKSKFDTKIEASSAKMYFHYYGQLLHQQNMLQDFVRTGTYYAAVMENRSDFEGRVVVDVGAGSGILSLFAAQAGARHVYAVEASEMAEHAQRLISGNPSLGQRITVIKGKVEEVELPEKADILISEPMGTLLVNERMLESYVIARDRFLAPDGKMFPTTGRIHVAPFSDEYLYVEMANKALFWQQHNFFGVDLTPLHGSAFQGYFSQPVVDAFDPRLLISPPTYHTLDFTSMKEEELYKIDIPLSFVASVGTRVHGLACWFDVLFNGSTVQRWLTTAPGSPTTHWYQLRCMLSQPLYVMAGQEITGRLHLVAHSSQSYTIYLTMSAKMWGVGADQGGILQTSTGKLELKEPYYRLSQPQSYVLQQDQQQQQLPCLQPQGSKQQMQEGLSPGITIDQVDQECGLH

SEQ ID NO: 3875 - DNA, 1652 bp, Panicum virgatum
  misc_feature: Ceres CLONE 1795304
  misc_feature: Encodes the peptide sequence at SEQ ID NO. 3876
gagaaggagatgacctaatataacccaaagccacctgctccgactcggctccaccccacacccacatcctccattcccctcctcctgtcgtctctgctctgccttcgtcgtatcatgatagtagaaaatcagtcaaagaggagaattggcggccggcggttcatcgtcatcatcaagtcaacacacagagcaacagaagcagattggggagcagaattgttctgttgggctccagcctccagattgaggagcaggcagaaacagcaagagatcgaggagacaaagaaagaaagactgagatggacaagtacgagccggttcgggagatcggggcgggcaacttcggtgtggcgaagctgatgcggaacaaggagacgcgggagctggtggccatgaagttcatcgagcgagggaacaggatcgacgagaatgttttccgcgagatcgtcaaccaccggtcccttcgtcaccccaacatcatccgcttcaaggaggttgtgctgacgccgacgcacctcgcgatcgtgatggagtacgcggccggcggcgagctgttcgagcgcatctgcgaggccgggcggttccacgaggacgaggcgcgctacttcttccagcagctggtgtgcggggtgagctactgccacgccatgcagatctgccaccgcgacctcaagctggagaacacgctgctggacggcagcccggcgccgcgcctcaagatctgcgacttcggctactccaagtcgtcggtgctgcactcgcgccccaagtcaacggtcggcacgccggcctacatcgcgccggaggtgctgtcccgccgcgagtacgacggcaagcacgccgacgtctggtcctgcggcgtcacgctctacgtcatgctcgtcggcgcatacccgttcgaggatccaaaggacccaaagaacttcaggaagacgatctcgaggatcatgtcggtgcagtacaagatcccagagtacgtgcacgtctcccagaactgccgacacctgctctcccgcatcttcgtcgcaaacccctacaagaggatcaccatgagcgagatcaagagccacccctggttcctcaagaacctgccgcgggagctcaaggaggaagcgcaggccgcctactacagccgccggggaggagacgccgccggcgcaagtggcagcagcaacaatgccaatgccaatggcaacgcccccgccgccacctactcggcgcagagcgtcgaggagatcatgaggatcgtgcaggaggcacagacggtgcccaggggggacaggcccgtctccggctacggctggggcgcctcggacgacgaggaggaggcagagcaagacgaggaggaacaagacgactacgacaggacggtgaagcaggtgcacgccagcggggagttcgacatgagcaagcttcacatctgaatctgatgatgattagcgtgcatgcactccaaaccaaatctgatgattagcatgcaggcattctgtgttcgttctagtactacctactagttacttctgcatacaccctgcggcgaacgcgccattaatttttgttagcgctctgatctctcccttccttttgagccatccatccatgatccatctactgcatctacttccgttatgttctgcaaaaaaaaaaaaaaa

SEQ ID NO: 3876 - protein, 374 aa, Panicum virgatum
  misc_feature: Ceres CLONE 1795304
  misc_feature: Great-hit functional homolog of the protein sequence given in SEQ ID NO 9181
  misc_feature: Great-hit functional homolog of the protein sequence given in SEQ ID NO 9751
  misc_feature (1)..(279): SWISSPROT Homolog: EC 2.7.11.1 Serine/threonine-protein kinase SAPK7
  misc_feature (1)..(374): SWISSPROT Homolog: EC 2.7.11.1 Serine/threonine-protein kinase SAPK5
  misc_feature: Useful for biocontainment applications
  misc_feature: Useful for making plants with modulated biomass
  misc_feature: Useful for making plants with modulated time to senescence
  misc_feature: No seed is being produced by the plant
  misc_feature: The plant is abnormally small.
  misc_feature: The plant senesces significantly late compared to wild-type.
MDKYEPVREIGAGNFGVAKLMRNKETRELVAMKFIERGNRIDENVFREIVNHRSLRHPNIIRFKEVVLTPTHLAIVMEYAAGGELFERICEAGRFHEDEARYFFQQLVCGVSYCHAMQICHRDLKLENTLLDGSPAPRLKICDFGYSKSSVLHSRPKSTVGTPAYIAPEVLSRREYDGKHADVWSCGVTLYVMLVGAYPFEDPKDPKNFRKTISRIMSVQYKIPEYVHVSQNCRHLLSRIFVANPYKRITMSEIKSHPWFLKNLPRELKEEAQAAYYSRRGGDAAGASGSSNNANANGNAPAATYSAQSVEEIMRIVQEAQTVPRGDRPVSGYGWGASDDEEEAEQDEEEQDDYDRTVKQVHASGEFDMSKLHI

SEQ ID NO: 3877 - DNA, 1435 bp, Panicum virgatum
  misc_feature: Ceres CLONE 1795315
  misc_feature: Encodes the peptide sequence at SEQ ID NO. 3878
aacacccaccacgcggcgaagccggagcgcgcgcgggcggcgacgcgatggagcggaggctgtcggcggcgtcgaggcggtccgcgccgtcgcgcatccagcagctgtcccacctggcgcagcgcgtcggcgccgtcaacctcgccgagggcttcccggacttccccgcgcctccccacgtcaaggccgccgccgccgccgccatcgccgccgaccacaaccagtacaggcatgtgcagggcatctgcgacatcctcgcggagacggcgaaacgggaccacggcctcgacgccgacccgctcacggacttcgtcatctgctgcgggcaatcggaagcgttcgccgctgccatctttgcaataatagatccaggggatgaggttttgctcttcgaccctgcttacgaaacgtacgagacatgcattgaactggcccgaggtgtccctgtgtatgtgccattggatccaccttcttggactctgaaccaagatgaattcttgaaatcttttacaagtcgaacgaaggcggtggtcttgaacagcccgcacaatccaacagggaaggtcttcagcaaagaggagttgcttattattgcccaagcttgtcagaaaatggattgctttgcaataactgatgaggtttatgagtatattacttatgatgagaacaagcatatctcactggcttctcttccagggatgcaagagaggaccatcatcacatcctcactatctaaaacttacagcgtaactggttggagaattgggtgggcttgtgctccagcaagcattgcctcagcaataagaaatatccatgtcaaactaacagattcagctcctgcaccattccaagaagctgcactgatcgcattaaccagcacaccggacttctattcgtccctgaaaaaagactatgaggtgagaagagacttcatccttttgctgctgaaagattttggctttcacatcagcttcaagccacaaggttcagtctttgtatttgctgagctgccctcgtcctgccaaatttctgatatagatttcgtaacgaacttgatcaatggcgccggtgtggcagctgtgcctggccgtgggttcttccacagaaattgtgacggtgaaagctaccatcaccggtacgtcaggtttgcgttctgcaagagcgatgacacactgatggctgctgctctaaggatgaggaagctggcggacaccaagggaaagacgtgccttactggcagtggcaaacaagaggatcagactgtctctgcctctcattgatgcggttctgcttgaatgtgcatcctggtgcggttttgtttgaatagatttattctttttgtagtttctgggtagaagtttgatgttatgcagtgcttctttacgtggacaacaagaacaaaaaaaaggaacctttattcatttcatcttttctc

SEQ ID NO: 3878 - protein, 410 aa, Panicum virgatum
  misc_feature: Ceres CLONE 1795315
  misc_feature (109)..(336): Pfam Name: Aminotran_1_2 Pfam Description: Aminotransferase class I and II
MERRLSAASRRSAPSRIQQLSHLAQRVGAVNLAEGFPDFPAPPHVKAAAAAAIAADHNQYRHVQGICDILAETAKRDHGLDADPLTDFVICCGQSEAFAAAIFAIIDPGDEVLLFDPAYETYETCIELARGVPVYVPLDPPSWTLNQDEFLKSFTSRTKAVVLNSPHNPTGKVFSKEELLIIAQACQKMDCFAITDEVYEYITYDENKHISLASLPGMQERTIITSSLSKTYSVTGWRIGWACAPASIASAIRNIHVKLTDSAPAPFQEAALIALTSTPDFYSSLKKDYEVRRDFILLLLKDFGFHISFKPQGSVFVFAELPSSCQISDIDFVTNLINGAGVAAVPGRGFFHRNCDGESYHHRYVRFAFCKSDDTLMAAALRMRKLADTKGKTCLTGSGKQEDQTVSASH

SEQ ID NO: 3879 - DNA, 2700 bp, Panicum virgatum
  misc_feature: Ceres CLONE 1795316
  misc_feature: Encodes the peptide sequence at SEQ ID NO. 3880
cgactgccatcgccactcttaccttcactcgctcactcacaatgtggcgccatggcgagagatgcgtgatctttgctgtggccaccgcggccctgctggcggcggcggcggcgaccgccgccggacgagacgaccggcagacgtacatcgtccacatgtcccactcgggcatgccgaatgatttcgtggagcatggggagtggtacgccgcgtcgctgcaggcggtgtcggaggcggccaccgtgctctacacctacgacacgctcgtccacggctactcggcacggctgacgcgcgccgaggcggaggcgctggagtcgcagcccggcgtcctcatcgtcaacccggaggtgcggtacgagctgcacaccacccggacgcccgagttcctggggctcgacggcacggacgcgctgttcccgcagtcgggcgccgggagcgacgtcatcatcggggtgctcgacaccggcgtgtggccggagaggccgagctacgacgacacggggttcggtcccgtgccggcgggctggaagggcgagtgcgagaaggggaacgacttcagcgcctccgcgtgcaacaagaagctcatcggcgcgaggttcttcctgacgggctacgaggccgccaagggccccgtggacacgtccaaggagtcgcggtcgccgagggacaacgacggccacgggacgcacacctcgagcacggcggccggcgccgccgtccagggcgcggacctgctcgggtacgcggccgggacggccaagggcatggcgccccgcgcgcgcgtggccacgtacaaggtctgctgggtgggcggctgcttcagctccgacatcctcaaggccatggaggtcgcggtgaccgacggcgtcgacgtgctctccctctccctcggcggcggcaccgcggactactaccgcgacagcatcgccgtgggcgctttcagcgccatggagaaggggatcttcgtgtcctgctccgccggcaatgccggtccgggggcggcgacgctgtcgaacggcgcgccgtggatcaccaccgtgggcgcggggaccatcgaccgcgacttccccgcctatgttgccctcggcaacggcaagaactacaccggcgtgtctctgtacagcggcaagccattgcccaccacgcctgtgccgctgatctacgccgggaacgcgtccaacagcagcatgggccagctctgcatgtccggcagcctcgtaccggagaaggtcgccggcaagatcgtcctctgcgaccgcggcaccaatgccagggtccagaagggcttcatcgtcaaagacgccggcggcgctggcatgattctcgccaacaccgccgcgaacggcgaggagctcgtcgctgacgcgcacatcctcccgggctccggcgtgggggagaaggccggcaacgccatccgggactacgccatgtccgatccgaaggcgacggctagcattgtgttcgctggcaccaaggtcggcatccagccgtctcccgtggtcgcggccttctcgtcgcggggcccgaacaccgtcacgcccagcgtcctgaagccggacatcatcgcccccggcgtgaacattctcgcggcctggtcggggtccgtcggaccctcagggatcgccggcgacagccgccgcgtcggcttcaacatcatctccggcacgtccatgtcgtgcccgcacgtgagcgggcttgcggcgctgctccgcgcagcgcacccggagtggagcccggcggccatccgctcggcgctgatgacgacggcgtacaacgagtaccccaacggcaacggcatcctggacgtggccaccgggcgccccgcgacgccgctggacgtgggcgccggccacgtggaccccggcaaggccgtggacccaggcctggtgtacgacatcgccgccgccgactacgtcgacttcctgtgcgccctcaactacggcccgatgcagatcgcgacgctgacgaagcggtcggccgacgggtgcaccgccaaccgcacgtacgcggagagcgccctcaactacccgtccttcgccgtgacgttcccggccggcggcggcacggtgaagcacacccgcacggtgaccaacgtgggccagcccggcacgtacagggtgaccgccagcgccgccgcgggcggcaccccggtggcggtgtccgtggagccgtcgacgctgagcttcagcaaggccggcgagaagcagagctacacggtgagcttcacggcgccggcgaagccgtcgggcaccaacgggttcgggcggctcgtctggtccagcgaccaccacgtggtcgccagcccgatcgcggcgacatggaactaaaccgcggccgtggcagcttagcgagagaaaaaaaaacgtcctggatctcgagataaatccgagcgagatggcaacgaatcaaagagcgagcgccattctcgaacgcgagaggagagatggtgggtgtcgccgaggagtgttgttgtatcagtcgattagcgcggcgattttcgccgctccggtgtgcaagctgccggtgtagtagtctgcgactgacaacccgattgtggttaggctgaccacagcggagggagcaagagcaaatttgctccctcctcgtttcccacgccctctctgtctacagtgccaaacagtacatctaccgtgtcaaatagtgtatttattccttcaaaaaaaaaaaaaaaaaaaa

SEQ ID NO: 3880 - protein, 762 aa, Panicum virgatum
  misc_feature: Ceres CLONE 1795316
  misc_feature (5)..(475): Pfam Name: Peptidase_S8 Pfam Description: Subtilase family
  misc_feature: The sequence is a functional homolog of  SEQ ID NO 1433 in the  10/374,780 US patent application
  misc_feature: The sequence is a functional homolog of  SEQ ID NO 1519 in the  10/412,699 US patent application
  misc_feature: Useful for making plants with modulated growth and phenotype characteristics
MWRHGERCVIFAVATAALLAAAAATAAGRDDRQTYIVHMSHSGMPNDFVEHGEWYAASLQAVSEAATVLYTYDTLVHGYSARLTRAEAEALESQPGVLIVNPEVRYELHTTRTPEFLGLDGTDALFPQSGAGSDVIIGVLDTGVWPERPSYDDTGFGPVPAGWKGECEKGNDFSASACNKKLIGARFFLTGYEAAKGPVDTSKESRSPRDNDGHGTHTSSTAAGAAVQGADLLGYAAGTAKGMAPRARVATYKVCWVGGCFSSDILKAMEVAVTDGVDVLSLSLGGGTADYYRDSIAVGAFSAMEKGIFVSCSAGNAGPGAATLSNGAPWITTVGAGTIDRDFPAYVALGNGKNYTGVSLYSGKPLPTTPVPLIYAGNASNSSMGQLCMSGSLVPEKVAGKIVLCDRGTNARVQKGFIVKDAGGAGMILANTAANGEELVADAHILPGSGVGEKAGNAIRDYAMSDPKATASIVFAGTKVGIQPSPVVAAFSSRGPNTVTPSVLKPDIIAPGVNILAAWSGSVGPSGIAGDSRRVGFNIISGTSMSCPHVSGLAALLRAAHPEWSPAAIRSALMTTAYNEYPNGNGILDVATGRPATPLDVGAGHVDPGKAVDPGLVYDIAAADYVDFLCALNYGPMQIATLTKRSADGCTANRTYAESALNYPSFAVTFPAGGGTVKHTRTVTNVGQPGTYRVTASAAAGGTPVAVSVEPSTLSFSKAGEKQSYTVSFTAPAKPSGTNGFGRLVWSSDHHVVASPIAATWN

SEQ ID NO: 3881 - DNA, 2560 bp, Panicum virgatum
  misc_feature: Ceres CLONE 1795319
  misc_feature: Encodes the peptide sequence at SEQ ID NO. 3882
gagggcgggtataaaatttggcgggttcgtgccgcgtctccccccgctcctcgattccgccggcgaagcgtttacttcttcttcttcttcttcctcctccgcgatctcgaggagagcgcgagcgaggagggggcgcgcgcccatgttttgacctcgcctgcgtcgtcccggccgcgatccagatctgaggtcgtgaggttcttgattgagcgatctcaagaatcatcactgcaatggttgccaagatgccgtcatccagatggatctcggcctccctgctcgtcatgctcctgagcatgcacccagctgtgcacgccttctacctccccggcaccttcatgcacacctactcccccggagaggcgatctgggccaaggttaactccctcacctccattgagactgagctgcccttcagctactacagcctgccatactgcaagcctccggaaggtgtcaagaagagtgctgagaaccttggtgagatcctcatgggtgaccaaattgacaactcgccataccgcttccgtgtcaatgtcaatgaatctgtatacctctgcaccacggacccgctcaccaaggaccaggctgagctgctcaagaagagggcgcggaatctgtaccaggtcaacatggtcctggacaatttgccagtcatgcggttcaccaagcagaacggggtgacaatccagtggactgggttcccagtggggtacaacccgacagggagcaatgaggattatatcattaaccacctcaagttcagagtcttggtccatcaataccaggcgcagggtgatgtggtggtcacaagtgaggatggtgttgcaatggttgagtctgaccgcaagagtgggttccagattgttggatttgaggtcgtgccttgcagtgtgaggcgtgatcctgaggccatgtctaagctcaagatgtacgacaaggttgactccgtgaattgcccattggagcttgagaaatctcaggcgatccatgagaatgatcggattacatttacctatgaggttgagtatgtcaagagcaacatcaagtggccgtcaaggtgggatgcttacctgaagatggatggtgccaaggtgcactggttctcgattatgaactcaatgatggtcgtcttcttcctggctggcattgtgtttgtcatattcttgaggactgtccgcagagatctgacaaggtatgaggagatggacaaggaagcacaagctcagatgaatgaggagctctcaggatggaaacttgttgttggtgatgtcttcagagagccctgctgctcaaagctgttgtgtgttatggtcgctgatggtatccagatcactggtatggcagttgttacaattgtgtttgctgctctgggattcctctcacctgcttccaggggaatgctcctgactggaatgatcattctctacctcttccttggtatcattgctggatatgttggtgtccgtgtttggaggactatcaaaggaacctcagaagggtggaaatctgttgcctggctgacttcctgcttcttccctggcattgttttcatcatcctcactgtgctgaactccattctgtggggcaagaagagcactggcgctctacccatctcattgttcttcaccctcctggccctgtggttctgcatctctgtgccactcacacttattggaggcttgctaggcacacgtgcagcaagcattgattaccctgtccgcaccaaccagattccacgggagatccctgagcgcaagttcccctcatggttgcttgtgctcggtgcaggaactttacccttcggtactctcttcattgagctcttcttcatcctctccagcatttggttgggaagattctactatgtctttggcttcctgttcattgtcctcttcctgctggtcatagtctgtggtgaggtttctcttgtcctaacctacatgcacctatgcgttgaggactggaaatggtggtggaaggccttctttgcttcaggttctgtagcattctatgttttcctctactcgatcaactacttggtgttcgacctcaggagcctgagtggaccagtctctgcaacactctaccttggctactccctgatcatggctcttgcaatcatgctctccactggtgccattggcttcctgctatcattctacttcgtccactacctcttttcatctgttaagattgactagaggtgtgcctgctccctcctgcaatagagtcacctgatcatggtgagttggtgacagttaccccttagaaacactacacaataatatcaaacggaaaaaattggatacatggcaacacccatggcttttggccctgattaattcaatcatttaggatagcacagttactcaagtcgaagcttatttcttagacatgtttgtaaggtttcagctatgttttatgaccttttgtaatactattcagttttgcttgctctgggcatttgtgagcagcctttggtgttggaacactcgagatctattcaatatgaaacaagcttattcgtttacatctgcaaaaaaaaaaaaaaaaaaaa

SEQ ID NO: 3882 - protein, 656 aa, Panicum virgatum
  misc_feature: Ceres CLONE 1795319
  misc_feature: Great-hit functional homolog of the protein sequence encoded by LOCUS At5g35160
  misc_feature: Useful for making plants with altered cell wall content and/or composition
MVAKMPSSRWISASLLVMLLSMHPAVHAFYLPGTFMHTYSPGEAIWAKVNSLTSIETELPFSYYSLPYCKPPEGVKKSAENLGEILMGDQIDNSPYRFRVNVNESVYLCTTDPLTKDQAELLKKRARNLYQVNMVLDNLPVMRFTKQNGVTIQWTGFPVGYNPTGSNEDYIINHLKFRVLVHQYQAQGDVVVTSEDGVAMVESDRKSGFQIVGFEVVPCSVRRDPEAMSKLKMYDKVDSVNCPLELEKSQAIHENDRITFTYEVEYVKSNIKWPSRWDAYLKMDGAKVHWFSIMNSMMVVFFLAGIVFVIFLRTVRRDLTRYEEMDKEAQAQMNEELSGWKLVVGDVFREPCCSKLLCVMVADGIQITGMAVVTIVFAALGFLSPASRGMLLTGMIILYLFLGIIAGYVGVRVWRTIKGTSEGWKSVAWLTSCFFPGIVFIILTVLNSILWGKKSTGALPISLFFTLLALWFCISVPLTLIGGLLGTRAASIDYPVRTNQIPREIPERKFPSWLLVLGAGTLPFGTLFIELFFILSSIWLGRFYYVFGFLFIVLFLLVIVCGEVSLVLTYMHLCVEDWKWWWKAFFASGSVAFYVFLYSINYLVFDLRSLSGPVSATLYLGYSLIMALAIMLSTGAIGFLLSFYFVHYLFSSVKID

SEQ ID NO: 3883 - DNA, 1740 bp, Panicum virgatum
  misc_feature: Ceres CLONE 1795320
  misc_feature: Encodes the peptide sequence at SEQ ID NO. 3884
acgccactcgccgttccgcctccaccctgctgcccctcggcatctcgctgacaccaccacgactgcaaccgccgcaccgcgctccgatcgcctcctgcgtttcccgccggcggtgtgcgttccgatagagatcttcgctggtagcttaatctagcccgggagagaagccgccggccgcggagatgatgatgatgagcggtcgtgcgggcggcggggccggcgcggggcggtatccgttcacggcgtcgcagtggcaggagctggagcaccaggcgctcatctacaagtgcctggcgtccggcaagcccatcccgtcctacctcatgccgccgctccgccgcatcctcgactccgccctcgccacctccccctccctcgccttcccgccgcaaccctcgctggggtggggctgcttcgggatggggttcagcaggaagcccgacgaggatccggagcccgggcggtgccggcggacggacggcaagaagtggcgctgctccaaggaggcctacccggactccaagtactgcgagaagcacatgcaccgcggcaagaaccgttcaagaaagcctgtggaaatgtcccttgccacgccggcgccgtcctccaacgccacctccgccaacagcgccaccgccaacaccaccacgacctcgtcccccgcgcccacctaccaccgcccggcccccgccgccgcgcacgacgcggcgccctaccacgcgctgtacggtggcagcccatacgcggcggcctccacccgccccgccagcgcgtaccacgcgtcggcgcaggtgagcccgttccacctccacctcgataccacccacccgcacccgccgccgtcgtactactccgtggaccagagggactacgcctacgggcacgccgccaaggaggtcggcgagcacgccttcttctccgacggcacgaccgagagggaccgccaggccgcgggtcagtggcagttcaagaatctcggcgtggagccgaagccgagcgccgcgtcgctgttctcggtcggcgggtacgggaacgccgcggcgacggcgtacgccgctgatctgagcaaggaagaggacgaggaggagcggcggcgccagcagcagcagcactgcttcgtgctgggagccgacctgcggctggagaggccgtcgggccacgacgccgcccccgcgcagaagccgctccggcccttcttcaacgagtggccgcacgagaaggcaaacaagggcggctcctggatggggttcgacggcgagacgcagctttccatgtccatccccatggcgaccaacgacctccccatcacctcccgctaccgtaatgatgagtaagaccagcttgtgtgattgctgctagacgagaggctgagccgctgaggccagatcaacctggaacacaactacgagtgccttccagggatatgtacggttctgctcaaggccggtacagttcctgaagttgaaagacctgaacctcctaagaatgaattttcctttttctccattttttttcctcttaagcgacgttgcctgtagtgttacacttcactgtaatgctaatgcttcttatgttagttgtgatgaggttagtaggagtggaggcctttcggatttctgaagcgttttgcctctgttctgttcttgtcagtgctatgtaatatcttgtgagcgagctcaggccccgttcaattcccaaaaaaattgctacagtaaccgtcaaaaaaaaaaaaaaaaaaaa

SEQ ID NO: 3884 - protein, 383 aa, Panicum virgatum
  misc_feature: Ceres CLONE 1795320
  misc_feature: Great-hit functional homolog of the protein sequence encoded by LOCUS At3g13960
  misc_feature: The sequence is a functional homolog of  SEQ ID NO 1781 in the  10/374,780 US patent application
  misc_feature: The sequence is a functional homolog of  SEQ ID NO 1803 in the  11/479,226 US patent application
  misc_feature: Useful for biocontainment applications
  misc_feature: Useful for making plants with modulated biomass
  misc_feature: Useful for making plants with modulated flowering time
  misc_feature: Useful for making plants with modulated nitrogen use efficiency
  misc_feature: The plant flowers significantly late compared to wild-type.
  misc_feature: The plant is abnormally large.
  misc_feature: Useful for making plants with modulated growth and phenotype characteristics
MMMMSGRAGGGAGAGRYPFTASQWQELEHQALIYKCLASGKPIPSYLMPPLRRILDSALATSPSLAFPPQPSLGWGCFGMGFSRKPDEDPEPGRCRRTDGKKWRCSKEAYPDSKYCEKHMHRGKNRSRKPVEMSLATPAPSSNATSANSATANTTTTSSPAPTYHRPAPAAAHDAAPYHALYGGSPYAAASTRPASAYHASAQVSPFHLHLDTTHPHPPPSYYSVDQRDYAYGHAAKEVGEHAFFSDGTTERDRQAAGQWQFKNLGVEPKPSAASLFSVGGYGNAAATAYAADLSKEEDEEERRRQQQQHCFVLGADLRLERPSGHDAAPAQKPLRPFFNEWPHEKANKGGSWMGFDGETQLSMSIPMATNDLPITSRYRNDE

SEQ ID NO: 3885 - DNA, 1755 bp, Panicum virgatum
  misc_feature: Ceres CLONE 1795322
  misc_feature: Encodes the peptide sequence at SEQ ID NO. 3886
aacgattccccaattctttcccgcctacatctcccgcctcttcccctccccccaaaaccccaaaccctagcagccctccacccgcccccgcctccgcatccgcatccagatcgaccacggccatggcgctcaagcagaagggcaccgacgctgccgccgccgaccccaagaagcgccgccgcgttggcttctccggcatcgatgctggagtcgaggcaaatgagtgtatgaaagtgtttctggcaaggaatcctgacgaggtgggctctgaggactgtacttctattcaaccatttgacctaaaccatttttttggtgaagatggaaagatatatggttacaaaaatcttaagataaatgtgtggataagtgcaatatcattccatggatatgctgatatttcatttgaggaaacatctgatggagggaaaggaataactgatctaaagcctgttcttcagagcatttttggagaaaacctggtagaaaaagaggaatttatgcaaaccttttcaaaggaatgcgaatatatcagagacgtggtgacaaatggtaatgccataaagcatgaaggcaccaatgaatcagatccagcagttgagattgttcgagttgaactccaaggtgctgctgctttcctttattctcgtctggtgccgcttgttctgcttctggttgaaggttccactcctatagatattggagaacatggatgggaaatgcttctggtagtaaagaagacaacacaagagtctgtttcaaaatttcaactgctaggttttgcagctgtccataatttttatcattaccctgagagcactcgattgcgaatcagccagatactggtattgccacctcatcaaggtgaaggccatggccttcgtcttcttgaggcaatcaattctattgcactatctgagaacatatatgatgtaaccatagaagacccttcagattacctgcagtatgtgcgttcgtctatcgactgcctccgtcttctcacatttgatccaatcaagccagcgctcagtgctattgtctcgtctctgaaggagaccaacctgtcaaaaaggacttgcagcttgaggatggttccaccagcagacctgactgaaactgtccggcagaagctgaagatcaacaagaaacagttactgtggtgctgggaaattctggtctatctaagccttgattctgaggactgcaagagcatggacaacttcagggcctgcatatatgaccgcacgaagggtgaaatccttggcagcgccactggaaccaacggcaagcgtctggtgcagatgccaagcagtgtgaacgaggagtcctttgctgtgttctggacacaggatggcggggatgctgacgaccagacagttgagcagcagccagaagatctcaagacccaggaggagcagctcaatgagctcgtggacaaccaaatggaggagattgttggggttgcgaagaatgttgcctcgcgtgggaaggataagctggcagggctgtcagctcggtgaacttgggtgatccttgcttaatatcatgctaacatggaaatgctgtggaagctttcttggtgagatcttttacatagaccagctcttcagagtagacacggaaatgttggttgttacactgtcttcatagttgtagaaccaacacaaaaataggtcgggttattatgtattgcaattctggaatcattgatgagaatgttacgtttgacttgattaaaaaaaaaaaaaaaaaaaa

SEQ ID NO: 3886 - protein, 465 aa, Panicum virgatum
  misc_feature: Ceres CLONE 1795322
  misc_feature (1)..(42): Pfam Name: Acetyltransf_1 Pfam Description: Acetyltransferase (GNAT) family
  misc_feature (1)..(462): SWISSPROT Homolog: EC 2.3.1.48 Histone acetyltransferase type B catalytic subunit
MALKQKGTDAAAADPKKRRRVGFSGIDAGVEANECMKVFLARNPDEVGSEDCTSIQPFDLNHFFGEDGKIYGYKNLKINVWISAISFHGYADISFEETSDGGKGITDLKPVLQSIFGENLVEKEEFMQTFSKECEYIRDVVTNGNAIKHEGTNESDPAVEIVRVELQGAAAFLYSRLVPLVLLLVEGSTPIDIGEHGWEMLLVVKKTTQESVSKFQLLGFAAVHNFYHYPESTRLRISQILVLPPHQGEGHGLRLLEAINSIALSENIYDVTIEDPSDYLQYVRSSIDCLRLLTFDPIKPALSAIVSSLKETNLSKRTCSLRMVPPADLTETVRQKLKINKKQLLWCWEILVYLSLDSEDCKSMDNFRACIYDRTKGEILGSATGTNGKRLVQMPSSVNEESFAVFWTQDGGDADDQTVEQQPEDLKTQEEQLNELVDNQMEEIVGVAKNVASRGKDKLAGLSAR

SEQ ID NO: 3887 - DNA, 1662 bp, Panicum virgatum
  misc_feature: Ceres CLONE 1795323
  misc_feature: Encodes the peptide sequence at SEQ ID NO. 3888
agttagctgcgcgcacagggaaagaagaagcaacaaataaataaggcagcgagcagaaccgcagatgagagatagatatccgtcgtcctcagatagatagctagctagctacaagatcacatactacagtcccctccccagtgatcgatcgatcgatcgagccaccacaccgacctagctagcggcagtcgtctcgacatacagctagctccgatatcctgcaagtaattaataagctagctagctagcagcagatagctgtaaattaagctgcagctagcatggcgccgccgccgctcctcctcctccggctgctgcttgttgcggcggcggcatcatcatcaaggatgacgacgatcaggtgccatgggtaccagtacaacgcgtcgcaggggcccctggtgacggcggtgatcgcgttcggcgactccatcgtcgaccccggcaacaacaacgacctgcacacgcagatcaaggccaaccatccaccctacggcaaggacttcttcaaccacgaggccaccggaagatactccaacggcctcatacccactgacctcatcgcccaggggcttggtgtgaagcagctgctgccgggctacctgggcgtggatctgagcccggaggatctcctgacgggcgtgagcttcgcgtccggcgccaccggattcgatccgctgacgcccgtcgtggtgagcgtcatctcgctggagcagcagcttgcctacttcgacgagtaccgcgcgaagctggtggccatcgccggcgaggaggagacggacaagatcatcaggggggcgctcttcgtggtgtgcgccggcaccgacgacgtggccaacacctacttcacgacgcccttccggcgcgtggtgtacgacatccccagctacgtggagctgctcgtctccggcgccgaggccttcctccggaacgtcagcgcgaggggcgccaccaggatcggcttcgtggggatgccgccggtggggtgcgtgccgtcgcagcagacgctgggcggcggcctccgccgcgagtgcgagccgaggcgcaacgaggcggcgcagctgtacaacgcccggatccaggggatgatcgccggcctcaacgccgagcagggattcggcacgctggtggtgtacctggacatctaccgcatcctggacgagctcatggagcgcggcgacaggtacggcttcaccgagaccaccaagggctgctgcggcaccggcaccatcgaggtcaccgggctctgcgacagccgcttcgtctccgtctgcgacgacgtctcccagcacgtcttcttcgacagctaccaccccacggagcgagcctacaggatcatcgtcgacgacatcttcgacaactacatccaagtgctcgtctgatcatctgcactagttctgtatcgatcgtctaattgtatgattgcattcttgtttattgttttaattgaggggtgaattgaatgcgtgttgttgttttctttttctttttcttttcttaggggggattattatattgaatgcgtgttgttgctgctgttgctgcatccagcaaatgcatgggccaaaaagatatggggcccagggtaaagcaaagcccaccctcaaataacattatttattggccggccgggccggtcatcaaaaaaaaaaaaaaaaaaaa

SEQ ID NO: 3888 - protein, 366 aa, Panicum virgatum
  misc_feature: Ceres CLONE 1795323
  misc_feature (1)..(312): Pfam Name: Lipase_GDSL Pfam Description: GDSL-like Lipase/Acylhydrolase
MAPPPLLLLRLLLVAAAASSSRMTTIRCHGYQYNASQGPLVTAVIAFGDSIVDPGNNNDLHTQIKANHPPYGKDFFNHEATGRYSNGLIPTDLIAQGLGVKQLLPGYLGVDLSPEDLLTGVSFASGATGFDPLTPVVVSVISLEQQLAYFDEYRAKLVAIAGEEETDKIIRGALFVVCAGTDDVANTYFTTPFRRVVYDIPSYVELLVSGAEAFLRNVSARGATRIGFVGMPPVGCVPSQQTLGGGLRRECEPRRNEAAQLYNARIQGMIAGLNAEQGFGTLVVYLDIYRILDELMERGDRYGFTETTKGCCGTGTIEVTGLCDSRFVSVCDDVSQHVFFDSYHPTERAYRIIVDDIFDNYIQVLV

SEQ ID NO: 3889 - DNA, 1259 bp, Panicum virgatum
  misc_feature: Ceres CLONE 1795347
  misc_feature: Encodes the peptide sequence at SEQ ID NO. 3890
ctctctctataaacgcccatctcgctggcgcccctcctcctcatccgcaccctctcctccccccgattccgatccctcatggccgccgcctccgccgccgccgccgccgcgctcgcctcaccggcggccctctccgcgtcgccggcgcgccggggcctcgtcagcttcgccgcccccgcgctccgttcgggcccgggcacccgcgccgtcgcgctctccggagtacgaactcatgttgcggctgttgagcaagctgttgcacaagatgctactaaattggaagctcccgttgttgttgttactggtgcttccagggggatcggaaaagccattgcattaactcttggaaaagcaggttgcaaggtcttggtgaattatgcccgatcttcaaaggaggctgaagaagtctccaaggagattgaagcatctggaggccaggccatcacctttggaggagatgtttccaaagaagctgacgttgaatctatgataaaaacagcagttgacacatggggaacaattgatgtactcgtaaataatgcaggaatcacacgggacacattgttgatgagaatgaggaaatcacagtggcaagacgtaattgatctgaatcttacaggcgttttcctttgcacgcaggctgcaacgaaagtaatgatgaagaaaaggaagggaagaattatcaacatagcatcaattgttggtctaactggtaatgttggacaagctaattatgctgctgctaaggctggagttattgggttcacaaagacagttgctagggaatatgcaagcagaaatattaatgcaaatgctgttgctcctggatttatttcatcggatatgactgctgaacttggagaagagctcgagaggaaaattctgtcaactgtccccttagggcgatacgggacaccagaggatgtagcaggcctggtggaattcttagccctcagccctgctgcaagctacatcactggacaggtcctcaccatcgatggtgggatggttatgtaaggctttggcaaactatcacccggcttcaatcccccccccccccccatgccctattatttggtaaaagaagactgtaatcaacagtgttgatgtgttctcttttaaaagggcgatttgtttgctgagcagcaatttttctagtgtctggtttatagggagagtgagacagtatggagatagaaatgtaagagatttccaagcatatatttaaattcctttccgaaaaaaaaaaaaaaaaaaaa

SEQ ID NO: 3890 - protein, 312 aa, Panicum virgatum
  misc_feature: Ceres CLONE 1795347
  misc_feature (1)..(169): Pfam Name: adh_short Pfam Description: short chain dehydrogenase
  misc_feature (1)..(312): SWISSPROT Homolog: EC 1.1.1.100 3-oxoacyl-[acyl-carrier-protein] reductase, chloroplast precursor
  misc_feature (21)..(312): SWISSPROT Homolog: EC 1.1.1.100 3-oxoacyl-[acyl-carrier-protein] reductase 1, chloroplast precursor
MAAASAAAAAALASPAALSASPARRGLVSFAAPALRSGPGTRAVALSGVRTHVAAVEQAVAQDATKLEAPVVVVTGASRGIGKAIALTLGKAGCKVLVNYARSSKEAEEVSKEIEASGGQAITFGGDVSKEADVESMIKTAVDTWGTIDVLVNNAGITRDTLLMRMRKSQWQDVIDLNLTGVFLCTQAATKVMMKKRKGRIINIASIVGLTGNVGQANYAAAKAGVIGFTKTVAREYASRNINANAVAPGFISSDMTAELGEELERKILSTVPLGRYGTPEDVAGLVEFLALSPAASYITGQVLTIDGGMVM

SEQ ID NO: 3891 - DNA, 1929 bp, Panicum virgatum
  misc_feature: Ceres CLONE 1795349
  misc_feature: Encodes the peptide sequence at SEQ ID NO. 3892
aacccgcaagtcgaatctacaaaaccccattagagcgtgaccgaagagctcctccgcctcgaaccctctcgcgctttgcctccaccgacctcgccgccgcagccatggcgatcgacatcctcggcgagcgccagtccggccaggacgtccgcacgcagaacgtgatggcgtgcggggcagtggccaacatcgtcaaatcctcgctcggccccgtcgggctcgacaagatgctagtggatgacattggtgatgttataataactaatgatggagccaccatactgaagatgttggaagttgagcacccagctgccaaggttcttgttgagttggctgagctccaagatcgtgaggtaggagatggaacaacttcagttgtcatcatagcggcagagttgctcaagagaggcaacgatcttgtgaaaaataagatccatccgacctctataatcagtggctacaggcttgctatgcgtgaagcctacaaatatgtggaggaaaagttggcagtcaaggttgatagacttggaaaagactcccttattaactgcgcaaaaactagcatgtcatcgaaactgattgatagtgacagtgatttctttgcaactatggtcgttgatgcggttcaagctgtgaagactacaaatgccaagggggaagtgaagtatccaatcaagagcatcaatgttttgaaagctcatggtaaaagtcagaaggatagttatctgctgaatgggtacgcattaaacacaggccgtgcagctcaaggaatgcctactagagtaactcctgctagaattgcttgtctcgattttaaccttcagaagacaaaaatgcaacttggtgttcaagttcttgtaactgatccaagggaacttgagaagattcgtcaaagagaatctgacataacaaaggagcgaattgagaaaattctcaaggctggagctaatgttgtgttgaccaccaagggaattgatgatatgtccttgaagtactttgtcgaggctggagcaattgcagtaaggcgtgtgcgcaaggaagatttgcgtcatgttgccaaggccaccggtgcaactatgattactacttttgcggacatggaaggcgaagaaacatttgattcatcattccttggacatgcggatgaagttgtggaggaaagaattgcagatgatgatgttatcctggtgaaaggcacgaagaacaccagcgcggtgtccataatacttagaggtgcaaatgatttcatgcttgatgagattgagcggtccttgcatgatgccttatgcattgtgaagagaaccctggagtcaaatatggttgttgctggcggtggtgcagtcgaagctgcattatcagtttacttggagaaccttgcaacaaccctgggatctagggaacagttggcaattgctgaattcgctgaatctttgttaatcatacccaaggtactctctgttaatgctgcaaaagatgcaactgagcttgtagcaaaacttagggcatatcatcatactgctcaaacgaaggctgataagcaacatttctcaagcatgggtcttgacctctctaaaggtatcattcgcaataaccttgagtatggtgtgattgaacccgcgatgagcaaagtaaagattattcagtttgccactgaggcagccatcactatcctgaggatcgatgacatgatcatgcttaccaaggaagagggtaacgaagaggagtaaccagctcactggtaggggtcgtggactgttgtgtgatggttgtgatagcatgtaatatttgtctttccttttttgctagctgtggacattttagtaggatgttgtacgagaactgcaagtggatctgtatcctagtgagttgacgttatttggaaagacagctcacgaatgaatcaagtttcaaaaaaaaaaaaaaaaaaaa

SEQ ID NO: 3892 - protein, 540 aa, Panicum virgatum
  misc_feature: Ceres CLONE 1795349
  misc_feature (1)..(506): Pfam Name: Cpn60_TCP1 Pfam Description: TCP-1/cpn60 chaperonin family
MAIDILGERQSGQDVRTQNVMACGAVANIVKSSLGPVGLDKMLVDDIGDVIITNDGATILKMLEVEHPAAKVLVELAELQDREVGDGTTSVVIIAAELLKRGNDLVKNKIHPTSIISGYRLAMREAYKYVEEKLAVKVDRLGKDSLINCAKTSMSSKLIDSDSDFFATMVVDAVQAVKTTNAKGEVKYPIKSINVLKAHGKSQKDSYLLNGYALNTGRAAQGMPTRVTPARIACLDFNLQKTKMQLGVQVLVTDPRELEKIRQRESDITKERIEKILKAGANVVLTTKGIDDMSLKYFVEAGAIAVRRVRKEDLRHVAKATGATMITTFADMEGEETFDSSFLGHADEVVEERIADDDVILVKGTKNTSAVSIILRGANDFMLDEIERSLHDALCIVKRTLESNMVVAGGGAVEAALSVYLENLATTLGSREQLAIAEFAESLLIIPKVLSVNAAKDATELVAKLRAYHHTAQTKADKQHFSSMGLDLSKGIIRNNLEYGVIEPAMSKVKIIQFATEAAITILRIDDMIMLTKEEGNEEE

SEQ ID NO: 3893 - DNA, 1570 bp, Panicum virgatum
  misc_feature: Ceres CLONE 1795371
  misc_feature: Encodes the peptide sequence at SEQ ID NO. 3894
gacgacccaccctagcgctctagctacggccgggcagagcaggtcgacatgcatgcacttgcaccgcagctctagctcagccagcactcttattagctagtggtggattgctgcgagcatggcggcgtattcagctagcggcggcggccgctcgtcaccgccacctgccgccgcggctcctcgggcggtggtggacaacctgatcgacctgcgtgagcgagcggagatgctacggaacatgctgcaggggtcgcccacgccgccgggaacgcccgccgacgccgctccagctgggaccagcgatctgatagacgggatcatgagcagcctgtcgagcgcgctgtcggcagccctcgacaccaccgccgccggcggccgtggacagggccggaggaggaggagagctggcgcggcgaccgggtctggaccgcagcgccggagcagcaccaccaggagaagatcgcacagccccttcttgaggacagtcactacaaatactctcgatgatggcaactcatggagaaagtacggccaaaaacatattcaagactcacctaataacccaaggagctactacaggtgcacacacaagccagaccaagggtgcagggcgacgaggcaggtccaggcctccgatgacaacccgtccgagttcgtcatcagctactacggccagcacacctgccgggacccctccacgatcccgctcgtcatcgaggccgccgccgctccgcccgacgactgcgcaaacctcatcagcttcgggtcgtcgtccatcactgctactgctactaccctgggcctgggcggcgcatccacgctcgccgccgttgttcctccccaacaaccccaagccgttccttcggatccgacgacgacgacgatgttcatatctggcatggtcgggtacagctcctcctctctgccggcggcgcagctgcaggactactaccgctgcggcagcgaggaggcgcacaggcacagcagtattagctcaccgccggccgcggtgggatcagctgcagctggaataataatgacctcgtcggccaccgtggggtcggcaccggccgagtactggccaggaggaggagggaccctcggcgacatggcttgtggtggtggccatggcgccgcaggcagcttcccgtcgtctcctagcagcctcgggctcttgacgggctcgtttggatcctttggggatgacgacatgtttggcttcgatccctgacaatggctgatgcatgcatgcatggctaatgacgcaagtttgcagttttgcatgcatgcactagttgcacaactaagctagctagtagcagcagtgttgattaatacctacaataaagcaggctagctctattattcatcgatcgggtacggtctttgcttgtgtaaagcatatgtattgtaatgcctcggtctgtgtatttgtacatatatgatgcatgattatatatgtatgtatgatccggaaaatgtaatggaataatgtatatatgctacatacataatctgttctgttcagaaataatatatgtgattattccaaaaaaaaaaaaaaaaaaaa

SEQ ID NO: 3894 - protein, 370 aa, Panicum virgatum
  misc_feature: Ceres CLONE 1795371
  misc_feature: The sequence is a functional homolog of  SEQ ID NO 2456 in the  10/374,780 US patent application
  misc_feature: The sequence is a functional homolog of  SEQ ID NO 568 in the  10/225,066 US patent application
  misc_feature: Useful for making plants with modulated growth and phenotype characteristics
MAAYSASGGGRSSPPPAAAAPRAVVDNLIDLRERAEMLRNMLQGSPTPPGTPADAAPAGTSDLIDGIMSSLSSALSAALDTTAAGGRGQGRRRRRAGAATGSGPQRRSSTTRRRSHSPFLRTVTTNTLDDGNSWRKYGQKHIQDSPNNPRSYYRCTHKPDQGCRATRQVQASDDNPSEFVISYYGQHTCRDPSTIPLVIEAAAAPPDDCANLISFGSSSITATATTLGLGGASTLAAVVPPQQPQAVPSDPTTTTMFISGMVGYSSSSLPAAQLQDYYRCGSEEAHRHSSISSPPAAVGSAAAGIIMTSSATVGSAPAEYWPGGGGTLGDMACGGGHGAAGSFPSSPSSLGLLTGSFGSFGDDDMFGFDP

SEQ ID NO: 3895 - DNA, 1729 bp, Panicum virgatum
  misc_feature: Ceres CLONE 1795411
  misc_feature: Encodes the peptide sequence at SEQ ID NO. 3896
actgttcccgttttcgtcaagctcgcgcttaaccccaccgccgggagaagacgaagtgttcgacgaaatgacgagcgctggatcggcggcgggcgccgcgctgggcgcgctcacggcgcgctcctgcgacggctgcatgcgtcggcgggcgcggtggcactgccccgccgacgacgcctacctgtgccaggcctgcgacgcctccgtccactcggccaacccgctcgcgcgccgccaccaccgcgtccgcctcccctcggcgtcttgctcctcccctccgcgcgaccccgacgcgcccgcgtggctccacggcctcaagcgccggcctcggacggcgcggtccaagccaggaggaagcggcaagcatgaggccacgcccgcctcgatcgccgcggccgtgtcggcagcggtgcccgacctcgaggcggaggagtctggctcaggcatcgtgggcgacgacgacgacttccacggggtggaggatgaggatgaggacgaggatcttctgtaccgcgtccctgtgttcgaccccatgctcgccgagctctacaaccccgtgaccgacgagggggagcagaagccggcctgcctgatctcgtctctcgccgagacgtcgccggactttgcctccggctcggcggaggcggacgggctctccgggtttgacgtcccggacatggagctcgctagcttcgccgcggacatggagagcctcttcatgggagtcgaggacgggtttgatgatctgggtttcttggacgaggagaagcctcaggtgaacgtggacctgggtcgcatgaaccttgaggccacggcgacgccggcgcctccgccggaacgagatgagaagaaaaggaagcggccagagatgatactcaagctcaactatgagggagtcatcgcctcttgggtccgtgacggcggctcgccgtggttccacggcgagcgtcgtcctcacctcgatccttacgacgagtcctggtcgggcttcccggcggggtgcaggggactcctcggcggcgccgtgaccgcggtgaccggcggcgagcgggaggcgcgggtgtcgcggtaccgggagaagcggcggacgcggctgttcgccaagaagatccggtacgaggtgcgcaagctcaacgccgagaagcggccgcgcatgaagggccggttcgtgaagcgcagctcgctgccgccgctgccgaggcccccgccgccaccgcagcagcagaagcagccgccgcgggcgatgatgccgcacgtgggcatgatgctcgcgccgccagggggcgtgcacgggcgcttccgtttttgagactactcgtcgtgcattgcaaagcatagtatatatagtatgtgcatgatgcatcggtgcatgcatcttcacgtacagtacacgtacatgtgatctacaagtaaacactacagatagtatcacgtagcatgttctttctactctacttttaaatggggatgaacgtacctagtgttagttttgagcagaatccgtacgtgctagttattagttctcccaaagatgccttacaagttacattagtcacgactgaaatattcgtatccaccacctgtgcagaatctaattaatgtgcaaagtagctaaggatcgttaagtatgttaatgggcgcatagctaggttgggtgtttctcttctgtttgtaaagaaggatatactaattacaagggcgtgtgagatcaaaaaaaaaaaaaaaaaaa

SEQ ID NO: 3896 - protein, 413 aa, Panicum virgatum
  misc_feature: Ceres CLONE 1795411
  misc_feature (2)..(48): Pfam Name: zf-B_box Pfam Description: B-box zinc finger
  misc_feature: The sequence is a functional homolog of  SEQ ID NO 1522 in the  10/374,780 US patent application
  misc_feature: The sequence is a functional homolog of  SEQ ID NO 1593 in the  10/412,699 US patent application
  misc_feature: Useful for making plants with modulated growth and phenotype characteristics
MTSAGSAAGAALGALTARSCDGCMRRRARWHCPADDAYLCQACDASVHSANPLARRHHRVRLPSASCSSPPRDPDAPAWLHGLKRRPRTARSKPGGSGKHEATPASIAAAVSAAVPDLEAEESGSGIVGDDDDFHGVEDEDEDEDLLYRVPVFDPMLAELYNPVTDEGEQKPACLISSLAETSPDFASGSAEADGLSGFDVPDMELASFAADMESLFMGVEDGFDDLGFLDEEKPQVNVDLGRMNLEATATPAPPPERDEKKRKRPEMILKLNYEGVIASWVRDGGSPWFHGERRPHLDPYDESWSGFPAGCRGLLGGAVTAVTGGEREARVSRYREKRRTRLFAKKIRYEVRKLNAEKRPRMKGRFVKRSSLPPLPRPPPPPQQQKQPPRAMMPHVGMMLAPPGGVHGRFRF

SEQ ID NO: 3897 - DNA, 1067 bp, Panicum virgatum
  misc_feature: Ceres CLONE 1795422
  misc_feature: Encodes the peptide sequence at SEQ ID NO. 3898
accgatccggaatcctctaggcctcgctctcctctcctctcctcctctctccgagcgccaccgagcccgccatccccggctcagatccgacgagggcgacggcggcgagatgacggggggcgcggcggcgtcgcaggcgtacggggaggcgtggtactgggacgagcgctaccgcaaggaggccgggcccttcgactggtaccagaagtacccggccctcgcgccgctgctccgcctctacctcgcgccgcaccaccgcctcctcctcgtcggatgcgggaactccgtctttggtgaaaatatggttgatgatggttatcaagatgttgtcaacatcgatatatcttcagtggtaattgagcaaatgaagaagaaataccatgataagcctcaacttaaatacatgaagatggatgtaaaggacatgtcatattttgagtccggttcattcgacgctgttattgacaaaggaacactagattctattatgtgtggccaaaattcacaagagaatgcaacgaaaatgctagaggaggtcaacagaatcctcaaggaaaagggtgtctacatgctgatcacttatggggatccaagttaccgattgcgtctcctgaaggacatggaaaattggacaataaagctccatgtcatagaaagatgggagaaaagtctgaatctgaataaatgggaactgacaaaaccattgcccttagacgacgatagcacatcggtagttgcgcttctcggaccgaaacctgatgttcactacatatatgtctgtgtaaagggcaacgatagtgcaagagcggatactaaagctggagaagctgccaattgatttcgccaataaccctccgaaccggcgtgcataactagtgtagcgaataatgtagaacaggtgctgtacctctaattgttgttgcttgatgagaacccacttcacgttcagtgaagttgtagattagctgtaccagatgtttcattgttcctgttgtagtgttgtgcacccatcgaatcccaagggaacagatgcggcgatttcctgccaaaaaaaaaaaaaaaaaaaa

SEQ ID NO: 3898 - protein, 242 aa, Panicum virgatum
  misc_feature: Ceres CLONE 1795422
  misc_feature (1)..(104): Pfam Name: Methyltransf_11 Pfam Description: Methyltransferase domain
MTGGAAASQAYGEAWYWDERYRKEAGPFDWYQKYPALAPLLRLYLAPHHRLLLVGCGNSVFGENMVDDGYQDVVNIDISSVVIEQMKKKYHDKPQLKYMKMDVKDMSYFESGSFDAVIDKGTLDSIMCGQNSQENATKMLEEVNRILKEKGVYMLITYGDPSYRLRLLKDMENWTIKLHVIERWEKSLNLNKWELTKPLPLDDDSTSVVALLGPKPDVHYIYVCVKGNDSARADTKAGEAAN

SEQ ID NO: 3899 - DNA, 1523 bp, Panicum virgatum
  misc_feature: Ceres CLONE 1795458
  misc_feature: Encodes the peptide sequence at SEQ ID NO. 3900
atcagtagacgacgctacggacgaagcggtggccaagtcggcagagcagcacctgcctcgcagcgatggagggcggcgggagcagcaggagatggcgcttcgcgtcgccgaacccggccgtggcggccgccggggagcggagcatccagaggcacctccgcgacctgcacggctgcctggacgagcgcggcccgcggcccgtgatcccgctcagccacggggacccctcatcgtccctctccttccgcaccgctcccgaggcggtggaggccgtcgccgccgccctcctctccggtgatttcgacggctacgcgtcccgcgacacgaatctcgcagcttgccgagctgttgcagagtacttatcgtgtgatttgccttacaagctttcccctgatgatgttctcctcacttctggatgtacccaagctatcgagactgtgatgtctgttcttggccaacaaggtttcaatatattgctcccaaggcctggttacccaaaacatgaagcacatgcagtgtttcataagatggaagtacgccattatgatcttgttccagagaggggttgggaggtcgacctggaagctgttgaagctcttgcagatgagaatactgttgcaatagtgattactaatcccaacaacccttgtggcactgtgtatacttacgagcatttgtccaagattgcaggtacagcaaacaagcttggtatgttagtcatttctgatgaggtctatgggcatcttgtctatggtagcactccttttgtgccaatgggtgtttttggggatactgttccaatactcacacttggagctatatcaaagagatgggcagtacctggctggagatttggctggatagcaatttgtgaccctaaatgtattctgaaagaaaccaaggtttttcattcactgacaagcttcaaaatgctaacaacagatcctgcaacatttgttcagggatctattcctcatattatgaagaacacacatgatgagttctttagcaagattatcaggttgttaaaggagtgcgcagaaatatgctacagcgaaataaaggaaatcaagtgtattacctgtccctgcaaagcagaaggatcattttttatgatggtgaaactagacatatcacagttgtcagacattagtgatgacgtcgatttctgtagaaagttggcaaaggaggaatcagtcatggtgttgcctgggactgccttaggcattgagaactggctacgcataacctttgcttcggatccagcaaaactgaagcaaggacttgaaaggatcaagtccttttgcctgaggcatcagtcacatgtcaattaatcccaagggagtgcctttgcaatactgaattaaattctccaatgcttgttggggtttccatgttcgtacaatgacatcatgtttcttgagtacattgaacaaacagcatagaacttcgcctctgttgtgttcgcacaaatttcacctgttccccgtttaatgcttcatcaaaaaaaaaaaaaaaaaaaa

SEQ ID NO: 3900 - protein, 422 aa, Panicum virgatum
  misc_feature: Ceres CLONE 1795458
  misc_feature (1)..(367): Pfam Name: Aminotran_1_2 Pfam Description: Aminotransferase class I and II
MEGGGSSRRWRFASPNPAVAAAGERSIQRHLRDLHGCLDERGPRPVIPLSHGDPSSSLSFRTAPEAVEAVAAALLSGDFDGYASRDTNLAACRAVAEYLSCDLPYKLSPDDVLLTSGCTQAIETVMSVLGQQGFNILLPRPGYPKHEAHAVFHKMEVRHYDLVPERGWEVDLEAVEALADENTVAIVITNPNNPCGTVYTYEHLSKIAGTANKLGMLVISDEVYGHLVYGSTPFVPMGVFGDTVPILTLGAISKRWAVPGWRFGWIAICDPKCILKETKVFHSLTSFKMLTTDPATFVQGSIPHIMKNTHDEFFSKIIRLLKECAEICYSEIKEIKCITCPCKAEGSFFMMVKLDISQLSDISDDVDFCRKLAKEESVMVLPGTALGIENWLRITFASDPAKLKQGLERIKSFCLRHQSHVN

SEQ ID NO: 3901 - DNA, 1420 bp, Panicum virgatum
  misc_feature: Ceres CLONE 1795465
  misc_feature: Encodes the peptide sequence at SEQ ID NO. 3902
gttcagctgcgcttcgtcttcctccccacctcgccgcgcggatcggagagcgggcgagccaaggaggaaggaggggagagccgacgatccaggcaagcaagatgcagtacaagaacctgggccgctcggggctgcgcgtcagccagctctcgtacggggcctgggtcaccttcggcaaccagctcgacgtcaaggaggccaaggcgctgctgcaggcgtgccgcgacgccggcgtcaacttcttcgacaacgccgaggtctacgccaacggccgcgccgaggagatcatgggccaggccatccgcgacctcggctggcgccgctccgacgtcgtcatctccaccaagctcttctggggcggccaggggcccaacgacaagggcctctcccgcaagcacatcgtcgagggcctcaagggctcgctcaagcgcctcgacatggactacgtcgacatcgtctactgccaccgccccgacgcctccacgcccatcgaggagaccgtgcgcgccatgaactgggtcatcgaccagggatgggccttctgctggggcacgtccgagtggtccgcgcagcagatcaccgaggcatgggcggtcgccaaccgcctcgacctcgtcgggcccatcgtcgagcagccagagtacaacctcttctcgcgacacaaggttgagtccgagtttgtacctctttacagcacctatggtattggtttaactacttggagtcctctagcttcaggagtactaactggaaaatatggcaaagggaacatacctgctgatagcaggtttgccctagacaattacaagaacttggctaacagatccctggtcgacgagacgctccgtaaagtgaatgggctaaaacccattgccgctgaacttggtgtctcattagctcaactttcaattgcttggtgtgcatcaaaccccaatgtctcatctgtgatcacaggagccactaaagaaagccagattgtggagaacatgaaggctcttgatgccattcctctgctgactccggaggtcctcgacaagatcgaggcggtagtccaaagcaggccgaaacgcactgagtcatacaggtgaagtgggtgcagaatgagtgccagggagagattcggctttcatctgatcagagtttaggccatgctacctcaccagcgtttgatatcatggaactatatgcatgctattgtgtattctgggtgtccagtcgtggtgctgtgttcaaaacatttcccatgtggtcacgaacagtagtttgtccttgtgtattctgcatttcccgatggcatctattccgattcctggtattccgtcctgcttgcattgtgaaatttgtggaggatccgtctttcaacaagaagaattattgaggaccctggatgatatgatcctaaaaaaaaaaaaaaaaaaaa

SEQ ID NO: 3902 - protein, 328 aa, Panicum virgatum
  misc_feature: Ceres CLONE 1795465
  misc_feature (1)..(312): Pfam Name: Aldo_ket_red Pfam Description: Aldo/keto reductase family
MQYKNLGRSGLRVSQLSYGAWVTFGNQLDVKEAKALLQACRDAGVNFFDNAEVYANGRAEEIMGQAIRDLGWRRSDVVISTKLFWGGQGPNDKGLSRKHIVEGLKGSLKRLDMDYVDIVYCHRPDASTPIEETVRAMNWVIDQGWAFCWGTSEWSAQQITEAWAVANRLDLVGPIVEQPEYNLFSRHKVESEFVPLYSTYGIGLTTWSPLASGVLTGKYGKGNIPADSRFALDNYKNLANRSLVDETLRKVNGLKPIAAELGVSLAQLSIAWCASNPNVSSVITGATKESQIVENMKALDAIPLLTPEVLDKIEAVVQSRPKRTESYR

SEQ ID NO: 3903 - DNA, 1642 bp, Panicum virgatum
  misc_feature: Ceres CLONE 1795466
  misc_feature: Encodes the peptide sequence at SEQ ID NO. 3904
aggacggaacggaaaccaggggaggaagacgagaagcctgcgcagggagcgcgagacggagaccatggtgcgggcatgggggcggacggcgctgcctccgctcctcatcctctgccttctccacctgcagtactccccgctggtcttcgctcaagaaggtcaagaaaaggaacctgctactctgttcgcacgagcatcggagatgatgaacctgaggaggtatgatggggcacttggcctgctaaatgctgtgttggaagttgacccaaatcattctgaagcttacaggcagcgtgcatcagtgctccgccataagtgcagatacaaggaagctgagatcgactataacaaatacctggagttaaatcctgggactgctacagtggaaaaggaattatctcagcttctgcaggctcaaagttcattacagtctgcttatggccagtttgattccggagacttttcaaaagtcctggaatacatcaacaaaattgtacttgttttttctccaggttgcttgaaggcaaagcttctcaaggctaaaacattgctagcacagaaagactactcaagtgttatttcagagacaggatttattctaaaggaagatgaagacaacttggatgcactgctactacgtggtcaggcttattattaccttgctgatcatgatgtggcctccaggcactaccagaaagggcttcgtcttgacccagagcattcagatttgaagaaagcatatttcgggttgaagaatcttttgaagaagtctaagagtgctgaagataatgctgccaagggtaagctacgtttgtctgctgaggactacaagaaagctctagcaatggatcctgaccatactgcatataatgtacatctttatctcgggttatgtaaaactctggttatacttgggagaggtaaggaggccatcagcagttgtactgaagcactcaacatagacagtgatcttgttgatgcgcttatacagagaggtgaagctaaacttctctcagaagattgggaaggagcggttcaggatctaaaagaggccgcccagaaatccccacaggacatgggcatccgtgaagcacttatgagagccgaaaagcagcttaagttgagcaaaagaaaagactggtacaaaatccttggtatttcaaagacagcatcagctgctgagataaagcgtgcctacaaaaagctggccttgcagtggcatccagataaaaacgtggataaccgggaggaagcagaaaacatgttccgagaaattgctgctgcttatgaggtgcttggtgatgaagacaaacgtgtgagatatgaccgaggagaggatgtcgacgagatgaacatgggaggaggcgggggtggcttcaatcctttcgggggaggaggccagcaatacacgtttcatttcgatggtggattcccgggtggtgggttccctggaggtggaggctttcagttcaactttggatgatattgccatactcatgtggaatcgtcataggaattcttagcggcagctgataactattcataggaaaggaagaatgctgagaccattcctattactgtacaagtgtttaagggcagctacgatttttccttggcattttaaaaaaaaaaaaaaaaaaaa

SEQ ID NO: 3904 - protein, 472 aa, Panicum virgatum
  misc_feature: Ceres CLONE 1795466
  misc_feature (1)..(64): Pfam Name: DnaJ Pfam Description: DnaJ domain
MVRAWGRTALPPLLILCLLHLQYSPLVFAQEGQEKEPATLFARASEMMNLRRYDGALGLLNAVLEVDPNHSEAYRQRASVLRHKCRYKEAEIDYNKYLELNPGTATVEKELSQLLQAQSSLQSAYGQFDSGDFSKVLEYINKIVLVFSPGCLKAKLLKAKTLLAQKDYSSVISETGFILKEDEDNLDALLLRGQAYYYLADHDVASRHYQKGLRLDPEHSDLKKAYFGLKNLLKKSKSAEDNAAKGKLRLSAEDYKKALAMDPDHTAYNVHLYLGLCKTLVILGRGKEAISSCTEALNIDSDLVDALIQRGEAKLLSEDWEGAVQDLKEAAQKSPQDMGIREALMRAEKQLKLSKRKDWYKILGISKTASAAEIKRAYKKLALQWHPDKNVDNREEAENMFREIAAAYEVLGDEDKRVRYDRGEDVDEMNMGGGGGGFNPFGGGGQQYTFHFDGGFPGGGFPGGGGFQFNFG

SEQ ID NO: 3905 - DNA, 1581 bp, Panicum virgatum
  misc_feature: Ceres CLONE 1795487
  misc_feature: Encodes the peptide sequence at SEQ ID NO. 3906
actcgcacagtcgcactcacccctgggctagttggcttgtgtcccttcccgttcgaaccaaaaccctctctcccctcacctccgtcccggatcaaacggccaccggaaaatccccgaaaaataactatcagctcgtcgccagagtaaacgccgcggcagaaccctagcgcgccctccctccgagatcggctcccctcccgcccgcccacccaccccgcatggcggccaacccctcctccggcgccgacgcccccccggccccggcgccggtgcggctctcggcggcggcgcaggtggccgcgatccagccctcatccccgcgcttcttcttctcctcgctcgcggggaccaacccggcctccccgcaccgccgcatcgccatcgccgtcgacctctccgacgagtccgccttcgccgtcaagtgggccgtgcagaactacctccgccccggggacgccgtcgtgctgctccacgtgcgccccacctcggtcctctacggcgccgactggggctccatcccggtctccgtcgccgacgaggccgacgccgccgaggacgccgccgccgccgcccagggcggccccaccgaggaggagctgcagaagaagcgggaggagtacttcgacgccttcacctccaccaaggcgcaggacctggcgcagccgctggtcgacgcgcagatccccttcaagatccacgtcgtcaaggaccacgacatgaaggagcgcctctgcctcgaggccgagcgcctgggcctctcggctatgatcatggggagccgtggttttggtgcccaccggaagggcggcaaggggaggcttgggagtgttagcgattactgcgtccatcactgtgtctgccctgttgtggtggttcgctacccggatgatgctacaggtgctggtggagatgcagcaggggtgatagatgagctgcacactgtaccggaggatgagcctgtttaccacgacgcccctgaggtgcagaaagaaaactgaggcaatggcagcagctgaagcacaaaggaaaacatgcagcttttagcaagggcatccttgtgtacgtgaagatgcaactggttgtttatctttgcttctatgtccactgcgtatcataaactgggttgatcagcaggctgcttgccgttttgagtttcatatcggagtcctagatcatcggagtctttgttggtttgtttgtgagatatttatgttggcgatgcaatgtagagtacacttcttccagtaggctggagctgtcttattatggtctacggatgcttatgctgtgctcccgaatctatcttgttttgcaaggccagttgaccgttgtattctctcgtagttgtctacacggtatcaggacatctattcagcttgctgctgtaatggatacttggttaatggaggaccgccacttctctgtatttactactttattggatggaataattgtctagtcgaacggtttcagctgctaaaaacacgagcttgtgcttgtgggtttcatgtctgtatttgtaagaccggtctgtgaagattttattagaaataaatttgtcaaaaaaaaaaaaaaaaaaaa

SEQ ID NO: 3906 - protein, 259 aa, Panicum virgatum
  misc_feature: Ceres CLONE 1795487
  misc_feature (1)..(166): Pfam Name: Usp Pfam Description: Universal stress protein family
MAANPSSGADAPPAPAPVRLSAAAQVAAIQPSSPRFFFSSLAGTNPASPHRRIAIAVDLSDESAFAVKWAVQNYLRPGDAVVLLHVRPTSVLYGADWGSIPVSVADEADAAEDAAAAAQGGPTEEELQKKREEYFDAFTSTKAQDLAQPLVDAQIPFKIHVVKDHDMKERLCLEAERLGLSAMIMGSRGFGAHRKGGKGRLGSVSDYCVHHCVCPVVVVRYPDDATGAGGDAAGVIDELHTVPEDEPVYHDAPEVQKEN

SEQ ID NO: 3907 - DNA, 2233 bp, Panicum virgatum
  misc_feature: Ceres CLONE 1795500
  misc_feature: Encodes the peptide sequence at SEQ ID NO. 3908
actagctacttgccatctatatatatctagaaatctaacagcaacctatgtcctatatacacatatagcatatggacatatacatgtagctcaaggactgcagataatccatatctgcgacagcaagcgaagtaaagcagcagcgcagttcgttcgcagctgtcggctagcgagaggatcggagaggccccgcgtcgtcatcgtcgtcgtcgatcgatcgctcgcgacgctcggacatgacgacgtacagggtgtgctgcttcctgcggcggttccgggcggcgtccaacgagccgtcggaggcggtcagggacgtgttccaggcgtacaccgacggcggcggcgtggtcggggaggaggcgctgcggaggctcctgcgggaggtgcagggggagaccgacgccggcgccgaggcggcggccaaggaggtgatggcgttcgcggcggagcagaggctgctcaagaagggcggcctcaccgccgagggcttccaccgctggctctgcagcgacgccaacgccgctctcgacccgcgccgtggggtttaccaggacatgggttcaccgctgtcgcactacttcatctacacgggccacaactcgtacctgacggggaaccagctgagcagcggctgcagcgagaggcccatcgtgaaagccctcctcgacggcgtcagggtcatcgagctcgatctctggcccaacaccgccaagaacgacgtcgaggtcctccacggcaggacattgacgtcgcccgtggagctgaacaagtgcctggacgccatcaaggagcacgccttcgcggcctccccctaccccgtcatcctcaccctggaagatcacctcaccccggacctccaagccaaagtggccaagatgctaaaggacaccttcagggacatgctgtacatctcggaatccgagaacatggcggagttcccttccccggattacctcaagggcaagatcatcatctccacgaagccgcccaaggagtacctccagacgaagagcggcaaggaggaggagaccgccgaagacagggccgaggagggcgtctggggggaggagatctccgacgacaaggccaccgccctgcagatgtcggagcagtacagcggcaagtacggcgcggaggaggccgaggaggagccgccggacggcgaggccgagaagaaggcgcggcagggggccgacaacgagtacaagcgcctcatcgccatccagctcacccggaggaagcacgacatggaccaggacctcaaggtcgacccggagaaggtgacgcggctgagcctgggggagaaggcgtacgagaaggccatcgtctcccacggggctcacatcatcaggtttacgcagagaaacctgctgcggattttcccgcggtcaacgcgcatcacgtcgtcgaactacaatccgttgatggggtggaggtacggggttcagatggttgcagcgaacatgcagggacacgggaggaaactgtggctgacccaagggatgttccgagcgaacggcggctgcggctacgtgaagaagcctgacatcctgatgaacagcgaccccgacaagctgttcgacccccgagccgatctgccggtgaagacgaggttgaaggtgacggtgtacatgggggacgggtggcggttcgacttccgcaagacgcatttcgacaagtgctcgccgccagacttctacgcaagggtgggggtcgccggcgtggcggcggacacgcggatggagcagacccgggtgatgatggacagctggatcccgacgtgggaccgcgagttcgagttcccgctggcggtgccggagctggcgctgctccgggtggaggtgcacgagtccgacaaccaccagaaggacgacttcggcggccagacctgcctgccggtgtgggagctccggccggggatccgctccgtccgcctctgcgaccacaagggccagccgctgcgatccgtcaagctgctcatgcgcttcgagttcttcccctcctcctcctcctccaaataaaacctcactgtcactgtcgtgatgacgcgctggatttcggaggattctttgtttgttgtttctgttgcttgtgcatggaaattgttcggtactgctgcgtgtgatccgggactgtgactgggagtgtgattgtgattatcattatattggtggtgataagtaacttaataaaaaagagaggcttttgttcagaaaaaaaaaaaaaaaaaaaa

SEQ ID NO: 3908 - protein, 594 aa, Panicum virgatum
  misc_feature: Ceres CLONE 1795500
  misc_feature (1)..(145): Pfam Name: PI-PLC-X Pfam Description: Phosphatidylinositol-specific phospholipase C, X domain
MTTYRVCCFLRRFRAASNEPSEAVRDVFQAYTDGGGVVGEEALRRLLREVQGETDAGAEAAAKEVMAFAAEQRLLKKGGLTAEGFHRWLCSDANAALDPRRGVYQDMGSPLSHYFIYTGHNSYLTGNQLSSGCSERPIVKALLDGVRVIELDLWPNTAKNDVEVLHGRTLTSPVELNKCLDAIKEHAFAASPYPVILTLEDHLTPDLQAKVAKMLKDTFRDMLYISESENMAEFPSPDYLKGKIIISTKPPKEYLQTKSGKEEETAEDRAEEGVWGEEISDDKATALQMSEQYSGKYGAEEAEEEPPDGEAEKKARQGADNEYKRLIAIQLTRRKHDMDQDLKVDPEKVTRLSLGEKAYEKAIVSHGAHIIRFTQRNLLRIFPRSTRITSSNYNPLMGWRYGVQMVAANMQGHGRKLWLTQGMFRANGGCGYVKKPDILMNSDPDKLFDPRADLPVKTRLKVTVYMGDGWRFDFRKTHFDKCSPPDFYARVGVAGVAADTRMEQTRVMMDSWIPTWDREFEFPLAVPELALLRVEVHESDNHQKDDFGGQTCLPVWELRPGIRSVRLCDHKGQPLRSVKLLMRFEFFPSSSSSK

SEQ ID NO: 3909 - DNA, 1708 bp, Panicum virgatum
  misc_feature: Ceres CLONE 1795503
  misc_feature: Encodes the peptide sequence at SEQ ID NO. 3910
gactccctctctctctcccacaaaccaaggccacggttcctgaccaccaccaccacggcaccaccaccaccaccagcagccagtgcccggatccggcgagggtgcgccggagcagctagcgacgaggtgaactgatcgatcgaccggcagcagcagcagcatggggctgaggaagcgcctgctgctgtgcttcgggcgcggcggcgaggaggagcggcggcaggaggagaagcgggaggaggcggggggcaagcgccccggcggcggcggcggggggaagccgaagctgcggcggctgagcacggcgaacctgcggtcgctgtcgctgcaggacctgtcgcggaagctggagaccaccaggctgcacgccttcacgctggacgagctcaaggccgccaccaagaacttctccgccgcctacttcctcggcgagggcggcttcggccccgtctacaagggcttcgtcgacgcccgcctccgcccgggcctcctcgagccccagcacgtcgccgtcaagtacctcgacctcgagagcgacggcgtccaggggcaccgcgagtggctggcggaggttgtgtacctcgggatgctgagccacccgcatctggtcaagctggtggggttctgcaaccaggacgaccaccggatgctggtctacgagtacatgcccaggggcagcctcgagaaccacctcttcaagaatctcctcgcgtcgctgccatggtcgacgcgcctcaagatcgccgtcggcgccgccaaggggctggcgttcctgcacgaggcggagactccggtgatctaccgcgacttcaaggcctccaatattctgctcgattcggactacaccgcgaagctgtctgatttcgggctggccaaggagggccccaaaggggacgcgacgcacgtgacgacgcgcgtgatgggcacccacgggtacgcggcgccggagtacatcctgacgggccacctgacggccaagagcgacgtgtacagcttcggcgtggtgctgctggagctgctcacggggcggcgctccgtggacaagcgccgccgcgggcgcgagcagaacctcgtcgactgggcgcgcccctaccttcggcgcgccgacaagctgcaccgggtcatggacccgggcctggagatgcagtactcggcgcgcgccgccgagaaggcggcccgggtggcgcaccagtgcctgcagagcgtgcccaaggcgcggccctccatgcgcgacgtcgtggccgcgctggagccgctgctcgcgctcgaggacgacgtgcccacggggcccttcgtgtacacggtcggcggcgccgcgccggccgccgccgcggcgggcggcgacgaggagcaggaggaggaggaggcggcggaggccggcggccggcagggcaagaggcacgtcatgtccgccgtgcacgcggagagcccgctgcgctacgcgagcgcggtgaagagaccggagagcccgccgaccctgagcagagcgtgagagcatggcgagaaccggcgaagggatcgcaatctacaagtgtacatagctgacaacgacgtgtccatggattcttttgtttttgggtttcttggtgatgttattaattcttgctcccaggaatttagaggggagagatcttctttcgtttcccattgtgttattattagtataccgccgagaatatgaatacctcaaaaaaaaaaaaaaaaaaaa

SEQ ID NO: 3910 - protein, 443 aa, Panicum virgatum
  misc_feature: Ceres CLONE 1795503
  misc_feature (63)..(369): SWISSPROT Homolog: EC 2.7.11.1 Protein kinase APK1A, chloroplast precursor
  misc_feature (63)..(371): SWISSPROT Homolog: EC 2.7.11.1 Protein kinase APK1B, chloroplast precursor
MGLRKRLLLCFGRGGEEERRQEEKREEAGGKRPGGGGGGKPKLRRLSTANLRSLSLQDLSRKLETTRLHAFTLDELKAATKNFSAAYFLGEGGFGPVYKGFVDARLRPGLLEPQHVAVKYLDLESDGVQGHREWLAEVVYLGMLSHPHLVKLVGFCNQDDHRMLVYEYMPRGSLENHLFKNLLASLPWSTRLKIAVGAAKGLAFLHEAETPVIYRDFKASNILLDSDYTAKLSDFGLAKEGPKGDATHVTTRVMGTHGYAAPEYILTGHLTAKSDVYSFGVVLLELLTGRRSVDKRRRGREQNLVDWARPYLRRADKLHRVMDPGLEMQYSARAAEKAARVAHQCLQSVPKARPSMRDVVAALEPLLALEDDVPTGPFVYTVGGAAPAAAAAGGDEEQEEEEAAEAGGRQGKRHVMSAVHAESPLRYASAVKRPESPPTLSRA

SEQ ID NO: 3911 - DNA, 951 bp, Panicum virgatum
  misc_feature: Ceres CLONE 1795526
  misc_feature: Encodes the peptide sequence at SEQ ID NO. 3912
aatactcccctgccgcagacactgccacgcacattcccccatggcggcagccacggcctcgcgccccctcacgcccctcctccaccggcaccacccccgcagccggcggcgcgcgagcgccgtcgtcattgccgccgcgagcgcgccggacgccgagccgacggccgcagccggggcggccgcggggcaggagaagaagaagacggtggacacgaggatacactggtccgacccggaggaagggtggatcggtggcaaggccaagaaggacggcgctggcggccgtagcaagaacgagccgctgggagggaggttcgccgacctcatcagcgccgcttccgagtctcactatcagttcctggggattgctccagaggcggacatcgaggagatcaaggcggcgtaccggcggctgtccaaggagtaccacccagacacgacgactctgccgctcaaggtggcgtcggagaagttcatccgcctccgggaggtgtacaacgtgctgagcaaggaggaaagccggcggttctacgactggacgctggcgcaggaggccgagagccggcggctgcagcagatgaggtccaggctcgagaacccctacgagcaggacatacagaactacgagtccgtgccagacatggtcgaccgactcggcggcagaaacatgaagctcagcgaccaggccatgaccgccctcaccatcgatttcgtcatcatcatcatctccgtcatctgcatcatctacgccgtgttcttcaaggagcagtactgacagcagcgtattaacagcagcaaggttgaaggagtgtaccatatacagaacaatattcctaggtaaattaaatgataatacctcaagactgtctttacagatgttgttcatatacagtgtcatgatgttatgtcaaatagggcaagagcaacaaataaaaaaaaaaaaaaaaaaaa

SEQ ID NO: 3912 - protein, 244 aa, Panicum virgatum
  misc_feature: Ceres CLONE 1795526
  misc_feature (1)..(64): Pfam Name: DnaJ Pfam Description: DnaJ domain
MAAATASRPLTPLLHRHHPRSRRRASAVVIAAASAPDAEPTAAAGAAAGQEKKKTVDTRIHWSDPEEGWIGGKAKKDGAGGRSKNEPLGGRFADLISAASESHYQFLGIAPEADIEEIKAAYRRLSKEYHPDTTTLPLKVASEKFIRLREVYNVLSKEESRRFYDWTLAQEAESRRLQQMRSRLENPYEQDIQNYESVPDMVDRLGGRNMKLSDQAMTALTIDFVIIIISVICIIYAVFFKEQY

SEQ ID NO: 3913 - DNA, 2227 bp, Panicum virgatum
  misc_feature: Ceres CLONE 1795537
  misc_feature: Encodes the peptide sequence at SEQ ID NO. 3914
aaaaaaaaaacccaccattccgcccccgcccgtgacgcgagagaccacttcgcatcccgaggcggcgccttttagttcgggtcgggggctgacgggcgggtggtggaggtggcggcggtgagcagcgacgggcgaggcgagcgcgagcccgagccggagcaggggcaccatgtgcggcatcctcgccgtcctcggcgtcgccgacgtttccctcgccaagcgcgcccgcatcatcgagctctcgcgcaggttacggcatcgaggacctgattggagtggtctgcactgccaccaggattgctatcttgcacaccagcggttggctattgttgatcccacatctggagaccagccgttatacaatgaggacaaatcaattgttgtaacggtgaacggagagatctataaccatgtagagttgaaagctaagttgacaactcatcaattccaaactggcagtgattgtgaagttattgcccatctctatgaagaatatggggaagaatttgtggatatgttggatggcatgttcgcgtttgttcttcttgatacacgtgataaaacctttatcgcagctcgtgatgctattggcatctgccctttatacatgggatggggtcttgatgggtcagtttggttttcttccgagatgaaggcattgagcgatgattgtgaacgcttcataaccttcccacctggacacctgtactccagcaaaacaggtgctctaaggagatggtacaacccaccatggttttcagagagcattccctcaaccccgtacaatgctctcctcctccgagagatgtttgagaagtctgttatcaagaggctgatgtctgatgtgccatttggtgtactcttatctggtggacttgactcttctttggttgcatctgttgcttcacgatacttagaagaaacaaaagctgccagtcagtggggaaacaaactgcataccttttgtatcggcttgaagggttctcctgatcttaaagctgctaaggaagttgctgactacctcaacactgtacatcatgaactccactttacagtgcaggaaggcattgatgccttggaagaagtcatctaccatattgagacatatgatgttacgacgatcagagcaagtaccccaatgtttttgatgtcacgtaaaatcaaatctttgggggtgaagatggttctttctggagaaggctcagatgaaatttttggtggatacctttactttcataaggcaccaaacaagaaagaattccatgaggaaacatgtcggaagataaaagctctacatttatatgactgtttgagagcaaacaaagcaacttctgcctggggtgttgaggctcgtgttccattccttgacaagagtttcatcaatgtagcaatggacatcgatcctgagtggaagatgataagacgtgaccttggtcggattgaaaagtgggttattcgtaatgcattcgatgatgagaagaggccatatttacctaagcacattctatacaggcaaaaggaacagttcagtgatggtgttgggtatagttggattgatggattgaaggaccatgcaagtcaacatgtctcggattccatgatgatgaatgctagctttgttttcccagagaacacacccacaacaaaagaaggatactattatagaacgatattcgagaaattattcccgaagcccgcggcaaggtcaactgtccctggaggtccaagtgtggcatgcagcaccgccaaagctgttgaatgggacgcggcctggtcgaagaaccttgatccatctggtcgtgctgctctgggtgtacacgatgctgcgtatgaaggtactcccggggaagctcctgcagccatccatccagttacagataacagccttcgtccagctattggtgaaagcctcgtgaaacctgttgcttaagccactgctgtctaagcttctgttgtctcataagaatgctcgaacaagaagattgttcgctagttatttcagctttttttaagatcatgttgcaagttccttcagtctagccatggagacatggtcatgctccatgcctggcatgtttggtttacattgtacacactgcttgtttgttttatgcactgattagagcgttgtaaatatttgtccatgggactgatctccttttgctgtttatctaatttacagattgcagtggttaatgtagtttttcaaaaaaaaaaaaaaaaaaaa

SEQ ID NO: 3914 - protein, 586 aa, Panicum virgatum
  misc_feature: Ceres CLONE 1795537
  misc_feature (1)..(578): SWISSPROT Homolog: EC 6.3.5.4 Asparagine synthetase [glutamine-hydrolyzing]
  misc_feature (1)..(586): SWISSPROT Homolog: EC 6.3.5.4 Asparagine synthetase [glutamine-hydrolyzing]
MCGILAVLGVADVSLAKRARIIELSRRLRHRGPDWSGLHCHQDCYLAHQRLAIVDPTSGDQPLYNEDKSIVVTVNGEIYNHVELKAKLTTHQFQTGSDCEVIAHLYEEYGEEFVDMLDGMFAFVLLDTRDKTFIAARDAIGICPLYMGWGLDGSVWFSSEMKALSDDCERFITFPPGHLYSSKTGALRRWYNPPWFSESIPSTPYNALLLREMFEKSVIKRLMSDVPFGVLLSGGLDSSLVASVASRYLEETKAASQWGNKLHTFCIGLKGSPDLKAAKEVADYLNTVHHELHFTVQEGIDALEEVIYHIETYDVTTIRASTPMFLMSRKIKSLGVKMVLSGEGSDEIFGGYLYFHKAPNKKEFHEETCRKIKALHLYDCLRANKATSAWGVEARVPFLDKSFINVAMDIDPEWKMIRRDLGRIEKWVIRNAFDDEKRPYLPKHILYRQKEQFSDGVGYSWIDGLKDHASQHVSDSMMMNASFVFPENTPTTKEGYYYRTIFEKLFPKPAARSTVPGGPSVACSTAKAVEWDAAWSKNLDPSGRAALGVHDAAYEGTPGEAPAAIHPVTDNSLRPAIGESLVKPVA

SEQ ID NO: 3915 - DNA, 3427 bp, Panicum virgatum
  misc_feature: Ceres CLONE 1795552
  misc_feature: Encodes the peptide sequence at SEQ ID NO. 3916
accgcaactgcagctgctagctagcccggcgcgcgcccccctctccagccacctagctagcctcgcttgccggcctccccgcccgcccgcgcacggcgccatggcgtcctccgagcgccaccactccatcgacgcgcagctccggcagctggcccccggcaaggtctccgaggatgacaaactcgtcgagtacgacgtcctcctcatggagcgcttcctcgacatcctccaggacctccacggccccgccatccgcgaattcgtccaggactgctacgagctgtcggcggagtacgagggcgaccgcaacgccgcgcgcctcaaggagctcgggtccaggctcgccgcgctggcccccgccgacgccatcctcgtcgcgggctccatccagcacatgctcaacctcgccaacctcgccgaggagctgcagatcgccaaccgccgccggaacaagctcaagagcggggacttcgccgacgagggctccgccaccaccgagtccaacatcgacgagaccatcaagcgcctcgtcgacctcggcaagtccaaggaggaggtgttcgaggcgctcaagaaccagtccgtcgacctcgtcctcaccgcgcaccccacgcagtccgtccggaggtcgctcctccagaagcacgccaggatccggaactgcatcaatcagctgaatgccaaggacgtcacggaggacgaaaagaaggagctcgacgaggctctttccagggagatccaagcagccttcagaactgatgagatccggagagcacagccgaccccacaggacgaaatgcgttacgggatgagctacatccacgaaaccatctggaagggtgttcccaagtttctgcgtcgtctggacactgctctgaagaacatcgggatcgacgagcgtctcccctacaatgttcctctcatccagttttgttcttggatgggtggcgaccgtgatggaaacccaagagttacgcctgaggtgacaagggatgtatactacctgtcacggatgatggctgcaaacttgtacttctatgggctagaagaactcatgtttgagctctctatgtggcgctgcaacgacgaactccgtgctcgcgcgcaagaaatacacagtgctccgaagaaagctgccaagcactacatagaattctggaagcaaattcctctaagtgagccgtatcgcgtggtgcttggtgacgtgagggacaaactgtacaacacccgcgagcgtgcgcgccaactgctgaccaatgagttttctgacattccggaggaattgacctttagcaatgttcagcagttcctggagccccttgagctgtgctacaaatcactgtgcgagagcggcgacaagacgatcgccgacgggaggctgctggacttcctccggcaggtctccgccttcgggctctccctcgtgaagctggacatccggcaggagtcggagcggcacaccgacgtgatcgacgccatcaccacgcacatcggcatcggctcctaccgctcctggcccgaggagaagcgccaggagtggctgctgtccgagctgcaaggcaagcgcccgctgctcgccccggacatgccccagaccgaggagatcgccgacgtgctcggctgcttccgcgtcctcgccgagctgccccgcgacagcttcggcccctacatcatctccatggccaccgcgccgtcggacgtgctcgccgtcgagctcctgcagcgcgagtgccacatacgcgacccgctgcccgtggtgccgctcttcgagaggctcgccgacctgcagaacgggcccgcgtccatggagcgcctcttctccgcggactggtacctgaagcggatcaacggcaagcagcaggtcatgatcggctactccgactccggcaaggacgccggccgcctgtccgcggcgtggcagctgtacagggcgcaggaggagctcgcgcaggtggccaagaaatacaacgtcaagctgaccatgttccacggccgcggcggcaccgtcggcaggggtggcggcccgtcgcacctcgccatcctgtcgcagccgccggacaccatcaacgggtccatccgggtgacgatccagggcaaggtcatcgagcactccttcggcgaggagcacctctgcttccggacgctggagcggttcacggcggcgacgctggagcacggcatgcacccgccggtgtcccccaagcccgagtggcgcaagctcatggacgagatggccgtcgtggccacggacgagtaccgctccatcgtcgtcagggagccgcgcttcgtcgagtacttccgatcggccacgcctgagacggagtacggcaagatgaacatcggcagccggccggcgaagaggaagccccagggcggcatcacgtcgctccgcgcgatcccctggatcttctcgtggacgcagacgaggttccacctccccgtgtggctcggcgtcggcgccgcgttccagtccgccattaagaaggacagcaagaacatccagaagctcaaggagatgtacaaggagtggcccttcttcagggtcaccattgacctgctggaaatggtcttcgccaagggggaccccagcatcgccgccttgtacgacaagctgcttgtcgccgacgagctcaagcccttgggggagcagctgaggaacaagtacctggagacgcagcagcttctcctgcagatcgctgggcacaaggaaatcctcgagggcgatccctacctcaagcaggggctgcggctgcgcaacccctacatcacgacgctgaacgtgttccaggcctacaccctgaagctgatgagggacccgagcttcaaggtcgagaagcagccgccaatgtccaaggagttctccgacgagaagaagcccgccgggctggtggagctcaaccctgccagcgagtacccgccggggctggaggacacgctcatcctcaccatgaagggtatcgccgccggcatgcagaacaccggctaggaggccaccggctgccctgctcctctgcgctccgctcctcaactgcagagtactgctgctcatcaaggcaccagcgtgtcgatgcgcatgtatccttttcaattcacgcttgatgtacgtgtcggctgtgtcaaacctgtgtccgtgtctggtttcgtttgtctgagctggagctcggcttgtttgctcaccgagcccagcgcgtcctgtatggttgagccagaggcgtagtccacgccgtggcgcgtcgcgtcggcgcgcggcatgatctagcgtgcgggatggcgcacgcggagagcggatcatggcgcgcgcgtgcagggacggcgagaccaagctctgcctttcctttttcacactcggtttgtaataatcgatacatatatgaataaataaaggggtcaatacagaaaaaaaaacgccgcacgttacgcgcgcggc

SEQ ID NO: 3916 - protein, 961 aa, Panicum virgatum
  misc_feature: Ceres CLONE 1795552
  misc_feature (1)..(750): Pfam Name: PEPcase Pfam Description: Phosphoenolpyruvate carboxylase
  misc_feature (3)..(961): SWISSPROT Homolog: EC 4.1.1.31 Phosphoenolpyruvate carboxylase 3
  misc_feature (5)..(961): SWISSPROT Homolog: EC 4.1.1.31 Phosphoenolpyruvate carboxylase 1
MASSERHHSIDAQLRQLAPGKVSEDDKLVEYDVLLMERFLDILQDLHGPAIREFVQDCYELSAEYEGDRNAARLKELGSRLAALAPADAILVAGSIQHMLNLANLAEELQIANRRRNKLKSGDFADEGSATTESNIDETIKRLVDLGKSKEEVFEALKNQSVDLVLTAHPTQSVRRSLLQKHARIRNCINQLNAKDVTEDEKKELDEALSREIQAAFRTDEIRRAQPTPQDEMRYGMSYIHETIWKGVPKFLRRLDTALKNIGIDERLPYNVPLIQFCSWMGGDRDGNPRVTPEVTRDVYYLSRMMAANLYFYGLEELMFELSMWRCNDELRARAQEIHSAPKKAAKHYIEFWKQIPLSEPYRVVLGDVRDKLYNTRERARQLLTNEFSDIPEELTFSNVQQFLEPLELCYKSLCESGDKTIADGRLLDFLRQVSAFGLSLVKLDIRQESERHTDVIDAITTHIGIGSYRSWPEEKRQEWLLSELQGKRPLLAPDMPQTEEIADVLGCFRVLAELPRDSFGPYIISMATAPSDVLAVELLQRECHIRDPLPVVPLFERLADLQNGPASMERLFSADWYLKRINGKQQVMIGYSDSGKDAGRLSAAWQLYRAQEELAQVAKKYNVKLTMFHGRGGTVGRGGGPSHLAILSQPPDTINGSIRVTIQGKVIEHSFGEEHLCFRTLERFTAATLEHGMHPPVSPKPEWRKLMDEMAVVATDEYRSIVVREPRFVEYFRSATPETEYGKMNIGSRPAKRKPQGGITSLRAIPWIFSWTQTRFHLPVWLGVGAAFQSAIKKDSKNIQKLKEMYKEWPFFRVTIDLLEMVFAKGDPSIAALYDKLLVADELKPLGEQLRNKYLETQQLLLQIAGHKEILEGDPYLKQGLRLRNPYITTLNVFQAYTLKLMRDPSFKVEKQPPMSKEFSDEKKPAGLVELNPASEYPPGLEDTLILTMKGIAAGMQNTG

SEQ ID NO: 3917 - DNA, 1652 bp, Panicum virgatum
  misc_feature: Ceres CLONE 1795565
  misc_feature: Encodes the peptide sequence at SEQ ID NO. 3918
cccatctttttcgcctctccaccgaggccaccgcttcgccccctcacacaccgcacctggaggctggagctaggtttttagcgccgcctccccccttctcgctgcggcggccgcacgcgccgacctcctcccggaagaagtccctagcgccggccgcttccactccgtgccagatcgttgtttatgagctcgaaggagaaacccaccctcagagggacgcggatcaagacccgcaagaggaatatcgcggctccattggaccctgcatcattctctgatgcaattgtccagatttatgttgacaatggtggagatctggaacttgtcgccaaaagtatcgagtcctctgatctcaacttctcacgttatggtgacaccttttttgaggttgttttcgttggaggacgaactcagcctggcacaataaaacctgaagaagaaggagaccgccacccttattcggtgctagattgtgcagcacagcgtgaagcaattttaccttctgtactctatattcagaaaacattacgcaggaggcctttcttaccaccaatcgaccaaccaccgcaccctaccgatcgatcactagcaagctcctttccaagaagaagctctagatagtagatcgatcggcagatagcaacaatggcggcgcggctgcctccgctggctctgctcgcggcgtccctcgccgtcatggcggccgtcgcgtcgaccgactcctggctctacgagaagttcaacacggacggcaccgtccgcgcggactacgacgcgtcgggccagcaggtcgccatgctcaacctcgaccggagctccggcgccgggttcaactccaaggagcagtacctctacggcgagttcagcatccagatgaagctcatccccggcaactccgccggcaccgtctcgtgcttctacctctcttccggtgacagcgacgaccacgacgagatcgacatggagttcatgggcaactcgagcgggcagccggtggtgctcaacaccaacgtgtgggccagcggcgacggcaagaaggagcaccagttcgacctgtggttcgacccggccgccgactaccacacctacaccattgtctggaaccccaccaacatcctcttcaaggtcgacggcaccgtcatccgctgcttcaagcgctacgacgacctgccctacccgagctccaggcccatggcgctgcacgccacgctgtgggacggcagctactgggccaccgagaagggcaaggtctccatcgactgggcgagggcccccttcgtcgtctcctaccgcggctactccgccgacgcctgcgtcagcggcggcgcgtgccccgccggcagcgaccggtggatgaacaagcagcccgacgccgccgaatggggcaccgtcaagtgggcggagagcaactacatgcgctacaactactgcgaggacgggtggaggttcccacaggggctccccgccgagtgcagccgcagctgatcgagctgatgatgattcgtccgccgtcggatctatccattgttaataagctcttgatttgtttcttttaattttgttggatgtccgtatgattcttgatctgtggctgtgaatttgtgattaaaaggaagccccgcatggagcgagagaatactagttttcttgtg

SEQ ID NO: 3918 - protein, 279 aa, Panicum virgatum
  misc_feature: Ceres CLONE 1795565
  misc_feature (1)..(180): Pfam Name: Glyco_hydro_16 Pfam Description: Glycosyl hydrolases family 16
  misc_feature (34)..(276): SWISSPROT Homolog: EC 2.4.1.207 Xyloglucan endotransglucosylase/hydrolase protein 22 precursor
  misc_feature (8)..(278): SWISSPROT Homolog: EC 2.4.1.207 Xyloglucan endotransglycosylase/hydrolase protein 8 precursor
MAARLPPLALLAASLAVMAAVASTDSWLYEKFNTDGTVRADYDASGQQVAMLNLDRSSGAGFNSKEQYLYGEFSIQMKLIPGNSAGTVSCFYLSSGDSDDHDEIDMEFMGNSSGQPVVLNTNVWASGDGKKEHQFDLWFDPAADYHTYTIVWNPTNILFKVDGTVIRCFKRYDDLPYPSSRPMALHATLWDGSYWATEKGKVSIDWARAPFVVSYRGYSADACVSGGACPAGSDRWMNKQPDAAEWGTVKWAESNYMRYNYCEDGWRFPQGLPAECSRS

SEQ ID NO: 3919 - DNA, 1533 bp, Panicum virgatum
  misc_feature: Ceres CLONE 1795572
  misc_feature: Encodes the peptide sequence at SEQ ID NO. 3920
agcgtggtgcagtgtagcaggtgcaggcccctcgccgccgtgcccgccctctttccgctgccccccgcttctcttcttcctcttcctcttcctctttccttccacaccatccaggccactgctggtttctcattggcgaggcgaggcgaggcgaggtcctcgtggccatggcagcgagtaggaggagggtcttctccttgccggtggcggcggcgtgcctggttgttgtcctgctgcggtgcctgtcggcgtccggcgagcccctgccgcagtactacaatgccatcttcagcttcggcgactccttctccgacacgggcaacttcgtgatcatcaactccggcaagctgcccaacatgcccaagttcccgccgccgtacgcgcgctgctccaacgggcgcctcgtcatcgacttcctggccgaggcgttcggtctgccgctgctccctccgtcggcgaacaagggcaccaacttcagccagggcgccaacttcgcggtgatgggcgcgactgcgctggacctcaagtacttcaaggacaacaacgtgtggagcatcccgcccttcaacacctccatgaacgtgcagctgcagtggttcgacgaggtgaagcagaccatctgctcggacccagcagagtgccgcgccttcttctccaagtccctgttcgtgttcggcgagttcggcggcaacgactacagcttcgcgtggaaggcggagtggtcgctggagaaggtgaagacgatggtgccggcggtggtggcgtcgctggtgcgcggcgtggagcggctgctggacgagggcgcccggcacgtggtggtgccggggaacctccccgccgggtgcatccccatcacgctcaccatgtacccctccgaggaccggtccgagtacgacccccgcacgggctacctcaagcgctacaacagcgtcgcgctctaccacaacgccatgctccggatcgccctcgaccgcctgcagcgccgccgcccagaggcgcgcgtcgtctacgccgactactacacgccctacatccagttcgcgcgcacgccgcatctctacgggtacaagcgcggcgccctccgcgcgtgctgcggcggcggcgggccgtacaactacaacatgagcgcctcctgcggcctgcccgggtcgacgacgtgcgaggaccccgacgcgcacgtgagctgggacggcatccacctcacggaggcgccctaccgcttcatcgccaacacctggctcaagggcccctacgcgcacccgccgctcgcgaccgtcgtccgcgaggacatggtcgactgactcatgatcaccgtccatccatccatccatcctggtgataccgtgtgtgtgtcactgtgcgcgcgagtgtgtgtgcgcttgctgcctgcaagaagaagagatgatagtgagagtgctaatggtataacggatgtgagtgagtgagtgcattccatttgttagtgtatattttggttgggataagtaagtgaaatcgatcggtgcttaggttcaaaaaaaaaaaaaaaaaaaa

SEQ ID NO: 3920 - protein, 377 aa, Panicum virgatum
  misc_feature: Ceres CLONE 1795572
  misc_feature (1)..(318): Pfam Name: Lipase_GDSL Pfam Description: GDSL-like Lipase/Acylhydrolase
MAASRRRVFSLPVAAACLVVVLLRCLSASGEPLPQYYNAIFSFGDSFSDTGNFVIINSGKLPNMPKFPPPYARCSNGRLVIDFLAEAFGLPLLPPSANKGTNFSQGANFAVMGATALDLKYFKDNNVWSIPPFNTSMNVQLQWFDEVKQTICSDPAECRAFFSKSLFVFGEFGGNDYSFAWKAEWSLEKVKTMVPAVVASLVRGVERLLDEGARHVVVPGNLPAGCIPITLTMYPSEDRSEYDPRTGYLKRYNSVALYHNAMLRIALDRLQRRRPEARVVYADYYTPYIQFARTPHLYGYKRGALRACCGGGGPYNYNMSASCGLPGSTTCEDPDAHVSWDGIHLTEAPYRFIANTWLKGPYAHPPLATVVREDMVD

SEQ ID NO: 3921 - DNA, 1742 bp, Panicum virgatum
  misc_feature: Ceres CLONE 1795573
  misc_feature: Encodes the peptide sequence at SEQ ID NO. 3922
gatctcccacgggttcccctcgatggcgacgccccgctccccaagcccccgcgccgacgcgcccctcgactcggcgccgcttctgggcggcgccaccggcggcgggagccggcgccgaggcggcgcgctccggcggccctccctccgcggcgcggcgcgtctgctacgccggggcgggcggcgggcgatgcgggagccgtcggtgctggtgcgggaggccgcggcggagcaccttgaggagcggcaggcggactgggcctactcccgccccgtcgtggcgctcgacctgctctggaacctcgccttcatcaccgtcgccgcggtcgtgctggtgctcagccgggacgaggactcgcccatgccgctccggacctgggtcgccggctacgccctccagtgcgtcgtccacatggtctgcgtcgcgatagagtaccggatgcgccacggcccgcgcggtggaggcccagcgcccgccgacgaggaaaggggcagcgatggatcgtcctcgtccagcgacgaggatgacagggagcttgatcgccgtggtcgccgcaccgattacgccagtattgcaaagcacttggagtctgctaatacgatgttctccttcatatggtggataattggattttactggatatctgctggaggtgaagaggttatccgggatgcacctcaactttactggctttgcatagtctttctggcatttgatgtgttctttgttgtattctgtgttgctctggcttgtatcattggtattgctgtttgttgttgcctcccttgcatcatagcaattctctatgcagtatctgatcaggaaggggcatctgaagatgatattcgtcaaatcccaaggtacaaatttcggcggactgatgagcccgaaaagcaagatgttgaccccatggggccttttggtggaataatgacagagtgtggcacaaatcaacctattgagaaagtgcttgcagctgaagatgcagagtgttgtatctgcctttcggcatatgacgacggtgcagagctgcgcgaactcccttgtgggcaccatttccactgcacatgcatcgataagtggctgcacatcaatgcaacatgccccctgtgcaagtacaacattcggaaaagcagcagtagcagtggaagtgaagaagtatgaatgtccgccccttgacaattccaatccgtttcgactttgtgcctgtgccgttgctaatatgactccaggttgtgtccggtgtaaatttttgtatccaaatgtgctgatagagtcaatcaattatggccctgtttagttccccccgtaaacgcaaaaaagccgtaaacgcaaaattttgcgaaggaatcttgctaatttgaagaactaaatgaagtttatttacaaaacttttttcatggatgggctgtaaatcgcgagacgattctaatgagcctacttaatctataatttgcaacagtgatgctacagtaaccatccgctaattattgattaatcatggattaattagcatcattagattcgtctcgcgatttacaactcatctgtgcaaaaagttttgcaaatagacttcatttagtacttcaaattatctagatttctttgcaattttttttgcgtttacacccccatcggatctaaacagggcctattgtactaaagttactcaaagtgctgtccatatgtcgcataagttaataaatagttgggtgtgcacctgcaaaaaaaaaaaaaaaaaaaa

SEQ ID NO: 3922 - protein, 379 aa, Panicum virgatum
  misc_feature: Ceres CLONE 1795573
  misc_feature (1)..(41): Pfam Name: zf-C3HC4 Pfam Description: Zinc finger, C3HC4 type (RING finger)
MATPRSPSPRADAPLDSAPLLGGATGGGSRRRGGALRRPSLRGAARLLRRGGRRAMREPSVLVREAAAEHLEERQADWAYSRPVVALDLLWNLAFITVAAVVLVLSRDEDSPMPLRTWVAGYALQCVVHMVCVAIEYRMRHGPRGGGPAPADEERGSDGSSSSSDEDDRELDRRGRRTDYASIAKHLESANTMFSFIWWIIGFYWISAGGEEVIRDAPQLYWLCIVFLAFDVFFVVFCVALACIIGIAVCCCLPCIIAILYAVSDQEGASEDDIRQIPRYKFRRTDEPEKQDVDPMGPFGGIMTECGTNQPIEKVLAAEDAECCICLSAYDDGAELRELPCGHHFHCTCIDKWLHINATCPLCKYNIRKSSSSSGSEEV

SEQ ID NO: 3923 - DNA, 3609 bp, Panicum virgatum
  misc_feature: Ceres CLONE 1795593
  misc_feature: Encodes the peptide sequence at SEQ ID NO. 3924
gcgcaaggcaacaaaggaaaggagccccaacccaagcaagcgcggcgcccctcccccttctccccactccctcccctcttccgcgttcagttcccacccccattccctcctgccgccgccgccgccgcacgcgcgcctccctcactcggccggcggggtagccagaggaggagccgcctgagatctggagatctggtagtgcgagggggatggaggccagcgccgggctggtcgccggctcgcacaaccggaacgagctcgtcgtcatccgccgcgatggcgagccagggctgaagccgctgaaccagcagaacgggcaggtgtgccagatttgcggcgacgacgtggggctcaatcccgacggcgagcccttcgtcgcctgcaacgagtgcgccttccccatctgccgggactgctacgagtacgagcgccgcgagggcacgcagaactgcccgcagtgcaagacccgcttcaagcgcctcaaggggtgcgcgcgtgtaccgggggatgaggaggaggacggcgtcgatgacctggagaacgagttcaactggacggacaagcacgactcccagtatgtcgccgagtccatgctccacgcccacatgagctacggccgcggcgccgactttgatggtgtgccgcagcccttccagcccaacccaaatgttcccctcctcaccaacgggcagatggttgatgacatcccaccggaacagcacgccctggtgccatctttcatgggtggtggtgggaagaggatccaccctcttccatacgctgatccaaaccttcctgtgcaaccaaggtctatggacccatccaaggatctcgccgcgtatggctacgggagtgtagcatggaaggagaggatggagagctggaagcagaagcaggagaggatgcaccagatgaggaacgaaggaggtggcaacgatgatggtgatgatgcagatctaccactaatggatgaagctagacagccattgtccagaaagattccacttccttcaagccagatcaatccctatagaatgattatcataattcgactagtggttttggggttcttcttccactatcgagtgatgcatccggtgcctgatgcatttgctttatggcttatatctgtcatctgtgagatatggtttgccatgtcttggattcttgatcagttcccaaagtggtttcctattgagagggaaacctatcttgaccggttgactttgaggtttgacaaggaagggcagccttctcaactcgccccagtcgatttctttgtcagtacagttgatcccatgaaggaacctccgttggtcacagcaaatactgttctatctatcctggcagtggattatccagttgataaggtttcatgctatgtttctgatgatggtgctgccatgctgacatttgaagcattgtctgaaacatctgaatttgcaaagaaatgggttcctttctgcaaaaaatacagtattgagcctcgtgctccagaatggtacttccaacagaagatagactacctgagagataaggtggctacaaacttcgttagggagcggagagcaatgaagagagaatatgaggaattcaaggtcagaatcaatgccttggttgctaaagcccaaaaggttcctgagaaaggatggacaatgcaggatgggactccatggcctggaaacaacgttcgtgatcatcctggaatgattcaggtgttccttggtcaaagtggtggcaatgatgtggaaggaaatgagctgcctcgattggtttatgtttcaagagaaaaacggccaggctacaaccatcataagaaggctggtgctatgaatgcattggtccgagtctctgctgtactaactaatgcaccatatatgctgaatttggattgtgatcactacgtcaataacagcaaggctattaaggaagcaatgtattttatgatggatcctttgctaggaaagaaagtttgctatgtgcagtttcctcaaaggttcgatgggattgatcgtcatgatcgatacgccaacaggaatgttgtcttttttgatatcaacatgaaaggtttggatggtattcaaggccccatatacgtcggtactggatgcgtcttcagaaggcaggcattatatggctacgatgcccccaaaacaaagaagccaccatcaaggacttgcaactgctggccaaagtggtgtgtttgctgttgctgttttggtaacaggaagaccaagaagaagaccaagagatcaaagcctaaatttgagaagataaagaagcttttcaagaaaaaggaaaatcaagcccctgcgtatgctcttggtgaaattgacgaagctgctccaggagcggaaaatgaaaaggctagtattgtaaatcaacagaagttagaaaagaaatttggccagtcttcagtttttgttgcttccacacttcttgagaatggtggtaccctgaagagtgccagtccagcttctcttctaaaggaagctatacatgtcatcagttgtggctatgaggacaagacagactgggggaaagatattggttggatttatggatcagttacagaagatattcttactgggtttaagatgcactgccatggttggcgatcaatttactgcatacctaaatgggccgccttcaaaggttccgcacctctcaatctttctgatcgtcttcaccaggttcttcggtgggctcttggttcgatcgaaattttcttcagcaaccattgccctctttggtatggatatggtggtggactaaaatttctggaaaggttttcctacattaactccatcgtatacccgtggacatccatcccgctcttggcctattgcacattgcctgctatctgcttgctgacagggaaatttattacgccagagcttgacaatgctgccagcctctggttcatgtcactttttatctgcatttttgctacgggtatcctggaaatgagatggagtggtgtaggcatcgatgattggtggagaaatgagcagttttgggtcattggaggagtgtcttcgcatctctttgccgtgttccaaggacttctcaaggtcatagctggtatagatacgagcttcactgtgacgtcaaagggtggagatgatgaggagttctcggagctgtacacattcaaatggactacccttctgatacctccaaccactctgctcctcttgaacttcattggagtggtggctggtgtttccaatgcaatcaacaacggatatgaatcctggggacccctctttgggaagctcttctttgcattttgggtgattgtccatctgtacccgttcctcaagggtttggttgggaggcagaacaggacgccaacaattgtcattgtctggtccatcctcttggcttcaattttctcgctgctttgggtccggatcgatcctttccttgcgaagaacgatggtcccctcttggaggagtgtgggttggattgcaactaggaggtcagcatgtaaacttccccatcagtgttgtgctcgaagaagtatttctgcagatgttttgtgcccatatttttccaatttttcctctgtagatagaaacacggaaaaaaaaaaaaaaaaaaaa

SEQ ID NO: 3924 - protein, 1090 aa, Panicum virgatum
  misc_feature: Ceres CLONE 1795593
  misc_feature: Great-hit functional homolog of the protein sequence encoded by LOCUS At2g21770
  misc_feature: Great-hit functional homolog of the protein sequence encoded by LOCUS At4g39350
  misc_feature: Great-hit functional homolog of the protein sequence encoded by LOCUS At5g09870
  misc_feature: Great-hit functional homolog of the protein sequence encoded by LOCUS At5g64740
  misc_feature: Great-hit functional homolog of the protein sequence given in SEQ ID NO 9308
  misc_feature: Great-hit functional homolog of the protein sequence given in SEQ ID NO 9313
  misc_feature: Great-hit functional homolog of the protein sequence given in SEQ ID NO 9315
  misc_feature (1)..(413): Pfam Name: Cellulose_synt Pfam Description: Cellulose synthase
  misc_feature (1)..(1089): SWISSPROT Homolog: EC 2.4.1.12 Cellulose synthase A catalytic subunit 2 [UDP-forming]
  misc_feature (1)..(1089): SWISSPROT Homolog: EC 2.4.1.12 Cellulose synthase A catalytic subunit 6 [UDP-forming]
  misc_feature: Useful for making plants with altered cell wall content and/or composition
MEASAGLVAGSHNRNELVVIRRDGEPGLKPLNQQNGQVCQICGDDVGLNPDGEPFVACNECAFPICRDCYEYERREGTQNCPQCKTRFKRLKGCARVPGDEEEDGVDDLENEFNWTDKHDSQYVAESMLHAHMSYGRGADFDGVPQPFQPNPNVPLLTNGQMVDDIPPEQHALVPSFMGGGGKRIHPLPYADPNLPVQPRSMDPSKDLAAYGYGSVAWKERMESWKQKQERMHQMRNEGGGNDDGDDADLPLMDEARQPLSRKIPLPSSQINPYRMIIIIRLVVLGFFFHYRVMHPVPDAFALWLISVICEIWFAMSWILDQFPKWFPIERETYLDRLTLRFDKEGQPSQLAPVDFFVSTVDPMKEPPLVTANTVLSILAVDYPVDKVSCYVSDDGAAMLTFEALSETSEFAKKWVPFCKKYSIEPRAPEWYFQQKIDYLRDKVATNFVRERRAMKREYEEFKVRINALVAKAQKVPEKGWTMQDGTPWPGNNVRDHPGMIQVFLGQSGGNDVEGNELPRLVYVSREKRPGYNHHKKAGAMNALVRVSAVLTNAPYMLNLDCDHYVNNSKAIKEAMYFMMDPLLGKKVCYVQFPQRFDGIDRHDRYANRNVVFFDINMKGLDGIQGPIYVGTGCVFRRQALYGYDAPKTKKPPSRTCNCWPKWCVCCCCFGNRKTKKKTKRSKPKFEKIKKLFKKKENQAPAYALGEIDEAAPGAENEKASIVNQQKLEKKFGQSSVFVASTLLENGGTLKSASPASLLKEAIHVISCGYEDKTDWGKDIGWIYGSVTEDILTGFKMHCHGWRSIYCIPKWAAFKGSAPLNLSDRLHQVLRWALGSIEIFFSNHCPLWYGYGGGLKFLERFSYINSIVYPWTSIPLLAYCTLPAICLLTGKFITPELDNAASLWFMSLFICIFATGILEMRWSGVGIDDWWRNEQFWVIGGVSSHLFAVFQGLLKVIAGIDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPLLEECGLDCN

SEQ ID NO: 3925 - DNA, 1473 bp, Panicum virgatum
  misc_feature: Ceres CLONE 1795601
  misc_feature: Encodes the peptide sequence at SEQ ID NO. 3926
gaactcggtcgtctcttctcatcatcgcccctgctcctcctcccaccttcctccttatcccacccaaattgacctcgccgcctgccgggccgccacatcctcctccccgcttcgaacgaccgcgccgcggaacccatctcctggcctctcgtccaccgaggcgcgtcgcgtcgaattccttgcctcccagtcgtcgtcggcggcggcgtcgttggcatcgttattatcctcgctggtggtgctggacttgcgcgggcgggcggcagatccacccgagctcggattgatttcgtccttcgctgctgtagtgtcagcaactgaatcaaaaacacttttcatggaagctgggagaatggatcagccttgcatggctgctatcaatagccagcctttggtggctgatgttgaggcagtgaagaaagcaagtggggacatgcctgcaacaatgggaagtggatgcttcgactgcaacatctgccttgattttgcagcagaacctgtggttaccctctgtggtcacctttactgctggccttgcatctatgagtggctgcgccctggggtggagtcaactgccagtgacaacagcagttcagcaaggcggcagtgccccgtatgtaaggcaacactctccccggatacactagtaccactgtatggccgtggagggagctcaaagaaatcgctgaacggcatgtccatcccgcgccgtcccacggtgcaccgggagactgttgagcatcataacacacagagcaacgtcaatgaccagcagcaccaccagagcatggaaaccaaccctccgcatcagccattgcggcacgcacactaccatcccagttccactgggttcgacttcatctaccctccggcaccactaggacgtggcttgatccactccactgccggaggggtgctcggagggatggcagaggctgtgctcccgttggtgctcggtggccagctgccagcaagcttgtactatacaagcccttaccatgtcgcggcacagaacgtgaaccccaggctgaggcggcatcagatggagattgagaggtccctccaccagatctggttcttcctcttcgtgtttgtggtgctgtgcttgctcttgttctgagacaagactgtgccctgtgcacctctctgtagatatcgaaagtgggagaggggatactaatggatgatgcgtatagtgaagagggtaacgggttgtcgataagcatgtgcgtaagcatgctgataatagagttgtattatgatgagacatggaggtaaaatgcattcatacttctcgtcttgatgtcaggagctgttgcttctttcttgcttgcctggccggcctgtcaccatcggctggttaggttgcctactcatcatgttgttcattggttggtgtcactgccaagggcaattggatctgtatataaataaaaaatgatgtttggctaccaaaaaaaaaaaaaaaaaaaa

SEQ ID NO: 3926 - protein, 260 aa, Panicum virgatum
  misc_feature: Ceres CLONE 1795601
  misc_feature: Great-hit functional homolog of the protein sequence given in SEQ ID NO 9603
  misc_feature (1)..(51): Pfam Name: zf-C3HC4 Pfam Description: Zinc finger, C3HC4 type (RING finger)
  misc_feature: Useful for making plants with altered alkaloid content
MEAGRMDQPCMAAINSQPLVADVEAVKKASGDMPATMGSGCFDCNICLDFAAEPVVTLCGHLYCWPCIYEWLRPGVESTASDNSSSARRQCPVCKATLSPDTLVPLYGRGGSSKKSLNGMSIPRRPTVHRETVEHHNTQSNVNDQQHHQSMETNPPHQPLRHAHYHPSSTGFDFIYPPAPLGRGLIHSTAGGVLGGMAEAVLPLVLGGQLPASLYYTSPYHVAAQNVNPRLRRHQMEIERSLHQIWFFLFVFVVLCLLLF

SEQ ID NO: 3927 - DNA, 1868 bp, Panicum virgatum
  misc_feature: Ceres CLONE 1795608
  misc_feature: Encodes the peptide sequence at SEQ ID NO. 3928
agagagagatagagaaacagagcgcgggcaccaatggcggcagctgcctcgtcagcccctccacttctcgccttcttgcagctcctgctgctcctcgcggccttctcaccggccacagccacagcatcgcgctcctccaaccccaaagcgccgttcccggccgtcactcctctgcacctgcaggctctccggcagcagcgggcgcgggccggctcgtccgctgccaagcacgtcgccgccgatggcgccagcgccagcgacggcacggcagcgaagccgttcacggcgcactacttcccgcaggagctggaccacttcaccttcacgcccaacgcgtccatgctcttccaccagaggtacctcgtcaacgacaccttctggcggaggcccaccggcggcaaaggcgccgccgggccgctgttcgtgtacaccggcaacgagggcgacatcgagtggttcgccaccaacaccgggttcatgttcgacatcgcgcccaagttcggcgccctcctcgtcttcatcgagcatcggttctacggggagtcgaagccgttcggcaacgactcgtacaattctgccaagacgctgggctacctgacgtcaacgcaggcgctcgccgacttcgccatcctcattagaagcctgaagcacaacctctccaccgaggacgccccggtcgtcgtcttcggcggctcctacggcggcatgttggcttcatggttcaggctcaagtacccccacgtcgccattggggctctggcatcctcggcgccaatcctgcagttcgactacataacaccgtggagcagcttctacgatgccgtctcgcaagactacaagtctgagagtttgaactgcttcagcgtcatcaaggcaacttgggatgtgctggatgagagaggggccaatgacaaagggctcctggagctcagtaaactattcaaagcctgcaagactgtgaaatattcttattcgatccgaaactgactgtggacagcattcacctacactgccatggtggactatccaaccccggccaatttcctagagaatctacctgcctaccccgtcaaggagatgtgcaagatcatcgatgggtaccccgcgaacacagacattctggaaaaggcattcgcagcggccagtttgtactacaactacacaggaaacctgacttgcaatccgatagaggatgaagatgatccacatggccttggtggctggcaatggcaggcttgcaccgagatgatcatgccaatgacaatctccaatgaaagcatgttcccaccatccaatttcagttatgatgacaggtcagatgaatgccttcagagctggggggttcggctgaggccgcattggatcaccaccgaatatggtggatataaaattgataaggtgctcaagagatttgggagcaacattattttctccaatggaatgcgagatccatggagtcgaggcggggtgctcaagaacatctcatccagcattattgcccttgtcacagagaaaggggctcatcatttggacttaagatcggcaacgaagggtgatcctgactgggttatagaacaaaggagacaagaagttgagatcatacagggatggatagatcagtatcatcaggacatggctggaatataatactgactacagagaatgtgctattgcagttacagtcaaggaaaagaaatatttgatccgtggaaacaacaaaagaaaaaaaaaaggaaaaaaatccttcttacacaggatgatcagcagagcaagttaagataatataaggtgaaagtaaaaaaaatgtcactgaggaacagaaactgttaatctcaaatggtcttacataaaaaaaaaaaaaaaaaaaa

SEQ ID NO: 3928 - protein, 317 aa, Panicum virgatum
  misc_feature: Ceres CLONE 1795608
  misc_feature (1)..(229): Pfam Name: Peptidase_S28 Pfam Description: Serine carboxypeptidase S28
MAAAASSAPPLLAFLQLLLLLAAFSPATATASRSSNPKAPFPAVTPLHLQALRQQRARAGSSAAKHVAADGASASDGTAAKPFTAHYFPQELDHFTFTPNASMLFHQRYLVNDTFWRRPTGGKGAAGPLFVYTGNEGDIEWFATNTGFMFDIAPKFGALLVFIEHRFYGESKPFGNDSYNSAKTLGYLTSTQALADFAILIRSLKHNLSTEDAPVVVFGGSYGGMLASWFRLKYPHVAIGALASSAPILQFDYITPWSSFYDAVSQDYKSESLNCFSVIKATWDVLDERGANDKGLLELSKLFKACKTVKYSYSIRN

SEQ ID NO: 3929 - DNA, 1551 bp, Panicum virgatum
  misc_feature: Ceres CLONE 1795615
  misc_feature: Encodes the peptide sequence at SEQ ID NO. 3930
caaaaccccaccccccacctcgctctcctccccttccccatcgccatcgccatcggaatctccagccagcggctcccgcccgctcgtacttctcccgtcatatgtggagtttgaacggtggttccatttgtgctggggatgtgaatttgttggagggagaaggatttttattctagccatacccaatggagtgtccaagctcaactagttcccaagggcatcatgtgaatggaaagcagagcattgatccccctggtcctgccactgagaagaacggaccaagacaccgtccgctgactccaatgagacgatgccatggagtgttatgtttggtggttatgctattaacagcattcatgatgatggtttacctgtcacctactactactttcctcctacggttgttcagtgtgcattacagcagaaaatcaacatgctttctgtttggtatgtggctagcattgtggccctttttgttcgagaaggttaacaagaccaggtttattttctctggtgaaagtgtgcccccaaaagggcgcgtgttgttgtttgctaaccacaggactgaggttgattggatgtacttgtgggattttgcactgaggaaaggccgtttgcagtgtatcaagtatatgcttaagaaaagcttgatgaagttgcctgttttcaattggtcatttcaccttattgagtttatcccagtagagcgcaagtgggagattgatgagccaatcatccgaaggaggctatcagaatttaagaatcccagggatcccctttggctggcagtttttcctgaaggcactgattatactgagaagaaatgtatcagaagtcaagagtacgcagtagagcatggtttgcctattctgaaaaatgtactccttccaaagacaaagggattcaattgctgtttgcaagagctgaggagttctatagatgctgtttatgatatcacaatcgcatataaacataggctaccgacttttttggacaacgtttatggcatcgatcctgccgaagtccacatccatatcaacagcatccaagtctctgacataccgacatcagaagacgaagtggctacttggttgatcgagcggttccgattgaaggacgagctcctgtccaatttctcgaaactaggccacttcccaaatgaagggactgaaggggatctgtcaacactaaagtgccttgcgaatttcaccgcggtgatcagtgttacaggaatcctcacgtacctgaccctgttctcgtccgtgtggttcaaggttttcgtagtgtttagctgtgtgtttcttacggtcacgacctgctactctatacatctgccccagctgataggttcccctgaggtgagcgcccgtccgaaggtgtcttgattgtaacttgtgttgtaactgaaggctggaagctggatgtcacagctcgtaaccaccacgctcggagtgtatgtgcatatgtgttcatggtgtatctgttactgggaacattgtgtttggttcagctgctgggagtattctttgccaaaaaaaaaaaaaaaaaaaa

SEQ ID NO: 3930 - protein, 399 aa, Panicum virgatum
  misc_feature: Ceres CLONE 1795615
  misc_feature (1)..(137): Pfam Name: Acyltransferase Pfam Description: Acyltransferase
MECPSSTSSQGHHVNGKQSIDPPGPATEKNGPRHRPLTPMRRCHGVLCLVVMLLTAFMMMVYLSPTTTFLLRLFSVHYSRKSTCFLFGMWLALWPFLFEKVNKTRFIFSGESVPPKGRVLLFANHRTEVDWMYLWDFALRKGRLQCIKYMLKKSLMKLPVFNWSFHLIEFIPVERKWEIDEPIIRRRLSEFKNPRDPLWLAVFPEGTDYTEKKCIRSQEYAVEHGLPILKNVLLPKTKGFNCCLQELRSSIDAVYDITIAYKHRLPTFLDNVYGIDPAEVHIHINSIQVSDIPTSEDEVATWLIERFRLKDELLSNFSKLGHFPNEGTEGDLSTLKCLANFTAVISVTGILTYLTLFSSVWFKVFVVFSCVFLTVTTCYSIHLPQLIGSPEVSARPKVS

SEQ ID NO: 3931 - DNA, 1745 bp, Panicum virgatum
  misc_feature: Ceres CLONE 1795626
  misc_feature: Encodes the peptide sequence at SEQ ID NO. 3932
agtcctcagtcctcacaaaagatccaagaattccagggcaggatttccaaaatggccacgccaagatcctcccccaactcctagcacatgccatgcgcaacaattttgatctctctctccgaaaagatttcattccattcaatcccattccgtccttttttgggttggtcataaagcagagctgctccttggatccacggcggtttagcggtttcctttcccctggctccgtgagattgatccaggctgcgatgagcggcggcaactcgtcgtggctgatgcctccgccgtcgccgccgcagccccagccgtcggcgctcgacaacgtggaggccaagataagcccgagcatcctcttcatcgtggccatcctggcgatcgtcttcttcgtctgcggcctgctgcacctgctcgtgcgccacctgctgcggctgcgccgccgccgccgcacgcgggaggacgcggagagcgtcacggcgttccagggccagctgcagcagctgttccacctgcacgacgccggcgtcgaccaggccttcatcgacgcgctcccggtgttcctctaccgcaacgtcgtcggcgccgccggccaagccgagggcaaggacccgttcgactgcgccgtctgcctgtgcgagttctcgcccgacgaccagctccggctgctgcccaagtgcagccacgcgttccacctagagtgcatcgacacatggctgctctcgcactccacgtgcccgctctgccgccggagcctcctcgccgagctctcgccgacgtgcagccccgtcgtcatggtgctcgagtcagagagctcccgcgatatgggcgcgtcggcgacgcgggccaccgacgccgccgacggccagccgagcggtctcgctttggcgcaggacggagcagaggaggtggtcgaggtgaagctgggaaagtttatgtgcgtggaaggtaacggcaatgcgaatgccaccgccaacgacggcgatggggccggcaccagcagcgacggcaatggcgacgccaatgccgaggccggtatcgggcaaagaaagtgccactccatggggtcctacgagtacgtcatggacgagcgcgcctcgctccgcgtggcgatcaagccgcccaagaagaagcccgcggtgtccaagtcgcgccgccgcggtgccatttcggagtgcgagttcggcgcgtccaagcgcggggagacatcgctccgcctcccattcacagcaatggtccagcagcagcagcagcagtcggagtcggacacggctatggcgaggctcaccaaggacagcttctccgtgtccaagatttggatggtgccgtcgtccaagaaggacccggaagcggccggcgagaggcgcgcggtgtcgttccggtggccggtgagcaaggacgaggaagaaggcaagaacaagaagagcgggagcgaggcagactgggacgtcgaggctgggagctgcggcggcaacagtgtggtgtcgtcggtcgccgaggagaggccatcgttcgcgaggaggaccctgctctgggtcgtcggaggccggcaacagagcagagtcggagctgttcccgatcaggatacctgaagagagaaaaaaaaaggaaattatttccctctttctttgtgttctttggcggattggtggtagcgagtagcgattgcaatagctagaaatttgtaaaacccaaaaggctctgaagaattctttctttcgcttgtgcaaaaaaaaaaaaaaaaaaaa

SEQ ID NO: 3932 - protein, 498 aa, Panicum virgatum
  misc_feature: Ceres CLONE 1795626
  misc_feature (1)..(42): Pfam Name: zf-C3HC4 Pfam Description: Zinc finger, C3HC4 type (RING finger)
MRNNFDLSLRKDFIPFNPIPSFFGLVIKQSCSLDPRRFSGFLSPGSVRLIQAAMSGGNSSWLMPPPSPPQPQPSALDNVEAKISPSILFIVAILAIVFFVCGLLHLLVRHLLRLRRRRRTREDAESVTAFQGQLQQLFHLHDAGVDQAFIDALPVFLYRNVVGAAGQAEGKDPFDCAVCLCEFSPDDQLRLLPKCSHAFHLECIDTWLLSHSTCPLCRRSLLAELSPTCSPVVMVLESESSRDMGASATRATDAADGQPSGLALAQDGAEEVVEVKLGKFMCVEGNGNANATANDGDGAGTSSDGNGDANAEAGIGQRKCHSMGSYEYVMDERASLRVAIKPPKKKPAVSKSRRRGAISECEFGASKRGETSLRLPFTAMVQQQQQQSESDTAMARLTKDSFSVSKIWMVPSSKKDPEAAGERRAVSFRWPVSKDEEEGKNKKSGSEADWDVEAGSCGGNSVVSSVAEERPSFARRTLLWVVGGRQQSRVGAVPDQDT

SEQ ID NO: 3933 - DNA, 2239 bp, Panicum virgatum
  misc_feature: Ceres CLONE 1795627
  misc_feature: Encodes the peptide sequence at SEQ ID NO. 3934
acgttcgactccgctcgtgtgtggggtatacagacgaacacctcgcgcctcgcggggacaaaccagccactcgtcgccgcgcgctcctcgattccggaaccttcctgcggacggaatgtgtggatgctcggccctcgtcgccggaggccgggcgcctccgtcctccatccctcgccggctccgccgccgccgagggagctccgtgcgggcagaggtctcgccaggcgccgagtccgagcggaagaaggtcgccgtcgcgggcgccggctgggccggccttgccgccgcgcaccacctcgtcaaacagggatacgatgtcacgcttctcgccgcagaggacggcccaaccgaggaggttggcctcagaggattctggtatccgtaccgcaacatcttcgctttagtcgatgagctggggatctcgcctttcacggactggaagaaagcagcctactattctgcagagggacttacggttgaattccccatatttcataaccagccacggttaccagctccctttggagtctttgcatatccagagttccctaaccttactttgattgataggttgacatcaattcctgtcatagctgcagtcattgactttgacaacacagacactgcttggaggaaatatgactcaatgactgcaagagagctttttaagatgtatggttgctctcaaaggctctacagggaagtctttgagccagctattcaggcagccctgtttgctcctggtgagcagtgtagtgcagctgcaacactggggatgttgtactattatatgctgtctcatcaggaaaattctgacttcttgctgtgccgtggtgacgtagaagaaaaaattttctctccctggcttcaatcattagagatggaaggcttaaaatttgtaccaaacaaagttccatcaagcttgactatagatacggatagtggatgcatctctgctattatctgtggtgacgagatatataaggcagatgcatttgtttcagccatgggactctcttctctacagtccattgtaaaaaacagtccattcctatggtctcatcaagaattcaccaatcttcttcacctgtctacagtcgacgtgatctctataaaattatggcttgataaaaagatcacaattccaaatgttgcgaatgtatgtcccggttttgatgattcatccggctggacgttctttgaccttacctcaatatatgatgattattatgaagaaccaatgacagtagtggagattgagttttataatgctagctggctagtaactctaagtgatgatgatattgtctctgaagcttcattgcatcttatcaagtgcataccagattttgagggtgctactgtgatccaaaaatcagtcagaagatctcctaaatctgtaatcaactttcttccaggttcctacaagtacacaccaagaggatcaacttcatttccgaatttgtttattgctggtgattggattgtcaaccgacatgggtccttttcaaaagaaaaagcatatgtgactggacttgaggccgctaatagggtggtagactattttggcactggagactttgccaaaataattgcagttgaaggagatgagcctcatatagagacattgcgtagtctcagcagaagagccaatgaactgaagtcacagattccactctcggagttctttctccaataatgtggttcgggtttttccatatgactgttgaccaatgcccattgttgtaggcccatatgtaaaagtatttgttgaaacacacacacatatatatacaacctcttccatcgttagaccagagagttgcctcaggtgtaacttcccttcctcatcatttccacaaactcttcatagtcgatattcccatcctgtgaattcagtgggggtgatgattaaatctatgcaaatggaattggttagtcggaagaatattcttaccttgtctttatcaacttcgtctagtacttgtttaatgcttgcttcatcacccattccatactctgccatggcttgttccagttcgtctcttgttatgtacctgcagttgttatgtatgttgtctcgggttaatcatactaaaccttttttgttttattaataatgatttcgaccaattgaaacgacaaagtgatggtagcatgtattgagcattgttaattttttatatgaaaaaaatgagtggcatgtaatttgcctttacaaaaaaaaaaaaaaaaaaaa

SEQ ID NO: 3934 - protein, 527 aa, Panicum virgatum
  misc_feature: Ceres CLONE 1795627
  misc_feature (1)..(442): Pfam Name: Amino_oxidase Pfam Description: Flavin containing amine oxidoreductase
  misc_feature (1)..(33): Pfam Name: Pyr_redox_2 Pfam Description: Pyridine nucleotide-disulphide oxidoreductase
MCGCSALVAGGRAPPSSIPRRLRRRRGSSVRAEVSPGAESERKKVAVAGAGWAGLAAAHHLVKQGYDVTLLAAEDGPTEEVGLRGFWYPYRNIFALVDELGISPFTDWKKAAYYSAEGLTVEFPIFHNQPRLPAPFGVFAYPEFPNLTLIDRLTSIPVIAAVIDFDNTDTAWRKYDSMTARELFKMYGCSQRLYREVFEPAIQAALFAPGEQCSAAATLGMLYYYMLSHQENSDFLLCRGDVEEKIFSPWLQSLEMEGLKFVPNKVPSSLTIDTDSGCISAIICGDEIYKADAFVSAMGLSSLQSIVKNSPFLWSHQEFTNLLHLSTVDVISIKLWLDKKITIPNVANVCPGFDDSSGWTFFDLTSIYDDYYEEPMTVVEIEFYNASWLVTLSDDDIVSEASLHLIKCIPDFEGATVIQKSVRRSPKSVINFLPGSYKYTPRGSTSFPNLFIAGDWIVNRHGSFSKEKAYVTGLEAANRVVDYFGTGDFAKIIAVEGDEPHIETLRSLSRRANELKSQIPLSEFFLQ

SEQ ID NO: 3935 - DNA, 1103 bp, Panicum virgatum
  misc_feature: Ceres CLONE 1795629
  misc_feature: Encodes the peptide sequence at SEQ ID NO. 3936
gctcttcgctctagcttgctcccgtgctgatctttactagtagtggttgcctggtgtcgagaggaagcccccggagcacgggaggccggggagcttctcgaggagcgaggggcgcggccatgaggatccagtgcgacgcgtgcgagggcgcggcggccacagtggtgtgctgcgcggacgaggcggcgctgtgcgcgcgctgcgacgtcgagatccacgccgccaacaagctcgccggcaagcaccagcgcctcccgctcggcggcggcgccggcgccggcggggacgtcccgcgctgcgacgtctgccaggagaagccggccttcatcttctgcgtcgaggacagggcgctcttctgccgcgactgcgacgagcccatccacgtcctcggcacgctctcggggaaccaccagcgctacctcgccaccggcatccgcgtcggcttcagctccgtctgcgccaccgtcagctccgtctgcggcgccggcgccgacgtccttccgccgcctaagggcagctcaaagcccgcggctgccgccgggtccgctaaggcgccggccagtaagcccgcgcagccgcaggaggtgccgtcgtcgccgttcctgccgccgtccgggtgggccgtcgaggacctcctgcagctctccgactacgaatccagcgacaagaaggactcgcctctcgagttcaaggagctggagtggttcgcggacatcgacctgttccacggccacgcgccggccaaggccacgacggccgaggtccccgagctcctcgccacgccgcagccggcgagcaacgcggggttctacaagacgagcggtgcgcgccagagcaagaagccgcgggtggagctgcccgacgacgaggacgacttcttcatcgttcctgatcttggctgagacgtaaagtcttctcatggttcccctcatcccctgtcatgtgatgtgtatgtatgcaaagtatgtgtgtatgcactgatcgcttacgctgggcttatgtaattataaggcagtttggggccggtactttcagcctgaaaattgagatgggtttgatgtctgagatgaactcacttggagcaaaaaaaaaaaaaaaaaaaa

SEQ ID NO: 3936 - protein, 260 aa, Panicum virgatum
  misc_feature: Ceres CLONE 1795629
  misc_feature (3)..(48): Pfam Name: zf-B_box Pfam Description: B-box zinc finger
MRIQCDACEGAAATVVCCADEAALCARCDVEIHAANKLAGKHQRLPLGGGAGAGGDVPRCDVCQEKPAFIFCVEDRALFCRDCDEPIHVLGTLSGNHQRYLATGIRVGFSSVCATVSSVCGAGADVLPPPKGSSKPAAAAGSAKAPASKPAQPQEVPSSPFLPPSGWAVEDLLQLSDYESSDKKDSPLEFKELEWFADIDLFHGHAPAKATTAEVPELLATPQPASNAGFYKTSGARQSKKPRVELPDDEDDFFIVPDLG

SEQ ID NO: 3937 - DNA, 1675 bp, Panicum virgatum
  misc_feature: Ceres CLONE 1795633
  misc_feature: Encodes the peptide sequence at SEQ ID NO. 3938
atatatacagccatacatacacacggcaaccggaaacaaatcagtgccgcttacacttgaacaataagcgcccgacgagatgggctccatcgccgccgacgccggcaagccgcacgccgtgctggtgccgttcgcggcgcagggccacgtcacgccaatgctgaagctgggcaaggtcctccactgctggggcttccatgtcaccttcgtgaacacggagtacaaccaccgccgcctcctccgctcccgcggcgccggcgcgctcgacggcctcccgggcttccgcttcgccaccatcccggacggcctgccgccgtccgacgcggacgtcacccaggacgtggcctcgctctgccgttccacggcggagacctgcctcccgcacttcaggagcctcctcgccgagctcaacgcctccacggacgcgccgccggtcacctgcgtcgtcggcgacgacgtcatgagcttcaccctggaagccgccagggagatcggcgtgccgtgcgcgctgctctggacgtccagcacctgcggctacacgggctaccgctactaccgcaccctcatcgaagagggcgtcttccctctcaaagaggagcagctgacgaatgggttcttggacacgccggtggagagcgcgcccgggttgagcaagcacatccggttcaaggacctcccaagcttcatccgttcgacggaccccgacgagttcatggtccatttcgccctcaaggtgacggagcaaatagccgccgcggacgccgccgtcctcaacaccttgtacgaactcgagcaggaggcggtcgacggcatgcgcgccatgatcccgcctgccgcgtccatccacaccgtcggcccgctcgctctgctcgccgagcagatcgtgccccatggaggccagctcgaagcgctgggctccaacctctggaaggaggacggctcctgcctcgcctggctggagggccggaggcccgggtccgtggtgttcgtcaactacggcagcatcacggtgatgaccaacgcggagctggtggagttcgcgtgggggctggccaacagcggccacgacttcctgtggatcatccggccggacctcgtgagcggcgacgctgccgtgctgccgccggagttcctggaggcggtagaggggcgcggcctgctggcgacctggtgcccgcaggaggcggtgctgcggcacgaggcggtgggcgtgttcctgacgcactccgggtggaactcgacgctggagagcctctgcgccggggtgccgatgctgtgctggcccttcatcgcggaccagcagaccaactgccggtacaagtgcgccgagtggggcgtggccatggagatcggccacgacgtgcggcgggagaccgtggaggggaagatacgggaggccatggacggggagaaagggaaggagatgcggcgccgcgcggcggagtggcgggaggcggccgtgcgcgcgacgcggcccggcgggggctcgtacgccagcctcgagaagctggtgaacgacgtgctcctgtcgggtggcaagagctcttgaattcaacctactattaggatgcgtgtatgctgtgtccacttggcggtattgttgtactcttcaataatgtccgtactggaccaagctaagatggaggcgagttgacaaaaaaaaaaaaaaaaaaaa

SEQ ID NO: 3938 - protein, 489 aa, Panicum virgatum
  misc_feature: Ceres CLONE 1795633
  misc_feature (2)..(121): Pfam Name: UDPGT Pfam Description: UDP-glucoronosyl and UDP-glucosyl transferase
MGSIAADAGKPHAVLVPFAAQGHVTPMLKLGKVLHCWGFHVTFVNTEYNHRRLLRSRGAGALDGLPGFRFATIPDGLPPSDADVTQDVASLCRSTAETCLPHFRSLLAELNASTDAPPVTCVVGDDVMSFTLEAAREIGVPCALLWTSSTCGYTGYRYYRTLIEEGVFPLKEEQLTNGFLDTPVESAPGLSKHIRFKDLPSFIRSTDPDEFMVHFALKVTEQIAAADAAVLNTLYELEQEAVDGMRAMIPPAASIHTVGPLALLAEQIVPHGGQLEALGSNLWKEDGSCLAWLEGRRPGSVVFVNYGSITVMTNAELVEFAWGLANSGHDFLWIIRPDLVSGDAAVLPPEFLEAVEGRGLLATWCPQEAVLRHEAVGVFLTHSGWNSTLESLCAGVPMLCWPFIADQQTNCRYKCAEWGVAMEIGHDVRRETVEGKIREAMDGEKGKEMRRRAAEWREAAVRATRPGGGSYASLEKLVNDVLLSGGKSS

SEQ ID NO: 3939 - DNA, 2154 bp, Panicum virgatum
  misc_feature: Ceres CLONE 1795634
  misc_feature: Encodes the peptide sequence at SEQ ID NO. 3940
cccgtccgtgcggtgaggcccagccgcgagcggtgcgccccacacggtctcgtactctcatgccggcgccgcccggccagtaaagagagacgccgcgggggcgcgcgcgagcgggcgtggagcgggagggcgatgacgccgccgccgcatggccggagaggcgggcacgggggcggcggcgcgctgggccggcgcgcgtacgcgtccctcctcgcggcggccgtcgtggcgctcgcgctcctctgcctcttctacggcgccgccttcgccccctccatccgcagcgcccaccctcggctccccgtccgccgcctcgggttccgggcccgggcggcgggagcgctcccggtcccggccggcctcgccctctcctccatcccggtgtgcgacgcgaggcactcggagctgatcccgtgcctggaccgggctctccactaccggctccggctccggctcaacctctccctcatggagcactacgagcgccactgcccgcccgcgccgcgccgcctcaactgcctcgtcccaccgcccgacggctatcaggtgcccatcaggtggccgaggagcagggacgaggtgtggaaggccaacataccccacccccaccttgctgctgagaagtcagaccagcggtggatgatcgtcaatggtgataagatcaactttcctggtgggggcactcacttccacactggcgctgataagtatattgtgcaccttgcgcagatgctgaatttcccaaatggcaagctcaacaatcgagggaatgttaggaatgtgcttgatgtcggctgtggtgttgccagcttcggggcttaccttctttcgcacgatgtgcttgcaatgtctcttgctcccaatgatgtgcatgaaaaccaaattcagtttgcccttgagagaggaatcccagcaacccttggcgtgctgggaacaaggaggctgccatacccaagccgctcgttcgagatggcacattgctctcgttgtcggatcgactggctgcagaggaatggaatcttgctgctggaagttgatagggtgttaaggcctgggggatattttgtgtattcgtcaccggaggcctatgctctggatccccacaacaggaagatatggacacagatgagcggtcttgctcgaaggatgtgttggcgggtcgcatctaagaagaatcagacggtgatatgggccaagccattgaccaacggatgctatatgaggagagagcctggaacacttcctcccatgtgtgaacgcgatgatgatccagatgcggcttggaatgtacccatgaaagcatgcctaactccatactctaagagagttaacaaggttaaagggagtgaattgcttccctggccactaaggctcacagcaccaccacctcgccttgaagagcttgggatcagttcaaacaatttttctgaagacaatgagatttggcattctagagtaactcagtactggaagcacatgaaatctgagatacaaaagaattcctttagaaatgttatggatatgagcgccaaccttggtggatttgcagcatctctgaggaataaggatgtctgggtaatgaatgtagttcctttcaccgaatctggaaaactgaaggttatatatgatcgcggtttaatggggactatccacaattggtgtgaatcattctcgacatacccgcgcacctatgacctccttcacgcctggctccttctctctgagattgagaagcagaggtgtagcctggaggatctgctgattgagatggaccgcatccttaggcctcatgggtatgccatcatcagagacaaagccgctgtcttaaactacatcaagaagcttttatcagcgctaaggtgggatgactggacatttgaggtgaaacctaagaaagatgcactctcgtcagatgatgaaagagtcttgatcgtcaggaaaaagctgtggaatcagacgttgcaagatttgtagctggtagtcgctcttgttttgatcctagctgtagctaactgagtacggtgattatcctaaccgtcaagtgtaatatagttctgggcttttttggtttgcccgttgtttgtgttgtggaatgttgatagtacagtatcatgaatcttcaggagcagacttcaaaaaaaaaaaaaaaaaaaa

SEQ ID NO: 3940 - protein, 613 aa, Panicum virgatum
  misc_feature: Ceres CLONE 1795634
  misc_feature (1)..(95): Pfam Name: Methyltransf_11 Pfam Description: Methyltransferase domain
  misc_feature: The sequence is a functional homolog of  SEQ ID NO 1236 in the  11/479,226 US patent application
  misc_feature: Useful for making plants with modulated growth and phenotype characteristics
MTPPPHGRRGGHGGGGALGRRAYASLLAAAVVALALLCLFYGAAFAPSIRSAHPRLPVRRLGFRARAAGALPVPAGLALSSIPVCDARHSELIPCLDRALHYRLRLRLNLSLMEHYERHCPPAPRRLNCLVPPPDGYQVPIRWPRSRDEVWKANIPHPHLAAEKSDQRWMIVNGDKINFPGGGTHFHTGADKYIVHLAQMLNFPNGKLNNRGNVRNVLDVGCGVASFGAYLLSHDVLAMSLAPNDVHENQIQFALERGIPATLGVLGTRRLPYPSRSFEMAHCSRCRIDWLQRNGILLLEVDRVLRPGGYFVYSSPEAYALDPHNRKIWTQMSGLARRMCWRVASKKNQTVIWAKPLTNGCYMRREPGTLPPMCERDDDPDAAWNVPMKACLTPYSKRVNKVKGSELLPWPLRLTAPPPRLEELGISSNNFSEDNEIWHSRVTQYWKHMKSEIQKNSFRNVMDMSANLGGFAASLRNKDVWVMNVVPFTESGKLKVIYDRGLMGTIHNWCESFSTYPRTYDLLHAWLLLSEIEKQRCSLEDLLIEMDRILRPHGYAIIRDKAAVLNYIKKLLSALRWDDWTFEVKPKKDALSSDDERVLIVRKKLWNQTLQDL

SEQ ID NO: 3941 - DNA, 1562 bp, Panicum virgatum
  misc_feature: Ceres CLONE 1795649
  misc_feature: Encodes the peptide sequence at SEQ ID NO. 3942
atcccgtttcctctttcgcccgagcacaccggacacgcggactacacccccaaggagcggagcgagagaggatggcctccctggcgcagcacgtcgcgggcctcccatgcccgcctctctccggcgcgtcgcggcgccgcccagcggcgccgaggcggccgccttcggcgctagtgtgcgggacgtacgcgctaaccaaggaggagcgagagcgggagcggatgcgccagcagttcgacgaggcctccgagcggtgccgcaccgcgcccatggagggcgtcgccttctcccccgaggacctcgacaccgccgtcgagtccactgacatcgacaccgagatcggctcccttattaaaggaacagtattcatgactacctcaaatggtgcatatattgacatccaatcaaagtctactgctttcttgcctctagatgaggcatgccttcttgacattgataatgttgaagatgcgggcattcgccctggtttagtagaagaattcatgattattgatgagaaccctagcgatgaaactttgattctgagtttgcaagcaattcagcaagaacttgcgtgggaaaggtgccggcaacttcaggctgaggatgttgtcgccacgggcaaagtgattggcggaaataaaggaggtgtagtagctcttgtggaagggcttaagggatttgttccgttttcccaagtgtcatcgaaaacaactgcggaagagctccttggcaaagaactgcctctcaagtttgtagaggttgatgaggaacagggcaggcttgtccttagcaatcgcaaggcaatggctgacagtcaggcccagcttggtattggttcagttgttttgggaactgttgagagcctaaaaccttatggtgccttcattgacatcggcggaatcaatggtcttctccatgtcagccagattagtcatgaccgtgttgcggatatctcaacagttctgcaaccaggagacaccctcaaggtgatgatactgagccatgaccgtgaaagaggccgtgtcagcctttctacaaagaagcttgagccaacacctggtgacatgatccgcaatcccaagcttgttttcgagaaggccgacgagatggctcagatattcaggcagagaattgctcaagcagaggcaatggctcgtgctgacatgttgagattccagccagagagcggattgacactcagttcagagggaatactaggaccattgtcatcagattcaccttcagaggattcaggagaagaacccacggacgaatagaagcggtagacacaatgcatcgggtttgtaagatgtgatcgctgtttatcgtattcatttttcttcgagcgaaggcatgacaaaaggcctgttgtgttcagatcgtttcccccctttgtgcttgtccccatgtgtaggaaattcggaaatgtaagaaggctctgaagaggccgaaaagaaatggaatttacttatcttgtgaagctatccaatccttgcaggacccccaaaagtatagttgaccgtgagcttatatttgtgcaaaaaaaaaaaaaaaaaaaa

SEQ ID NO: 3942 - protein, 402 aa, Panicum virgatum
  misc_feature: Ceres CLONE 1795649
  misc_feature (1)..(73): Pfam Name: S1 Pfam Description: S1 RNA binding domain
MASLAQHVAGLPCPPLSGASRRRPAAPRRPPSALVCGTYALTKEERERERMRQQFDEASERCRTAPMEGVAFSPEDLDTAVESTDIDTEIGSLIKGTVFMTTSNGAYIDIQSKSTAFLPLDEACLLDIDNVEDAGIRPGLVEEFMIIDENPSDETLILSLQAIQQELAWERCRQLQAEDVVATGKVIGGNKGGVVALVEGLKGFVPFSQVSSKTTAEELLGKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDSPSEDSGEEPTDE

SEQ ID NO: 3943 - DNA, 1710 bp, Panicum virgatum
  misc_feature: Ceres CLONE 1795658
  misc_feature: Encodes the peptide sequence at SEQ ID NO. 3944
atcgcatcgcatcgtccagcctcgcctcagatctcgccccaactgctagcttccactcggcctacctccccacccgatcgccgtcgagctcccacacgtttggctggcggcttggctgaccccatcaacgctgctaggattgggggacagggcggggcggtggcgacgcgcccagctacccacccgcggcttcctctgaactggccgcagctgttcttggcccagctgctctgttcttgtcgagggatggtccggcgcttcgagaagcccccacgccaacattgagctctgccttggcgctgccgattcgtggtgggtctttggatagtacagtggaggtgggtgcccgatgggctgcacggggtccaggcacgcgctgcgcggcggcggccggtcgccgtatgcgcggagctgctccgggccggtcaccggaggcgtgcaccacaccgtcgcgctcaggtcatccacgctcgggtcgctcagccttgaccgggacgaggatatgatgaagtggcgcgacgacggcgtcgtcggtgcggcgaggacgccgccgctgaagcagcagctgctggtcaggcggcacaaacaggtgccgggctcgccggccaagacgccggtccgggagcccgaggtgatcaacgtgtgggagctcatggacggcctcgacgacaaggaggaggaggaggggggcgacgccggcggcgaggaccgccgggggaagtcggcgccgggatcgccggagttcgatccggacatcatcgcggcgttccgaaaggcgcttgatgagatgcccccgccgccggacgacccgggcaacgacgagtgcgccaagaagcctgacgacccggtcggcgacgaggcaggcgtcaagaagcgcgagatacagaggttcccgggcatcgtgcgcgcacgggttagcgcgttccagcagaggatcgacgcgaagctcgccaagctgacgccgccgaagccgccggctcctccgcccccgccggacagcgcccggaaggtggtgctgtacctgaccagcctccgcggcatccgcaagacgtacgaggactgctggtccacccggtccatcctccacggctacggcgtgcgcgtcgacgagcgcgacctgtcgatgcacgccgggttcaaggacgagctcaacgccgcgctgggcgcccccgcgggcaggctcccgcaggtgttcgcggacggcaggcacctgggcggcgccgaggagatccgacggatgcacgaggccggcgagctgtcgagggcgctggaggcctgcgagatggcgcccccgccgagcgccggcggcaagggcattgccctggacgcgtgctccggctgcagcggcgtgcggttcgtgccctgcgaggagtgctccggcagctgcaaggtgttcctcgaggaggtgggcaccttcaggcggtgccccgagtgcaacgagaacggcctcgtgcggtgtcccgtctgctccctgtgaaaaacctgagagctggcttgttgttttgcaggattgcttgtcgttttagttcagggtttgtacagaagttacacgcgtttgtaaatttaggactgatgaagagcagcagatgactgtatttatgtttcatttctcgccggatttggatgtgtacgagacatgacaacaatcttccgaagaacagaacagatacgcattgcatttctcactcggaaaaaaaaaaaaaaaaaaaa

SEQ ID NO: 3944 - protein, 375 aa, Panicum virgatum
  misc_feature: Ceres CLONE 1795658
  misc_feature (1)..(66): Pfam Name: Glutaredoxin Pfam Description: Glutaredoxin
MGCTGSRHALRGGGRSPYARSCSGPVTGGVHHTVALRSSTLGSLSLDRDEDMMKWRDDGVVGAARTPPLKQQLLVRRHKQVPGSPAKTPVREPEVINVWELMDGLDDKEEEEGGDAGGEDRRGKSAPGSPEFDPDIIAAFRKALDEMPPPPDDPGNDECAKKPDDPVGDEAGVKKREIQRFPGIVRARVSAFQQRIDAKLAKLTPPKPPAPPPPPDSARKVVLYLTSLRGIRKTYEDCWSTRSILHGYGVRVDERDLSMHAGFKDELNAALGAPAGRLPQVFADGRHLGGAEEIRRMHEAGELSRALEACEMAPPPSAGGKGIALDACSGCSGVRFVPCEECSGSCKVFLEEVGTFRRCPECNENGLVRCPVCSL

SEQ ID NO: 3945 - DNA, 2047 bp, Panicum virgatum
  misc_feature: Ceres CLONE 1795670
  misc_feature: Encodes the peptide sequence at SEQ ID NO. 3946
aacctaacccaacccatcttttccccgacacctcaccacaccaacctcctccactccggaaccagccgaagcaccgggtgcgcacgctcccacgcagcagaaatcgggctgcggcggcctcctggggaggagattcccggagaaagcgagcgagtgcgcatcgaaagcagcagtctttctgaaagaagcaatcccggagacctgcaggaccaggaggaggaggagcggcagggcacgcgcacccctcccaatggggagttggagcagaggagggagcggtagcagcttgctcaccccactcctcttcttcctcctctctcttcactgctcgccggtggtggtgtcggcggcggggagcggcgagccgtatgtgggcgtgaccatcggcacggcggtgacgaacctgctgtcgccgtcggacctggccgacttcctccgcgcgcagcacatcacccgcgtgcgcctctacgacgcggacccgcgcctgctgtcggcgctggcctccgcgggggcgcgcgccatcgtgggcgtccccaacgacgagctcctggcgctgggctcctccccggcgacggccgcggcgtgggtggcccgccgagtgctcccattcgcgggcgtcaactccagcaccccggccgtcatctctgccatcgccgtcggggacgaggtgcccaccgcgctcccctccgcgctgcccgtgctcctcccggccatccggtccctcgcctccgcgctcgccgcggccaacctgtcctcccccatcccggtgtccacgccgctgcccttctccgtggtggaggacccgttccccccgtcgcaggccttcttcaaccagaccctggccaagaccttcgtcgcgccgctgctcgcccacctcgccaacacctcggcgccgctgatgctcaacctgtacccctactactcgctgatgcagagcgacggcgtgatcccgctggacaacgcgctgttccggccgctgccgccgtcgctggagatggtggaccccaacacgctgctccactacaccaacgtgttcgacgcaatgctcgacgccgtgcgcgtggccgtgcggaacctcaacgtgagcggctccggcggcgtgcccatcctggtgacggagactgggtggccgtcgtacggcgaccggcgggcggagccgtacgcgagcaaggataacgcggacacgtacaactcgaacctgatcaagcacgtcctgcaggacaagcccgggacgcccatggcgcccggcgcggcggcgcagtcgagcgcctacatctacgagctcttcaacgaggacctccggccgggccccgtgtcggaggcgaactggggcctgttctacggcaacggcacgccggtgtacctcctgcacgtgtcgggcgccggcgggctcctggggaacgacacgacggaccggtccttctgcgtggcggcggacgacgcggaggagaaggcggtgcaggcggccatggactgggcgtgcgggcccgggcgcgccgactgcacggcgatccagcccgggcaggggtgctacctgcccaacgacgtgcgcagccacgcgtcgtacgccttcgacgcctactaccagtcgcagggccgcgccgccgggtcctgctacttccagggcgccggcatggtcaccaccacggatcccagtcatgacaactgcttattccctggaagtaagcagctgggtaaccacaccaaatctggcagcgcaagcaacactacaacgccgacaagtgacgccgagggatctgcaatatggaggctaagaacaggaagggagaaagggttctcgctcttccttcggctgctgctgagcatcacggtggttatcgtgacagattcaaacttttggacatgacaagagagtgctagttgtaacaaaaccagaaattttgggagggggtaaattagaggaggggggattgggttgtgcttagcgattctttattgttaggagtaagcatcaataaattaatctcttttttttcttcagctaatgaaatgtgtctatgatctgcaaaaaaaaaaaaaaaaaaaa

SEQ ID NO: 3946 - protein, 538 aa, Panicum virgatum
  misc_feature: Ceres CLONE 1795670
  misc_feature: Great-hit functional homolog of the protein sequence encoded by LOCUS At1g11820
  misc_feature (1)..(332): Pfam Name: Glyco_hydro_17 Pfam Description: Glycosyl hydrolases family 17
  misc_feature: Useful for making plants with altered cell wall content and/or composition
MGSWSRGGSGSSLLTPLLFFLLSLHCSPVVVSAAGSGEPYVGVTIGTAVTNLLSPSDLADFLRAQHITRVRLYDADPRLLSALASAGARAIVGVPNDELLALGSSPATAAAWVARRVLPFAGVNSSTPAVISAIAVGDEVPTALPSALPVLLPAIRSLASALAAANLSSPIPVSTPLPFSVVEDPFPPSQAFFNQTLAKTFVAPLLAHLANTSAPLMLNLYPYYSLMQSDGVIPLDNALFRPLPPSLEMVDPNTLLHYTNVFDAMLDAVRVAVRNLNVSGSGGVPILVTETGWPSYGDRRAEPYASKDNADTYNSNLIKHVLQDKPGTPMAPGAAAQSSAYIYELFNEDLRPGPVSEANWGLFYGNGTPVYLLHVSGAGGLLGNDTTDRSFCVAADDAEEKAVQAAMDWACGPGRADCTAIQPGQGCYLPNDVRSHASYAFDAYYQSQGRAAGSCYFQGAGMVTTTDPSHDNCLFPGSKQLGNHTKSGSASNTTTPTSDAEGSAIWRLRTGREKGFSLFLRLLLSITVVIVTDSNFWT

SEQ ID NO: 3947 - DNA, 1743 bp, Panicum virgatum
  misc_feature: Ceres CLONE 1795696
  misc_feature: Encodes the peptide sequence at SEQ ID NO. 3948
aaaaccgcggtgtccgcagctctcgccactcgccagtcaccaccgcccccgcgctcctcgcctccacgccacggagagggggggatggcgacggcgagcggcgtctccgccggccccgtgctgcagctcccctccctgcgggtgccgtccagtagattgctgccgcggagagcagccgccggagctccggcaggtaatttatttgtgaagagagctgttgtatataacagaagaagctgccaccattttttaccatcgaatcaaagaggaggcttgcaagcagcagtcctgcctgttgctccaccaatattagatgatgaggaaacaaggaagcaaatggctgaagattttgggttcacacaaattggagaagaactgccagatagtgtcactcttaaagacgtcatggatactctacctaaagaggtatttgaaatcaatgatataaaggcttggacatcagttttaatatcagttacttcttacgcactgggtctatttttcattgcaaagtctccatggtatcttcttcccttggcttgggcttggactggcacagcagtgactgggttttttgtcataggtcatgattgtgctcacaaatcattttcaaggaataagttggtggaagatatcgttggaaccttagcattcatgccattgatgtatccttatgaaccgtggagattcaagcatgaccgacatcatgccaagacaaatatgttgatagaagataccgcgtggcaacctgtttggcaaaaggaaattgaatcatcacctcttctgaggaaggctattatttttggctatggccctatcaggccatggatgtcaattgctcactggttgatttggcactttgatctaaaaaaattcagaccaaatgaagttccaagggttaagataagcttagcatgtgtgtttgcattcatggcaattggatggcctttgatcattctcaaatcaggactggctggatggtttaagttctggtttatgccatggatggtttatcatttttggatgagcacttttacaatggtacagcacacggctccccatataccattcaaatcctcggatgagtggaatgctgcacaagctcaattaaatggcacagttcattgtaactaccctcaatggatagagatcctttgccatgacataaatgtgcatgtcccacaccatatttctccaagaattccaagttataacctccgtgctgcctatgactccattaaacagaactggggcaagtatgtcaatgaagccaactggaattggcgattgatgaagacgatactgactagatgccatgtgtacgacaaggagagatactatgtcccatttgacgagctcgcacctgaggaatccctaccaatcaaattccttcggaagttcatgccagattatgcatgatgccatgactactgttgactagagtatcattggccaggcgaacaataaaatgacttagaaggcacttcctaacaccattgatgcacaccccaaattttgaccgaattactatgccaaattgtgtggcaaaaaaggaaaaaccattgtttcttaaaggttgctgaaaaataatgccattttttctcgactttacaccttgttagagtatttacacagatttgcaaacatgcagcatttgtatggttctctaatacatttgtatatcatgatttgcaaacatgcagcatttgtatggttctctaataaaaaaaaaaaaaaaaaaaa

SEQ ID NO: 3948 - protein, 444 aa, Panicum virgatum
  misc_feature: Ceres CLONE 1795696
  misc_feature (1)..(238): Pfam Name: FA_desaturase Pfam Description: Fatty acid desaturase
MATASGVSAGPVLQLPSLRVPSSRLLPRRAAAGAPAGNLFVKRAVVYNRRSCHHFLPSNQRGGLQAAVLPVAPPILDDEETRKQMAEDFGFTQIGEELPDSVTLKDVMDTLPKEVFEINDIKAWTSVLISVTSYALGLFFIAKSPWYLLPLAWAWTGTAVTGFFVIGHDCAHKSFSRNKLVEDIVGTLAFMPLMYPYEPWRFKHDRHHAKTNMLIEDTAWQPVWQKEIESSPLLRKAIIFGYGPIRPWMSIAHWLIWHFDLKKFRPNEVPRVKISLACVFAFMAIGWPLIILKSGLAGWFKFWFMPWMVYHFWMSTFTMVQHTAPHIPFKSSDEWNAAQAQLNGTVHCNYPQWIEILCHDINVHVPHHISPRIPSYNLRAAYDSIKQNWGKYVNEANWNWRLMKTILTRCHVYDKERYYVPFDELAPEESLPIKFLRKFMPDYA

SEQ ID NO: 3949 - DNA, 1713 bp, Panicum virgatum
  misc_feature: Ceres CLONE 1795720
  misc_feature: Encodes the peptide sequence at SEQ ID NO. 3950
agtccaggcaccttgccttcttcctcaactcacctctctctttcacacacgcctctccctcctctctctttctttctccgagaagcggccatttccgcttcctcccgtgggggcttgcagcggaaggacggcgagagagggaagctgttgctgctgctgctggttcggtgcggtggagatgtctgaggtgtcggtgataaaccaggcggaggtggaggacgccggccagctggacctgccgccgggcttccgcttccaccccaccgacgaggagatcatcacgcactacctcactcacaaggccctcaacaaccgcttcacctcgggcgtcatcggcgaggtcgacctcaacaagtgcgagccatggcacctcccaggcagggccaagatgggggagaaggagtggtacttcttctgccacaaggatcgcaagtacccgacggggacccggaccaaccgcgccacggagaccggctactggaaggccaccggcaaggacaaggagatcttcaggggccgcggcatcctcgtcggcatgaagaagaccctcgtcttctaccgcggccgcgcccctcgcggggagaagaccggctgggtgatgcacgagttccgcctcgagggcaagctgccccacccgctcccacgctccgccaaggacgagtgggccgtgagcaaggtgttcaacaaggagctggcggcgcgggcggagccaatggcggcggccggcgcggagctcgagcgcatcggctcgttgggcttcatcagcgagctcctggacagcgccgagctgccgcccctcatggacccttccttcggcggcgaggtggacgaggtggtcgacttcaagggcgcgtccacgtccgcacacgccgccgcgccgggcgcgagctacctgccggtcaagatggagaagcacgcgccgctgcagtaccacaaccaccagcagcagcaggcgccgccgatgttctactccagccagtacttctcgctgccggcggtgaactccggcgacctgaccccggcgatccggaggtactgcaaggcggagcaggtggcctccgggcagacgacgtccgtgctcagcccgtcccgcgagaccgggctcagcaccgaccccaacgccggcagcggctgcgcggagatctcgtcggcagcgacgccgttgtcgtcgtcgcaccagttcccgcacgacctcgacgacccgctcctgcacgtcgccgacttctggaagtactgaagcctggacgggcgatcgggggccgggaccgcccacccgccccgatcacatggtttggttgataaattgcttgatttaattgattaccttggtctctcctcgctcgggttggtgacagtctgctgacgcatcgccgccgatcgtcaccgcccccgccaagtccggccgctcgggtctggctagattatttatccgtccagaccgccaggggattagggcctgcttgtgttaattaattcccccatgctaggttccttgtcttgatgtatgtacatagtactactcctactgctctgattgtgtcattaggggggtagcagcaatgattattgataggattaatgaatgggtgtagattagggggggctgcacctgcgcctgcaagtgcagtgcaggggtgatttacgaattgattagttaatttgggcgcttggtgagccagctagcgctagctttaaaaaaaaaaaaaaaaaaaa

SEQ ID NO: 3950 - protein, 352 aa, Panicum virgatum
  misc_feature: Ceres CLONE 1795720
  misc_feature: The sequence is a functional homolog of  SEQ ID NO 106 in the  10/225,068 US patent application
  misc_feature: The sequence is a functional homolog of  SEQ ID NO 2348 in the  10/374,780 US patent application
  misc_feature: The sequence is a functional homolog of  SEQ ID NO 340 in the  10/412,699 US patent application
  misc_feature: The sequence is a functional homolog of  SEQ ID NO 778 in the  11/479,226 US patent application
  misc_feature: Useful for making plants with modulated growth and phenotype characteristics
MSEVSVINQAEVEDAGQLDLPPGFRFHPTDEEIITHYLTHKALNNRFTSGVIGEVDLNKCEPWHLPGRAKMGEKEWYFFCHKDRKYPTGTRTNRATETGYWKATGKDKEIFRGRGILVGMKKTLVFYRGRAPRGEKTGWVMHEFRLEGKLPHPLPRSAKDEWAVSKVFNKELAARAEPMAAAGAELERIGSLGFISELLDSAELPPLMDPSFGGEVDEVVDFKGASTSAHAAAPGASYLPVKMEKHAPLQYHNHQQQQAPPMFYSSQYFSLPAVNSGDLTPAIRRYCKAEQVASGQTTSVLSPSRETGLSTDPNAGSGCAEISSAATPLSSSHQFPHDLDDPLLHVADFWKY

SEQ ID NO: 3951 - DNA, 2320 bp, Panicum virgatum
  misc_feature: Ceres CLONE 1795733
  misc_feature: Encodes the peptide sequence at SEQ ID NO. 3952
ctcctccctcgttctcctccgggttttgctctccccttcctcttccacctgcagctgacctgtctgcctttgcttcctcccgcgacctccttccttccaccgcaccctccctcgttctcctccgggtagggagggcacctggggcatcagatcagaccctacccggggacctattaatgccccggtcgtgacagatgcccgctgttcttggcaccggtggcagcctcgctctctgaaccttttgcttgcccctgctcctgcaaacaccctgctccgggaagaacgaaccccgtgccgccggtcctgaactcggtttgattcggagcacccggtgttttgttcgttctgcaaaagagatttccttcccttttttcagagtctccagccagtttcaggagttccttcattgcaaggctttcctctgttctctcgctcgcctgcctttttcagagccgttttagtcattgattttgttcgagctgcggattcttggctgctctttgattgattcttgaccacgaaacaagctcgtcgaattccatatagattcagctgatcaatcaagtttaatcacgccagtcatatcccaagcgaaatcttctacttcccggcctgctgctctggccagttcctctcctgagcagtgatcacccacccggcgcagcggttcttgatcgccgtccatggcggcggcggcggcggctgtgcgcgccgcggcggtggcggtgctgtcagtggcggtgctgtgcggcgcggcgcaggcgatcggcgtgaactggggcacgcagctgagccacccgctgccggcgagcacggtggtgcggctgctgcaggacaacggcttcgacaaggtgaagctgttcgacgccgaggacgccatcctcggcgcgctcaagggctcgggcatccaggtcatggtcggcatccccaacgacatgctcgccgacctcgccgccggcggcaaggccgccgaggactgggtcgccaagaacgtctccggccacgtccgcgacggcgtcgacatcaggtacgtggccgtgggtaacgagccgttcctggagacgttcaacgggacgtacctgaatacgacgttcccggcgatgcagaacatccaggcggcgctggtgaaggccggccttgccgacaaggtgaaggtgacggtgccgctgaacgccgacgtgtaccagtcgccgacggggaagccgtcggacggcgacttccgcggcgacatccacggcctgatgctcaccatcgtgcagttcctggcgtccacgggcgcgccgttcgtggccaacgtgtacccgttcatcagcctgtacacggaccccaacttcccgctggactacgccttcttccagggctcgtcgtcgccggtggtcgacggcggcgtcacctaccagaacaccttcgacgccaaccacgacacgctggtggcggcgctccgccggaacgggttcggcaacgtgtcggtggtggtcggcgaggtcgggtggccgacggacggcgacgccaacgccaacctcgactacgcgcggcgcttcaaccaggggttcctcgcccacatcgccggcggccagggcacgccgctgcggccgggccccgtcgacgcctacctcttcagcctcatcgacgaggaccgcaagagcatccagccgggcaacttcgagcgccactggggcatcttcaactacgacggcacgcccaagtacgcgctcagcctcgccggcggcggcaacggctcggctgcgctgacgctcaagccggcgaggggcgtccagtacctggagaagcggtggtgcgtgctcaagccgtcggcggacctcgccgatcagaaggtcggcgacagcgtcggctacgcgtgcgggctcgccgactgcacggcgctcgggtacaagacctcctgcggcggcctcgacgccaggggcaacgtttcctacgccttcaacagctactaccagaccatggaccaggacgaccgcgcctgcgacttcaggggcctcgccgccgccacctccgtcgaccccacggcggggacgtgccgcttcatcgtccagatcgacgtcggcgccgccgcggctatcagctccgccaggggcgtcgccggaggcgtggccagctccgcgctcgccgcgctcgtgctcatgtcgtccatgttgctctgatgagactgaagcgtttccaaatagaccgtaccgtccatgcgcattgtttgtctttaattagcttctgatgagaggattcttgacgcatgtactaactagtgttgtttattttggttggataaatctttcttttatttcaaaaaaaaaaaaaaaaaaaa

SEQ ID NO: 3952 - protein, 492 aa, Panicum virgatum
  misc_feature: Ceres CLONE 1795733
  misc_feature (1)..(319): Pfam Name: Glyco_hydro_17 Pfam Description: Glycosyl hydrolases family 17
MAAAAAAVRAAAVAVLSVAVLCGAAQAIGVNWGTQLSHPLPASTVVRLLQDNGFDKVKLFDAEDAILGALKGSGIQVMVGIPNDMLADLAAGGKAAEDWVAKNVSGHVRDGVDIRYVAVGNEPFLETFNGTYLNTTFPAMQNIQAALVKAGLADKVKVTVPLNADVYQSPTGKPSDGDFRGDIHGLMLTIVQFLASTGAPFVANVYPFISLYTDPNFPLDYAFFQGSSSPVVDGGVTYQNTFDANHDTLVAALRRNGFGNVSVVVGEVGWPTDGDANANLDYARRFNQGFLAHIAGGQGTPLRPGPVDAYLFSLIDEDRKSIQPGNFERHWGIFNYDGTPKYALSLAGGGNGSAALTLKPARGVQYLEKRWCVLKPSADLADQKVGDSVGYACGLADCTALGYKTSCGGLDARGNVSYAFNSYYQTMDQDDRACDFRGLAAATSVDPTAGTCRFIVQIDVGAAAAISSARGVAGGVASSALAALVLMSSMLL

SEQ ID NO: 3953 - DNA, 1882 bp, Panicum virgatum
  misc_feature: Ceres CLONE 1795744
  misc_feature: Encodes the peptide sequence at SEQ ID NO. 3954
ctgctcacacgcaagcgcaaaccaagctcctccccttgctaaccactccttgcccactagaccactactctgcttgattcgatctagctcgtgtgccaataaggcacgcgtacacgcgtctcgtcgtcgagatcggcagatcgcgcataggaatggcggcggcggtgggggcggctcgcgacgcgccggcgacgccgtggacgctgccggaggagggcgcggtctcgggctcggcgcgggaggggtccgccgacgggtgggctaggaggaagcgctcgaggtcgaggcgccgcctacgccgcgcggcgcccaccgaggagaagcacctcgcggtctgcctcctcatgctggcgcgcggccagcgcgacgcccgcgcgccgccggcggcgcagcagcaggagcacaggtgctccgtctgcggcaaggcgttcccgtcccaccaggccctcggcggccacaagtcgagccaccgcgccaggccgccgccgccgccggcagccccaaccccggccgccgaggaggagccggccgcggccccggccccaccagccgcagcggtgccctcggcctcgcccgccgcgtcctcgtccacgtccggcgccgccgctggcagcatcagcggcggcagcggcagggtgcacgagtgctccgtgtgcaggaagacgttcccgacggggcaggcgctgggcggccacaagcgctgccactacgagggcgccggcggcggcgccaccaccaccaacgtcccatccaccagcgcaggattgatgagctgccgcgggttcgacctcaacgtaccggccctgccggacatcatcaccgccggcgatcggtgcatgccggcggccgaggaagaggatgaggtgctcagccccttggccttcaagaagcagaggctaatgatcctcgcataggtagttggctattccctccttccccgtttattaggtgcaccatcgattcacacagatacaagactcaccagctcgcgattaattatccgcctactgctgcatgcagcatgctctccgagcccatcagtgcctggcacctgattggatggaactacttcaaccaacatttattgcgtgcatgcatgcatttcgagggcgtgtgccctacataaataaaaaagctgaaaatcgtggtacgcctaataaacggaacggagggagtagttggttactccaagtcatgatctcctcctcgattgcttctactgtgttgagttgctggaagtgttggtgagcagctgtacgcttgcacgggtcaggtgtaggtctctgattgccgtaaacctatgtatttaaattttaattccgtagaatgattcttttcattgattgctgtaagcctgtaagcttatgtgtatagaaaagaattggaattagatgtggcatgtgagtgctactatcttttactaaatcctttagtcagtatttcatatatatagaagaatggagaagacatattggcttgaatatagctcgccatttcaagttgatggtttttgccgaccagagtaaatgtcagggcagtaaaaatttaaatcctcaaaagtttttatggtgtattggcatgtcaagattttggtttggcagaaattaacatccaaccaatcggactcatgatgtacatgaagagattctcatcagttttgccacttgaagtgctaaaaagaaatagttcagacagatatttgttgctttttttagtcaggggcggagaggggggcatggccccgcctaatgttggtgtaactacacataaaatcccctaatctcattgctaatattgctcattagtaaggtgtggcccctcctaattgtcggcattaataaattggccccctctatgtttcgaaaaaaaaaaaaaaaaaaaa

SEQ ID NO: 3954 - protein, 253 aa, Panicum virgatum
  misc_feature: Ceres CLONE 1795744
  misc_feature: Great-hit functional homolog of the protein sequence given in SEQ ID NO 9572
  misc_feature (2)..(23): Pfam Name: zf-C2H2 Pfam Description: Zinc finger, C2H2 type
  misc_feature: The sequence is a functional homolog of  SEQ ID NO 1012 in the  10/666,642 US patent application
  misc_feature: Useful for making plants with altered Lignin content
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
  misc_feature: Useful for making plants with modulated growth and phenotype characteristics
MAAAVGAARDAPATPWTLPEEGAVSGSAREGSADGWARRKRSRSRRRLRRAAPTEEKHLAVCLLMLARGQRDARAPPAAQQQEHRCSVCGKAFPSHQALGGHKSSHRARPPPPPAAPTPAAEEEPAAAPAPPAAAVPSASPAASSSTSGAAAGSISGGSGRVHECSVCRKTFPTGQALGGHKRCHYEGAGGGATTTNVPSTSAGLMSCRGFDLNVPALPDIITAGDRCMPAAEEEDEVLSPLAFKKQRLMILA

SEQ ID NO: 3955 - DNA, 2028 bp, Panicum virgatum
  misc_feature: Ceres CLONE 1795745
  misc_feature: Encodes the peptide sequence at SEQ ID NO. 3956
gttgcttcaagagctttccgattcgtcgccgtccacttgtctcacggcctgtcgccatcccatccctccctccctctcgcatctccgccaccagcccacctccccctcggaccccgccgccggtgacgactccgtcgagccactccgcagcaggcgcaggcgaccatgcgccgcgccgtatcgggcctcagcgccctcaagaggcatagggcagatgctcaaatgatgaatattgcaattaggtctgccagcacaagtgttgcacagagctcatcaggcggcttctggacttggttgactggtgcacgctcaaatgcattacctcctccagatttcgcacttccaggagtgactattcctcctcctttacctgatctcgtggagcctggcaagacaaaaatcacaacgctttcgaatggtgtaaaaatagcctctgagacatctgcaggatcatcttgttctgttggagtttatattgattgtggttctgtatatgaggcacctgagacaacaggggtcagtcagctgttgaagacaatggcatttgtgaccactaccaacaggagtgaattgcgcgttgtgcgtgaaattgaggcgataggtggcagtgccaaagcatctgctagccgtgagatgatgagctacacttatggagcgctgaagacatacatgcctgaaatggtcgaggtgcttattgactgtgtacgcaaccctgcttttcttgattgggaggttaaggagcagattttgaggctcaaggcagagcttgcaaaagcatcaagtaaccctgaaaaattgcttttggaggctcttcattctactggttattccggtgctttggcaaaccctctgattgcatcagaatcttcgattagcagattgaatacagatgtcctggaacagtttatatttgagaactacactgctccccgaattgttctagctgcatcaggtgttgatcatgatgaattggtatctattgctgaaccgcttctgtctgacattcccaatgtaactggaaccacaaggccgaaatctacctatgtgggcggcgaatatagacgaactgcagattcattgaacacagatgttgccttggcatttgaggtccctggtggttggctcaaagaaaaagattttgccactgtatcagttcttcagacacttctgggtggtggtggcacgttttcttggggaaggcagggaaagggattgcattcacgtctaaatcaccttgtaactgaatttgaccaaattaagtcaatctctgctttcaaggatgttcacagtaacactggcatctttggaattcatgcatctactgatgcgtcatttgttcctaaagctattgacctggcagccagagagctcacttccattgcaactcctggacaagttgaccaaagccaactggatcgtgctaaagcctcagctaaatctgcaatattagtgaaccttgaatcaaaggcatcactaacagaagacatggggcgtcaagtactggcatttggtgaaaggaaacctgttgagcaccttctcaaggctgttgatggtgttactctgaaagacgtaacgacagttgctgaaaagatcatttcatcaccgctgacaatggcatcccatggaaacgttctgaatatgccaacctacgagtcggtcagaggcaagttcagctcgaaatgagtacatgggccttttatttctctgcctgctggacaagtttaacagcctgtactttcacacccaggccattactctcggtcaaagtttcatcaggaaaataaggaacctcatacaattttgttcgttaaatctttgctcattttgcaatcacttgttcccccaccttttttgcggaaacattcgtccacttgagttggtgattattgctggtgataggccagtcgtgtgtttgtaaatttaactgataccggcctacctgggctcctctttcgtttacaaggcccaaagagtgtacaaaaaaataccattctctggtcgtaaaatctttgacaagaatgtcgaagc

SEQ ID NO: 3956 - protein, 505 aa, Panicum virgatum
  misc_feature: Ceres CLONE 1795745
  misc_feature (1)..(147): Pfam Name: Peptidase_M16 Pfam Description: Insulinase (Peptidase family M16)
  misc_feature (1)..(186): Pfam Name: Peptidase_M16_C Pfam Description: Peptidase M16 inactive domain
  misc_feature (2)..(505): SWISSPROT Homolog: EC 3.4.24.64 Mitochondrial-processing peptidase alpha subunit, mitochondrial precursor
MRRAVSGLSALKRHRADAQMMNIAIRSASTSVAQSSSGGFWTWLTGARSNALPPPDFALPGVTIPPPLPDLVEPGKTKITTLSNGVKIASETSAGSSCSVGVYIDCGSVYEAPETTGVSQLLKTMAFVTTTNRSELRVVREIEAIGGSAKASASREMMSYTYGALKTYMPEMVEVLIDCVRNPAFLDWEVKEQILRLKAELAKASSNPEKLLLEALHSTGYSGALANPLIASESSISRLNTDVLEQFIFENYTAPRIVLAASGVDHDELVSIAEPLLSDIPNVTGTTRPKSTYVGGEYRRTADSLNTDVALAFEVPGGWLKEKDFATVSVLQTLLGGGGTFSWGRQGKGLHSRLNHLVTEFDQIKSISAFKDVHSNTGIFGIHASTDASFVPKAIDLAARELTSIATPGQVDQSQLDRAKASAKSAILVNLESKASLTEDMGRQVLAFGERKPVEHLLKAVDGVTLKDVTTVAEKIISSPLTMASHGNVLNMPTYESVRGKFSSK

SEQ ID NO: 3957 - DNA, 1812 bp, Panicum virgatum
  misc_feature: Ceres CLONE 1795778
  misc_feature: Encodes the peptide sequence at SEQ ID NO. 3958
agctctccaccaagagctaataccagtatacccgccgccgcccgccccaccagcacctaacgccccccgcctgctttacagtttacaccgcgtcccgcgccgccgccgccgcgttgggttgcgtcccagatccgccgagctcttcgactggtcgctcgagcaagatgaagatcacggtgcgggggtcggagatggtgtacccggcggcggcgacgccgcggcggcggctgtggaactcgggcccggacctggtggtgccgcggttccacacgcccagcgtctacttcttccgccgcagggacggcgagggcaacgacctggcggccgcggacgggagcttcttcgacggcgcccggatgcggcgcgcgctggcggaggcgctggtgcccttctacccgatggcggggcggctggcgcgcgacgaggacgggcgcgtggagatcgactgcaacgccggcggggtgctgttccaggaggcggacgcgcccgacgccaccgtcgacgacttcggcgacttcgcgcccaccatggagctcaagcgcctcatccccaccgtcgagtacaccgacgacatctccgccttcccgctcctcgtgctccaggtgacacacttcaaatgcggtggcgtggcgatcggcgtgggcatgcagcaccacgtcgccgatggcttctccggcctgcacttcatcaactcgtgggcggacctctgccgcggcatcccgatcgccgtcatgccctacattgaccgctccctcctccgcgcgcgcgacccgccgaccccagtgtacccacacatcgagtaccagccggcgcccgccatgctgtccgagccgccgcaggcgcccctcacggccaagccggcgacgccgcccaccgctgtggccatcttcaggctcagccgcgccgaccttggccgcctccgctcgcagatccccgcgcgcgagggcgcgccgcggttcagcacgtacgcggtcctggcggcgcacgtgtggcggtgcgcgtccctggcgcgcggcctccccgcggaccagcccaccaagctgtactgcgccacggacgggcggcagcggctgcagccgccgctccccgagggctacttcggcaacgtgatcttcactgctacaccgctggcggacgccggcacggtgacggccggggtggcggagggcgcggccgtgatccaggcggcgctggaccggatggacgacgggtactgccggtcggcgctggactacctggagctgcagccggacctgtcggcgctggtccgcggcgcgcacacgttccggtgccccaacctggggctcactagctgggtgcggctgcccatccacgacgcggacttcgggtgggggcggcccgtgttcatgggccccggcggcatcgcgtacgaggggcttgcgttcgtgctccccagctccaaccgcgacggcagcctgtccgtggccatctcgctgcaggccgagcacatggagaagttccggaaattcatctacgacttctgatcgcctcgacacccaagtcatcggcgagcgcaggcgcggtagaagcaagcagagaagcgctaggcagatgcccagcacaggacagggagggtgatcttactaggttacagcaagattctttgattgcacacatagttcctgcacacttaattttttttccccgttcctgcctgccccctttcgggcgggatatatacttgtgcgtatgattcacgggcctgaacggcctgaacaaattgtaatatgaacaatttaatccgttctgagtgatacaggttaataaggtcaaaaaaaaaaaaaaaaaaaa

SEQ ID NO: 3958 - protein, 446 aa, Panicum virgatum
  misc_feature: Ceres CLONE 1795778
  misc_feature: Great-hit functional homolog of the protein sequence given in SEQ ID NO 9220
  misc_feature (1)..(432): Pfam Name: Transferase Pfam Description: Transferase family
  misc_feature: Useful for making plants with altered Lignin content
  misc_feature: Useful for making plants with altered cell wall content and/or composition
MKITVRGSEMVYPAAATPRRRLWNSGPDLVVPRFHTPSVYFFRRRDGEGNDLAAADGSFFDGARMRRALAEALVPFYPMAGRLARDEDGRVEIDCNAGGVLFQEADAPDATVDDFGDFAPTMELKRLIPTVEYTDDISAFPLLVLQVTHFKCGGVAIGVGMQHHVADGFSGLHFINSWADLCRGIPIAVMPYIDRSLLRARDPPTPVYPHIEYQPAPAMLSEPPQAPLTAKPATPPTAVAIFRLSRADLGRLRSQIPAREGAPRFSTYAVLAAHVWRCASLARGLPADQPTKLYCATDGRQRLQPPLPEGYFGNVIFTATPLADAGTVTAGVAEGAAVIQAALDRMDDGYCRSALDYLELQPDLSALVRGAHTFRCPNLGLTSWVRLPIHDADFGWGRPVFMGPGGIAYEGLAFVLPSSNRDGSLSVAISLQAEHMEKFRKFIYDF

SEQ ID NO: 3959 - DNA, 1767 bp, Panicum virgatum
  misc_feature: Ceres CLONE 1795787
  misc_feature: Encodes the peptide sequence at SEQ ID NO. 3960
ggcgcggctcctcccttcttcttcttctctcccccctcggcttcgagggttttttttttctctttgtttctttccttttttttctttttttttttcttttcgttttttttgggttcctcctccccgttggggttttcggccccgacgaaaccctaataaccggcggggggcaatcgccggcggcatgcaccagcagcggatgaagcaggccgcagcggcggcggcggcgcagcagcagcagctgatgcagcaggcgctactcctgcagcagcagcagcagcagcagcaggcgcagccgcccttgttccctgggcaccacccgcaccccggcctcctcgccgcgccgcagatagagcccatagttagcggaaaccttcctcctgggtttgattcaagtacatgccgcagcgtgtatattggcaatatccatcttcaagtgacggacatgttactgcaggaagtcttccaaagtattggtccagtagaaggttgcaagctcatcagaaaagaaaagtcgtcttttggtttcattgactactatgaccgccgatctgctgcactagcaattttatctctcaacggcaaaccactgtatggtcagccaataaaagttaattgggcatatacaagtactcagagggaggatacatcaggccattttaatatttttgttggggatctttgcccagaaatcactgatgctgctctatttgcctttttttctggatactctacctgctcagatgctagggttatgtgggaccagaaaacaggacgatccagagggttcggttttgtttctttcaggaatcagcaggatgctcaaaatgcgataaatgacttgaatgggaagtggcttggcaaccgtcaaattcgttgcaattgggcgacgaaaggcgctaatgctggtgatgaaaaacaaagtgtggacaccaatgtggaccagacaaatggttcatcagaagctggaaaggagaattcaaatgaagatggtcctgaaaataacccactttttaccactgtttatgttggtggtcttcctcatgaggccaccaacaatgatgtgcacctgttttttcattcacttggggctggctcaatcgaggaggtccgtgtaacacgtgacaagggctttggctttgtgaggtacagcacccatgaggaagctgcactggcaattcagatgggcaatggccaactgattggcgggaggccaataaggtgctcctggggaaacaagccaactccaccggggacagcatctttgccgctcccccctccggcaccgtctccattccccaccggcgtgtcggcaactgacttccttgcctatcagcgcctggccctgagcaagattgccgcgaacccagccctaatgggccagcacgccctgaagcaggctgcactggggatggacgccggggccagccaggctatctatgatggcggctaccctggcatcaacgctgcggccggcacacagcagcagcagcaacagcagctcatgtacttctagagtgacagctatcttatgaggcggcagctacctgtctctgcaggaggaaggcgaagatgatgccccagttacagccccccgtatacatatactagtagtatcatagtaatcaagccttaccaggaccttcttttatttacctttaatctttcgttacaccatctaagtaacttgtcctgtatgccggctctctatatatatatactcaccaccgtagaacacatatatgtatttctagagacatggaaacc

SEQ ID NO: 3960 - protein, 443 aa, Panicum virgatum
  misc_feature: Ceres CLONE 1795787
  misc_feature: Great-hit functional homolog of the protein sequence given in SEQ ID NO 9221
  misc_feature: Useful for making plants with altered Lignin content
MHQQRMKQAAAAAAAQQQQLMQQALLLQQQQQQQQAQPPLFPGHHPHPGLLAAPQIEPIVSGNLPPGFDSSTCRSVYIGNIHLQVTDMLLQEVFQSIGPVEGCKLIRKEKSSFGFIDYYDRRSAALAILSLNGKPLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGDEKQSVDTNVDQTNGSSEAGKENSNEDGPENNPLFTTVYVGGLPHEATNNDVHLFFHSLGAGSIEEVRVTRDKGFGFVRYSTHEEAALAIQMGNGQLIGGRPIRCSWGNKPTPPGTASLPLPPPAPSPFPTGVSATDFLAYQRLALSKIAANPALMGQHALKQAALGMDAGASQAIYDGGYPGINAAAGTQQQQQQQLMYF

SEQ ID NO: 3961 - DNA, 1211 bp, Panicum virgatum
  misc_feature: Ceres CLONE 1795833
  misc_feature: Encodes the peptide sequence at SEQ ID NO. 3962
gaaaccgcggcaactgccaccggacccgcccgcgccgccgcgcccgcacctacgccccccgccggtgctctccttgcgacccgctggcgccgatccaggagcaacgccgccgccgggggccatgacctccgctcactccaagctctactccgatgacgtcagcctcgtggtggtggtcgtcgacacgaaccccttcttctgggccgccgctgcgctccccttcgccgacttcttcgcgaatctgatccacttcgtgaactcactcctactgctgaaccacctcaaccgtgtggtcgtcatcgccgctggagtcagctcctgtgcctacatctttgattccagcgatgccagccccgctggtggtgtaggcgtcacggccacctttgaaaacgcaagccgcaaggtggaggagttcattgcacaagatgctcgtgccactgcgggcaacggttccgttgcttctgccaatgccgcgtcactgctgtctggggcactgtcccttgctttgtgctatatacagagggttttcaggtctgggactcgacatccgcaacctcggattttgtgtctgcagggttctccagatggtcctgaacaatatgtggcagtgatgaattcaatattttctgctcaacgttccatggttccaattgattcatgtattatgggaacccatgattctgctttcttgcaacaggcttcatacataacgggaggaatttatttgaagccccaagagctaaatggtttgtttcagtatcttgctgctgtatttgcaactgatttacactcgagaacatttttgcgccttcctaagacccttggagtggactttcgtgcttcatgtttctgccataagaagactattgacatgggatatgtttgttcagtttgtttgtcaatattctgcaagaatcagaagaagtgttcaacttgtgggtcagaattcagtcgtgtcatgcctgatttgaattccatgccagatcaaagcaagtagtagtctgtaaacagttagccatcaaccaacgtgctttgctcaaatgtctctccacaggtttgtttcagactatcttcttagatgggcaccttgacatgttctgcattatgctactattcgatgaacagatacatccaactcacatgcaaaacgtttctttgatcaatatgtaaatgactcctgtgcctgatatcaaaaaaaaaaaaaaaaaaaa

SEQ ID NO: 3962 - protein, 291 aa, Panicum virgatum
  misc_feature: Ceres CLONE 1795833
  misc_feature (1)..(262): Pfam Name: Tfb4 Pfam Description: Transcription factor Tfb4
MTSAHSKLYSDDVSLVVVVVDTNPFFWAAAALPFADFFANLIHFVNSLLLLNHLNRVVVIAAGVSSCAYIFDSSDASPAGGVGVTATFENASRKVEEFIAQDARATAGNGSVASANAASLLSGALSLALCYIQRVFRSGTRHPQPRILCLQGSPDGPEQYVAVMNSIFSAQRSMVPIDSCIMGTHDSAFLQQASYITGGIYLKPQELNGLFQYLAAVFATDLHSRTFLRLPKTLGVDFRASCFCHKKTIDMGYVCSVCLSIFCKNQKKCSTCGSEFSRVMPDLNSMPDQSK

SEQ ID NO: 3963 - DNA, 1756 bp, Panicum virgatum
  misc_feature: Ceres CLONE 1795839
  misc_feature: Encodes the peptide sequence at SEQ ID NO. 3964
atggttccacccccttttccttgcctccccccgccccccagcgcgcctcgatccgatgagggacgggtcgaggggcaggggaatgtcgtcgtcgtcttcggcggcggcgcaccaccaccagcaccggcgccagggcggagggagcgggctcgtgccgctcgccgcgctcatcaaggaggaggcccgcaccgagcgccgcgcctgcgccggcggcggcggcgggaccaggatctgcgcgcgcgacgaggacgcaggaggctccggcgtgggtggggagccagcggaggaggaggcgcggcggcagcgcccgctgctgcgttacgggtgcgccgcgcagtccaaaaagggcgaggacttcttcctgttgaggacggactgcccgcgaccttccacgtctgcttcctcctccgcggcctcgccgcaccagaccttcgccgtttttgccgtacttgatggccataatggtaacgccgccgcaatatacacaagggacaatttgctcaaccatgtcctcagtgcgatgccacgtgggctgtccagggaggagtggttgcatgcgttgccccaagcactggtcgcagggtttgttaagactgacaaggagttccagagcaaaggccaaacttctggcacaactgctacttttgtgataattgatggatggactatcactgttgcctctgttggcgattctcgctgtattttagatgctcagggcgggactgtttctttacttactgtggatcacagactagaagaaaatgttgaggagagggaacgcgttacagcaagcgaaggtgaagttggaaggcttagtgttgttggtggagctgagattggcccactacgatgctggccaggaggactatgcctatcaagatccattggagatattgatgttggtgaatttattgttcctattccttatgtgaagcaagtgaagttgtcaaatgctggaggaagacttatcattgcctcagacggcatttgggatgcattatcctcagaggcagctgctaagtcttgcagaggattgcctgctgagcttgctgcaaagcaagtcgttaaggaggcgctcaggacaagagggctaaaggatgatacaacttgcattgttgttgacataatcccacctggtcaaacaatacggcctccatctccacctaaaaagatgaacaagttgaaatcgttaatcttcagaaagaaagcaaaggagccttctcagaaattgactaagcagcattcaggggctgatgctgttgaagagatatttgaggagggttcagccatgctctcagaaaggttaggtcccgatttgaatggcgggcatacatcctcaagtttgtttacatgcgccatttgccaggtagacctggaaccaagtgaaggcatatctgtccatgctggatccatcttctcttcaagctccaggccatgggaaggcccattcctctgctctaattgccgtgacaagaaggatgcaatggaaggcaaacggcccagcggagtcaaggttctgtagtcaacggcaaccgatcaccattgtagcttcccgctcttcttttttcttggtgagcaaggaaccttgcgttacagaaaatttccttaattttttaggtggtttggataatttttaggctgcattttattttgttttattatgcgaggaactagccgactatgtaagtagctcttggcaaaaggaaatgtgaagcgagtgaatagggtatgccttcaaaaaaaaaaaaaaaaaaaa

SEQ ID NO: 3964 - protein, 488 aa, Panicum virgatum
  misc_feature: Ceres CLONE 1795839
  misc_feature (1)..(255): Pfam Name: PP2C Pfam Description: Protein phosphatase 2C
MRDGSRGRGMSSSSSAAAHHHQHRRQGGGSGLVPLAALIKEEARTERRACAGGGGGTRICARDEDAGGSGVGGEPAEEEARRQRPLLRYGCAAQSKKGEDFFLLRTDCPRPSTSASSSAASPHQTFAVFAVLDGHNGNAAAIYTRDNLLNHVLSAMPRGLSREEWLHALPQALVAGFVKTDKEFQSKGQTSGTTATFVIIDGWTITVASVGDSRCILDAQGGTVSLLTVDHRLEENVEERERVTASEGEVGRLSVVGGAEIGPLRCWPGGLCLSRSIGDIDVGEFIVPIPYVKQVKLSNAGGRLIIASDGIWDALSSEAAAKSCRGLPAELAAKQVVKEALRTRGLKDDTTCIVVDIIPPGQTIRPPSPPKKMNKLKSLIFRKKAKEPSQKLTKQHSGADAVEEIFEEGSAMLSERLGPDLNGGHTSSSLFTCAICQVDLEPSEGISVHAGSIFSSSSRPWEGPFLCSNCRDKKDAMEGKRPSGVKVL

SEQ ID NO: 3965 - DNA, 1770 bp, Panicum virgatum
  misc_feature: Ceres CLONE 1795845
  misc_feature: Encodes the peptide sequence at SEQ ID NO. 3966
atcccccgtccgctccaggtctccaccctgccactcgaactgctcctcgtcctcgacgccgggcgcgccgcgcggggggatcatggcctgaagtgaaatcccgcaccgcgacactgcgagggtgacaaggataactttctcagaccagggaaggaagacatctccttgacgcggtagagcttttgatggttgctataagtattcaggggtgaattaggactggaagatactgctgaagcgaaacagagagtgtcaagagagtttgtttcaagatggatgaagaccagggagttaggtattggtgccacatgtgtgaggaggtgatcgatcctatgccggaaatgaagtgtcctagctgtgagggtgggtttgtggaagagatggaatctgaaggctttgaaccagctacaaacacaaggtctgatcgctccctctccgttttggctccgctgctttttggtatgctggggggttcctcgcgcagatcaagactcaggagggaggccatggaagatgctgatgctgatgaggatgatgaagaggatgattcagaccgtgagtttgaactattcagtaggaggcgaaggaggatgccctcgtcagcgcttgccaggctgattcaaactatgcgtgatgacatgaggggcttggatgacactgacagtgatacagagagagatatggagagagaaagaagggagaggcagagggcagagaggcaggctgtcgagaggagggtggagaggcagagggcaatagagaggctgagcaatcgtgggagagagaggacagaaagcctaatactgatcaactctaacaatgaggccatcattctccaaggaacgtttggacgcgatgacaaccaagaggaatcaagcaacacaagttctggtgtatcagctgcggattactttcttggtcctggcttagatattctgttgcagcgtttggcagagagtgatctcaatcgttctggcacaccacctgccaagaaggaggcggtagctgcattgccaactgtgaacatcaaggaagtgttgggttgttcagtctgtcttgaggattttgagatgggagcagaagcaaagcagatgccctgtcagcataaattccactgtcagtgcatccttccatggctggagcttcacagttcttgcccaatttgtcgatttcagttgcctactgaggagacgaagaacccatgtgaatcagccagcagtgccggggccatgaacggcgatggagacaatgttgctgcaagcagtagtgatacagaaagtactaaccgtaatggagataaccattcagatagtcctatcttctctgctttgagcgcactcttctctaatccatcctcgccatctgatgatgaaagtgctccacactcttctgagacctgaagtttcatctaaattgcagacaccgccggatgcaggcttgcagtatggtgaaggtgatctgaaatgtgagactggcatctttatattgtagtttctgtacatatctctgaattggcacccccagaagacaagatattctattctcttttctgaaaactatgtggcttgtagtgtgctagtgcttgctatgtttacttatcttaaataaaagttagcctctagtgtgcgtaccatctcctgaaggcttcaacatgcatcagtcggctgccagtttagttgagagtgtgatcaatgtaagactaatctcctctgctagctgtttggcttatgtaagcagtgacattgcgctcaaaaaaaaaaaaaaaaaaaa

SEQ ID NO: 3966 - protein, 375 aa, Panicum virgatum
  misc_feature: Ceres CLONE 1795845
  misc_feature (1)..(41): Pfam Name: zf-C3HC4 Pfam Description: Zinc finger, C3HC4 type (RING finger)
MDEDQGVRYWCHMCEEVIDPMPEMKCPSCEGGFVEEMESEGFEPATNTRSDRSLSVLAPLLFGMLGGSSRRSRLRREAMEDADADEDDEEDDSDREFELFSRRRRRMPSSALARLIQTMRDDMRGLDDTDSDTERDMERERRERQRAERQAVERRVERQRAIERLSNRGRERTESLILINSNNEAIILQGTFGRDDNQEESSNTSSGVSAADYFLGPGLDILLQRLAESDLNRSGTPPAKKEAVAALPTVNIKEVLGCSVCLEDFEMGAEAKQMPCQHKFHCQCILPWLELHSSCPICRFQLPTEETKNPCESASSAGAMNGDGDNVAASSSDTESTNRNGDNHSDSPIFSALSALFSNPSSPSDDESAPHSSET

SEQ ID NO: 3967 - DNA, 1717 bp, Panicum virgatum
  misc_feature: Ceres CLONE 1795887
  misc_feature: Encodes the peptide sequence at SEQ ID NO. 3968
atatagaactcccgtctccgtctccggtgagcaggagaggggagggaggagaggagggccaagaacgcagcagctcaagcagccgcggagccaaagctcacccgatccagccacagcttgcctcttaggtccccgcgccattgccagttctgttctcagattcacgagctcatctcccagatccagcttctgcctgcccgaattctgtttcctgggagtaaagaggtagttttgacaaggtgctggtcggcggcgtggttcggtggttctggttctcctcctctgcttggtttcctggttcagcggtggagatgggggtggcgggggagaagttccagctggggacggtaggggcgctcagcctctcggtcgtgtcctcggtctccatcgtcatctgcaacaaggccctcatgagctccctcggcttcaactttgccacaactttgacaagctggcatctcctggttacgttctgctctctccatgtggcattatgtatgaagctctttgagcataaaccttttgatgcaaggactgtcatgggttttggagtgctcaatggcatctcaattggacttctcaacttgagtttgggtttcaactctgttggtttctatcagatgacaaagctggctattattccctgtactgttatattggagacccttttcttcaggaagaaatttagtcggaatatcaagctctcccttagcgtgctccttgttggtgtttgtgtcgcaacagtgactgatctgcaactcaacgcagtgggatctatactgtccctgctggcaatcatcacaacctgtattgctcaaattatgacaaatacaatacagaagaagttcaaggtttcttcaacccagcttctgtaccaatcatgcccgtaccaagcattgaccttgttccttatcggtccattccttgatggatttttgactaacaaaaatgtctttgcttttgattacacaactcaagtcctgtttttcattgtgttgtcatgcctgatttcagtctcagtaaacttcagcaccttccttgtgattgggaagacatctcctgtaacctaccaagttcttgggcatctgaaaacatgcttggttctcaccttcggctatgttctgcttcatgatccgtttagctggagaaatatacttggaatcctaattgctgtgattggtatggttttgtattcctacttctgcactagagagactcagcaaaaacctgcagaagtctctccgcaagtcattcaggtgaaggagagcgagtcaaacccgttgatctcagactctttaagcactgctgaaaacgggggcagcaccacagacgatgaacccctgaaggtaccaatgtggagctcaaagtactcgagggcgtgaagaatgaaaattgctcttttgttagcgtatggtattatatagaattcagcttagtaggcagatactagggttggaaggcaaccctgttcctgttccatttttggccttcttttttttctctggcttatattatatgcgttgttagtaaatggatctcactcgtgagaggatactactgtttcctctgctccagacgattgatctgcctgaaagctagacatgagagctagctgcacaggagatttctgttgtattttcttatgttctgaatgcgccacgtgcagtaactttgtacctggacatgaaacaacacgtagttttcattcttttgtact

SEQ ID NO: 3968 - protein, 356 aa, Panicum virgatum
  misc_feature: Ceres CLONE 1795887
  misc_feature (1)..(143): Pfam Name: TPT Pfam Description: Triose-phosphate Transporter family
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLVGVCVATVTDLQLNAVGSILSLLAIITTCIAQIMTNTIQKKFKVSSTQLLYQSCPYQALTLFLIGPFLDGFLTNKNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEVSPQVIQVKESESNPLISDSLSTAENGGSTTDDEPLKVPMWSSKYSRA

SEQ ID NO: 3969 - DNA, 1546 bp, Panicum virgatum
  misc_feature: Ceres CLONE 1795909
  misc_feature: Encodes the peptide sequence at SEQ ID NO. 3970
agcgtggtgcagtgtagcaggtgcccgcccgctttccgctgccctcccggctcttcttcctcttccttccttccacaccacaccccggccactgctggtttctcattggcgagcccagccgaggtcctcgtgggcggccatggcagcatcgagtaggaggaggggcttctccttgccggcggcggcgtgcctggtggttgtcctgctgcggtgcctgtcggcgtccgccgagcccctgccgcagtactacaatgccatcttcagcttcggcgactccttctccgacacgggcaacttcgtgatcatcaactccggcaagctgcccaacatgcccaagttcccgccgccgtacgcgcgctgctccaacggccgcctcgtcatcgacttcctggccgaggcgttcggtctcccgctgctccctccgtcggcgaacaagggcaccaatttcagccagggcgccaacttcgcggtgatgggcgcgacggcgctggacctcaagtacttcagggacaacaacgtgtggagcatcccgcccttcaacacctccatgaacgtgcagctgcagtggttcgacgaggtcaagcagaccatctgctcggacccgcaggagtgccgcgccttcttctccaagtccctgttcgtgttcggcgagttcggcggcagcgactacagcttcgcgtggaaggcggagtggcccctggataaggtgaagacgatggtgccggccgtggtggcctcgctggtgcgcggcgtggagcggctgctggacgagggcgcccggcacgtggtggtgccggggaacctccccgccgggtgcatccccatcacgctcaccatgtacccctccgaggaccggtccgagtacgacccccgcaccggctgcctcaagaagtacaacagcgtcgcgctctaccacaacgccatgctccggatcgccctcgaccgcctgcagcgccgccgccccgaggcccgcctcgtctacgccgactactacacgccctacatccagttcgcgcgcacgccgcacctctacgggtacaagcgcggcgccctccgcgcgtgctgcggcggcggcgggccgtacaactacaacatgagcgcctcctgcggtctcccggggtcgacgacgtgcgaggaccccgacgcgcacgtgagctgggacggcatccacctcacggtggcgccctaccgcttcatcgccaacacctggctcaagggcccctacgcgcacccgccgctcgccaccgtcgtccgcgaggacatggtcgactgatcctggccatcagtccagccaggtggtagcgcggtgtcagtgtgcctgctgcctgcaagaagagatagtgagtgtgaagagagagagtgctaatataacggatgtgagtgcattccatttgttcatgtatattttgggataagtaagtgagatcgatcgatcggttaggttttttttcctttctgctttctccttgttttatttattatcacctgcaatcgagcgagtgtaatactctactactcttgttgctaaaaaaaaaaaaaaaaaaaa

SEQ ID NO: 3970 - protein, 377 aa, Panicum virgatum
  misc_feature: Ceres CLONE 1795909
  misc_feature (1)..(268): Pfam Name: Lipase_GDSL Pfam Description: GDSL-like Lipase/Acylhydrolase
MAASSRRRGFSLPAAACLVVVLLRCLSASAEPLPQYYNAIFSFGDSFSDTGNFVIINSGKLPNMPKFPPPYARCSNGRLVIDFLAEAFGLPLLPPSANKGTNFSQGANFAVMGATALDLKYFRDNNVWSIPPFNTSMNVQLQWFDEVKQTICSDPQECRAFFSKSLFVFGEFGGSDYSFAWKAEWPLDKVKTMVPAVVASLVRGVERLLDEGARHVVVPGNLPAGCIPITLTMYPSEDRSEYDPRTGCLKKYNSVALYHNAMLRIALDRLQRRRPEARLVYADYYTPYIQFARTPHLYGYKRGALRACCGGGGPYNYNMSASCGLPGSTTCEDPDAHVSWDGIHLTVAPYRFIANTWLKGPYAHPPLATVVREDMVD

SEQ ID NO: 3971 - DNA, 1688 bp, Panicum virgatum
  misc_feature: Ceres CLONE 1795917
  misc_feature: Encodes the peptide sequence at SEQ ID NO. 3972
gggagttgctaacaaccacacacctgacatgtccatcgttctagcaacgcttctccacatctgacatctccgtcaggcagataagcccaccgaatggtcgccatggccatggtccgagcatgcgcgcctcctgccgccgcaccctccaccagggacgacgctgcctcccaggtgaagaggtcgtcctactcctcgaggaccgcccgcgtgctcgtgctcggcggcaccggccgcgtcgggggttccacggccaccgcgctctccaagctccgccccgacctcagcgtcctcgtcggaggaaggaaccgggaaaagggtgaatccttcgcatctaaactcggagagcgatctgagtttgtccaagttgatacccgcgacgcaagaatgttggaggaagcgctacaaggtgtggatttagttgtccatactgctgggcctttccaaagggcggaggagtgcaccgtgttgcaggcagcaatatctacaaagacagcatatattgatgtttgcgacgacactgactattcctggcgagcaaaaggtttccatgaacaagcgaaatccgctggtgtcccagctattactactgccggcatatatcctggagtgagcaatgtgatggctgctgaacttgtcaatgctgcaagaagtgaaaatgatggcgaaccggaaagactaagattcttttactatactgcaggttctggtggcgctggtccaacaatactgacaacaagtttcctgcttcttggggaagatgtaattgcatacaacaagggaaaagaaatcaaactgaagccctacagtggagctctgaacattgattttggaaaaggggtcagaaagaaaaatgtttacttattgaatttgcctgaagtgaggagtgcctttaagattttaggtgtaccaactgtcagtgctcgatttggtacttctccttttttctggaattggggaatgcaggctttcgcaaacttcttacctgttgagttcttgagggataaaaataaggttcaaaagttagtcatgtcagttgatcctttggtccgagcaattgatggcattgcaggagagcgtgtctccatgagagtagacttggactgttcaaatggccggaataccattggactatttactcataagaagctatctgtatcagtgggctttgcaacagctgcatttgctttggcggttcttgagggcaacacccagccaggtgtttggtttccagaagagccagagggaataacagtcgaagcaaggaagcttcttcttgagcgtgcatctcaagggacaagcaacttcgtgatgaacaagccttcatggatggtagaaactgatccaaaggaagtcgggctaggaatttatgtgtgagaagattaagtgtgcttaaattcttggatgcttgacagagcttgactaaatctaaggagtaaaaagatgttgaatgtgacagccagcacccagcagcatgtcaaagtcccccagattgagcaagaattttttttaatgattggttgggctatctttattttgaaagggttgtatacaaaaatgatggttataagggaaaaaaactagtataggcggataaaacagttttgtgcaccacaagccacatgcttgaatggcagtggaagcacggtaaatacagcatcctagacccggaaaaaaaaaaaaaaaaaaaa

SEQ ID NO: 3972 - protein, 426 aa, Panicum virgatum
  misc_feature: Ceres CLONE 1795917
  misc_feature (1)..(350): Pfam Name: Saccharop_dh Pfam Description: Saccharopine dehydrogenase
MVAMAMVRACAPPAAAPSTRDDAASQVKRSSYSSRTARVLVLGGTGRVGGSTATALSKLRPDLSVLVGGRNREKGESFASKLGERSEFVQVDTRDARMLEEALQGVDLVVHTAGPFQRAEECTVLQAAISTKTAYIDVCDDTDYSWRAKGFHEQAKSAGVPAITTAGIYPGVSNVMAAELVNAARSENDGEPERLRFFYYTAGSGGAGPTILTTSFLLLGEDVIAYNKGKEIKLKPYSGALNIDFGKGVRKKNVYLLNLPEVRSAFKILGVPTVSARFGTSPFFWNWGMQAFANFLPVEFLRDKNKVQKLVMSVDPLVRAIDGIAGERVSMRVDLDCSNGRNTIGLFTHKKLSVSVGFATAAFALAVLEGNTQPGVWFPEEPEGITVEARKLLLERASQGTSNFVMNKPSWMVETDPKEVGLGIYV

SEQ ID NO: 3973 - DNA, 2032 bp, Panicum virgatum
  misc_feature: Ceres CLONE 1795960
  misc_feature: Encodes the peptide sequence at SEQ ID NO. 3974
cccaccgaggcaccgactcgtatagtcggatccccaaaggccgctcgccgtcgctccatttcccccaaattaacctgtgcccccgcgtccgcgccgagcacgcgcctccgtccagaactccagatccagccatcctcgcttgctcccgctgcagccgcacctctctccattccttcccgcatcggcggcgggcgggcgggcgtccttcgccttcctcttcccccgagcggggattggcgtggagacggtttcttcgtcttccggtaaggctgtcctggcttctcttgcacgggctgttcgtttcgccgcagagtcgcatcgttggttgtttcgccccccgtgagccgtcgaatcaaaatcattctttttcgagtggggattgcccctggacgtttagcttgtcgcggatttactcgctgcaagcgtagtgggggtggtaactggtaattgactaatttcagcggtttatttcccccaaatttgaaccgtctgcccctggtaatgtacggtctttcacttgagataaatgcctgctcttttctttttccctctactgtatcatcctcgtaccctattggttggcacttaaacgctgggacacaaattaagcataccattgctttcatttgtcattggcatttagctcatcgaatgctagatagggacttaagtcggacttttctttatttttttcgagtcctgctcctatctgttactgccacgagtatcatattttatatgctgattcccccctacttgttccagtgttatgtccttctccagtggcacagctgttcaactgaagagcagattcttgtagtgcgatggctgtggaaagagatgtctttggcatctctgggccgacatacctgaaatctgttgattggaactgcgagcataatcggagatctgtggctgcaagcttaattcaggctgtatatgtgttggagagagaccgacaattaaatcgccaatctgttgaagccctggctcctccttggtgggaattcttccattttgagctgattcgcaagctcattgatgatgccgatatgtccatatttggtgcaatatttgaattcaatcctccttcaagtgaagaagcttctgctgtgaatgctccaagatttgtcattgctttcagaggcaccataacagaaagggataccatctctagggatctttcccttgacatccaccttgtacaaaatggtctccacaggacctcaagatttaccattgcaatgcaagctgttcaaaatgttgcctcagtttttcctggatccaaaatttggttagcagggcactcattgggtgctggtatggctatccttactggaagaaacatggttaagaagggtgtgcttttggaaagctttctcttcaatccgccctttgtcgctgctccaattgaaaggatcagagatgaaaaggtaaagcacggtttccgcattgctagaagtgtaattaccgctggattaactattgcaatgaaaggtaaaactgaggggaacagtcagagatctgttgctgatgaatctttcagcattctgtcatcgtggacgccgtatctatacgttaacccaggagaccacatctgttcagagtacatcgggtacttccaacaccggaagaacatggaggatctcggtgctggttttattgagaagcttgcgacccagaattccatcggagatctgttcttcaaggcattagggtgggaatcagaaccactgcaccttctcccatctgctgacttgatcgtcaatgtgagcccttcacctgatttcaaatatgctcacagcatcagccaatggtggcagccagagctgaacttgcagtgcagtaaatatcggtacgaatagctatacactgctcgaaaaggaagatgttcttagaaactatagtcttctattctttcagtttattcatgtggtccattccatttatatgacacactatttcagacacaagactgcaaccttgacctgcaaaatctattgattatgtacaaaaaaaaaaaaaaaaaaaa

SEQ ID NO: 3974 - protein, 346 aa, Panicum virgatum
  misc_feature: Ceres CLONE 1795960
  misc_feature (1)..(121): Pfam Name: Lipase_3 Pfam Description: Lipase (class 3)
MAVERDVFGISGPTYLKSVDWNCEHNRRSVAASLIQAVYVLERDRQLNRQSVEALAPPWWEFFHFELIRKLIDDADMSIFGAIFEFNPPSSEEASAVNAPRFVIAFRGTITERDTISRDLSLDIHLVQNGLHRTSRFTIAMQAVQNVASVFPGSKIWLAGHSLGAGMAILTGRNMVKKGVLLESFLFNPPFVAAPIERIRDEKVKHGFRIARSVITAGLTIAMKGKTEGNSQRSVADESFSILSSWTPYLYVNPGDHICSEYIGYFQHRKNMEDLGAGFIEKLATQNSIGDLFFKALGWESEPLHLLPSADLIVNVSPSPDFKYAHSISQWWQPELNLQCSKYRYE

SEQ ID NO: 3975 - DNA, 1535 bp, Panicum virgatum
  misc_feature: Ceres CLONE 1795972
  misc_feature: Encodes the peptide sequence at SEQ ID NO. 3976
tataggccgcgtcggcgggcggcggcgccaatgctcccccctcgacaagcatgaaccacggcgaggaacgagactctctcctgggccctggcttccgaagcgatcaagcgaaaggaacaagctgtcgacgacgtaacccaagacagggtcgatgagaccgatcagaatctcttgctgatttccatggcaaattaacccgcccttgatcgaggcacgcagaaaccaagaagagtgacaccaaggaacacgggcacacagccagcagccaaggcctactgctatatatacagacacggaatcaatcagctaatagccatcgagccgagagcagcaccggccgcatcttgtcgatcgacgccgcgatcgagctcgctagctcgaagctttcaagggaggcgatggagggagacaaggccagcggctgcggcggcctggtgctgctcaactgcttcgtgagcccctacggcaaccgcgtgcgcatcgcgctgaagcgcaagggcctggcgtacgaggagaagcccgagaacctggcggccaagagcgcgctgctgctgtcctccaaccccgtccacgccaaggtccccgtcctcctcgtcgggggcaagcccgtgtgcgagtcgctcgtcatcctccagttcatcgacgaagccttcgccggcgccggcgagccgctcctccccgccgccccctgcgcccgcgcgcacgcccgcttctgggcctcctacgtcgacaccaagctgccggagtgcgcggtgcgcgtgtggcggtcgcccaagggagctgcggcggtggaggaggggaagaaggacatggtggccgtgctcaagacgctggaggcggagctgggcgccaagccctacttcgccgaggacgcgctcgggtacgtggacgtggcgttggtgccgttcgcgccgtggttcctgacctacgagaggctcggcgggttcaccatcgccgccgagtgcccggcgctcgcggcttgggcggagcgctgcgtccgggagaacgagtgcgtggccgagtcgctgccggagcccgaggacgtgttcgagttcgtgtgcggcatgaggaagatgctcggcctcgactgaggcgcgcgcgcggcgcggcgcgggtgctcgccgcccctcgcgggcggcgccggcaagatatataagcttggctgcaataaggagggaatggatcatcgggtcggtgcctgtgttttggtttgctttgcacgcacggcccgcgcggtgcgcgactgtgcaccgttggatgcataacctcgtcacaaacttgtcgatgcttggctattgtgacgcatgtcgttttgtgctcttgtgtttttcaaatcttgctgatttttttcgcgacgttttgacatttgtggttgtaatttctttttttttctcttcaggacttgtttggcagtggttgattttgaattgataaatgattttcacgccatccgcttgggtgtgtgggcgtgcatgtgcgtttatgacttgtactcataaaggaaataaactacataaaaaaaaaaaaaaaaaaaa

SEQ ID NO: 3976 - protein, 230 aa, Panicum virgatum
  misc_feature: Ceres CLONE 1795972
  misc_feature (1)..(72): Pfam Name: GST_N Pfam Description: Glutathione S-transferase, N-terminal domain
  misc_feature (1)..(104): Pfam Name: GST_C Pfam Description: Glutathione S-transferase, C-terminal domain
MEGDKASGCGGLVLLNCFVSPYGNRVRIALKRKGLAYEEKPENLAAKSALLLSSNPVHAKVPVLLVGGKPVCESLVILQFIDEAFAGAGEPLLPAAPCARAHARFWASYVDTKLPECAVRVWRSPKGAAAVEEGKKDMVAVLKTLEAELGAKPYFAEDALGYVDVALVPFAPWFLTYERLGGFTIAAECPALAAWAERCVRENECVAESLPEPEDVFEFVCGMRKMLGLD

SEQ ID NO: 3977 - DNA, 1459 bp, Panicum virgatum
  misc_feature: Ceres CLONE 1795976
  misc_feature: Encodes the peptide sequence at SEQ ID NO. 3978
tctcgcttcttcgctcccttaatttatcactcctataatttattttactatttccgtcttctcaacttagtatcccgattgtacccgcacctccagaaagtcagaactcggattgcttgtcagaataaaatttcgcactggttcggattggccaatcggggatcctccggtctcctccccaagttcttgagctccgaaatcgcgcgcgacgggattcggcctgggttccgccgatttggacctccgggcatggagcgccgcgggttgctaaaggcggctcttttgctgtgcttgcttgctgtttgctccgggagagaacttacgatcaaacataagccctcaactaccatatacaactccactcttgccaagatacttgtggagtatgctgctgcaatctatactgctgatttgacacaattgtttaattggacatgtgctcgatgcggtgacttgatcaaggggttcgagatgatagagatcgttgtgaatgtcgagaactgcttggaggcatatgttggtttcgctagtgatattaatgcactcgttgttgtgtttagaggaactcaagagaacagcatccagaattggatagaggacttgttatggaaacagcttgatcttgactaccctggtatgcctgaagcaatggtgcaccgagggttttattctgcctaccacaacacgacactgcgtgatggagtagtcagtggtattcaaaagactaggaaattttacggagatattccaatcatgatcacagggcattcaatgggaggagctatggcttcattttgtgcactcgatcttgttgtgaactacggactggatggcgtaaaactgatgacatttgggcagcctcgtattggcaatgctgcttttgcttcttatttcaagacacacttgcctcatgcaattcgagttactcatgcccatgatattgtgccccacctgccaccatacttctcattcttcccagagaagacctatcatcacttcccaagagaggtatggatccataacattggactaggaagcttagtctacaatgtggagaagatctgcgatgattctggtgaagacccaacatgcagcaggtcggtaagtggaactagtgtgcgcgaccatatatactatctcggtgttagcatgcatgcagaagactggagcagctgcagaatcgtcatggattacagcaaattgcagtatcagatggacctcaacggtaatgtcatattgtcaaagcagcctggtttgtcgaatgatagagggttcagtgcccagtgaacaagtgtatgatgtgtatagtacgatagcatcacgaatcagtaatgtgagctagcactgcacagatattccctctcatctccgttatgatgcttgctgttaaattattcctgcatcaaaccggagggtgaaaggagcatgcagatttggataaaaaaaaaaaaaaaaaaaa

SEQ ID NO: 3978 - protein, 345 aa, Panicum virgatum
  misc_feature: Ceres CLONE 1795976
  misc_feature (1)..(141): Pfam Name: Lipase_3 Pfam Description: Lipase (class 3)
MERRGLLKAALLLCLLAVCSGRELTIKHKPSTTIYNSTLAKILVEYAAAIYTADLTQLFNWTCARCGDLIKGFEMIEIVVNVENCLEAYVGFASDINALVVVFRGTQENSIQNWIEDLLWKQLDLDYPGMPEAMVHRGFYSAYHNTTLRDGVVSGIQKTRKFYGDIPIMITGHSMGGAMASFCALDLVVNYGLDGVKLMTFGQPRIGNAAFASYFKTHLPHAIRVTHAHDIVPHLPPYFSFFPEKTYHHFPREVWIHNIGLGSLVYNVEKICDDSGEDPTCSRSVSGTSVRDHIYYLGVSMHAEDWSSCRIVMDYSKLQYQMDLNGNVILSKQPGLSNDRGFSAQ

SEQ ID NO: 3979 - DNA, 1098 bp, Panicum virgatum
  misc_feature: Ceres CLONE 1795988
  misc_feature: Encodes the peptide sequence at SEQ ID NO. 3980
gcggcaagcgacgcgggggaggagaggcagcggcggcgcggcgacatcgcgaggccagacgcaggcgccgaggaggaggagttgcggagaccagcgcacggctcggccatggacaccttcttcctgtcgcacggctcgccgacgctctccatcgacgaggcgatcccggcgcggcacttcttcaagtcgtggctgccagcgctggtcgcgggggaccggccgccgcgcgccatcctcgtcgtctcgggccactgggagacggccacgccggcggtcaacgtcatccgcggcaccaacgacaccatccacgacttctacggcttccccaagcacatgtaccagctcaagtaccccgcccccggcgccccggacttagccctgcggaccaaggagctcctggagcaagccgggttcggccccgtgaaggaggaccacagccgcgggctggaccacggcgcgtgggtgccgctgatgctcatgtacccggacgccgacatccccgtgtgccagctctcggtgcagaccgaccgcgacggcgcgtaccactacaacctcgggcgggcgctggcgccgctgcgggaggagggcgtcctcgtcctcggctccggcagcgccacgcacaacctgcgcaagatggggcccatggacgcgcccgtgccgcagtgggcggccgagttcgacacctggctcaaggacgcgctcctcagcggaaggtacgatgacgtgaaccggtacgaggagaaggcgccgcacgcgaaggtggcgcacccgtggccggaccacttctacccgctgcacgtcgcgctgggcgccgccggggacagcgcgaaggcggagcagatccaccagagctggaccaacgccacggtctcctacgcttgttacaggttctccacaaacaagtgacggccgggtaattgctgaatgattgtgaagtgtgaaccatatcatccgtgttcatgtatagtatacccaacgcttgtaattgtaacattgtgtgcaccagacataatgtttgattgtatcgttcagtgaggtggcttattatttcagaaaataaagctctctggagtttggcaaaaaaaaaaaaaaaaaaaa

SEQ ID NO: 3980 - protein, 265 aa, Panicum virgatum
  misc_feature: Ceres CLONE 1795988
  misc_feature (1)..(261): Pfam Name: LigB Pfam Description: Catalytic LigB subunit of aromatic ring- opening dioxygenase
MDTFFLSHGSPTLSIDEAIPARHFFKSWLPALVAGDRPPRAILVVSGHWETATPAVNVIRGTNDTIHDFYGFPKHMYQLKYPAPGAPDLALRTKELLEQAGFGPVKEDHSRGLDHGAWVPLMLMYPDADIPVCQLSVQTDRDGAYHYNLGRALAPLREEGVLVLGSGSATHNLRKMGPMDAPVPQWAAEFDTWLKDALLSGRYDDVNRYEEKAPHAKVAHPWPDHFYPLHVALGAAGDSAKAEQIHQSWTNATVSYACYRFSTNK

SEQ ID NO: 3981 - DNA, 2098 bp, Panicum virgatum
  misc_feature: Ceres CLONE 1795989
  misc_feature: Encodes the peptide sequence at SEQ ID NO. 3982
agtacttccattgctctcatctcatctcatctcatctatcccttagcttcttgctcttcttctttcccctcttcttccagctgctgctctttccattagccagccagcagagatctcttccagcttgcttggcacttggtgatcgatccggcctcgatctttctcttgattgtgttcctgccagcgatcgattaccatcagaattgtaatccacatatatagatagatagagagagctagctgattgttggatctctactcgctcgctccggccgggatatattgttttagctagctatagctaggcggcctctaataattagattaaagcagctgctggtatatattagtagatcgacgactagctagctaggcagctgcctgcagcaggtggatcatcgatgcttgaggtgtcgatcctgcggagccctagcaaggcggatcatcatcagcgcgggttcgtgggcgaccatgtcgtgttcccgacgtccggcagcgtctgctgcgacgatttcatggtcgacgacaacctgctggactacatcgacttcagctgcgacgccgtgcccttcttcgacgccgacggggacatcctccccgacctggaggtggacccaacggagctcctcgccgagttctcctccccggaggcgagcccgacggcggctcacgcggaggccaagccgccggatgacctacgacgacgacaaccagaagaagaagcagtagtattgagcacgagtacaacgacggcgacgatagtagaagagaagaaagctgcagagcgggtgttgtcggccaaagatgagaaattagccgcggcaggtgtgagtgtgacgacgaggacgatgaggaagaaggtggatggtgaggggtcgagcgcggaggaggactctggcggcgccgggtcggacaccaagtggtcggcgtcggcggggggccacggcaagaagaagacggcggcggcggacaagaactcttccagcggcaaaaggaaggtgaaggtggactggacgccggagttgcaccggcggttcgtgcaggcggtggagcagcttggcatcgacaaggctgtgccgtcccggatcctcgacatcatggggatcgactgcctcacacgacacaacattgccagccacctccagaagtaccggtcgcacaggaagcacctgatggcgcgggaggcggaggccgcgacctgggcgcagaagcgccaccagtacatgtacgcgccggcgccggcgaggaagctggacgcggcggccgcaggaggaggcccgtgggtggtgccgacgaccatcgggttcccgcggcccgccttgtgccgggcgctgcacgtgtggggccacccgcccagcgcaggcggcgttgacgctcctccgacggtgctgcccgtgtggccgcggcaccttgcgccgccccggccatgggcgccgccgccggcgtactggcagcatcagtataatgcggccaggaagtggggtccacatcatcaggcagcagcagcagcagtgacgcccgccatggtgccgcagctgccgaggttcccggtgccgccgcacccggccaccatgtacagacccacctgcagcagcagtatggtcgtcccgccgccgccgccgacgagcaccaagctcgccgacttgcagcttcagctcgacgcgcacccgtccaaggagagcatcgacgcggccattggagatgttttagtgaagccatggttaccgctgccgctggggctcaagccgccctccatggacagcgtcatgtcggagctgcacaagcacggcataccaaaggtcccaccctccagcggctgatccatccatgctgcatgcaatgcaatgcaactactcgtcgacatgtaatgtattatattatattatattatattgccaccagagcaagagtacactagtatgtagcaagctaggcagagggcgttctgtgcgtgcgtgcgtgtattaaattaattaaataatctaggtgtgcaaagacccaacttatatgtatgtgcatgtatgcaaactgattcatgatagaataaccatctgaatggattgcactggtgttgatttaaaaaaaaaaaaaaaaaaaa

SEQ ID NO: 3982 - protein, 472 aa, Panicum virgatum
  misc_feature: Ceres CLONE 1795989
  misc_feature (1)..(51): Pfam Name: Myb_DNA-binding Pfam Description: Myb-like DNA-binding domain
MLEVSILRSPSKADHHQRGFVGDHVVFPTSGSVCCDDFMVDDNLLDYIDFSCDAVPFFDADGDILPDLEVDPTELLAEFSSPEASPTAAHAEAKPPDDLRRRQPEEEAVVLSTSTTTATIVEEKKAAERVLSAKDEKLAAAGVSVTTRTMRKKVDGEGSSAEEDSGGAGSDTKWSASAGGHGKKKTAAADKNSSSGKRKVKVDWTPELHRRFVQAVEQLGIDKAVPSRILDIMGIDCLTRHNIASHLQKYRSHRKHLMAREAEAATWAQKRHQYMYAPAPARKLDAAAAGGGPWVVPTTIGFPRPALCRALHVWGHPPSAGGVDAPPTVLPVWPRHLAPPRPWAPPPAYWQHQYNAARKWGPHHQAAAAAVTPAMVPQLPRFPVPPHPATMYRPTCSSSMVVPPPPPTSTKLADLQLQLDAHPSKESIDAAIGDVLVKPWLPLPLGLKPPSMDSVMSELHKHGIPKVPPSSG

SEQ ID NO: 3983 - DNA, 1634 bp, Panicum virgatum
  misc_feature: Ceres CLONE 1795993
  misc_feature: Encodes the peptide sequence at SEQ ID NO. 3984
acgctaacgaacggcacgggcgggagccgcaccggaacctaaccgagagcaccagacacctcgctccacctccaagactccgtttccggacttccagactccagagcggccgcggaggaaccgtgggggcaaaggaaagggaagactcgcgtcgcgtgacgtgtgcccgcgtcgtatgcgccgcgctgccgtcgcgacgacgaccaggaccaggatggcggccgaggagatgagacgggcctcggcctccgcggcggcggcggaggcggcgccggcgcaggcggggtcgaggtgggcgcgggtgtggccgcccgcgctccggtggatccccacctccaccgaccgcatcatcgccgccgagaagcggctcctctccatagtcaaaaccggatatgtccaggaacaagtcaacattggctcagctccacctgggtcaaaagtaagatggtttagatctgcaagtgatgaaccaaggttcatcaatactgtaacatttgatagcaaggagaacgcccccacccttgttatggtccatggctatggggcttctcaagggttcttctttcgaaactttgatgccctcgcaaaccgttttagggtgattgccattgatcagcttggctggggtggttcaagcagacctgacttcacctgtaaaagtaccgaagaaactgaggcatggttcatagattcttttgaggagtggcgcaaggccaagaacctcagtaactttatattgcttggtcattcttttggaggatatgttgcggcaaagtatgccctaaagcaccctgaacatgtgcagcacttgattttggttggtcctgctggcttctcgtcagaaacagagcatagctctgagtggttaacaaagtttcgagcaacatggaaaggcatgctaatcaatcatctttgggagtccaattttactcctcaaagaattgttagaggattgggtccttggggtccaggtctagtacaaagatatatcagtgctaggtttggtacaagttcaacttgtgaattactaacagatcaagaatctgcattgctgacagattatatttaccataccttagccgccaaagctagtggagagctgtgcttgaaatacatattttcctttggggcatttgcaaggaaacctcttctgcagtgcgcatctgattggaaagtgccgactactttcatatacgggcagcaagattggatgaactaccaaggggcgcagcaagcgcggaaggacatgaaagttccttgtgaaataattagagtcccacaggggggtcatttcgtgtttattgacaacccgtcggcgttccactcggctgtgatgtatgcctgtcgtaatattttatctggagctggagaggagggccccactcttcctgatggcttaatatccgcatgagatcgcatcctcaacaatctcgtgcccaacaatagtagtctagtacatgataaagcaaagcttatacgatggtggaactatttgtgcccatctccaccagattgtttgtgtacgaattgggctgatattttccgtgtacatattctgtatcaattgtgagaaacgtaaagttatgtaatgtacgaattctttatttgattttcaaaaaaaaaaaaaaaaaaaa

SEQ ID NO: 3984 - protein, 411 aa, Panicum virgatum
  misc_feature: Ceres CLONE 1795993
  misc_feature (1)..(250): Pfam Name: Abhydrolase_1 Pfam Description: alpha/beta hydrolase fold
MRRAAVATTTRTRMAAEEMRRASASAAAAEAAPAQAGSRWARVWPPALRWIPTSTDRIIAAEKRLLSIVKTGYVQEQVNIGSAPPGSKVRWFRSASDEPRFINTVTFDSKENAPTLVMVHGYGASQGFFFRNFDALANRFRVIAIDQLGWGGSSRPDFTCKSTEETEAWFIDSFEEWRKAKNLSNFILLGHSFGGYVAAKYALKHPEHVQHLILVGPAGFSSETEHSSEWLTKFRATWKGMLINHLWESNFTPQRIVRGLGPWGPGLVQRYISARFGTSSTCELLTDQESALLTDYIYHTLAAKASGELCLKYIFSFGAFARKPLLQCASDWKVPTTFIYGQQDWMNYQGAQQARKDMKVPCEIIRVPQGGHFVFIDNPSAFHSAVMYACRNILSGAGEEGPTLPDGLISA

SEQ ID NO: 3985 - DNA, 2245 bp, Panicum virgatum
  misc_feature: Ceres CLONE 1796001
  misc_feature: Encodes the peptide sequence at SEQ ID NO. 3986
acagctctactacctctcctaccccctcctccacctctgtggtctctagctacctccctctccattgctcaagtcgccgcggcatccattgccatggcagtccagccgtccatggagacgcaagcgcccgggaattcttctccacccaaggatggcaggagcgccgaggagaaggctgtggaggactggctcccgatcaacgcgtcgcggaacgccaagtggtggtactcggcgttccacaatgtcacggccatggtcggcgctggcgtgctcggcctcccctacgccatgtccgagctcggctggggcgccggcatcgccgtgctggtcctgtcgtgggtcatcactctgtacacgctgtggcagatggtggagatgcacgagatggtgccgggccggcggttcgaccggtaccacgagctcgggcagtacgccttcggcgagaagttgggcctctggatcgtcgtgccgcagcagctgatcgtggaggtgggcgtgaacatcgtgtacatggtcaccgggggcacctcgctcaagaagttccacgacaccgtctgcgaagactgcaagagcatcaagctcacctacttcatcatgatcttcgcctccgtccacttcgtgctctcccagctccccaacttcaactccatctccggcgtctccctcgccgccgccgtcatgtcgctcagttactccacgatcgcgtggggcgcgtcggtggacaaggggaagctggaggacgtggactacagcctgcgggcgacgacgacgccggggaaggtgttcggcttcctaggggcgctggggaccgtggcgttcgcgtacgcggggcacaacgtggtgctggagatccaggccaccatcccgtcgacgccggagaagccatccaagaaacccatgtggaggggcgtcgtcgtcgcctacatcgtcgtcgcggtgtgctacttccccgtctcgctcgtcggctactgggccttcggcaacagagttgacagcgacatcctcatcacgctctccaggccaaagtggctcatcgccctcgccaacttgatggtcgtcatccatgtcatcggcagctaccagatttacgcgatgccggtgttcgacatgatagagacggtgctggtgaagagactaaaattccctccaggcctgacgctccggctgattgctcggactgtctatgtcgcgttcacaatgttcatagcaatcaccttccctttctttgatggactgctcagtttctttggtggatttgcattcgcaccgactacctatttccttccgtgcattatgtggcttgcaatctacaaaccgaaaaggttcagcctatcatggttcactaactggatttgcattgttcttggagtgctgctgatggtactggcgccaattggaggactccggaatatcattctgaatgcaaagacatacaaattctaccagtaaacatgattagctaacacaaacaccttgttttgacctacagttaacaggactgcagaatgtctcggatcatcatcagctgaaaccagttctggatttgatacagcgtgacactacaatttttttggcaccacaaaaaactcgtattaagtggtgcaaggaaaccgactactgtgtctaatatgagccttttggaaagaaaaaatgggaatgccatggcatcaatacaaatttggaacatgtttcagttgatgacgcctcttgacatgtcctgttagtgttaaactaggaatttgagctgagttaaacatataatattcttgggcaatttttgcttttatgcgcatagactagggagaacaaatcctggtggtttgtttttcttccatccaaagttcactaatgttttggagttggaagtttgaaatagtgccaagaatatgttatttgggacttgagatttggccttttcatttcatttcattcctactactacatagtaatgtttcttctactcagctatccattggcttcatacttggactatcctacggaagacagcttagtggatttggttgcagctgttttgcccttgtggtcaaagagtgttttacccaggaatatgatggtggtcagtcttcggattgatagctattagcatgcatgtactcttttgtttcttttttattttctatcctccaagatcttgtatcatcttgatgtaaattggaaattaataatatttttcttataataaaacacaccaatctttctttcttaaaaaaaaaaaaaaaaaaaa

SEQ ID NO: 3986 - protein, 451 aa, Panicum virgatum
  misc_feature: Ceres CLONE 1796001
  misc_feature: Great-hit functional homolog of the protein sequence given in SEQ ID NO 9238
  misc_feature: Useful for making plants with altered oil content
MAVQPSMETQAPGNSSPPKDGRSAEEKAVEDWLPINASRNAKWWYSAFHNVTAMVGAGVLGLPYAMSELGWGAGIAVLVLSWVITLYTLWQMVEMHEMVPGRRFDRYHELGQYAFGEKLGLWIVVPQQLIVEVGVNIVYMVTGGTSLKKFHDTVCEDCKSIKLTYFIMIFASVHFVLSQLPNFNSISGVSLAAAVMSLSYSTIAWGASVDKGKLEDVDYSLRATTTPGKVFGFLGALGTVAFAYAGHNVVLEIQATIPSTPEKPSKKPMWRGVVVAYIVVAVCYFPVSLVGYWAFGNRVDSDILITLSRPKWLIALANLMVVIHVIGSYQIYAMPVFDMIETVLVKRLKFPPGLTLRLIARTVYVAFTMFIAITFPFFDGLLSFFGGFAFAPTTYFLPCIMWLAIYKPKRFSLSWFTNWICIVLGVLLMVLAPIGGLRNIILNAKTYKFYQ

SEQ ID NO: 3987 - DNA, 2232 bp, Panicum virgatum
  misc_feature: Ceres CLONE 1796003
  misc_feature: Encodes the peptide sequence at SEQ ID NO. 3988
agctagctatctattcacactagtcacgcacgcgctctcctcctcctcccttcatcccccccactggccactgctaaccaaaagggagagcgagccagccggcctgcaagccctcttctccctcccaagccattgccagcactgcaagagcaatggcggccctggcgccgctcctcgccgtcgccttcctggccgccgccgcgcacgccgccgaccccttcgccttcttcgactgggacgtcacctacatgacggcctccccgctcggcgtcccgcagcaggtgattgcaatcaacaagcagttccctggccctgtcatgaatgtcaccaccaactacaatgtcgtcgtcaatgtgctcaacagcttggatgagccactgctcatcacatgggatgggatccagcaccgcaagaattgctggcaggatggggttctcggcacaacctgccccataccgcctggttggaactggacctacaatttccaagtcaaggatcagattgggagcttcttctactttccatcccttggtatgcagcgtgctgctgggggtttcggaggtatcaccgtcaacaaccgtgccgtgatctcagtcccattcgacacgccagatggggacatcacgttattcatcggggattggtacaagaagaaccacacgcaccttaggaagatgcttgatgatggaaaggagttggggatgccagacggtgttttgatgaatggcaaggagccatataggtacaatgattccctcgtccaggatggcattgagtacgagactatcaaagttgagccaggaaaaacataccgtttccgtgtccataatgtgggtgtctccacaagcttgaacttcaggattcagaaccacaacctggcccttgttgaaacagaaggttcatacacaatgaagcagaatttcacaaatctcgacatccacgtgggacagtcttactctttcttggttacaatggatcaaaatgcaagcagtgattattacattgtggccagtgctaggtttgtgaatgaatccctctggaccagagttactggtgttgcaattttgcaatattcaaattcaaagggcaaagcatctggtcctcttcctgatcccccaaatgatgagtatgacaaaactttctcaatgaaccaggcacgctcaatcaggatgaatgtgagcacaggcgctgctcgtccgaatcctcagggttcatttcactatggttctatcaatgtgagccagatttacaagctgaggaatgaaccacctgttatcatcaatgggaaaaaacggactacactgagtggtatctcttattcgccacctgatactcctctgagattggcagatctctatgacaagaagggactctacacactcgacttccctacaatgccaattgatgggccaccagtgatcagaacatctgtcattaactccacatacaagaactttttggaaattgtatttcagaacaatgacacaattgtccagacctaccatatcgatggatatgcattctgggttgtaggaatggactatggtgagtggactgagaatagccgcggaacttacaacaagtgggatggtgtttctcgttgcacaactcaggtgtttcctggagcatggactgctgtgatgctgtcacttgacagcccaggtttctggaatgtgcgcacagaaaatctggacacatggtatctgggtcaggagacttacatcagggtggtggatccagatggaggctataatgttactgagatggtgtcaccagataacatgctctactgtggcctcctcaaggataaacagaaggctcagaagccgcatggttcatcgagttcagctgctgcagcgaaactgaacaactatctgctcgtggttttggtctctttgttagccttggcgttgggccattgacagaaattgccagcttgtgctcagctgctgtttgcagattaggagtttgacagaattgaagtaggttcgactcgatttgtgtaggctgcattcatgatttgtgtggaaatggaaatggcggatttgtgcatcttgaacgatgagaattgtgtagtagtagcaaaccaattgcatcgtattacattgagcctgtcggcagtcggcacccgcaaaagaaaggagtgctgtgttgcctgtgatgttttaattgctttgtggagtgttggatattgtcatccactttgcaggcaaaaaaaaaaaaaaaaaaaaa

SEQ ID NO: 3988 - protein, 589 aa, Panicum virgatum
  misc_feature: Ceres CLONE 1796003
  misc_feature (1)..(117): Pfam Name: Cu-oxidase_3 Pfam Description: Multicopper oxidase
  misc_feature (1)..(140): Pfam Name: Cu-oxidase_2 Pfam Description: Multicopper oxidase
  misc_feature (1)..(156): Pfam Name: Cu-oxidase Pfam Description: Multicopper oxidase
MAALAPLLAVAFLAAAAHAADPFAFFDWDVTYMTASPLGVPQQVIAINKQFPGPVMNVTTNYNVVVNVLNSLDEPLLITWDGIQHRKNCWQDGVLGTTCPIPPGWNWTYNFQVKDQIGSFFYFPSLGMQRAAGGFGGITVNNRAVISVPFDTPDGDITLFIGDWYKKNHTHLRKMLDDGKELGMPDGVLMNGKEPYRYNDSLVQDGIEYETIKVEPGKTYRFRVHNVGVSTSLNFRIQNHNLALVETEGSYTMKQNFTNLDIHVGQSYSFLVTMDQNASSDYYIVASARFVNESLWTRVTGVAILQYSNSKGKASGPLPDPPNDEYDKTFSMNQARSIRMNVSTGAARPNPQGSFHYGSINVSQIYKLRNEPPVIINGKKRTTLSGISYSPPDTPLRLADLYDKKGLYTLDFPTMPIDGPPVIRTSVINSTYKNFLEIVFQNNDTIVQTYHIDGYAFWVVGMDYGEWTENSRGTYNKWDGVSRCTTQVFPGAWTAVMLSLDSPGFWNVRTENLDTWYLGQETYIRVVDPDGGYNVTEMVSPDNMLYCGLLKDKQKAQKPHGSSSSAAAAKLNNYLLVVLVSLLALALGH

SEQ ID NO: 3989 - DNA, 1903 bp, Panicum virgatum
  misc_feature: Ceres CLONE 1796015
  misc_feature: Encodes the peptide sequence at SEQ ID NO. 3990
accaccactagggttttcggattaggtttctagaacattccgccgccgcctcatgcacgcgccgccgctggtcgcgctcgccgggggcgcctgccccgtcgccgccccgccgccgccgtggctggcctcgccccgggctgccatcctcgccgcgccggcgaggctcctccggtcccgccgcggtgcgctccggctggaagccaaggccgcgtggagggcggcctggggcgggcggggcccgcgggtcccggccaagggcgccgtgctcgcctcctacatgggtgccgaggaggtggtgggaccctcgcccctgctcgacgaggagggtctcgacgatgaagagctcattttacacatcagaaaggaactggaggagggaaaactgcctgcagatgttgctagcagcttggaggagctctattacaattacaagaatgctgttctgcaaactggaaatccagatgcatatgagatcatgctttcaaatatgatggctttgtttgatcgtgtcatactggatgtacagaatccatttacctttccaccatatcacaaagctatccgagaaccattcgactattacatgtttggtcagaattacattaggccactggtagactttaggaactcctacgttggcaacatttcccttttccatgacattgaagagaagctccaccagggccacaatgttgttttgatgtcaaaccatcagacagaagcagatccagcaattatcgccttgctgcttgaaaaaagcaatccgtggattagtgaaaacatagtttatgttgcgggcgatagggttattactgatccgctttgcaagccatttagcatgggaaggaacctgatttgtgtgtactcaaaaaagcatatgaatgattaccctgagctaattgagatgaagaggagatcgaatactagaagtctcaaggaaatggccttgcttttacgcggcggttcacagttgatttggattgcgccaagtggtggtagagaccggccagacccttcgacaggagaatggtacccggcgccattcaattcatcctcagtggataacatgaggaggcttctggagcatgctggtgttcctgggcacatatatccactatcattgctgtgttatgaggttatgcctccaccacaacaggtcgagaaagagattggtgagcaaagggtgatatccttccatggagtaggcttatcggtaactgaagaaataaagtatgtggatattactgctcataccaagaatgctgatgagggaagggagctattcacagatgctttgtacagctcagttgttaatcagtacaatgtgctcaagtctgctatctttagagaccgtggagcagcggctgcatcaaacactgccatctcactgtcgcaaccatggcgatgaatgtctagattccatagtgaagttaccttactttttcagaagatcagatggaggggcattgacattgtacaattttgatgggagaaattcttaaactttaaactttgacgtcaccgtactttattaatcatggaggtgcccgttactgccatcctgtcaagcgtgattagtggctttgcatacatggatcccatgcagtcggtccatctggtgcaagtattgtcgcctcaggttaaacagtgacatgctggttggacaccaaaggatccatcaggttgcatgcgccgaaccagcttgtcgatgagcaagtggatttgtgcggttgacgtcataattttgttaccgtctgtttggtgtacatagctttttgattctttctggctccacattcggagataaaaagcgtaacatgctcacagtcagtttctcagtgtagccctgaaatccatggatgtaacccgtctctttcgtgctcaaaaaaaaaaaaaaaaaaaa

SEQ ID NO: 3990 - protein, 451 aa, Panicum virgatum
  misc_feature: Ceres CLONE 1796015
  misc_feature (1)..(160): Pfam Name: Acyltransferase Pfam Description: Acyltransferase
  misc_feature (95)..(450): SWISSPROT Homolog: EC 2.3.1.15 Glycerol-3-phosphate acyltransferase, chloroplast precursor
MHAPPLVALAGGACPVAAPPPPWLASPRAAILAAPARLLRSRRGALRLEAKAAWRAAWGGRGPRVPAKGAVLASYMGAEEVVGPSPLLDEEGLDDEELILHIRKELEEGKLPADVASSLEELYYNYKNAVLQTGNPDAYEIMLSNMMALFDRVILDVQNPFTFPPYHKAIREPFDYYMFGQNYIRPLVDFRNSYVGNISLFHDIEEKLHQGHNVVLMSNHQTEADPAIIALLLEKSNPWISENIVYVAGDRVITDPLCKPFSMGRNLICVYSKKHMNDYPELIEMKRRSNTRSLKEMALLLRGGSQLIWIAPSGGRDRPDPSTGEWYPAPFNSSSVDNMRRLLEHAGVPGHIYPLSLLCYEVMPPPQQVEKEIGEQRVISFHGVGLSVTEEIKYVDITAHTKNADEGRELFTDALYSSVVNQYNVLKSAIFRDRGAAAASNTAISLSQPWR

SEQ ID NO: 3991 - DNA, 2063 bp, Panicum virgatum
  misc_feature: Ceres CLONE 1796029
  misc_feature: Encodes the peptide sequence at SEQ ID NO. 3992
gaggtggggagcagagggttgagggagggcggcaggtcgagcagctggcctattgctggtgaagagctcttccttggctttcttggtggaggcttctcaaggttcagtccaatggcgttgagcaggggagcggtgctcttcttcaagctcctggcgtgcctcctctggctcttcgagctgtcccatggcaagaagcagttccccttgaagaacctccctcctctccggaaggccagcagctaccccacggggtgcccggcgacgtacgactacattgtcatcggtggaggcaccgccggctgcccactggcggcgacgctgtccctcaagtacaaggtgctgctgctggagagaggaggctccccatatggcaaccgcaacgtctcctacatggagaacttccacatcgggctgctgaatatggcgccggactcggcggcgcaggccttcatctccaccgatggcgtcatcaatgcccgggcgagggtgttgggcggtggcacctgtatcaatgctggcttctacagccgggccagctcaagcttcatccagcaggtcggctgggatgaagaactggtgaacaagtccttcccttgggttgaggagaagattgtccagtggcctaagattgcgccttggcaggctgcattacgggatgggctgctacaagcaggtgtagcccctttcaatgggtatacctacgatcatgtttctgggacaaaagtggggggcaccatttttgacgagaccgggtaccgccacacggctgctgacttacttgcagctggagatcctaacaacctgagggtgctgctccatgctagtgtgcacaggatagtgttcgactcacgacaaggatgcctgaagccaagggccattggagtccaattcactgatgaaaatggcaggcaccaccaagcatttctgaacaacaaaaaagatagcgaaataattgtatctgctggtgcaatcgggaccccccagttgcttctgctcaacggaattggaccgaagaaccacctcaaaagccataacattcctgtggttctccataataaatatgtgggtaaagggatggctgacaaccccatgaactccatcttcatacccacaagaagccctccacggcagtccctcattgaaactgttggaataactgaagaaggtgtgtttattgaggctagcagcggttttggccagtcatcagagagtgtccactgccaccatggaatcatgtccgccgagattgggcagctgtctacaattcctccaaagcaaagaaccctggaagcagcccagaaatacactcagaacaaacttaacctacccaaagaggtattccatggcggttttatactcgagaagatcgatggtcctctgtccacaggtcatctggtcctcacagacactgatgtccggaacaacccagcagttaccttcaactacttcagtcatccacaggatctcaatcgttgcgtctatggtatcaagaccattgaaaggatactcaagacaaaccgtttctctgaactttctgctgatggcaccagattttcaatggaaagggtgctcaatatgagtgtgcaggctaatgtgaacctgatacccaagcatacaaatgacacagaatccctggagcaattttgcaaggacacagtgatcaccatctggcattaccatggtggatgccatgtagggaaggtggttgaccagcattaccgggtgcttggagtctcaggtctccgtgtagttgatggctcaatattttctagatcaccaggaacaaaccctcaagctactgtcatgatgatgggcagatacatgggagtaaagatcctaagggaaaggctgggacgtgcagctggagtgtagtcgattccaggacattagctttttattatgtgtggcctaggacagagattactaattttttgtgggatccagaatgaatcaccgaagaaaaacaagctacgagtttcatctgtacccagtagtcatttgtctaatatgatattgtagactgaatggttgattgaccccttcaaaaaaaaaaaaaaaaaaaa

SEQ ID NO: 3992 - protein, 586 aa, Panicum virgatum
  misc_feature: Ceres CLONE 1796029
  misc_feature (1)..(156): Pfam Name: GMC_oxred_C Pfam Description: GMC oxidoreductase
  misc_feature (1)..(287): Pfam Name: GMC_oxred_N Pfam Description: GMC oxidoreductase
MALSRGAVLFFKLLACLLWLFELSHGKKQFPLKNLPPLRKASSYPTGCPATYDYIVIGGGTAGCPLAATLSLKYKVLLLERGGSPYGNRNVSYMENFHIGLLNMAPDSAAQAFISTDGVINARARVLGGGTCINAGFYSRASSSFIQQVGWDEELVNKSFPWVEEKIVQWPKIAPWQAALRDGLLQAGVAPFNGYTYDHVSGTKVGGTIFDETGYRHTAADLLAAGDPNNLRVLLHASVHRIVFDSRQGCLKPRAIGVQFTDENGRHHQAFLNNKKDSEIIVSAGAIGTPQLLLLNGIGPKNHLKSHNIPVVLHNKYVGKGMADNPMNSIFIPTRSPPRQSLIETVGITEEGVFIEASSGFGQSSESVHCHHGIMSAEIGQLSTIPPKQRTLEAAQKYTQNKLNLPKEVFHGGFILEKIDGPLSTGHLVLTDTDVRNNPAVTFNYFSHPQDLNRCVYGIKTIERILKTNRFSELSADGTRFSMERVLNMSVQANVNLIPKHTNDTESLEQFCKDTVITIWHYHGGCHVGKVVDQHYRVLGVSGLRVVDGSIFSRSPGTNPQATVMMMGRYMGVKILRERLGRAAGV

SEQ ID NO: 3993 - DNA, 1790 bp, Panicum virgatum
  misc_feature: Ceres CLONE 1796043
  misc_feature: Encodes the peptide sequence at SEQ ID NO. 3994
agccagcccatctgctctccgccctctccgtaaggaagcaaagacgcaaacccctcgtccccccagaaaccctaaccctcgcgcgcccgcttcgtgggctcccctgccgcgctcgctgccccctcgacgccgccatgggctccgatgcagacatggaggactacggattcgagtactcggacgaggagccggaggagcaggacgtcgacatcgagaaccagtactacaactccaaaggtatggttgagacagacccagagggtgcacttgctggttttgatcaagtagtcaaaatggagccagaaaaggctgaatggggatttaaagctcttaaacaaactgtcaagctttactataagctggggaaatacaaagaaatgatggatgcctacagggagatgttaacatacataaaatctgctgtgacccgaaactacagtgagaaatgtataaacaacataatggattttgtttctggatcagctagtcagaacttttctcttttacaagagttctaccagacaacactgaaagctcttgaagaagcaaaaaatgagagattatggttcaagacaaacctgaagctttgcaaaatttggtttgatatgggggagtatggccgcatgaacaagatcctgaaggagctgcataaatcttgtcaaagggaagatggttctgatgaccaaaagaaaggcacacagcttttggaagtctatgctattgaaatccaaatgtacactgaaacaaagaataataaaaagctcaaggaattgtatcagagggctctgtctatcaaatcagcaatacctcatccaagaatcatgggtataattcgcgaatgtggtggtaagatgcacatggctgagaggcagtgggcagaagctgcgactgatttctttgaagctttcaagaactacgatgaagcaggcaacccgcggagaattcaatgtctcaaatatctcgtccttgccaatatgttaatggaatctgaagtgaatccttttgatggacaagaggccaagccgtacaaaaatgatcctgaaatccttgcaatgacaaacttgattgcagcgtaccagaagaatgacatcatggaatttgaaaagatcctaaagagtaatagacggacaataatggatgatcctttcatccgtaactacattgaggacctattgaagaacatcagaactcaagtcctgctcaagcttatcaagccatatacacggatcaggataccattcatttcacaggaactcaatgtccccgaaaaggatgtcgagcagctgttggtatccctgattctggacaaccggatccagggccacatagatcaggtgaacaagctgctagaacgtggagacaggtccaaggggatgaggaagtacaatgccatcgacaagtggaatagccagcttaagtcaatctaccaaacggtgtccaacagagttgggtgagacggctactggccgtcgcgtgatttgcacttatgagatatgttgatagcctgttttggggatctgagggcaaatacatattgttttatgacgcttgaggtagaaagttggatctgggtgacgcgaaatgccgatgtaatgtagagcttgaactgatctcagtgttcgagtctgaggcattactgtggtccaagccaattgccagtggggaaaacatgtaactacatccatctggttccttcacaactttttttgtgcttactgcccaagattcctttacatgcttgaaccagctgggaggcagctgcacttgaacaaaaaaaaaaaaaaaaaaaa

SEQ ID NO: 3994 - protein, 439 aa, Panicum virgatum
  misc_feature: Ceres CLONE 1796043
  misc_feature: Great-hit functional homolog of the protein sequence given in SEQ ID NO 9469
  misc_feature: Useful for making plants with modulated low light sensitivity
MGSDADMEDYGFEYSDEEPEEQDVDIENQYYNSKGMVETDPEGALAGFDQVVKMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMNKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRIQGHIDQVNKLLERGDRSKGMRKYNAIDKWNSQLKSIYQTVSNRVG

SEQ ID NO: 3995 - DNA, 1614 bp, Panicum virgatum
  misc_feature: Ceres CLONE 1796059
  misc_feature: Encodes the peptide sequence at SEQ ID NO. 3996
agtgcttgctcccatcagtacacacacacaccggccggccaggcagccaacacacagccctccgagatccctttcctttcctttcctccctgccttccttctccagcaagagctttctagctacaccgtcaaaaaaaaaaaggctttctagctagctagggtttacactacagtacttgtaccgagccaccgatcgatcaccgctccctgctctagagagaggtccttccttcgcaacgccgccgccagaattccggcgttcggcgttaggcgcgctcgctcgctcagctagctcatgggcggccggccatcccgtcagattcagccaaaggggccatggtgcaagctagttgagctgatctgagaggaaggaagtgtggactcttggtcatgcttgtgtgatcatgatcgcgcgcggtggctagctcaagatgataagtggcaacctcacaaatgaagagctggcggccaggtgcaccaaggccgaggccccggccgcgggcgccggcgccgtcgtcgccaagagtcccgccgtgccgagctcgcggcactggccgccgtccacggagtcgcggatcgtgcgcgtgtcgcgggtgttcggcggcaaggaccggcacagcaaggtgaggaccgtcaaggggctgcgcgaccggcgcgtgcgcctgtccgtgccgacggcgatccagctctacgacctccaggaccggctgggcctcagccagccgagcaaggtggtcgactggctgcttgacgccgcgcagcacgagatcgacaagctgccgccgctccagttcccgccacaagcgcaggacctcgtcgcacacctgcccccctccatggtggcgccgttcgcgaacggcgcagccgaccgcgccgccgccgccgcgaacgcggcgatggccgacggcgacaagcgccactgccacggcggcattaaaggactcatgggcttcaacaattcagtcggcctcgtcaatggcgcgatgccgctggctcacggattgtactacacgcccggcggtgaaccttgggcaaatggcaatgccgtccacgaccaggtgagccatggcacttcgcctcaaacggtggctcaccactcgccgttctcatcgctgctgtctctggctccggggcctcagctcgtcttctactcgccggaaggtggtggcttcgccatgaaagaagccgccgatcatcagttcctaggtaacctcgaccattcggaagggcagctctcactgagctcagcaagaagcttccttcaccccggcagccagggatgattaggtcactgatctctactgctccaagaaggtacgtagaacaataatgcttggtgtagtagtagtcaggtacggtatatggctgaagcaggttcgttaagcttatgattgcagttttgagatggtattcgaatagggggctccagaactacgtagagctgctagcatgcatagtaattaagccttttttcagggcatgcaatgcaattcgttgcttcttttttacgcaaggaagtaactggtatggtgtgtgtgtgtgtgtgttggtttttgtaataacagtttggtaatttttgaatttattcgtacctaaaaaaaaaaaaaaaaaaaa

SEQ ID NO: 3996 - protein, 283 aa, Panicum virgatum
  misc_feature: Ceres CLONE 1796059
  misc_feature: The sequence is a functional homolog of  SEQ ID NO 1202 in the  10/666,642 US patent application
  misc_feature: The sequence is a functional homolog of  SEQ ID NO 1406 in the  10/666,642 US patent application
  misc_feature: The sequence is a functional homolog of  SEQ ID NO 2378 in the  10/374,780 US patent application
  misc_feature: The sequence is a functional homolog of  SEQ ID NO 484 in the  10/666,642 US patent application
  misc_feature: The sequence is a functional homolog of  SEQ ID NO 538 in the  10/225,066 US patent application
  misc_feature: Useful for making plants with modulated growth and phenotype characteristics
MISGNLTNEELAARCTKAEAPAAGAGAVVAKSPAVPSSRHWPPSTESRIVRVSRVFGGKDRHSKVRTVKGLRDRRVRLSVPTAIQLYDLQDRLGLSQPSKVVDWLLDAAQHEIDKLPPLQFPPQAQDLVAHLPPSMVAPFANGAADRAAAAANAAMADGDKRHCHGGIKGLMGFNNSVGLVNGAMPLAHGLYYTPGGEPWANGNAVHDQVSHGTSPQTVAHHSPFSSLLSLAPGPQLVFYSPEGGGFAMKEAADHQFLGNLDHSEGQLSLSSARSFLHPGSQG

SEQ ID NO: 3997 - DNA, 2168 bp, Panicum virgatum
  misc_feature: Ceres CLONE 1796064
  misc_feature: Encodes the peptide sequence at SEQ ID NO. 3998
gcgcagagcctgggttacgttgggggcacattgggctcggggggacggggacttgagggtggtgaccacacgaacgaacagcacaggagcaaggagggccatggccaccaggccggggcctttgactgagtggccatggcagaggctcggcaacttcaagtacgtggtgatggctcccgtggtggtccacggcgcgcggcgggtggccggcggcggctggggcgacatcgacctcgccttcgcgctcatcctgccgtcgctgctgctgcgcatggtgcacaaccagatctggatcagcgccgcccgctaccagacggcgcgcagcaagcaccgcatcatcgaccgcggcatcgagttcgaccaggtcgaccgcgagcgcggctgggacgaccagatcatcctcaacgggttgttcttctacgtgggctacctgctcatcccgagcgcgccgcacctgccggcatggagggccgacggcgtcgtggcgatggcgctgctgcacgccgggcccgtggagttcctctactactggttccaccgcgcgctgcaccaccacttcctctactcgcgctaccactcgcaccaccactcctccatcgtcaccgagccaatcacatcggtgatccatccctttgctgagcacatggtctactacatcctgtttgcgatccccatgctgacgacggtttacatggggactgcctccgtcctgggctttgtcctctacatcgcctacatcaacttcatgaacaacatggggcactgcaacttcgagctggtgcccaagtgggtgttccaggtcttccctcccctcaagtacctcatgtacacgccctcgttccactccctgcaccacacgcagttccgcacgaactactcgctgttcatgccgttctacgactacatttacaacaccatggacaagtcatccgaccagctgtatcagagctcactcaaggggatagaggaaacgcctgaccttgttcacctcacgcacatgaccgacctgcagtcggcctaccatttacggatcgggttcgcctccatcgcgtccaacccatctaacagctctatgtggtggtatatgtggacgctgtggcccttggcatggctgtccatggtgtttgcgtgggtttatgggtcctctgcgtttgtggttgagagaatcaagctaaagaagctgaccatgcaaacgtgggcaataccaagatacaacttccaatatggcctgaactgggagagagaatccatcaacgacttgattgaaaaggcaatactagatgctgatgcaagaggcattaaagttctcagcctaggattgttaaatcaggcgaagcaactcaatggtggtggtgaattattcagacagaagtatccgaaattaagagttcgccttgtcgacggaagtggcttagcaactgcagtggtcctcaaaagcattcctcatgatgcaaagcaagtttttcttcatgcaggcccttctaaggtagcctgtgcaacagcttttgcattatgtgagaagggcgtcaaggtaatcatgaatccaaagaaggaatatgatatgcttaagtcacagattgcagatagcagagcaagctatttgaaacactccagcaaccacatgcctcagatttggctagtggacaacatcgatgacaaagaacagaagaaggcgccacaaggaactatattcattcctatctcacagttccccatcaaaaaaattcgcaaagattgcacttacttgagcaccccagcaatgaaaatcccagaaaccatgcagagtatccatgcctgcgagaattggctgccaagaaaggtgatgagtgcttggcgcattgctggaatacttcacgccctggaaggatggaccatgcacgagtgtggggatgccatgatggacgctgagaaggcatggtcggctgctataagccacgggttcgttcctctgataaagcttgagagctttcggagcatggattctgtaactgggagatgcatgcaactctagatggcacttgaggattctgaacaactgtatttcaaagtttagtaagacaaattctgcctggtataagggccaactatgatctcgaagataagggcggaacaatgtgaatgccgaccttgattccaacagcttactataaaaaaaaaaaaaaaaaaaa

SEQ ID NO: 3998 - protein, 636 aa, Panicum virgatum
  misc_feature: Ceres CLONE 1796064
  misc_feature (4)..(220): Pfam Name: Sterol_desat Pfam Description: Sterol desaturase
MATRPGPLTEWPWQRLGNFKYVVMAPVVVHGARRVAGGGWGDIDLAFALILPSLLLRMVHNQIWISAARYQTARSKHRIIDRGIEFDQVDRERGWDDQIILNGLFFYVGYLLIPSAPHLPAWRADGVVAMALLHAGPVEFLYYWFHRALHHHFLYSRYHSHHHSSIVTEPITSVIHPFAEHMVYYILFAIPMLTTVYMGTASVLGFVLYIAYINFMNNMGHCNFELVPKWVFQVFPPLKYLMYTPSFHSLHHTQFRTNYSLFMPFYDYIYNTMDKSSDQLYQSSLKGIEETPDLVHLTHMTDLQSAYHLRIGFASIASNPSNSSMWWYMWTLWPLAWLSMVFAWVYGSSAFVVERIKLKKLTMQTWAIPRYNFQYGLNWERESINDLIEKAILDADARGIKVLSLGLLNQAKQLNGGGELFRQKYPKLRVRLVDGSGLATAVVLKSIPHDAKQVFLHAGPSKVACATAFALCEKGVKVIMNPKKEYDMLKSQIADSRASYLKHSSNHMPQIWLVDNIDDKEQKKAPQGTIFIPISQFPIKKIRKDCTYLSTPAMKIPETMQSIHACENWLPRKVMSAWRIAGILHALEGWTMHECGDAMMDAEKAWSAAISHGFVPLIKLESFRSMDSVTGRCMQL

SEQ ID NO: 3999 - DNA, 2298 bp, Panicum virgatum
  misc_feature: Ceres CLONE 1796069
  misc_feature: Encodes the peptide sequence at SEQ ID NO. 4000
aggagagagaaatctctcgctccccgtcgtagaggagcggtgccggtggccgagctgtcgcgggcggcgtcggcggcagctgagcctgagcgagctcctcgcgggcgtggccacctcgggggacgccgtggggcctgcgcgcgcgcggctcggccggcgggatggcggcgccggcgctgcggtggtggtggtgggcggcggcggcggtcctgttgctggtggccggcctgagccgccgggtcgtcgccaacacggagggtgatgctctatacagtctacgccaaagcctgaaagatactaacaatgtgcttcagagttgggatcctactttggtgaatccatgtacatggttccatgttacttgtaaccctgataacagtgtcatcaggcttgatcttggaaatgcacaactagcaggtccattggtgccacagcttgggcaattgaaaaatatgcaatatctggaactttacagtaacaacataagtgggccaataccgcctgaactggggaacttaactaacttagtcagtttggatctgtacctcaacaacttcactggcgatattcctgataccttggggcaactattgaagctgcggtttctccgtcttaataacaacagcctttctggtcaaattccaaaaaccttgactgctatcaccactcttcaagttctggatctttcaaataacaatctctcaggagaggtgccgtcaactggctcattttcactctttacccctataagttttgctaacaacccaaatctatgtggccctggtactacaaagccttgtcctggggctcctcctttttctccaccccctccatacaatcccccaacaccaacttcatcaaaaggtgcgtctagcactggagcaattgctggaggtgctgcggctggcgctgcattactgtttgctatacctgccattgcatttgcattttggcgtaggcgtaaacctgaagagcatttctttgatgtccctgctgaggaggatccagaagttcaccttggacaacttaagaggttctcactcagagagcttcaagttgctacagataattttagcaataggaacgtactaggaaggggcggtttcgggaaggtgtataaagggagactgacagatggttcattggtagcggtgaagagattaaaggaggaacgcacaccaggaggagagctccagttccaaacagaagttgaactgattagcatggcagttcacaagaatctgcttcggctccgtggattctgcatgacacctacagagcgattgctggtctatccatacatggcgaatggaagcgttgcgtcccgcctccgagaacgcgggccgaatgacccgcctcttgaatgggaaacaagggccaggatcgcgctgggatccgccagaggtctctcttacctgcacgaccactgcgaccccaagatcatccaccgcgacgtgaaggccgccaacatcctgttggacgagagcttcgaagcggtcgtgggcgacttcggcctcgccaggctcatggactacaaggacacccacgtgacgacggctgtccgtgggacgatcggccacattgcgcctgagtacctttccaccggcaagtcctccgagaagacggacgtcttcggctatgggatcatgctcctggagctcatcaccggacagagggccttcgatctcgcccgcctcgcgaacgacgacgacgtgatgctgcttgactgggtgaagggcctgctgaaggagaagaagctggagcaactggtggacccggacctgcagggcgggtacacggacgaggaggtggagtcgctgatccaggtggcgctgctgtgcacgcaggggtccccgatggagcggcccaagatgtcggaggtggtgcggatgctggagggcgacgggctggcggagcggtgggaggagtggcagaaggtggaggtggtccggcaggaggcggagcgcgccccgcgccacaacgactggatcgtcgactccacctacaacctcaacgccgtcgagctgtccggcccgaggtagaggaccccccgaggggatcgatcgatcgatcgggctcctctccgatcgtggccggctagctttgagactcgagagggccgcgtctcgccgcgaggaatgaaatcctcgcctgttcatatgacaggtttgttggtcctgatgtgatggctggcaaagttgtaggtgatgaaaatggttcgcacctgtcctcacctgaccgcagtaagttttgttttaatggttagaattctgaacagcaaaaaaaaaaaaaaaaaaa

SEQ ID NO: 4000 - protein, 626 aa, Panicum virgatum
  misc_feature: Ceres CLONE 1796069
  misc_feature (17)..(626): SWISSPROT Homolog: EC 2.7.11.1 BRASSINOSTEROID INSENSITIVE 1- associated receptor kinase 1 precursor
MAAPALRWWWWAAAAVLLLVAGLSRRVVANTEGDALYSLRQSLKDTNNVLQSWDPTLVNPCTWFHVTCNPDNSVIRLDLGNAQLAGPLVPQLGQLKNMQYLELYSNNISGPIPPELGNLTNLVSLDLYLNNFTGDIPDTLGQLLKLRFLRLNNNSLSGQIPKTLTAITTLQVLDLSNNNLSGEVPSTGSFSLFTPISFANNPNLCGPGTTKPCPGAPPFSPPPPYNPPTPTSSKGASSTGAIAGGAAAGAALLFAIPAIAFAFWRRRKPEEHFFDVPAEEDPEVHLGQLKRFSLRELQVATDNFSNRNVLGRGGFGKVYKGRLTDGSLVAVKRLKEERTPGGELQFQTEVELISMAVHKNLLRLRGFCMTPTERLLVYPYMANGSVASRLRERGPNDPPLEWETRARIALGSARGLSYLHDHCDPKIIHRDVKAANILLDESFEAVVGDFGLARLMDYKDTHVTTAVRGTIGHIAPEYLSTGKSSEKTDVFGYGIMLLELITGQRAFDLARLANDDDVMLLDWVKGLLKEKKLEQLVDPDLQGGYTDEEVESLIQVALLCTQGSPMERPKMSEVVRMLEGDGLAERWEEWQKVEVVRQEAERAPRHNDWIVDSTYNLNAVELSGPR

SEQ ID NO: 4001 - DNA, 1759 bp, Panicum virgatum
  misc_feature: Ceres CLONE 1796124
  misc_feature: Encodes the peptide sequence at SEQ ID NO. 4002
gtttctgctcccaccagcctccataccttggccgtcggcacacaagcgcaaccacggggcagcaggaaagccaccccagcgacccctcacctctccggcaagccgccccggcaccccctctcctctctggcaagccgtccccttcggccctcccaacaccgaaagatggaatccaacaccaacaagcttcaaaacctccatatcacctccaatgaggaaacatatcctgttcccgagattgattgcacggatgatgaagatgacgaggtcatggagcctcaagtaacattaggtttcatagatgagcctgaggaaccagaggactggcatcttcttctcccacaacacttccccaacaaagctggcggtgttccggcctggcttgatcctgtgaatttgccatcaggcaagtcgaggagctgtgacttctgtggcgagccactgcgctttgttctccaggtttatgcaccaattcactcgaaagaaacagcctaccaccggacattgtttgtgttcatgtgcccttcaatggcatgcttactcctagaccagcatgaacaggggaaggacagagctgcgaatcctaaaagaagtgtgaaggttttccggtgccagctggcccaggacaatgcattttatcaacttgaagaacatgaaggatgcagtgaatccattgagtcacagtgtgctagaggaccacgtgctcagctttgccattggtgtggtacatggaaaggtgaaaaaagatgtagcgtctgtagaaaagcatactactgttccaagaagcatcaggaattggattggcgtagcagtcacaagaatgaatgtcatcaaattctaggtgcacccaatgattctgattctattttgccagatgcaaggaaagttccagtatttgctggcgcggcatggcctgaatatacggtggttgatgaaactgaaaagcctccccgttttgctaattgtgatggcaatagctcagaattgtatgtggtgcaaggacaaaacgaaccagatcacatgttgtctttgatggatgagtttgaggctgatgctgacaacagatgctgggcatcttttctagaccgcatctcaagagctccacatcaagtgctgaggtactgcagggaggcaaaagcaaaacctctttgggcgatgtcatctgggtctctggccactgcagctatcccgtcatgcatctactgtagcggtccacttcgctatgagtttcagataatgccacagctgctccatttcttccatgttgaaaataagcccgactctcttgattgggcaacaatagttgtgtttacatgtcaagggtcctgtgatcgaaatatcaattacaaggaagaatttgtatgggttcagttatacccaactactgcgacaagataccgcagttctggttaccaatctccttcaacgaataagattctccggtccgatctatagatgtatgtgcacctgtcatggtggaagggggtggaaggttgggggtgctcactcacctcgccaacctgtcatggtgccagttgtatcagttcgttccattatgtgttgatcttgtcaccttcctatttacagttgctgagttctgctaaacgctccaaggcaatactcctattgcattttatgttgttgagtgctgtctgttaaaactaacagattataatgttcattcttctgttatttatagttgtattgtctggtgtggacaattgttgagattaaatattaaaaaaaaaaaaaaaaaaaa

SEQ ID NO: 4002 - protein, 429 aa, Panicum virgatum
  misc_feature: Ceres CLONE 1796124
  misc_feature (1)..(53): Pfam Name: PDCD2_C Pfam Description: Programmed cell death protein 2, C-terminal putative domain
  misc_feature (1)..(39): Pfam Name: zf-MYND Pfam Description: MYND finger
MESNTNKLQNLHITSNEETYPVPEIDCTDDEDDEVMEPQVTLGFIDEPEEPEDWHLLLPQHFPNKAGGVPAWLDPVNLPSGKSRSCDFCGEPLRFVLQVYAPIHSKETAYHRTLFVFMCPSMACLLLDQHEQGKDRAANPKRSVKVFRCQLAQDNAFYQLEEHEGCSESIESQCARGPRAQLCHWCGTWKGEKRCSVCRKAYYCSKKHQELDWRSSHKNECHQILGAPNDSDSILPDARKVPVFAGAAWPEYTVVDETEKPPRFANCDGNSSELYVVQGQNEPDHMLSLMDEFEADADNRCWASFLDRISRAPHQVLRYCREAKAKPLWAMSSGSLATAAIPSCIYCSGPLRYEFQIMPQLLHFFHVENKPDSLDWATIVVFTCQGSCDRNINYKEEFVWVQLYPTTATRYRSSGYQSPSTNKILRSDL

SEQ ID NO: 4003 - DNA, 1677 bp, Panicum virgatum
  misc_feature: Ceres CLONE 1796127
  misc_feature: Encodes the peptide sequence at SEQ ID NO. 4004
agctgtgactctacgagggagaggggaggacccgaggaccgaagaaatccgaaggcccggcgagctccgacgccgtggagtggagggcaaaccacaggagctggacttggtgcccaggagcgacggggtcggcacaggatgtggtgcgcgtcgtgcctggcgtccgcctgcgcgggctgcacctgcaacctctgcacgtcggcggcgtcggccgtgacccgccgctccgcgcgcatcgcctactgcggcctcttcgccgcctccctcatcctctccttcctgctccgccagttcgccgtgcctcttctgaagcacatcccgtgggtaaatgcatttgaccagacaccaccagatgaatggtttcaaatgaatgctgttcttcgtgtaagcctggggaacttcttgttttttgcaatatttgccatcatgatgattggtataaaagaccagaatgatcggcgagatgcatggcaccatggtggctggattgcaaagattgctgtctgggctgttctcattgttcttatgttctgtgttccgaacattgtaattactatttacgaggtactgtcaaagtttggatctggtttgtttcttctagtacaggttgcgatgcttttagacttcacaaataattggaatgactcatgggttgagaaagatgagcagaagtgggaaatagctttactggtagtgacagtggtttgctatctctctacatttgccttctctggtgtacttttcatgtggtttaatccctccggtcatgactgtggtctcaacgtgttctttattgtcacgactcttattcttgcctttgcctttgcaatagttgctttgcacccccagatcaatggaagcattatgcctgcttctgtcatttctgtctactgtgcgtacctgtgttacactagtctctctagtgaaccagacgactacgaatgcaatgggcttcacaggcattctaagcaggtttcaatgagcgctcttatactcgggatgctcactaccgtgctatctgttgtgtactctgctgtccgtgctggatcttccactacattcctctcaccaccatcgtctcctagatctggagccaaaaaccctttactcggcgatgaggagactggcaaaggcaatgacaaagaaagcgaacctcgccctgtgagctattcctacactttcttccacctcatcttcgcccttgcaagcatgtactcagccatgcttttgactggctggacaagtgcggtgtctgaaaagtcagagctaatggatgttggatggacaaccgtctgggtgcgcatctgcacagagtgggtcaccgcagcgttatacatctggaccctcattgccccgctgctcttcccggaccgtgatttctcctaggcacctgtgaccaggagttgttccgtatttgtgaattggctgtgattgtgaatataaataagcagaatttggaagtagaacaagtagcatctgatgttgtggcctgcaagcggtagcatttcgtacctgttcgtgtgggcatatacaaacctatatctatgccaaagtagttggttgtggatattgaatcatatatagttgtatgccaagttgtgacaattactagtggttacgctataagtgattaacaatggagtagcatctgtggtgcaaaaaaaaaaaaaaaaaaaa

SEQ ID NO: 4004 - protein, 415 aa, Panicum virgatum
  misc_feature: Ceres CLONE 1796127
  misc_feature (1)..(403): Pfam Name: Serinc Pfam Description: Serine incorporator (Serinc)
MWCASCLASACAGCTCNLCTSAASAVTRRSARIAYCGLFAASLILSFLLRQFAVPLLKHIPWVNAFDQTPPDEWFQMNAVLRVSLGNFLFFAIFAIMMIGIKDQNDRRDAWHHGGWIAKIAVWAVLIVLMFCVPNIVITIYEVLSKFGSGLFLLVQVAMLLDFTNNWNDSWVEKDEQKWEIALLVVTVVCYLSTFAFSGVLFMWFNPSGHDCGLNVFFIVTTLILAFAFAIVALHPQINGSIMPASVISVYCAYLCYTSLSSEPDDYECNGLHRHSKQVSMSALILGMLTTVLSVVYSAVRAGSSTTFLSPPSSPRSGAKNPLLGDEETGKGNDKESEPRPVSYSYTFFHLIFALASMYSAMLLTGWTSAVSEKSELMDVGWTTVWVRICTEWVTAALYIWTLIAPLLFPDRDFS

SEQ ID NO: 4005 - DNA, 1538 bp, Panicum virgatum
  misc_feature: Ceres CLONE 1796134
  misc_feature: Encodes the peptide sequence at SEQ ID NO. 4006
aacctatttatattctctccttaattccccatctctctggtccgcctccgctgcgtcctccgcatccccctcctgttctccgacgcctccccctcgcgaccggcgccggaaccctaaccctagccgtcatctgtgccgccgatatggcgagcagcaacgtctccaccgtctacatctccgtaatcgatgatgtcatctccaaggtcagggaggatttcatcacctacggagtcggcgacgccgtcctcaacgagcttcaggctctctgggagatgaagatgctgcactgcggcgcaatctcggggaacattgaccgcactaaggcgtccgccgcgtctgccggaggcaccaccggaacaacaccgcccgtgcatgacctcaacgtgccctacgaggctacatccgaggagtacgccaccccgacagcagacatgctgttcccaccaacgccactgcagaccccgatccaaactcctcttccagggaccgacgcaggaatgtataacatacccaccggcccttctgattacgccccatcaccaatcagcgatgtcaggaacgggatgtcaataaatggggcggatccaaaaacaggccgcccgagcccctacatgccaccaccttccccttggatgaaccagaggccgctgggtgttgatgtcaatgttgcttatgtggagggccgcgaggatcctgacaggggtatgcagcctcagccactgactcaggattttctgatgatgtcttctggaaaacgtaagagggatgagtatcctggtcagctcccttctggttcttttgtaccacaacaagatggaagtggggatcagatagtagaatttgttgtgtcaaaggagaatgctcaacaactttggaattccatcatcaacaagcaagaaacaacaagcaagacagtcactacagttattccacagcttgatgggattcaagatgactataacgatcattttttcttcccaagagttccaactgaagattataatacccctggagaatctgcggagtatcgagctcccacacctgttgttgcaactccgaaaccaagaaatgatgcaggggatgatgatgatgatgatgatgatgatgaacctcctcttaatgaagatgacgacgacgatgacgagttagatgaccttgagcaaggggaggatgaaccgaacacacaacatcttgtacttgcgcaatttgacaaagtgacaagaaccaagaatcgttggaagtgcactttgaaggatggaatcatgcatttgaatggaagagatgttctatttaacaaggcgaccggagagtttgatttttgaattttgggatcaagaagagctattttagctgcttctgtatggacatatctttgacataaggatggggaggtgacaagtcttcttggtgaggtccaggcagtatgacattgcgctgtgttttcctgttgaggctttgcttcgcccagttggtttgtcacaactgttatcgctgtaaaaaaaaggtcactcctgggacaaaaaaaaaaaaaaaaaaaa

SEQ ID NO: 4006 - protein, 392 aa, Panicum virgatum
  misc_feature: Ceres CLONE 1796134
  misc_feature: Great-hit functional homolog of the protein sequence given in SEQ ID NO 9378
  misc_feature: Useful for making plants with altered terpenoid content
MASSNVSTVYISVIDDVISKVREDFITYGVGDAVLNELQALWEMKMLHCGAISGNIDRTKASAASAGGTTGTTPPVHDLNVPYEATSEEYATPTADMLFPPTPLQTPIQTPLPGTDAGMYNIPTGPSDYAPSPISDVRNGMSINGADPKTGRPSPYMPPPSPWMNQRPLGVDVNVAYVEGREDPDRGMQPQPLTQDFLMMSSGKRKRDEYPGQLPSGSFVPQQDGSGDQIVEFVVSKENAQQLWNSIINKQETTSKTVTTVIPQLDGIQDDYNDHFFFPRVPTEDYNTPGESAEYRAPTPVVATPKPRNDAGDDDDDDDDDEPPLNEDDDDDDELDDLEQGEDEPNTQHLVLAQFDKVTRTKNRWKCTLKDGIMHLNGRDVLFNKATGEFDF

SEQ ID NO: 4007 - DNA, 1897 bp, Panicum virgatum
  misc_feature: Ceres CLONE 1796135
  misc_feature: Encodes the peptide sequence at SEQ ID NO. 4008
cgaagtcaattctcaccagtggttgtctactctgctccgcgccgcgccgcgccgatagcccgtagccagagcggccactgcgatccttcctggttgatcgcctgaggtttcctgaagcgaggaagaaggaaacagtgcagttatcatgtcaggagggtcgtctgagtcttccccgttatctgggcaaaatagctttagttctctatcaagtttcaaggaccttgaactatcttcagagtcgggttgcttgtccattgttgtactaggtgcttctggagaccttgctaagaagaaaactttcccagcactctttcacctttttcagcagggatttctgcaagctggagaagtccatatatttgggtatgcaagatcaaatctttctgacgatggattaagagaacgcatccgtggatacctcaatggagcttcagatgaacatctttctcaatttttgcagctaattaaatatgttagtggttcctatgatagtggggaaggatttgagttattaaacaacacaatctctgattatgaaacatcaaaaaacaatgaatcgggaagctatcgcagactattttacttggcattgcctccatccgtctatccatcagtatgcaaaatgataagatcatattgcatgaatccatcttcacacactggttggacaagggttattgttgaaaaaccctttggaaaggatttggactcttcagagaaactgagtgccgaacttggaaagctgtttgaagaagaccaactttatagaattgaccactatttaggaaaagagctggtccagaacttgctcgtgctacgttttgcaaaccgcttatttttgcctctctggaatcatgataatattgctaatgtacagatcgtatttaaagaggactttggaactgagggacgtggaggatattttgatcaatatggtatcattcgtgatatcattcagaaccatttgttgcaggtcttctgtttggtggctatggaaaagccagtctctcttaaacccgagcacattagagatgaaaaagtcaaggttctgcaatcagtggagcctatacagcacgaagaggtagtgatcgggcagtatgatggctacaaggatgatcctactgtgccagatgagtccaacacccctacttatgcatctgttgtactgagggtacacaatgaaagatgggaaggagttccattcattctcaaggctggtaaagcactaaattctaggaaagcagagatacgtgtgcagttcaaggatgctcctggtgatattttcagatgcaagaaacaaggaaggaatgagtttgttatacgcctgcagccatcagaagccatgtatatgaagttaacagtcaagaaacctggactggaaatggcaactgaacaaagtgagctggacctatcctacgggatgcgttaccaagatgttaaaatcccagaagcatatgagcgtcttatcttggacacgataagaggagatcagcaacactttgttcgccgagatgaactgagggctgcatgggagatcttcactcctttgcttcacgacatcgatgctggcaagctgaagtccgtttcatacaagccaggaacccgaggaccgcaggaggccgatgagatgagtaggaggatggggtatgtgcagacccatggctacatatgggtaccgccaattctcgctaagttttagatttttttgtcagttgccgtgtaatcacataatggcagaaaggtcgcctaatctgaatgcgcaaacaagcacttgggaagaagagcccttgtaatacacgcgtcatgtaataagagaaacttctgcgtgttgaaagtgtaccatttacgatatgaaataaaattttcatgctgagtgcaaaaaaaaaaaaaaaaaaaa

SEQ ID NO: 4008 - protein, 517 aa, Panicum virgatum
  misc_feature: Ceres CLONE 1796135
  misc_feature (1)..(285): Pfam Name: G6PD_C Pfam Description: Glucose-6-phosphate dehydrogenase, C-terminal domain
  misc_feature (14)..(514): SWISSPROT Homolog: EC 1.1.1.49 Glucose-6-phosphate 1-dehydrogenase, cytoplasmic isoform 2
  misc_feature (22)..(514): SWISSPROT Homolog: EC 1.1.1.49 Glucose-6-phosphate 1-dehydrogenase, cytoplasmic isoform
MSGGSSESSPLSGQNSFSSLSSFKDLELSSESGCLSIVVLGASGDLAKKKTFPALFHLFQQGFLQAGEVHIFGYARSNLSDDGLRERIRGYLNGASDEHLSQFLQLIKYVSGSYDSGEGFELLNNTISDYETSKNNESGSYRRLFYLALPPSVYPSVCKMIRSYCMNPSSHTGWTRVIVEKPFGKDLDSSEKLSAELGKLFEEDQLYRIDHYLGKELVQNLLVLRFANRLFLPLWNHDNIANVQIVFKEDFGTEGRGGYFDQYGIIRDIIQNHLLQVFCLVAMEKPVSLKPEHIRDEKVKVLQSVEPIQHEEVVIGQYDGYKDDPTVPDESNTPTYASVVLRVHNERWEGVPFILKAGKALNSRKAEIRVQFKDAPGDIFRCKKQGRNEFVIRLQPSEAMYMKLTVKKPGLEMATEQSELDLSYGMRYQDVKIPEAYERLILDTIRGDQQHFVRRDELRAAWEIFTPLLHDIDAGKLKSVSYKPGTRGPQEADEMSRRMGYVQTHGYIWVPPILAKF

SEQ ID NO: 4009 - DNA, 1790 bp, Panicum virgatum
  misc_feature: Ceres CLONE 1796147
  misc_feature: Encodes the peptide sequence at SEQ ID NO. 4010
atccactcccctcgtctctcctgtgacctcacggatcactagaggccactgcgcgcggttaccagcgccgagctgtgcagcagcagcaatggcgtcaccgatgctcaatgcatcaccactcctccagttggcgcggtccgtatggtgcgtcctcctcctcgccgcgtcgtcgacggtgtccgggcgtcaccactccgccccggcggcgtccaggaccgggcagagcatgtacatttcgcccaactgccgggcgcacacggcgtcgctggcggacttcggcgccgtgggcgacggcacgacgtccaacacagcggcgttccggtcggcggtggatcacctgtcgcagtactccggcgagggcggcggcggcgccatgctgtacgtgccggcggggaagtggctgacggggccgttcaacctgacgagccacttcacgctcttcctccacagcgacgccgtcatcctcggatcgacggatatcagcgagtggccggtgatcgacccccttccttcctacggccgaggcagggacaaggtcggaggccgctacgccagcctcatcggcggctccaacctcaccgacgtggtggtcaccggcgagaacgggacgatcaacgggcagggcgcggtgtggtggtccaagttccgcagcaacaagctcaagtacacgcgcgggtacctgatcgaggtgctgtggtcggacacggtggtggtgtcgaacgtgacgctgctcaattcgccggcgtggaacatccacccggtgtacagcagcaacatcgtggtgcagggcgtgacgatcctggccccgacgcggtcccccaacacggacggcatcaacccagactcgtgctcccacgtgcgcatcgaggactgctacgtcgtctccggcgacgactgcgtggccatcaagagcggctgggacgagtacggcatccgggtcggcatgccgagccagcacatcgtggtccggcggctgacgtgcgtgtcgccgacgagcgccgtcatcgcgctgggcagcgagatgtcgggcggcatccgcgacgtgcgcgccgaggacatcgccgccgtggactcggagtcgggcgtgcggatcaagaccgccgtggggcggggtgcgttcgtgcgggacgtgttcgtgcggcggatgacgctgcagacgatgaagtgggtgttctggatgacgggcaactacaagtcccacccggacgacggcttcgacccgggcgccgtgccggtggtggagggcatcagctaccaggacgtggtggccaccggggtctacaaggcggcggcgcgcctcgagggcatccagggcgcgcccttccggggcatctgcctcgccaacgtcacggcggagctggacaagtccaagaagtacccctggacctgcgccgacgtggagggcgtgtcggccaacgtcagcccgccgccgtgcgaggcgctgcagcagggcggcgtcgacggcgcctgccccttcccgacggacacgctgcccatcgaccagctcgtcctgcagcagtgcgcctacgacgtccctgctcctgcgtctcccggcaagtactagttgttgctgggtgctgccgcgggctgatacactactagtactagtctcatcaggaaaacaataaggatgatggcgtgcgtgtgctgcttaatttagtctggatgtgtaagtttgggcgtgttgtcagttgaagttccctcatcatactctactgatcaaaagtgaaagggggctgctgccctgcaagttgtatgttcgtttctgctaaaaaaaaaaaaaaaaaaaa

SEQ ID NO: 4010 - protein, 491 aa, Panicum virgatum
  misc_feature: Ceres CLONE 1796147
  misc_feature: Great-hit functional homolog of the protein sequence encoded by LOCUS At3g61490
  misc_feature (2)..(130): Pfam Name: Glyco_hydro_28 Pfam Description: Glycosyl hydrolases family 28
  misc_feature: Useful for making plants with altered cell wall content and/or composition
MASPMLNASPLLQLARSVWCVLLLAASSTVSGRHHSAPAASRTGQSMYISPNCRAHTASLADFGAVGDGTTSNTAAFRSAVDHLSQYSGEGGGGAMLYVPAGKWLTGPFNLTSHFTLFLHSDAVILGSTDISEWPVIDPLPSYGRGRDKVGGRYASLIGGSNLTDVVVTGENGTINGQGAVWWSKFRSNKLKYTRGYLIEVLWSDTVVVSNVTLLNSPAWNIHPVYSSNIVVQGVTILAPTRSPNTDGINPDSCSHVRIEDCYVVSGDDCVAIKSGWDEYGIRVGMPSQHIVVRRLTCVSPTSAVIALGSEMSGGIRDVRAEDIAAVDSESGVRIKTAVGRGAFVRDVFVRRMTLQTMKWVFWMTGNYKSHPDDGFDPGAVPVVEGISYQDVVATGVYKAAARLEGIQGAPFRGICLANVTAELDKSKKYPWTCADVEGVSANVSPPPCEALQQGGVDGACPFPTDTLPIDQLVLQQCAYDVPAPASPGKY

SEQ ID NO: 4011 - DNA, 1819 bp, Panicum virgatum
  misc_feature: Ceres CLONE 1796175
  misc_feature: Encodes the peptide sequence at SEQ ID NO. 4012
acattcatccagtccacgccctccgccaccagcgcagtagccagccgagccgcctcagcccccctcgccgggcgcgatggcggtcacgcgcgtcgcggtggccgccgcactcccggccgcgccgccctcctcccgccgccgccgggccgcgctcccctcctcctgccggcctctccccacctcccgcgcgtccaaggcgctgcacgccgccgcccccgccgcaggcgcggtcgacgaggagaccctcgccgcgtcgccttcctcagattctagcaagggagtggagaacctggtgatcattggttccggcccggccgggtacactgctgcaatttacgctgccagggcaaacctgaagcccgtcgtgttcgaaggttaccaggtgggtggtgtccctggtgggcagctgatgaccacgaccgaggtggagaatttccctggttttcaagaaggtataacgggacctgatctgatggacagaatgcgtaagcaagcggaacgctggggtgcggagcttcaccaagaggatgttgagtttgtgaatgtaaagagcagcccatttgttatccgtagcagcgatcgcgaggtgaaatgttatagtgtaatcattgcaactggagcaacagctaagcgcctccgtttgcctcgtgaagatgaattttggagtagaggtatcagcgcatgtgccatatgtgacggagcatcgccactgttcaagggtcaagttcttgcagttgttggaggtggtgatacagctacagaggaagcaatatatttgacaaagtatgctcgccatgttcatttacttgttagaaaggatcagctacaggcatccaaagctatgcaggacagagtactcaacaaccccaacataacagtacatttcaataccgaagccatggatgttgttagcaatgataaaggtcagatgtctggcattcaactgaagagaaccgatacaggagaggaatcagttcttgaggtgaaaggtctattttatggcataggacatactccaaacagtcagcttttgcaaggtcagattgaacttgatagtgctggctatattttagttaaagaaggttcagccaaaacttcagtggatggtgtatttgctgctggtgatgttcaggatcatgaatggagacaagcggttactgcagctggatctggatgtatagctgctttgtcagttgaaagatacttagttgccaatgatcttcttgttgaatttcaccagcctgttcaagaagaaacaaagaaggatattactaacaaagatgttgaaatgggctttgacatttctcgcacaaaacacaagggacagtatgcactccgcaaaatataccatgagagtccacggctcatttgtgttctatacacttctcctacatgtggtccttgcagaaccttgaaaccaattttgagcaaggttatagatgagtatggtgagtacgttcattttgttgaaattgatattgaagaggatcctgaaatagcagaagctgcaggcatcatgggaacaccttgtgtccaatattttaagaataaagaaatgctcaggactgtctctggtgtgaaaatgaagaaggaatatcgggagtttatcgagtcgcacaaatgagttggacatgcagtacacgcccttgatttttttttaagactagaagtacagtcattattttgaactcttttagacgaccccccggtgcccaatttttgatcagatttgaagatggacctggtgtaaatgcacaaaatatattctttgctacgtacaacatacatggagttgacccaaaaaaaaaaaaaaaaaaaa

SEQ ID NO: 4012 - protein, 515 aa, Panicum virgatum
  misc_feature: Ceres CLONE 1796175
  misc_feature (1)..(286): Pfam Name: Pyr_redox_2 Pfam Description: Pyridine nucleotide-disulphide oxidoreductase
  misc_feature (72)..(377): SWISSPROT Homolog: EC 1.8.1.9 Thioredoxin reductase
MAVTRVAVAAALPAAPPSSRRRRAALPSSCRPLPTSRASKALHAAAPAAGAVDEETLAASPSSDSSKGVENLVIIGSGPAGYTAAIYAARANLKPVVFEGYQVGGVPGGQLMTTTEVENFPGFQEGITGPDLMDRMRKQAERWGAELHQEDVEFVNVKSSPFVIRSSDREVKCYSVIIATGATAKRLRLPREDEFWSRGISACAICDGASPLFKGQVLAVVGGGDTATEEAIYLTKYARHVHLLVRKDQLQASKAMQDRVLNNPNITVHFNTEAMDVVSNDKGQMSGIQLKRTDTGEESVLEVKGLFYGIGHTPNSQLLQGQIELDSAGYILVKEGSAKTSVDGVFAAGDVQDHEWRQAVTAAGSGCIAALSVERYLVANDLLVEFHQPVQEETKKDITNKDVEMGFDISRTKHKGQYALRKIYHESPRLICVLYTSPTCGPCRTLKPILSKVIDEYGEYVHFVEIDIEEDPEIAEAAGIMGTPCVQYFKNKEMLRTVSGVKMKKEYREFIESHK

SEQ ID NO: 4013 - DNA, 1507 bp, Panicum virgatum
  misc_feature: Ceres CLONE 1796200
  misc_feature: Encodes the peptide sequence at SEQ ID NO. 4014
cttcccccctaggctgctgactcgtccgcctcccccctccctccccgcgtccgccgcacgcgccgcctgagaaccctaacttccgccgccgcaggcagctgggatggagaagggggcctcggagtcgccgctctgctgcgctcgctgcggcaagcctgccctcctgcaatgccccaagtgcgcggagctgaagctaccgcgtgagggcgctgctttctgcacacaggattgttttaaggcagcatggagctctcacaaatctgtccacccaaagccaaatgttcagcagtctccagaaggttggaagtattgtttgaaaaaagggcgggcgcgttcgttgcagcttcctcattttccatggacaggtccattgagaccatatccaatatcaaagatgcgtgtggttccagatgaaattgagaagcctgattgggcacttgatggaattcccaagattgaaccagacagtgatttgcagaaaagagtagagattaagacccctgagcaaatagaaaggatgagagaaacatgtcgaattgcaagagaagttttagatgcagctgcacgtataataaaaccaggaattacaacagatgaagttgatagagtcgtccatgaggaaacaattgctagaggtggatacccatctccattgaattaccatttcttcccaaagtcgtgttgcacatctgtcaatgaagtcatttgccatggaattcctgatgccaggaaacttgaggacggtgacattgtaaatgttgatgtaactgtatattataaaggcgttcacggtgatttgaatgagacatattttgttggcaatgttgatgaagcttccaaacagcttgtccgttgtacctacgagtgcttggagaaagctattgctatagttaaacctggagttaggtttcgagaagttggagaaatcataaatagacatgcttcaatgtcaggtttatctgtggtgaaatcatattgtggccatggcataggagaattgttccactgtgccccaaacatccctcattattcaagaaacaaggctgttggtatcatgaaagctgggcagacatttacaatcgagccaatgatcaatgcaggagtttggaatgatcgtctgtggcctgatgattggaccgcagtgactgcagatggtaaacggagtgctcaatttgaacatacacttttggtgactgagacaggatgcgaagtgttgacggcacggttaccttcatcaccggacgtatttccatggttgaagccgtgataagcagcaacaagcaagtgattgtgatacattgggactgcattaattttgttctcatcagtcggtggccactgagaagtttcaatttttccaaattaatgcatatatgcaactgttaaacaatcgctgaaacttatgtcccgctcagttgtttccgggagtgtggattgttgaatcgatctgttcagagttatatgaatgaggcttaaaattacttgataaaaaaaaaaaaaaaaaaaa

SEQ ID NO: 4014 - protein, 387 aa, Panicum virgatum
  misc_feature: Ceres CLONE 1796200
  misc_feature (1)..(237): Pfam Name: Peptidase_M24 Pfam Description: metallopeptidase family M24
  misc_feature (2)..(385): SWISSPROT Homolog: EC 3.4.11.18 Methionine aminopeptidase 1A
  misc_feature (5)..(378): SWISSPROT Homolog: EC 3.4.11.18 Methionine aminopeptidase 1
MEKGASESPLCCARCGKPALLQCPKCAELKLPREGAAFCTQDCFKAAWSSHKSVHPKPNVQQSPEGWKYCLKKGRARSLQLPHFPWTGPLRPYPISKMRVVPDEIEKPDWALDGIPKIEPDSDLQKRVEIKTPEQIERMRETCRIAREVLDAAARIIKPGITTDEVDRVVHEETIARGGYPSPLNYHFFPKSCCTSVNEVICHGIPDARKLEDGDIVNVDVTVYYKGVHGDLNETYFVGNVDEASKQLVRCTYECLEKAIAIVKPGVRFREVGEIINRHASMSGLSVVKSYCGHGIGELFHCAPNIPHYSRNKAVGIMKAGQTFTIEPMINAGVWNDRLWPDDWTAVTADGKRSAQFEHTLLVTETGCEVLTARLPSSPDVFPWLKP

SEQ ID NO: 4015 - DNA, 1302 bp, Panicum virgatum
  misc_feature: Ceres CLONE 1796209
  misc_feature: Encodes the peptide sequence at SEQ ID NO. 4016
cccactctcatcccattccttccaagccacctctgctctgctcactctgtcctcctcgcggttgctaagctaagctaagcaaagcttaaggcaagctaggcggcatgggcaaggacgacgtgatcgagggcggcgccggcggcggcgagttcgcggccaaggactacacggacccgcccccggcaccgctgatcgacgcagcggagctggggtcgtggtcgctgtaccgcgccatgatcgccgagttcatcgcgacgctgctcttcctctacatcaccgtggccaccgtcatcgggtacaagcaccagacggatgcggcggcgtcgggcgccgacgcggcgtgcggcggcgtgggcgtgctgggcatcgcctgggccttcggcggcatgatcttcgtgctcgtctactgcaccgccggcatctcgggaggccacatcaacccggccgtcaccttcgggctcttcctggcgcgcaaggtctccctggtccgcgcgctgctctacatggtggcgcagtgcctgggcgccatctgcggcgtcggccttgtcaaggctttccagagcgcctacttcgaccgctacggcggcggcgccaactcgctcgcctccggctactcccgcggcaccggcctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccacgtcaccggcaccggcatcaaccccgccaggagcctcggcgccgccgtcatctacaacaaggacaagccatgggatgaccactggatcttctgggtcggccccttcgtcggcgcggccatcgctgccttctaccaccagtacatcctccgggccggcgccatcaaggccctcggctccttcaggagcaacgcgtgagccgcctgagtagccttcttcctgtgacctgtgagcttgcaaaaggctgcgtgctgaagcaatggcggtcgacgctgggggagaataagatgaaagtactgccgctggtcgtcttgtttcagcagctgcgtgcgtgaatttggcttcctagctccttcctcctgtaatcaaccatgtgtcgtgatctgtctctcgaggggttctatcatctccactcctattctcctagcatgtacctctatttaatcattatgtagcgacgatcaccatcatcatcatcatcagtgaaaaccttgcttctgtctaaaaaaaaaaaaaaaaaaaa

SEQ ID NO: 4016 - protein, 290 aa, Panicum virgatum
  misc_feature: Ceres CLONE 1796209
  misc_feature: Great-hit functional homolog of the protein sequence given in SEQ ID NO 9410
  misc_feature: Great-hit functional homolog of the protein sequence given in SEQ ID NO 9486
  misc_feature: Useful for making plants with modulated cold sensitivity
  misc_feature: Useful for making plants with modulated drought sensitivity
MGKDDVIEGGAGGGEFAAKDYTDPPPAPLIDAAELGSWSLYRAMIAEFIATLLFLYITVATVIGYKHQTDAAASGADAACGGVGVLGIAWAFGGMIFVLVYCTAGISGGHINPAVTFGLFLARKVSLVRALLYMVAQCLGAICGVGLVKAFQSAYFDRYGGGANSLASGYSRGTGLGAEIIGTFVLVYTVFSATDPKRNARDSHVPVLAPLPIGFAVFMVHLATIHVTGTGINPARSLGAAVIYNKDKPWDDHWIFWVGPFVGAAIAAFYHQYILRAGAIKALGSFRSNA

SEQ ID NO: 4017 - DNA, 1351 bp, Panicum virgatum
  misc_feature: Ceres CLONE 1796214
  misc_feature: Encodes the peptide sequence at SEQ ID NO. 4018
aatctggtggcaattcctgcgctctgcctgcacgcatcgggaaaaagaggcggctaccaggaaagcggagggtagacggcggcggaaggagggagcaaaagaagagcggcaaatctgagagagatcagagtctcgagggctgagagtcggcagagagcgccgagcatggagagctcgatctcgagtactgagctgaattgcatcagcctggcggacccggacatccagaaatcggtcgcgctcctcaagcaggcatgcctggattcaggcttcttctatgttgtggatcatgggataagcgaagagttcatggatgaagtttttgcccagagcaagaaattctttgaccttccccacattgagaaaatgaagcttctccgagacaagaagaaccgcgggtatacacccatgcttgatgaaattcttgatccagaaaatcaagtgaacggtgactacaaggaaggatattatataggtgttgaggtacctgcagatagtccagaagcaaacaaaccattttgtggtccaaatcagtggcctgctgaagaagtattgccaaaatggagggaggtgatggagcaatatcacagggaggcattgagagtagcaaaatcagttgcaaggatcattgctcttgctctggacctagatgtggacttctttgatagacctgaaatgcttgccaagcctatagccactttaaggctcctacactacgaaggtcgagtgtcaaatcctgcaaagggtgtctatggagcaggagcgcattcagattatggcctaataactctccttgcaaccgatgatgtagttggacttcaaatatgtaaggacaggaatgctcagcctcaagtatgggaatatgtagctccggtgaaaggaggattcatcgtcaatcttggtgatatgctcgaaaggtggagtaactgcattttcaggtcaaccttgcatcgagtagtcctcgatgggcgagaacgctactcgatagcctactttgtggaaccaagccacgactgcgtagtcgagtgcctgccaacctgcaaatctgaaacgaatcctccaaagttccctccaatcacctgctctgcctacctgacccagcgctacaaggacactcatgcagatctgagctcttacagcgacggcaaggcctgaaggatgccctactcttacttttttttctgtcactacttactgatgcttcagtttcagccatccaatatttacgtgtaaccttcataacacagtagtgtggaggatggcactttgtgtgtactaataccattaccagtgtgtatcacggtatcagtataagcatagcagttttgtggaaaaaaaaaaaaaaaaaaaa

SEQ ID NO: 4018 - protein, 329 aa, Panicum virgatum
  misc_feature: Ceres CLONE 1796214
  misc_feature (1)..(111): Pfam Name: 2OG-FeII_Oxy Pfam Description: 2OG-Fe(II) oxygenase superfamily
MESSISSTELNCISLADPDIQKSVALLKQACLDSGFFYVVDHGISEEFMDEVFAQSKKFFDLPHIEKMKLLRDKKNRGYTPMLDEILDPENQVNGDYKEGYYIGVEVPADSPEANKPFCGPNQWPAEEVLPKWREVMEQYHREALRVAKSVARIIALALDLDVDFFDRPEMLAKPIATLRLLHYEGRVSNPAKGVYGAGAHSDYGLITLLATDDVVGLQICKDRNAQPQVWEYVAPVKGGFIVNLGDMLERWSNCIFRSTLHRVVLDGRERYSIAYFVEPSHDCVVECLPTCKSETNPPKFPPITCSAYLTQRYKDTHADLSSYSDGKA

SEQ ID NO: 4019 - DNA, 1125 bp, Panicum virgatum
  misc_feature: Ceres CLONE 1796219
  misc_feature: Encodes the peptide sequence at SEQ ID NO. 4020
aaccatcccgaaaccccatcgcaaactaatccccgaccccaaacccccaatccacccacccccctcatccactccgggcggccatggcctgctccttcgccgccgccaccgtctcctccgcgccaacccacgccgccagggctctcgccgcggcgccgcaggccgtctccgtcgcccgctccgcggtagccgccaggcccctccgccccgccggctccagatccgcgcgggccaccaggctcgtcgcccgcgccggcggcgtcgatgacttgccattggtcgggaacaaggcgccagacttcgaggccgaggccgtgttcgaccaggagttcatcaacgttaagctatcggattacattgggaagaagtacgtgattctgttcttctaccccttggacttcaccttcgtctgccccaccgagattaccgccttcagcgacagatatgaagaattcgagaagttgaacactgagatccttggtgtctccattgacagtgtgttctcccaccttgcatgggtgcagacagacaggaagtctggtgggcttggggatcttaaatacccacttatttccgatgttaccaaatcaatttcaaagtccttcggtgttctgatccctgaccagggcattgctctgagaggactgttcatcatcgacaaggagggagtgattcagcactctaccattaacaaccttgccattggtcgcagtgtggatgagaccatgaggacccttcaggcgttgcagtacgtccaggagaacccagacgaggtctgcccggccggatggaagcctggggagaggtcgatgaagcccgaccccaagggaagcaaagagtacttcgcggccatctaggacgccctgcaatgcaggagctttggtgcttctgtatcatggtgcgcccgcttccggtgcaccagcggtggatcgatgtggagtttttgcacggctgtgccgagctcgtgttttgatatgtcagctgcgtcttgtgatgaaccgattgtagtagctcctgtgcatcggattgaatgctgttccccgccaccttgtttcttctttttgacctggcgaataaggttcattttggtcgtgtttgagagctcaaaaaaaaaaaaaaaaaaaa

SEQ ID NO: 4020 - protein, 257 aa, Panicum virgatum
  misc_feature: Ceres CLONE 1796219
  misc_feature (3)..(257): SWISSPROT Homolog: EC 1.11.1.15 2-Cys peroxiredoxin BAS1, chloroplast precursor
MACSFAAATVSSAPTHAARALAAAPQAVSVARSAVAARPLRPAGSRSARATRLVARAGGVDDLPLVGNKAPDFEAEAVFDQEFINVKLSDYIGKKYVILFFYPLDFTFVCPTEITAFSDRYEEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQALQYVQENPDEVCPAGWKPGERSMKPDPKGSKEYFAAI

SEQ ID NO: 4021 - DNA, 1234 bp, Panicum virgatum
  misc_feature: Ceres CLONE 1796221
  misc_feature: Encodes the peptide sequence at SEQ ID NO. 4022
aacaactcgcaccaccaccgcaccgctcgccctcgcctccgacagcgaccgcgcaaccgcgtcgtcatccccggccccggcgcctctcttctcctccgcagccgcctccgttctctgtgcagccctgagcgtatcggccggagccacgcggcgcgagacagccgagaccgagaggaccagagcagcaagcacttgcacggagacgcgtcactgacgacgatgtcgacgacctccgccaactccgcggcgtcgccggcggtgtccggcctggactacgacgacacggcgctcacgctcgccctcccgggctcctcctcctccgccggcgccgacgaccgcaagcgcgcccacgccgaccacgacaggccgccctccccgaaggcgcgggccgtggggtggccgccggtgcgcgcgtaccggcgcaacgcgctgcgcgacgacgaggccaagctcgtcaaggtggccgtggacggcgcaccgtacctgcgcaaggtggacctcgcggcgcacgacgggtacgcggcgctgctccgcgcgctgcgcggcatgttcgcctcctgcctcggcgtcggcgccgccgggaggctcgtcgacgccgccaccggcgccgagtacgtgcccacctacgaggacaaggacggcgactggatgctcgtcggagacgtccccttcaagatgttcgtcgactcgtgcaagcggatccgtctcatgaagagctccgaggccagcaacctatctccaagggcatcatcccaatgattgctgtcatcgaccgaacgcatatgcgcaaggcggttgatctgtctgaatttgttcacaacaaaagcgtgcagtggaagaggcttggctgctcaggtcctccatgcaccctatacaccttaggatcagagatgttcagtctgttgttgtgctctgtacaggccacacacaaccatgggaacttgtctcagttccaggtgcccctcctctcggccggacggtttggtttttggacgccggcgagaagggcggcgccgccactttgtcagctagattgttagtcccgtttttttcagtttctttcagacttgggcttccatgccatgccagtccatgtttgccctcggtcatatcttgtctcgaggggcgttgatgtgtagtatacacgaatatggtacatgctgtgtgctgtttccattgtaaggtcaaagaatacaactgtcactgttcttgcgaaaaaaaaaaaaaaaaaaaa

SEQ ID NO: 4022 - protein, 179 aa, Panicum virgatum
  misc_feature: Ceres CLONE 1796221
  misc_feature (1)..(174): Pfam Name: AUX_IAA Pfam Description: AUX/IAA family
  misc_feature: The sequence is a functional homolog of  SEQ ID NO 736 in the  10/374,780 US patent application
  misc_feature: Useful for making plants with modulated growth and phenotype characteristics
MSTTSANSAASPAVSGLDYDDTALTLALPGSSSSAGADDRKRAHADHDRPPSPKARAVGWPPVRAYRRNALRDDEAKLVKVAVDGAPYLRKVDLAAHDGYAALLRALRGMFASCLGVGAAGRLVDAATGAEYVPTYEDKDGDWMLVGDVPFKMFVDSCKRIRLMKSSEASNLSPRASSQ

SEQ ID NO: 4023 - DNA, 2158 bp, Panicum virgatum
  misc_feature: Ceres CLONE 1796250
  misc_feature: Encodes the peptide sequence at SEQ ID NO. 4024
acctgagcgagcctccacccgcccgcgccctgcaggccgcactcccgccagcccgcttcgccttcctcccgcggctgcagccagcgctcagcagctcaaggtcaccattgaatggccgcaacaatgggttcaatatctgcctatggttcttaccaaacaaataggcccattgcactgaagcagacacctcacatgcaattccaacaatgttgtagaggcggagttaggttcttaagcaatcattcccaatccatgcgaagtaagacacagctgtccaaaagaagagccacaaatcgtccaaagactaccaggtctcaggcacctattgtatgttccactggaatgaccataatttttgttgcaactgaagtacacccatggtgcaaaactggtggcctcggtgatgttgtaggaggactgcccccagctctggctgccatgggacaccgagtcatgacgatagctcctcgctatgatcaatacaaggatgcatgggatacaaatgtccttgttgaggtaaatgttggtgacacagtagaaactgttcgcttcttccactgctacaaaagaggagttgatcgtgtttttgttgatcaccctatgtttcttgaaaaggtatggggcaagactggtgcaaaattgtatggtcctactacaggaactgactatagagataaccagttgaggttctgccttttgtgccttgctgcattggaggctccaagagttctcaatctcagcaattctgaatacttctctggaccttatggtgaagatgttgtcttcgtagcgaatgattggcacactgcagttctgccctgctatctgaagagcatgtataagccaaatggaatttatgcgaatgctaaggttgctttctgcattcacaacattgcctatcaaggtagatttgccagagcagacttcgaagttcttaatctacctgacagtttcttgccgtcatttgattttattgatggacatgttaagcctgtactagggagaaagattaactggatgaaggcagggatcattgagagtgatctggttctaacagttagtccacattatgtcaaggaactcacttctggcccagacaaaggtgttgagttggatggtgtccttcgcacaaagccccttgaaactggaattgtaaatggcatggatgtttatgaatgggatccttcaacagataagtacatcagtgtgaaatatgatgcaacaacggtaactgaagcaagggctctcaataaagaaaggttgcaagctgaagttggattgcctgtggactccaacatccctgttatagtttttgttggccgtcttgaagaacagaaaggatcagacatacttatttcagccattccagaattcgtgggcgagaatgttcagataattgttcttggtacagggaagaagaaaatggaggaggaattgacgctgctagaagtgaaatatccaaacaatgctagaggcatagcgaaattcaacgtcccattagcacatatgatgtttgctggggctgacttcatcattgtcccaagcaggtttgagccgtgtggtctcattcagttgcaagggatgagatatggagtgatccccatctgttcatcaactggaggacttgtagacacggttaaggagggtgtcaccggattccacatgggttccttcaatgttgagtgtgaaactgtcgatccagctgatgtcacagcagtggcatcaactgtcacacgcgctctggaacagtacgacacccctgcattccatgagatgattcagaactgcatggtgcaggacctgtcctggaaggggcctgcgaagaagtgggaggaggtgcttcttggcctcggggtcgagggaagtgaggcgggcatcgagggcgaggagatcgcccctcttgccaaggaaaatgtggccactccctgaagcctctcgtgcctgggaaatatgcattgagcattatgaactagtactatcttttagaaccctcctgactgcatggcataggttaaaatttcttagccttccatgacatgttgagccagtcaccggcaaagccaccagtttcacgcctctacgtgatgtgtaatataatccttgatatcaggttgattaaaacctactgcccttccgccaaaaaaaaaaaaaaaaaaaa

SEQ ID NO: 4024 - protein, 605 aa, Panicum virgatum
  misc_feature: Ceres CLONE 1796250
  misc_feature (2)..(261): Pfam Name: Glyco_transf_5 Pfam Description: Starch synthase catalytic domain
  misc_feature (31)..(605): SWISSPROT Homolog: EC 2.4.1.21 Granule-bound starch synthase 1, chloroplast precursor
  misc_feature (49)..(605): SWISSPROT Homolog: EC 2.4.1.242 Granule-bound starch synthase 1, chloroplast precursor
MAATMGSISAYGSYQTNRPIALKQTPHMQFQQCCRGGVRFLSNHSQSMRSKTQLSKRRATNRPKTTRSQAPIVCSTGMTIIFVATEVHPWCKTGGLGDVVGGLPPALAAMGHRVMTIAPRYDQYKDAWDTNVLVEVNVGDTVETVRFFHCYKRGVDRVFVDHPMFLEKVWGKTGAKLYGPTTGTDYRDNQLRFCLLCLAALEAPRVLNLSNSEYFSGPYGEDVVFVANDWHTAVLPCYLKSMYKPNGIYANAKVAFCIHNIAYQGRFARADFEVLNLPDSFLPSFDFIDGHVKPVLGRKINWMKAGIIESDLVLTVSPHYVKELTSGPDKGVELDGVLRTKPLETGIVNGMDVYEWDPSTDKYISVKYDATTVTEARALNKERLQAEVGLPVDSNIPVIVFVGRLEEQKGSDILISAIPEFVGENVQIIVLGTGKKKMEEELTLLEVKYPNNARGIAKFNVPLAHMMFAGADFIIVPSRFEPCGLIQLQGMRYGVIPICSSTGGLVDTVKEGVTGFHMGSFNVECETVDPADVTAVASTVTRALEQYDTPAFHEMIQNCMVQDLSWKGPAKKWEEVLLGLGVEGSEAGIEGEEIAPLAKENVATP

SEQ ID NO: 4025 - DNA, 1666 bp, Panicum virgatum
  misc_feature: Ceres CLONE 1796254
  misc_feature: Encodes the peptide sequence at SEQ ID NO. 4026
ccggcactcccccctcgtctcgctccctcccttcccaaatcctccttgtcctctgcaatcgccaaggccaggcccgccgcgcagagtggactgactggtcactggtagctcgatcgatcggatcatcggaggcaggcatggcgtccgggaagcacttcaagtacgtcatcctcggcggcggcgtcgcggcggggtacgcggcccgggagttcgccaagcagggagttcagccaggggagctcgccatcatctccaaggaggcggtggcaccatacgagcgtcctgccctcagcaagggttacctcttccctcagaatgctgcaaggctcccaggattttatgtatgtgtcggaagtggtggagagaggctattgcctgaatggtactcagagaaaggtattgagctgatcctcagcacagaaattgtcaaagctgacctttccaccaagactctgactagtgcagctggagcaacctttacatatgacgtcctgctcattgcaactggatcctcagtcatcaagctcactgattttggcacacaaggagctgattctaacaacattctatacctaagggaaattgatgatgctgacaagctggttgcagctatccaggcaaagaagggtgggaaggctgtggttgtggggggaggttatattgggcttgaacttagtgcagcactgaagctcaatgactacgatgtcactatggtgtttcctgaaccttggtgcatgccccggctcttcactgccgatattgctgctttctacgaggcttactatactaacaaaggggtaaagattttgaagggcacattagctgttggttttgatgccaatgccattggtgatgtcactgcagttaagctaaaggatggcacagtacttgaagctgatattgttgttgtcggtgttggaggcagaccattgactacactcttcaaaggtcaagttgctgaggagaaaggtggaatcaggactgatgctttcttcgaaacaagtgttcctggagtatatgctattggcgatgttgctaccttccccttgaagatgtacaatgagttgaggagagtagaacacgttgaccatgctaggaagtctgcagagcaggctgtaaaggcaatcaagggaaaggagtccggggaatcagttccagagtacgactacctgccgtacttctactcccgatctttcgacctggggtggcagttctacggcgacaacgtcggtgaaaccatcctgttcggcgatagtgaccccacctccagcaagcccaagttcgggtcgtactggatcaaggacggcaaggtcttgggcgccttcctggaaggtgggtcaccggacgagaacaaggccatcgccaaggtggcgaaaacccagccggccgtcgccagcgtcgaggagctcaagaaggagggcctccagttcgccagcaagatctgagaccgcttcctgcttcattgttccatgtacatctcgcgtcatcatttaggtgttcttgtgtttatggtcgcagtgttctacgacggatgttgccatgcgtacttgaaccacatgacattccgttgctgatcgtgatgtctgaactacacatacacgcacacttgctgtaccacttgagatttgaataaagcttttgtcggcaaaaaaaaaaaaaaaaaaaa

SEQ ID NO: 4026 - protein, 435 aa, Panicum virgatum
  misc_feature: Ceres CLONE 1796254
  misc_feature (1)..(297): Pfam Name: Pyr_redox_2 Pfam Description: Pyridine nucleotide-disulphide oxidoreductase
  misc_feature (5)..(435): SWISSPROT Homolog: EC 1.6.5.4 Monodehydroascorbate reductase
  misc_feature (7)..(435): SWISSPROT Homolog: EC 1.6.5.4 Monodehydroascorbate reductase
MASGKHFKYVILGGGVAAGYAAREFAKQGVQPGELAIISKEAVAPYERPALSKGYLFPQNAARLPGFYVCVGSGGERLLPEWYSEKGIELILSTEIVKADLSTKTLTSAAGATFTYDVLLIATGSSVIKLTDFGTQGADSNNILYLREIDDADKLVAAIQAKKGGKAVVVGGGYIGLELSAALKLNDYDVTMVFPEPWCMPRLFTADIAAFYEAYYTNKGVKILKGTLAVGFDANAIGDVTAVKLKDGTVLEADIVVVGVGGRPLTTLFKGQVAEEKGGIRTDAFFETSVPGVYAIGDVATFPLKMYNELRRVEHVDHARKSAEQAVKAIKGKESGESVPEYDYLPYFYSRSFDLGWQFYGDNVGETILFGDSDPTSSKPKFGSYWIKDGKVLGAFLEGGSPDENKAIAKVAKTQPAVASVEELKKEGLQFASKI

SEQ ID NO: 4027 - DNA, 2133 bp, Panicum virgatum
  misc_feature: Ceres CLONE 1796257
  misc_feature: Encodes the peptide sequence at SEQ ID NO. 4028
gcacggcaaacggcacccccgcaggcgtgacgctgacgccgactcctccccaccttgctctttcccctccagctccgctctcctcttgccgccacgccaccctcctcccactctcccagccatcgccctcccgcttgctgctgccgttccgcttccgccgccaccgtcgcccgcccaccgaagcggcggcccgtgccgcctcccgcgcggtccctcccgcgagctccccctatttcgtgctccgggtgtgggcagctcctccccttctcatcttcctctaccggggatttctattgcgtttattgctgagttgcgtggtggcaatgtgataggatagcaaatttgggtggcagagcaaccagtggttcattactctacctgacatacactcacacacgccatgtcaacaaggacgagaaggcatttcgcgatattcaccaccgcaagtctcccatggatgacgggaacagccatcaatcctttgttccgagctgcatacctcgcaaaggatggtgataaggatgtcacgttggtaatcccctggctttgtctaagggaccaagagttagtttatcctaacaagattgtatttgactcgcctctggagcatgagagctatgttcgtcactggattgaggagagggttgactttaggccatccttcagcatcaaattttaccctgggaagttttctacagaaatgagaagcattctcccagttggagatattacagaatgcattctagatgaactggctgacattgctgtattggaagagcctgagcatctaaattggtaccaccatgggcaaagatggaaaaataagttccagcgagtgataggaattgttcacacaaattatctagcatatgtaaggagagaaaagaatggacaagtgattgcttgtttcctcaagtatgccaacacctgggtaactcgaatatattgccacaagattatcagattgtctggtgccactcaagatctgccaaggtctgttatatgcaacgtccatggtgttaatccaaaatttcttgaggtaggcaaactaaagttgaggcagctgcagagtggggagaaagccttcagtaaaggggcatactacattgggaagatggtatggagtaagggatacagggagcttcttgacctgctgttcaaatatcagagcaagttagctggtcttgaagtggacttatatggcagcggagaagattctgatgaagtccgtgaatctgccaaacgtttaagtttggctgtcaatgttcatcctggtcgtgatcatgcagatcccttgttccatgagtataaagtattcatcaaccccagcaccacagatgtggtctgtacgaccactgctgatgccttggcaatgggaaagatcgtcatatgtgccaatcacccgtcgaatgagttcttcaagcaattccccaactgccgtatctataatagtgaagaagaatttgtacagctaacactgaatgctctttctgaacagcctgctccattgacagacatgcagaggtatgggctgtcatgggaggcagcgactgagaggttcattgaggccgctgatataaatcctcatgcgccagagtccagggcccatcaaacctccagggcttcgttgcctgcttttctaagaactcgtagactgaagcaaaacttggaggacgcgtcagtttacctgcaccaagcgctctcaggtctggaagtcacccggtgtgcatttggtgctgttccaaagacgctgcagcctgatgagcagctgcgcaaggatcttgatttggcacctccgccaaagaggaaaaaactgaaatttaagctgatggcgtaacgtttgcaacttctttctacttcacgtttgcagtggttttcttcatgtacagcattagtggacattttcttttcttctaaaatttgacattaccagaacaatccggaggggtcctgaactcttgtggaggtttagtgcttattttcgctgcttactgggatgcatcatgcatcaaccagactatattgtactaaattgtactggtagcttagaggggagaagaacccactgaagtactgaacagtgctgtaattctgtgaattgattgatggatcgtaaaaaaaaaaaaaaaaaaa

SEQ ID NO: 4028 - protein, 478 aa, Panicum virgatum
  misc_feature: Ceres CLONE 1796257
  misc_feature (2)..(121): Pfam Name: Glycos_transf_1 Pfam Description: Glycosyl transferases group 1
  misc_feature (6)..(463): SWISSPROT Homolog: EC 2.4.1.241 Digalactosyldiacylglycerol synthase 2, chloroplast
  misc_feature (6)..(464): SWISSPROT Homolog: EC 2.4.1.241 Digalactosyldiacylglycerol synthase 2, chloroplast
MSTRTRRHFAIFTTASLPWMTGTAINPLFRAAYLAKDGDKDVTLVIPWLCLRDQELVYPNKIVFDSPLEHESYVRHWIEERVDFRPSFSIKFYPGKFSTEMRSILPVGDITECILDELADIAVLEEPEHLNWYHHGQRWKNKFQRVIGIVHTNYLAYVRREKNGQVIACFLKYANTWVTRIYCHKIIRLSGATQDLPRSVICNVHGVNPKFLEVGKLKLRQLQSGEKAFSKGAYYIGKMVWSKGYRELLDLLFKYQSKLAGLEVDLYGSGEDSDEVRESAKRLSLAVNVHPGRDHADPLFHEYKVFINPSTTDVVCTTTADALAMGKIVICANHPSNEFFKQFPNCRIYNSEEEFVQLTLNALSEQPAPLTDMQRYGLSWEAATERFIEAADINPHAPESRAHQTSRASLPAFLRTRRLKQNLEDASVYLHQALSGLEVTRCAFGAVPKTLQPDEQLRKDLDLAPPPKRKKLKFKLMA

SEQ ID NO: 4029 - DNA, 1914 bp, Panicum virgatum
  misc_feature: Ceres CLONE 1796258
  misc_feature: Encodes the peptide sequence at SEQ ID NO. 4030
ccccagcataacatccttctctttctcctcccccataacatccttctcccaactctcaacctagtactcgccctcgcttcgcgcttcttcttgagctcttgcgagccgctgatcatcctgcgctcggcactggaactggaagctgtttgaataacagctccaaggttcaaaggaaccttcgtttgttgtaagatgtatagggcaaagagagctgcactgtcaccaaaggtaaagcgccgtattgggaagtatgagctcggacgcaccattggggtgggaaccttcgcaaaggtccggtttgcaaagaacactgaaaatggggagcctgttgctatcaaaattcttgacaaggagaaggttcagaggtacagattggttgaacagattaagcgtgaaatttgcactataaagttagtcaagcatcctaatgttgttcgactgtttgaggtgatgggaagtaaagcaagaattttcattgttatggaatatgttactggcggagagctttttgaaatcattgctactaatggaaggttgaaggaggacgaagcacggaaatattttcagcaactaatcaatgcagttgattattgccacagtaggggagtgtaccacagagacttgaagttagaaaatttgctgcttgatgctgctgggaatctcaaagtatctgacttcggtttaagtgctttaacggagcaattgaaggctgatggtctgcttcatactacatgtggaactcccaattatgttgctcctgaggtgattgaggatggaggctatgatggcgcaacagcggatatttggtcttgtggagtaatcctctttgttcttcttgctggttatttacctttcgaggatgaaaacatcattgccttatacaaaaagatctccgaagctcagtttacatgtcccacatggttttcggcgggagctaagaacttgattgccagaattcttgatcccaatcctacaactcggatcaccattgctcagatactggaagatccttggttcaaaaagggatacaagcctcctgttttcgacgagaaatatcaaactagttttgatgacgtcgatgctgcttttggagactcagaagaccggcatgtgaaagaggaaactgaagatcagccgaccacaatgaatgcatttgaactgatttcactaaatcaggcactgaatttggagaatttgtttgaggcaaagaaggagtataaaagagagacaagattcacctcgcaatgtcctcctaaggaaataatcacaaagatagaagaggttgcaaaaccacttggatttgacattcagaagaaaaactacaagatgaggatggagaatccgaaagcaggtagaaaaggcaatctaaatgttgcaactgaggtttttcaaatagccccgtcccttcacgtggttgagctcaagaaagcaaagggagatactctggagtttcaaaagttctacagaagtctgtcgacccaactgaaggatgttgtgtggaagtgcgacagcgaggtcgagggcaacagcgcggcggcatgaagcggcctcctaaacttccagaggccggcgctggcctttccctgtacatagcttctctttcggatgaccggtgtccattgcagagtcggcttttgcaagccaagttctttggttcattggttgatggcgagtaagctccgatgaaacaaccgtcttcaaggccgttgcggatgggcttactggtgggttagttcattttatagtcaaggctgtcgtagtcctgtagtaatgaggtattgatgaggtgcaccagatggtgtgagggagtaccgattgttagctcaaggcttcaaacttagcccccttcagtttgttctatggtgtgttacttcagaataaacactgctttcagaaaaaaaaaaaaaaaaaaaa

SEQ ID NO: 4030 - protein, 449 aa, Panicum virgatum
  misc_feature: Ceres CLONE 1796258
  misc_feature (1)..(449): SWISSPROT Homolog: EC 2.7.11.1 CIPK-like protein 1
  misc_feature (12)..(437): SWISSPROT Homolog: EC 2.7.11.1 CBL-interacting serine/threonine-protein kinase 24
MYRAKRAALSPKVKRRIGKYELGRTIGVGTFAKVRFAKNTENGEPVAIKILDKEKVQRYRLVEQIKREICTIKLVKHPNVVRLFEVMGSKARIFIVMEYVTGGELFEIIATNGRLKEDEARKYFQQLINAVDYCHSRGVYHRDLKLENLLLDAAGNLKVSDFGLSALTEQLKADGLLHTTCGTPNYVAPEVIEDGGYDGATADIWSCGVILFVLLAGYLPFEDENIIALYKKISEAQFTCPTWFSAGAKNLIARILDPNPTTRITIAQILEDPWFKKGYKPPVFDEKYQTSFDDVDAAFGDSEDRHVKEETEDQPTTMNAFELISLNQALNLENLFEAKKEYKRETRFTSQCPPKEIITKIEEVAKPLGFDIQKKNYKMRMENPKAGRKGNLNVATEVFQIAPSLHVVELKKAKGDTLEFQKFYRSLSTQLKDVVWKCDSEVEGNSAAA

SEQ ID NO: 4031 - DNA, 1863 bp, Panicum virgatum
  misc_feature: Ceres CLONE 1796273
  misc_feature: Encodes the peptide sequence at SEQ ID NO. 4032
aacccagcgcagcccacaccgctacgccaattgcaacgccgccgtcgttactctcgccggagtcggaaccacgacgccggtcaccgccgctgcccaagcagcttcatccgagccctgattcgccggatcacatgtggtcacctctcagatgacctcccgactcttcaacgctttgttgctgttcctcctttttgtcgccgcctctctgggccgcggtggcgctgttcagacgacgccgtcgcttgagttccaccaccggttctccgcgcctgtgcggcggtggctggaggcccgcgggcacgcgctccccggcgggtggccggcccctggcggtgctgcgtatgtcgccgcccttgccgagcacgaccgtcaccacgcgatgtcggctgctggtgctggaggtagcggcgaggcccctccgctaactttcgccgagggaaacgccaccctcaaggtcagcaacctcggatttttgcactatgctctcgtgaccgtaggcacaccagggcaaacgttcatggtggctctggacactgggagcgacctcttctggctgccgtgccagtgtgatagctgcacgccgcctgcgaccgctgcttcgggatcagcttccttttacaaccctggtatgtcatcaactagcaaagtcattccatgcagtagcaacttttgtgatcttcaaaaagaatgctccacgacgtcacaatgtccatacaagatggtgtatgtctctgcgggcacatcatcttctggatttttagttgaggatgtactttatctctcaacggagaattcacatcctcacattcttaaggcgcagataatgcttggttgtggacagactcaaactgggtcatttctggatgctgctgctcctaatggcctttttggacttggaatagacaaggcttcagttccaagcattttagcgcagaaaggtctgatacctaactccttctcgatgtgctttggacgtgatggtattgggaggataaactttggagatcaaggaagctcggaccaacaagagacacctcttgatatcaaccaacgacatcccacctacaccatcagtatcactgggattgccattgaaaataagctaacagacttggaattcagtactattttcgacactggtacctccttcacatacttggcggacccagcatatacatatataacccagacttttcacgcacaagttcaagcaaatcgccatgctgctgactcgagaattccttttgaatattgctatgatctgagctctggtgaagcaaggattccaactcctgatataatcctgagaacagtaagtggaagtctgtttcctgtgattgatccagggcaagtaatctcaattcaggaacatgaatatgtttattgcctggcaattgtcaagagcatgaagctcaatattatagggcaaaatttcatgactggtcttcgtgtagtgttcgatcgagaaaggagaattcttggatggaagaaattcaattgtttttcaccttcaacgtctgagaactactctcctgaggaagcaaggaatccaactggtgtttcccagttgagacctttgaacaattcatctcctggaacgttacaagatagttttcttttcatgcttcttttaattggttcactggtgcattatgctctgattcctcttgttggtgtagggttgatccggctgtaaattagctcttactgtaaaatagatactgtagagcttgactagttagtacagcatatagaacacaacacaattgcttagtgcttacatgttctgtaaattcgacaatagtaattaattgtgatgctggtttttatggctcattatatacaaaaaaaaaaaaaaaaaaa

SEQ ID NO: 4032 - protein, 515 aa, Panicum virgatum
  misc_feature: Ceres CLONE 1796273
  misc_feature (1)..(339): Pfam Name: Asp Pfam Description: Eukaryotic aspartyl protease
MTSRLFNALLLFLLFVAASLGRGGAVQTTPSLEFHHRFSAPVRRWLEARGHALPGGWPAPGGAAYVAALAEHDRHHAMSAAGAGGSGEAPPLTFAEGNATLKVSNLGFLHYALVTVGTPGQTFMVALDTGSDLFWLPCQCDSCTPPATAASGSASFYNPGMSSTSKVIPCSSNFCDLQKECSTTSQCPYKMVYVSAGTSSSGFLVEDVLYLSTENSHPHILKAQIMLGCGQTQTGSFLDAAAPNGLFGLGIDKASVPSILAQKGLIPNSFSMCFGRDGIGRINFGDQGSSDQQETPLDINQRHPTYTISITGIAIENKLTDLEFSTIFDTGTSFTYLADPAYTYITQTFHAQVQANRHAADSRIPFEYCYDLSSGEARIPTPDIILRTVSGSLFPVIDPGQVISIQEHEYVYCLAIVKSMKLNIIGQNFMTGLRVVFDRERRILGWKKFNCFSPSTSENYSPEEARNPTGVSQLRPLNNSSPGTLQDSFLFMLLLIGSLVHYALIPLVGVGLIRL

SEQ ID NO: 4033 - DNA, 1939 bp, Panicum virgatum
  misc_feature: Ceres CLONE 1796285
  misc_feature: Encodes the peptide sequence at SEQ ID NO. 4034
gctactctccacctcctgttgacgaattgcatgccgctctccttgtctttaaagagccggccggtcagctcgtgaagcttgcgatcgagccgcaagctctccgttggccctagctaggaagctgccggcggcggcgctgttgagctgcaagagagttgagagtgatccggagctcacttgcttcattgatgaatgccgaagctatagaagtccctgctcgttccgaggttcgatgccccggtcgcccggatggcattgccaaccccggtggtagccggcattgctgccggcgccgccgcgttgctgctggcggccgtcctggtcgcggcgtggttcgtccggcggcggcgcagggcgcggcgtgaccggagctccgacactggctcgtccgaggctcctcccacgctggcggagtggggccggttcggccggacctcatcggcgccggagttccacggcgccaggcagttctcgctggaggagctggcgcacgccaccaagaacttcgccgaggccaatctggtgggcgccgggagcttcggcctggtgtacaagggcctgcttctcgacggcaccgtcgtcgccatcaagcgccgcgccggcgcgccgcggcaggacttcgccgacgaggtcaggaggctatcagagatctggcaccgcaatgtcgtgacgctgatcggatactgccaagaagggggtctacagatgctggtattcgagtacctgcccaacggcagtgtgagcggccatttgtacgacactggcaaggagtccatgacaaggctggagttcaagcaaaggctctccatagccattggagcagctaaaggtctgaatcacctgcacaccctggcgcctccgttgatccacagggatttcaagacgagcaacgtcctggtcgacgagaacttcatcgcgaaggtgtctgacgccggaatcgacaggctgctgcgaaggtttgaaggcgccgctccgccgaatgtcagcgtctaccaagatacagaggtacattcattggcccagctttctgaaagcagcgacgtatacagctttggggtttttcttctggagctgatcactggcagggaagctgccggcttaattccaccagaatccaaggaacctcttgctcattggatggaggcacatttcagctcgaacgagctgatcgacccgaggctgggagggagcttcacatcggagggcatgacggagctggtgggcctggcattccagtgcctgaacccctcggcgaggcggcggcccaggatgcggctggtggcggcggagctggaccggatcctggagaaggagatgaccctgaccaccgtcatgggcgacggcaccgccatcgtcacgctcggcagccagctcttcacatcctgatcagaacagcatcatcattcatcaatccaagcggagccaggcagcagtgccgaggtgagggagacgagcttctgaatgacgacgcgtacatctcgacgctcggatccggcaccgggcgcagcggcggcgcccgtcattgcaatgcagtgcagcctcccgttgatgtcctcgcgtgtcgagagaacgagcgaaggatctcaaggggttctccatctggaatagaagggcagcggaagcctaagccgtcgacgtcaggggtggccgccggcgacaggaaggggagcagttgatcccaagatttttcagaaaggctcctgaaatggattgtaattaataatcacgatccaactatttttcacgaaaccctctaattcggatcgcggttgtgcatcgtgatccaatcaaagggtatatgtaaatagttattttcagttttttttcataaagaactccctactttggatcgtgattaataaccgtgatctgaatatttacagaaacacctcgatccaaaaattggatttgcaccttccaaaaaaaaaaaaaaaaaaaa

SEQ ID NO: 4034 - protein, 378 aa, Panicum virgatum
  misc_feature: Ceres CLONE 1796285
  misc_feature: Great-hit functional homolog of the protein sequence encoded by LOCUS At3g26700
  misc_feature: Useful for making plants with altered cell wall content and/or composition
MALPTPVVAGIAAGAAALLLAAVLVAAWFVRRRRRARRDRSSDTGSSEAPPTLAEWGRFGRTSSAPEFHGARQFSLEELAHATKNFAEANLVGAGSFGLVYKGLLLDGTVVAIKRRAGAPRQDFADEVRRLSEIWHRNVVTLIGYCQEGGLQMLVFEYLPNGSVSGHLYDTGKESMTRLEFKQRLSIAIGAAKGLNHLHTLAPPLIHRDFKTSNVLVDENFIAKVSDAGIDRLLRRFEGAAPPNVSVYQDTEVHSLAQLSESSDVYSFGVFLLELITGREAAGLIPPESKEPLAHWMEAHFSSNELIDPRLGGSFTSEGMTELVGLAFQCLNPSARRRPRMRLVAAELDRILEKEMTLTTVMGDGTAIVTLGSQLFTS

SEQ ID NO: 4035 - DNA, 1255 bp, Panicum virgatum
  misc_feature: Ceres CLONE 1796290
  misc_feature: Encodes the peptide sequence at SEQ ID NO. 4036
tagcgagcggctcaagcttcacaatcacaaatccctccggataggtggtgcgtgcgtggtggacaggcatggcggtgccgcggcggctcccggcggcggcggcggcgctcgccctcctcctcgtggcggcggcgggcgcgctcccgcgcggcgcggacgcgcagctctcggcggggttctactccgcgagctgccccgccgtgcacagcgtcgtgcgccaggtcgtgtcgcaggcggtcatgaacgactcccgcaccggcgccgccgtcctccgcctcttctaccacgactgcttcgtcaacggctgcgacgcctcgctgctgctggacgacacgcccgcgacgcccggcgagaagggcgccggcgccaactccggcggctccaccttcggcttcgacctcatcgacaccatcaagtcccaggtcgaggccgcctgccccggcgtcgtctcctgcgccgacatcctcgccctcgccgcgcgcgacaacgtcaacctgctcggcgggccgagctgggcggtgccgctgggccggcgcgacgcgacgttcccgaatgcgacgggagccggcacggacctcccgggcccgggctccgacctcgcccgcctcgtggccgccttcgccgccaagggcctcacgtcgcgggacctcgcggcgctgtcgggcgcgcacacagtgggcatggcgcggtgcctcagcttccggacgcgcgcctactgcgacgacaacgtgagccccgcgtccgcggcccggatgcggggggcctgcccggcgtccggcggggacgacgcggccgcgccgctggacgccgccacccccgccgagttcgacaacgggtactaccggaacctggtcgccggcgccgggctgctgcactcggaccaggagctcttcaacaacgggcccctcgacgcgctcgtgcggctctacagcgccaacggcgccgccttctcgtcggacttcgccgcgtccatggtcaggctcgggaacgtcgccccgctcacgggctccgcgggggaggtcaggctcgactgcaggaaagtgaactcgtcctgaatcatgatgtgcatcgcattcacgatgatgccggcttgatgctaattcattagctctgtacgtgaacttcgtagagttttcatttgttcagaggctcagagctatgtatgtatgcatacatttcttttcttggaaatatactgctcattcttttatttaatctacaaaattagtaggagcaaaaaaaaaaaaaaaaaaaa

SEQ ID NO: 4036 - protein, 328 aa, Panicum virgatum
  misc_feature: Ceres CLONE 1796290
  misc_feature (1)..(242): Pfam Name: peroxidase Pfam Description: Peroxidase
  misc_feature (30)..(326): SWISSPROT Homolog: EC 1.11.1.7 Peroxidase 52 precursor
  misc_feature (31)..(326): SWISSPROT Homolog: EC 1.11.1.7 Cationic peroxidase 1 precursor
MAVPRRLPAAAAALALLLVAAAGALPRGADAQLSAGFYSASCPAVHSVVRQVVSQAVMNDSRTGAAVLRLFYHDCFVNGCDASLLLDDTPATPGEKGAGANSGGSTFGFDLIDTIKSQVEAACPGVVSCADILALAARDNVNLLGGPSWAVPLGRRDATFPNATGAGTDLPGPGSDLARLVAAFAAKGLTSRDLAALSGAHTVGMARCLSFRTRAYCDDNVSPASAARMRGACPASGGDDAAAPLDAATPAEFDNGYYRNLVAGAGLLHSDQELFNNGPLDALVRLYSANGAAFSSDFAASMVRLGNVAPLTGSAGEVRLDCRKVNSS

SEQ ID NO: 4037 - DNA, 1015 bp, Panicum virgatum
  misc_feature: Ceres CLONE 1796302
  misc_feature: Encodes the peptide sequence at SEQ ID NO. 4038
agctcgtctagactctagaggagacagtcgcaggaggccaggagaagcagccggcgagcagcaagccatggcgtccaccacctgcttcctccaccagtccaccgcccgcttcggcgccgccgccgcctcggcgcgcccccaggcgccgcgggcccagcagctcgtgtgcagggcgcagaagccgcaggacgccgccgccgagggcgacgccgcggtcacccgccgcgccgcgctcacgctcctcgcgggcgccgccgccgtcggcgccaaggtgaaccccgccgccgccgcctacggagaagcagccaacgtgttcgggaagcccaagacgaacacggaattcatcgcctacagcggcgacggcttcaagctgctgatcccgtccaagtggaaccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctggagagctcggcgccagtggtggacgggaagcagtactacagcgtgtccgtgctgaccaggacggcggacggcgacgagggcggcaagcaccagctcatcacggccaccgtctcggacgacaagctctacatctgcaaggcgcaggccggcgacaagaggtggttcaagggcgccaggaagggcgtcgagaaggcagccagctccttcagcgtcgcataagcagtgcacgcatcatctgtgtgccggaatttgtttcttttggttcagggatgcttacgtagatagaggttgggcatgcgtgtgcgctccggcctttgattgtacatgagaacaaagaccaaggagagctccatttcgtccctgcaaaaaaaaaaaaaaaaaaaa

SEQ ID NO: 4038 - protein, 260 aa, Panicum virgatum
  misc_feature: Ceres CLONE 1796302
  misc_feature: Great-hit functional homolog of the protein sequence given in SEQ ID NO 9494
  misc_feature: Useful for making plants with altered Lignin content
  misc_feature: Useful for making plants with modulated nitrogen use efficiency
MASTTCFLHQSTARFGAAAASARPQAPRAQQLVCRAQKPQDAAAEGDAAVTRRAALTLLAGAAAVGAKVNPAAAAYGEAANVFGKPKTNTEFIAYSGDGFKLLIPSKWNPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDDKLYICKAQAGDKRWFKGARKGVEKAASSFSVA

SEQ ID NO: 4039 - DNA, 2136 bp, Panicum virgatum
  misc_feature: Ceres CLONE 1796322
  misc_feature: Encodes the peptide sequence at SEQ ID NO. 4040
aatggaggctctgcgggcatggagggcctccaatctccttggcttcgcggcctcccgcgttgtcaccgccgcctccgcggcgaggtcactccgcctccgcctccgctgctgctcagctgctgccacgacgaaccagaagcagctgcctctacctcaggaccgccgtcgccgtagtgcctccacctccacctccgaccgcgactccatccgcgccatccgcctcaaaaaggttgaggagctaagaggaaagggttatgagccatatgcgtacaagtgggataggactcatacgaccaaggagcttcaggaagagtacacccatcttgaaaatggtgaaatctgtgaggaggcagcagtctccattgctggcaggattgttgcccgaagggcatttggaaagcttgttttcatgactgtgagagatgatactgggactattcagctttactgtgagaaagacaaccttacggaggaccaatttgaacaactgaaggcatttattgatattggtgatatcataggtgcaagtggatccataaagaaaacagagaaaggggaactatctctttatatgaaaaattttgagatcctcacaaaatccttactcccactaccagacaagtatcatgggttaactgatgtcgacaaacgctatcgtcaaaggtatgttgacatgatcgcaaatcctgaggttgctgagatattccgaactagagcaaaggtggtttctgaaatccgcaagacaatggagtcgtttggtttcattgaagttgaaactccagttctacagggagcagcaggtggtgctgaggctagacctttcataacctatcataactcacttcaaagagatctttacttgaggattgcaacagagctgcatttgaaaaggatgttggttggagggcttgagagggtgtacgagattggaagaattttccggaatgaaggtatctctactcgtcataatcctgaatttaccaccattgagatgtatgaagcatattcagactatgaaagcatgatgaatatggctgaagaaattgttgttcgatgtgctatggctactcatggcaagcttaaagttgcttatttgggaactgaaatttctctcgaaagaccatggaggagggagaccatgcattctcttgtcaaagaagcaactggaatcgacttcaacatcttcggccatgatgttgaatctgctaaaatcgctgcaagaggactgccagggatcaaaatgggaagcagtaaaagtacttcactgcaatcctgttcatctgttggacatgttcttaatgaggtttttgagacttttgttgaatctactcttgtacaaccgacttttgtccttgactacccagttgagatatctccattggcaaaaccacatcggagttatgctggccttactgaacgatttgaactttttatatgtggtcgtgaaattggcaatgcattttctgagctcacagacccaattgatcagaggagccgttttgaaaatcaaataaaacaacacaatgctaaacgtgctgcaagggctaaggtcaaatctactgaggatcaaggagatgaggatgattgttcgtatgaagtttgtttagatgaagacttcttaacttcattagaatatggaatgccaccagcatcaggaatgggcctgggtattgaccggttagtaatgcttttgacgaactctgccagcataagggatgttattgcctttcctgtcttgaagattcagcaatagatctttcatttaacgtaagaagagacactattgggagaaatgtggttgtcaaagcaatcatctgcagccttcgtttcacgcttgtttcattcatgcaaattttacttttgttaaccttttagctgatagatagatatggccactgatcaatcgataaatcgcaatggactatggtgagtgtccagacaatatttatagcaaaaacagctgatagatttgtcaacacttgaatcaataatggattccacatatttcatgggatgcaatgaatgcgatacaaaatagcaggaaactccgactcacctgttcataataatttaataaattgtttgatatgaatgtattgcttaatatctgattcctaaaaaaaaaaaaaaaaaaaa

SEQ ID NO: 4040 - protein, 583 aa, Panicum virgatum
  misc_feature: Ceres CLONE 1796322
  misc_feature (60)..(513): SWISSPROT Homolog: EC 6.1.1.6 Lysyl-tRNA synthetase
  misc_feature (69)..(509): SWISSPROT Homolog: EC 6.1.1.6 Lysyl-tRNA synthetase
MEALRAWRASNLLGFAASRVVTAASAARSLRLRLRCCSAAATTNQKQLPLPQDRRRRSASTSTSDRDSIRAIRLKKVEELRGKGYEPYAYKWDRTHTTKELQEEYTHLENGEICEEAAVSIAGRIVARRAFGKLVFMTVRDDTGTIQLYCEKDNLTEDQFEQLKAFIDIGDIIGASGSIKKTEKGELSLYMKNFEILTKSLLPLPDKYHGLTDVDKRYRQRYVDMIANPEVAEIFRTRAKVVSEIRKTMESFGFIEVETPVLQGAAGGAEARPFITYHNSLQRDLYLRIATELHLKRMLVGGLERVYEIGRIFRNEGISTRHNPEFTTIEMYEAYSDYESMMNMAEEIVVRCAMATHGKLKVAYLGTEISLERPWRRETMHSLVKEATGIDFNIFGHDVESAKIAARGLPGIKMGSSKSTSLQSCSSVGHVLNEVFETFVESTLVQPTFVLDYPVEISPLAKPHRSYAGLTERFELFICGREIGNAFSELTDPIDQRSRFENQIKQHNAKRAARAKVKSTEDQGDEDDCSYEVCLDEDFLTSLEYGMPPASGMGLGIDRLVMLLTNSASIRDVIAFPVLKIQQ

SEQ ID NO: 4041 - DNA, 1489 bp, Panicum virgatum
  misc_feature: Ceres CLONE 1796324
  misc_feature: Encodes the peptide sequence at SEQ ID NO. 4042
atcaccacgcacccaagttcaggaaaccacatccgaaccccaatcctcctcccgaattctccatcgccatggctctctcctccatcttcctccccctccccctgcccaagctcgtttcctcctccagatcccaccgtttgctccccgtcagggcgtcctccgacgcgcccgccgcctccgcttctttcgatctgcgccgctactggacctccctgatcgccgacgtagagtccgagctcgacgccgcgatgcccatgcgccccccggagagcatccacgccgccatgcgctacgcggtcctcccgggcgccggcaaggagggggccgccaagcgggcgccccccgtgctctgcgtcgccgcctgcgagctcctcggcgcgccgcgctcggccgcgctcccggccgcggcggccctcgagatgctccacgcggcgtcgctcgtgcacgacgacctgccgtgcttcgacgccgcgcccacgcgacgcgggcgcccctccacgcacgccgccttcggcaccgacatggccgtcctcgcgggtgacgcactcttcccgctcgcctacacccacatcatcgcgcacaccccgtcgccggacccggtgccccacgccgtcctcctccgcgtcatggcggagctcgcgcgcgccgtcggatccaccggcatggcggcgggccagttcctcgatctggccggcgccaccgccctcggcgaggccgaggtcatgcaggtcctgacgaagaagttcggcgagatggccgagtgctccgcggcctgcggcgccatgctcggcggggccgggcccgacgaggaggccgcgctgcggcgctacggccgcaccatcggcgtcctgtacgagctcgtcgacgacatccggagcgcgtcagggaacggcaagatgaggagcaacgccagcgtcctgcgcgcgctgggcatggatcgcgcgctcggcatcgtggaggagctcaaggcccaggccaagacggaggccgacaggttcgcggacaagtacggtgaccgggtgctgcccctgtacagcttcgtggactacgcggtggagagagggtttgagctccaggatgcagcagcagcgccatgaagagtgcgcgacctcagttggtactgagaaattggagcaagtgcgcgatcgcggctggtactgaacattggagcaagtgacatgtatgttctttagaatgggtgagagctctatttgccgaaattataatccctcctctatagatgtttagatgctcgaattcgtaacttggcgagattcatccggtagagttctcacccctgatacagatgtttagaacttcgaactttctgttgatgtctcggttgaagtttttgtagacatcaacagtcgtgcggtcgtaaaataagatgttactgattactggatgcaagaccaatagattaaggccttgtttagttcccgtcaaaaactttacacatcaattacatcaaaaaaaaaaaaaaaaaaaa

SEQ ID NO: 4042 - protein, 342 aa, Panicum virgatum
  misc_feature: Ceres CLONE 1796324
  misc_feature (1)..(261): Pfam Name: polyprenyl_synt Pfam Description: Polyprenyl synthetase
MALSSIFLPLPLPKLVSSSRSHRLLPVRASSDAPAASASFDLRRYWTSLIADVESELDAAMPMRPPESIHAAMRYAVLPGAGKEGAAKRAPPVLCVAACELLGAPRSAALPAAAALEMLHAASLVHDDLPCFDAAPTRRGRPSTHAAFGTDMAVLAGDALFPLAYTHIIAHTPSPDPVPHAVLLRVMAELARAVGSTGMAAGQFLDLAGATALGEAEVMQVLTKKFGEMAECSAACGAMLGGAGPDEEAALRRYGRTIGVLYELVDDIRSASGNGKMRSNASVLRALGMDRALGIVEELKAQAKTEADRFADKYGDRVLPLYSFVDYAVERGFELQDAAAAP

SEQ ID NO: 4043 - DNA, 1578 bp, Panicum virgatum
  misc_feature: Ceres CLONE 1796326
  misc_feature: Encodes the peptide sequence at SEQ ID NO. 4044
gccgcgtcgcgtgacgtcttccgcccgcgccttcttcctccctcccccgctcgctcccccgcctcaccggcctcgccgaaaccctagccctgtagccccggcccccgccgccgtagagggaaggggagagcggcgtcaggaggagggggggcgccgatggggaagaagaagaagcgcgtggagaaggtcttctgctactactgcgaccgcgagttcgacgacgagaagatcctcgtccagcaccagaaggccaagcacttcaagtgccacgtctgccacaagaaactctccaccgcctccggcatggccatacacgtcctccaagtccacaaggagtctgtcacgaaggttcctaatgctaagcctgatagggagtcaacggatattgagatctttggaatgcaaggaatccctgcacatgtattggctgctcactatggcgaagaggaagatccttcagcgaaggtagccaaagtagaagtgccacaggtaaggcctgttattatgcctaattcgctaggcatggcatttcctccacgaccagcttatggtgtagcacctccaatctataatcctgcactgaatcctttgatggcccgacctccgatttggcctactccaccagcacaagcttggtatccacaacaagtagcatacccacaacaaccaccagtttcagttgctccagtagttgctgggctgccaccacaacagccactatttcctattcagaatgtgcctactcctatgacatcagcacctgctaatatgcttcagacatcgtttcctatggctcctccaggagtaccttcacctgttgcccctcaggtttcccagcctttgtttcctgttaacacttccgttgtcaatggagctgcaagttccccatttgtagcatctgttgcacctggaaccatcccggcaagctctcctgcagcagttggatatggagccaataaccaaggcactggtggtccagcagttggatcttcacctgcagtatccaataacaaaacgcctggtacccagccagctacaaaagaggtctatctggtgtgggatgatgaagcaatgtcaatggaagaaagaaggttgtcgttgcccaagtatcaggtgcatgatgaaactagccagatgaactcagttgacgcagcaattgatcgaagaatatcagaaagtcggctagcaggacgcatggccctatgaagaagctgggccttgcttggtagatcaccccttgcaattcagcgatggaccctgcctgtgtgtgtgtcgcctttttgcagtggtcctgttcatttagttggtcaatggagttactgcagttaaagaatgtgctgtttctgacttgtcggttggcgtcgagcttttgatcttgtatccttccagctgaaggaaatgaatgttagtgtttagaagttatttggtccatttttattttacctcacagttctgcccggttgtagcctaattatatgttcctgatggtttttgctgtttgcgaagcaaactctaaattgttgttgcctattttaataacacatgttccaactgttccaaaaaaaaaaaaaaaaaaaa

SEQ ID NO: 4044 - protein, 349 aa, Panicum virgatum
  misc_feature: Ceres CLONE 1796326
  misc_feature (1)..(24): Pfam Name: zf-C2H2 Pfam Description: Zinc finger, C2H2 type
MGKKKKRVEKVFCYYCDREFDDEKILVQHQKAKHFKCHVCHKKLSTASGMAIHVLQVHKESVTKVPNAKPDRESTDIEIFGMQGIPAHVLAAHYGEEEDPSAKVAKVEVPQVRPVIMPNSLGMAFPPRPAYGVAPPIYNPALNPLMARPPIWPTPPAQAWYPQQVAYPQQPPVSVAPVVAGLPPQQPLFPIQNVPTPMTSAPANMLQTSFPMAPPGVPSPVAPQVSQPLFPVNTSVVNGAASSPFVASVAPGTIPASSPAAVGYGANNQGTGGPAVGSSPAVSNNKTPGTQPATKEVYLVWDDEAMSMEERRLSLPKYQVHDETSQMNSVDAAIDRRISESRLAGRMAL

SEQ ID NO: 4045 - DNA, 2014 bp, Panicum virgatum
  misc_feature: Ceres CLONE 1796348
  misc_feature: Encodes the peptide sequence at SEQ ID NO. 4046
aacttcctggaatcgactccaatccagatctcgcccacgtcgtccccgcctcgcgctgccgcggaggggagatcccgtccaccgaccaccggggggccttggaccgatctcttcttccccccgcggtggttgctgctactcttctaggtcgtcgctggcagtatgggcgtgcccaaggatggcgccgagttggaggagggaaccttggagatcggcatggagtataggactgtctctggtgtggcagggcccctggttattttggacaaagtaaagggacctaagtatcaggagattgtgaacatccgattgggagatggcaccactcgtcgtggtcaagtcctggaggtcgatggtgaaaaggctgttgtgcaggtctttgaaggtacctcaggaatagacaacaagtataccactgtgcagtttaccggtgaggtcttgaaaactcctgtctcacttgatatgcttggacgcatctttaatggttctgggaaacctatcgataatggccctccaatattgcctgaggcttacttggatatttctggaagttctatcaaccccagtgagagaacctatccagaagagatgattcaaacaggaatatccaccattgatgtgatgaactcaattgcgcgggggcaaaaaattcctctcttctctgctgctgggcttcctcacaatgagattgctgctcagatatgtcgtcaagctggtcttgtcaaaaggctggagagttctggcaagcacaaggagggtggtgatgaagataactttgccattgtttttgctgctatgggagtaaacatggaaacagcccaatttttcaagcgtgattttgaagaaaatggttctatggaacgagtcacccttttcctgaatctggcaaatgatcctacaattgaacgtatcatcacgcctcgaattgccctcacgacagcagaatatttggcatatgaatgtgggaagcacgtccttgtcattctgacagatatgagctcctacgcagatgcgcttcgagaggtctcagcagcacgagaagaggtgcctggtaggcgtggttatcctggatacatgtatactgatctggcaaccatatatgagcgagctgggcgtattgaaggaagaaaaggctcaattactcaaattcctattctaactatgcctaatgatgatatcacacatccaactccggatcttactggatacattactgaagggcagatatacattgatagtcagctccataacagacagatatacccacccatcaatgttctgccatctctctcacggttgatgaagagtgctattggtgagggtatgacacgccaagatcattcagatgtgtccaatcagctttatgccaactatgcaatcggcaaggatgtgcaagctatgaaagcagttgttggagaggaggctctttcatccgaggatctgctctatctagaatttcttgacaagtttgagaggaagtttgtgacacaaggtgcatatgacacccgaaacattttccagtcacttgacctggcttggtctttgcttcgcatattccctcgagaacttctccaccgtatccctgcaaagaccttggatcaatactacaatagggatgccacccactgatatatctgtccggaacaagataacagagttttccgaatcacagcttgaataaagaggagagttcaaagactttgtatattttttattatatatatatatatatatatatatatatatatagttaccctattctttcagtctctgcaagcaagttaccatcaacatgccaattgcacaggaggcttttgtaatattgtgccatgtatacttgaaccccatgctggagctcatttgttagatagaattgtgtagcagcactgtaaagccatattggctatgaaaagctcggctgtgttggttgcatttgtctctctttgtaaatgaatcaaataatgtcttcgtgtcatttctctcctgatgtaacgaagattaagttacgtcgctt

SEQ ID NO: 4046 - protein, 488 aa, Panicum virgatum
  misc_feature: Ceres CLONE 1796348
  misc_feature (1)..(232): Pfam Name: ATP-synt_ab Pfam Description: ATP synthase alpha/beta family, nucleotide-binding domain
  misc_feature (1)..(93): Pfam Name: ATP-synt_ab_C Pfam Description: ATP synthase alpha/beta chain, C terminal domain
  misc_feature (1)..(488): SWISSPROT Homolog: EC 3.6.3.14 Vacuolar ATP synthase subunit B isoform 1
  misc_feature (9)..(488): SWISSPROT Homolog: EC 3.6.3.14 Vacuolar ATP synthase subunit B isoform 2
MGVPKDGAELEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKRLESSGKHKEGGDEDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRKGSITQIPILTMPNDDITHPTPDLTGYITEGQIYIDSQLHNRQIYPPINVLPSLSRLMKSAIGEGMTRQDHSDVSNQLYANYAIGKDVQAMKAVVGEEALSSEDLLYLEFLDKFERKFVTQGAYDTRNIFQSLDLAWSLLRIFPRELLHRIPAKTLDQYYNRDATH

SEQ ID NO: 4047 - DNA, 1848 bp, Panicum virgatum
  misc_feature: Ceres CLONE 1796359
  misc_feature: Encodes the peptide sequence at SEQ ID NO. 4048
aaccgaaagcaaagcaacgcccccgacccccatagaaaaacaggagaggaggaaggggggaaaaagctcgcagaagtgagctcccacctcctctctctctctccctctccccgctcgcagtctcgcaccaccaccgaaccctccgatccaaaccctgctcgcatcgcgccgcatgcctccgcgcgccacgaggcggcggagcagcagcagctgaccacagaccgcccgcccctttgacccgccggggagagagagagagacatgggcggcgtgacgtccaccatcgccgcgcgcttcgccttcttcccgcccacgccgccgtcctacaccgtcgtcgtcgccgacgccgccaccggccgcctcgccatcccggagatctcccgcgcccccgggcgccgccggaggcgggacggcggcggcgctggcggggactcgtcctccgccgcggccgccgaggaggacggctcggaggtggtgcgcctccgcacgcgccgcgggaacgagatcgtgggggtctacgtgcgccacgcgagggcctccgccaccatgctctactcccacggcaacgccgccgaccttggccagatgtacgggctcttcgtcgagctcagccgacgcctccgtgtcaatctcttcggatatgattattctggttatgggagatctacagggaagcccactgagtgtaatacatatgcagacattgaagcagcatacaactgcctcaaggaaaaatatggtgtcgcagatgaggatataatcttatatggtcagtctgttggaagtggtccgaccattgatcttgcttcacgattgccaaacttgcgagctgtggttttgcacagtcccattttatctggactaagagtactgtatccagtcaaacggacattttggttcgacatttacaagaacattgataagattggcttggtaaattgcccagtgcttgttattcatggtacatcagacgatgttgtcgactgctcccatggaaaacagctatgggagcattgcaaagtgaaatattcaccactgtggttaagtggtggtggccactgcaacctcgagctgtatcctgattacattaggcacttgaagaagtttgtgtcaagccttaacaaaaaattgcccaaacctgacccgcaagagataacagccaatgatgacactaccactaaagcaaaggaggctgcatgctcggaaaaacccaaggaagctgcaaagtgctcacagatctcgcggaagagcctggatagccgagtcgggaaatctaaaacagtggatgttcctgagaaaccacggatgagctcagatgatatcgacaagttcaggaggaggcgatgcttggtctggtgatgtatgatgtgatctccggcgcaaattgtggagctgtgcctgaatactatggtatgggaatcaagcaactgtattacatgatatcgcaaggaatggcttcagctttcctgcggtggagagaaaagagctgtgaaataaggaagggaatcaggaagctacaatcattatccatcagagagctactacgcgaaaccagtagttcctcagttaatttaacacttacaccgtcgacctgttttgcagcaccgattagggcttccgtcatgtaaaagtgtaccattattgtctgtaatcacgagggaccaatacaaacatttaacagaatcacgagcacaattgtctgttctggctgcaccagacaccagtataaggttcacgtgcatcatgtatggtggatccttgtgagcttaccctgtgcgccaatctacttcttgtatggattattcagtaatgcagtacatatcatggcaaaaaaaaaaaaaaaaaaaa

SEQ ID NO: 4048 - protein, 365 aa, Panicum virgatum
  misc_feature: Ceres CLONE 1796359
  misc_feature (1)..(89): Pfam Name: Abhydrolase_1 Pfam Description: alpha/beta hydrolase fold
  misc_feature (1)..(208): Pfam Name: Abhydrolase_2 Pfam Description: Phospholipase/Carboxylesterase
MGGVTSTIAARFAFFPPTPPSYTVVVADAATGRLAIPEISRAPGRRRRRDGGGAGGDSSSAAAAEEDGSEVVRLRTRRGNEIVGVYVRHARASATMLYSHGNAADLGQMYGLFVELSRRLRVNLFGYDYSGYGRSTGKPTECNTYADIEAAYNCLKEKYGVADEDIILYGQSVGSGPTIDLASRLPNLRAVVLHSPILSGLRVLYPVKRTFWFDIYKNIDKIGLVNCPVLVIHGTSDDVVDCSHGKQLWEHCKVKYSPLWLSGGGHCNLELYPDYIRHLKKFVSSLNKKLPKPDPQEITANDDTTTKAKEAACSEKPKEAAKCSQISRKSLDSRVGKSKTVDVPEKPRMSSDDIDKFRRRRCLVW

SEQ ID NO: 4049 - DNA, 1394 bp, Panicum virgatum
  misc_feature: Ceres CLONE 1796383
  misc_feature: Encodes the peptide sequence at SEQ ID NO. 4050
actccactccactccactcccacccgcgccgttcgccctcgacctccgccgccgccccagtccccctctccgcgcaatggcgactcggcgagccaccgtcctcgcggccctcctcctcgcctcgctgctcccgctggcgctctcgcgcgggctggggttcggacgcggtcatgtgcggccgcacgggcacggggtgggactcgggcgccgtcacgccctgccgcacccgcagccgcacgggcacccgccgctcgggggcggcgcgtggtcctcggcccacgccaccttctacgggggcggcgacgcgtctgggaccatgggaggggcgtgcgggtacgggaacctgtacagccaggggtacggcaccaacacggcggcgctgagcacggcgctcttcaacaatgggctcagctgcggcgcctgcttcgaggtgcggtgcgacgccgccgggggcgggagccactcgtgcctgccgggctctgtcgtcgtcacggccaccaacttctgcccgcccaactacgcgctctcctccgacgacggcggctggtgcaacccgccgcgcgcccacttcgacatgtcgcagcccgtgttccagcgcatcgcgctctaccgggccggcattgtccccgtctcctaccgcagggtcgcgtgcaacaagaagggaggcatccggttcaccatcaacggccactcctacttcaacctggtgctggtcaccaacgtgggcggcgccggcgacgtgcacgcggtggccgtcaaggcggaccgctccccgggctggcaggccatgtcccgcaactggggccagaactggcagagcaacgcgctcctcgacggccaggccctctccttccgcgtcaccaccggcgacggccgctccgtggtctccaccaacgccgccccccgcggctggtccttcggccagaccttcagcggggcccagttcaactgaactgtccgctacagcctcgcgggcagcgtcaacgacgcgcaagtagtagcagtactactagtgaatggtcgcagtagttcttttccgtcttctccgattggaccttgctgctgggaggcgccgtggttttatgtgtggcgcatctcgcattggttcttgggaattaccggtagttcaggcctagtaagcatgggttttatcgtgctgttgtgagcctagagtgggagtgtttccttggttgttttggctagggaattggaggtggtggtaaaggcttggcttggagattaatggcggccgccttgtatcacccgccaatcagcgttttgggcctcatggtgatggccaacttcttgagatgagatcttgtgtggcgaatgtgtgctggttgttgtaatgaaccttatccttctgaacggcttaaaaaaaaaaaaaaaaaaaa

SEQ ID NO: 4050 - protein, 291 aa, Panicum virgatum
  misc_feature: Ceres CLONE 1796383
  misc_feature: Great-hit functional homolog of the protein sequence encoded by LOCUS At1g26770
  misc_feature: Useful for making plants with altered cell wall content and/or composition
MATRRATVLAALLLASLLPLALSRGLGFGRGHVRPHGHGVGLGRRHALPHPQPHGHPPLGGGAWSSAHATFYGGGDASGTMGGACGYGNLYSQGYGTNTAALSTALFNNGLSCGACFEVRCDAAGGGSHSCLPGSVVVTATNFCPPNYALSSDDGGWCNPPRAHFDMSQPVFQRIALYRAGIVPVSYRRVACNKKGGIRFTINGHSYFNLVLVTNVGGAGDVHAVAVKADRSPGWQAMSRNWGQNWQSNALLDGQALSFRVTTGDGRSVVSTNAAPRGWSFGQTFSGAQFN

SEQ ID NO: 4051 - DNA, 526 bp, Panicum virgatum
  misc_feature: Ceres CLONE 1796394
  misc_feature: Encodes the peptide sequence at SEQ ID NO. 4052
aaaaaaaaaaagagagagaagcggagagagtgcggcggaggcgatggcgagcggagggaaggggctgaacgcgaccggggagttcttccggcggagggacgagtggaggaggcacccgatggtggggaaccagctgcgccacgccttaccggggctcggcaccgccatcgtcgcctttgggatctacctcgtgggcgaggccgcctacaaccgcctcgcccgcccctccggcgaccaccaccactaggtggccggccgggatccgtgactccaaggtaaagtagctggagcaaactttaccaagttcattggtgttgtttttcttttaccagtttgagctcatgagatcagccatgaccatcatctagtttgtaaccatggagtcgaccactcttgaaacgctgtgctttatggcatttgggaatggcattgttcttgtaatactcaactcaagcaaatctgttgcacgcatgtttgatttctgaagtgttgatctgaactcatacaaaaaaaaaaaaaaaaaaaa

SEQ ID NO: 4052 - protein, 67 aa, Panicum virgatum
  misc_feature: Ceres CLONE 1796394
  misc_feature: Great-hit functional homolog of the protein sequence given in SEQ ID NO 9472
  misc_feature: Great-hit functional homolog of the protein sequence given in SEQ ID NO 9734
  misc_feature: Useful for making plants with modulated flowering time
  misc_feature: Useful for making plants with modulated time to senescence
  misc_feature: The plant flowers significantly late compared to wild-type.
  misc_feature: The plant senesces significantly earlier than wild-type.
MASGGKGLNATGEFFRRRDEWRRHPMVGNQLRHALPGLGTAIVAFGIYLVGEAAYNRLARPSGDHHH

SEQ ID NO: 4053 - DNA, 1274 bp, Panicum virgatum
  misc_feature: Ceres CLONE 1796408
  misc_feature: Encodes the peptide sequence at SEQ ID NO. 4054
agctgttcatttcactgcacttctccagctactctatcttcttcttcttcttcacttgaatcatcagattcaggtagcataggcatagcagcggagggaaagcagggcagatcgagagccgccgcctgaggaggagcggaggtggaggaagaccaaggaatcaaaccgaaccaaggaggcgtctcggatcggaggatgctcggagaccggccggtgttcgtgctattcggctcctccatcgtgcagtacagcttcaacaacggcggatggggcgccacgctcgccgacatctacgcccgcaaggctgatatcttgcttagaggatatatcggctggaacacaaggcgggctcttcaagtcatggacaaagtgttccctaaggactcaccagtgcagccatctttggtcatagtttactttggtggaaatgactccattgctgcccactcgtctggtctggggcctcacgtgccgatagatgagtacatagacaacatgagaaagattgcggatcacctgaagagcttatccgagaagacccgtgttatcttcctgagctgtccacctctgaacgaggagatgcttcgcacatcaaccagcagcactatactgagcgagatcgtgcggaccaacgaaacctgccacctctactcggacgcctgcgtagctctgtgcaaagagatgaacctgaaggtggttgatctgtggcatgccatgcagaagagggaggactggatgacggcatgctttaccgatggcctgcatctgtctgaagaggggagcaacatcgtggtggaagagatcctcaaggtggtcaaggaggcagactgggagccgtgcctgcactggaaggctttgccgacggagttcgcggaggactcgccctacgacctcgtctcctccggcggcgacgccaccgtgaacccctcggagtggaccatccacaggaagataccatgggactgactgattgtcttgtgcctcaagacgaattaataataatgctgacgagcatgcagtttgacggggacatacagcaggacaatgcatgccatgcatctctaatctgccaatcccggtcacatggacgaatgcagctcgatcaatcaatcatcttaattagacctcaaagattatttattcttgattattgaatttcctgttcatggctatcattgttaagtatgtatgcatgtatgtatatcagtcatttactactatttcttcaaagagatgagatcaggatcattatacaaaaaaaaaaaaaaaaaaaa

SEQ ID NO: 4054 - protein, 256 aa, Panicum virgatum
  misc_feature: Ceres CLONE 1796408
  misc_feature (1)..(195): Pfam Name: Lipase_GDSL Pfam Description: GDSL-like Lipase/Acylhydrolase
MLGDRPVFVLFGSSIVQYSFNNGGWGATLADIYARKADILLRGYIGWNTRRALQVMDKVFPKDSPVQPSLVIVYFGGNDSIAAHSSGLGPHVPIDEYIDNMRKIADHLKSLSEKTRVIFLSCPPLNEEMLRTSTSSTILSEIVRTNETCHLYSDACVALCKEMNLKVVDLWHAMQKREDWMTACFTDGLHLSEEGSNIVVEEILKVVKEADWEPCLHWKALPTEFAEDSPYDLVSSGGDATVNPSEWTIHRKIPWD

SEQ ID NO: 4055 - DNA, 1443 bp, Panicum virgatum
  misc_feature: Ceres CLONE 1796457
  misc_feature: Encodes the peptide sequence at SEQ ID NO. 4056
cttctccctcccgctggccacggcccacgggcagcagccactggttccgtctccaccgctcgtgctctcctgtcagaatccgaaaaaatggcggcgcctgcaaccgcaaccctatccttggcttcagttccttgcaggaagcatcagctccggcgtggcgccagtaccttcaacgcgcgacaactcagtgcttccagctcccactggcagccctctgccactctaaggtggggagtgccaagaccacgcgccggcgcggcgaagcgggtcatcgtcgcccaggccggcgccggcagctacaaggtggccatccttggcgccgcgggtgggattggggagccgctctcgctcctgatcaagatgtccccgctcgtctcggcgctgcacctctacgacaccgccaacgtcaacggtgtcgccgccgatctcagccactgcaacacgcaggtggaggtcgccggcttcaccggaaaagatgagctcgtcggcagcctagacggcgcggacgtggtggttatccccgccggcgcgccccggaagcccggcatgacgccggacgacctgttcagcgtcaacgccggcatcgtgaaggagctcgtggaggcggtggcggaccacgcgccgggcgcgctgatccacatcatcacgtacccggtgaactccacggtcccgatcgccgccgaggtcctcaagcggaagggcgcgtacgacccgcggaagctgctcggcgtcacgaccctggacgtggtccgcgccaacgcgttcatcgcggcggccaagggcctcccgctggccgacgtcgacgtgccggtcgtgggcggccacgcggggaccaccatcctgccgctgctgtccaaggcgcggcccaaggcggcgttcacggacgaggaggtcgaggagctcacggccagggtccagaacgccggcaccgaggtggtggaggccatggccggcgccgagtccgcgacgctgtccatggcgtacgccgaggcgcggttcctggaggcgtcgctgcgggggctcgacggcgacgccgacgtgtacgagtgcgcgtacgtgcagtcccaggtggtgccggagctcccgttcttcgcgtccagggtgaagctcgggagggaaggggtggaggaggcggtgggatcggagctcagggggctctcggactacgaggcgcgcgcgctggaggccctcaagccgcagctcaaggccagcatcgacaagggcatcgcgtacgtgcagcagcagcaggaggcagcgttgaactgagcctgctgaagaattggccatcgtcttgtgtcaggtctgggatgctgggctgtgccggttttgtagcactgcacacaaaacattctttttctactgaagattggagttggacggaacaatgaaaagaaaaaaaaaactctgaatctttgcgagatgcaaaaaaaaaaaaaaaaaaaa

SEQ ID NO: 4056 - protein, 392 aa, Panicum virgatum
  misc_feature: Ceres CLONE 1796457
  misc_feature (1)..(171): Pfam Name: Ldh_1_C Pfam Description: lactate/malate dehydrogenase, alpha/beta C-terminal domain
  misc_feature (30)..(385): SWISSPROT Homolog: EC 1.1.1.37 Malate dehydrogenase, glyoxysomal precursor
  misc_feature (33)..(392): SWISSPROT Homolog: EC 1.1.1.37 Malate dehydrogenase, chloroplast precursor
MAAPATATLSLASVPCRKHQLRRGASTFNARQLSASSSHWQPSATLRWGVPRPRAGAAKRVIVAQAGAGSYKVAILGAAGGIGEPLSLLIKMSPLVSALHLYDTANVNGVAADLSHCNTQVEVAGFTGKDELVGSLDGADVVVIPAGAPRKPGMTPDDLFSVNAGIVKELVEAVADHAPGALIHIITYPVNSTVPIAAEVLKRKGAYDPRKLLGVTTLDVVRANAFIAAAKGLPLADVDVPVVGGHAGTTILPLLSKARPKAAFTDEEVEELTARVQNAGTEVVEAMAGAESATLSMAYAEARFLEASLRGLDGDADVYECAYVQSQVVPELPFFASRVKLGREGVEEAVGSELRGLSDYEARALEALKPQLKASIDKGIAYVQQQQEAALN

SEQ ID NO: 4057 - DNA, 1610 bp, Panicum virgatum
  misc_feature: Ceres CLONE 1796470
  misc_feature: Encodes the peptide sequence at SEQ ID NO. 4058
ctataataaaccagcaaacaaggcaagcggcagcaggactcgcgaggaacagcgcccgcccaatccgccgacccccaatctggccgccgccgccggccggcccgacacgctgggatctttctttccttagctgatcggtcaacgccgcggattttattcttcttctttcccttccttccttccatcctcccttccatcctcccttcctccccccggggctctggaggtttccgtaaacccgtcgttcgtcgccgcggcgccgcccctcccccttctttcttgcagaggtgagaatccgccgggccctcgttcttccctctctttcccggatctagcctaggttggccgattggggaggcagggtaatcgggaaaggtgggattttgatttgtctgtcgggggagagggggggggggggggttggaatcccaggtattgacgagcagtcgttccattgcgacggcccttggattgcctgcttcggattttttagggcatttggattgcacatcagtttgctgcctttgagcatttggtgtctggttagttgggactcgaggagttctgcttaaggaactcctctgtgaaggtttgcttggattatgggagctttctgttcatgcctgcaacctgattattctgaccaccatgggaaccacacgtcctcagcgtttaggaactgcatgtgcctcagatgttttactcagcagctcatcaatgcgtacactgttttgttccgagctggatcagtgcactctgtttctcaggctatagaagccacccctgtggattcaactgagagttcctttgatacatatcgttctcccccaagaccgctgccctatgacgatccacgattttcccctcctgctcgtgactggttaagacatgagactccaagccattccccagaggaatcagaaccacttagagcaaatggtgatgatgaggacatggagacaccaagtagaattgacaaggcaagtaaaacaaactatgacacaaaaatgaagatatgcagctctgcctatggagataaggtgccaccaaaggaacatggaaattacttcagctactttttcccatctgctgaagatgaagatgtctgcccaacatgtcttgaagattatacatctgagaaccccaggatactgacgcagtgctcacaccatttccaccttggctgtatttatgagtggatggaaagaagtgaggcatgccctgtctgtggaaagaaaatggaatttgacgagacaacttaatcatctgtctggactctacatcttggattaacaacctcatatggtactctgaaaagacaggtgatctagctccaggaagttctctgtaaatacaccctgtaaatagtgaatcggtaatgcgctcttcgccatacagtgttcgaaatgctggatcagtgcacataaacattcttttttatttcttccaaatagtcagcaggtgaaggtttccccttttcctgtctgcgcccctgcctggacagggcttagaggcgctgtgattgtcggtgatagtatcatcggaaagatgtaaattagcgacatgttttcatataatcatatgaagcccaaaaaaaaaaaaaaaaaaaa

SEQ ID NO: 4058 - protein, 219 aa, Panicum virgatum
  misc_feature: Ceres CLONE 1796470
  misc_feature (1)..(41): Pfam Name: zf-C3HC4 Pfam Description: Zinc finger, C3HC4 type (RING finger)
MGAFCSCLQPDYSDHHGNHTSSAFRNCMCLRCFTQQLINAYTVLFRAGSVHSVSQAIEATPVDSTESSFDTYRSPPRPLPYDDPRFSPPARDWLRHETPSHSPEESEPLRANGDDEDMETPSRIDKASKTNYDTKMKICSSAYGDKVPPKEHGNYFSYFFPSAEDEDVCPTCLEDYTSENPRILTQCSHHFHLGCIYEWMERSEACPVCGKKMEFDETT

SEQ ID NO: 4059 - DNA, 1682 bp, Panicum virgatum
  misc_feature: Ceres CLONE 1796472
  misc_feature: Encodes the peptide sequence at SEQ ID NO. 4060
gaggaatccagaggcgccagaagcagaggaggaatccagaggcggcagagaggcagggaggcgtcgaccgaccgggctccccgctgctactcctcccatggggaactgcctcggctcagaggaagccgaattggagcccgtgaagagcgccgggcgccctggccagccccaagcggcacctgcgcgggcgctccccatggcgccaccggagccggacccttccatgagcacgagctcgtcggggcaccccagcagcaggtcccctggctcgtccatgagcagcgccgcgaccacccggagcggcggcagcggcagcagcagcagcaacctggcggcggcgtacccggagggccggatcctggagggtcccaacctccgcgtgttcaccttcgcggagctgcggtccgcgacgcgcaacttcaagccggacacggtgctcggcgagggcgggttcgggcgcgtgtacaagggctgggtcgacgagaagaccatgaaccccacgcgctccggcatcggcatggtcgtcgccgtcaagaagctcaaccccgagagcgtgcagggcctccaggagtggcagtcggaggtgaactttctcgggaggctgtcgcatccgaacctggtgaggctgctgggctactgcgtggaggatcgggagctgctgctcgtgtacgagttcatgcccaagggcagcctggagaatcatctcttcagaaagggtggatccttcgaaccgattccctggaacctcaggctccggatagccatcggcgcggcccgtggcctcgccttcctccacacgtcggagaagcaaatcatctaccgggacttcaaggcctcaaacatcctcctcgacacgcactacaacgccaagctctcggatttcggcctcgccaagaacggccccaccggcggcgacagccacgtcaccacgcgcgtgatgggcacctacggctacgctgccccggagtacgtcgccacagggcacctgtacgtgaagagcgacgtgtacggcttcggcgtggtgctgctggagatgctgacgggcctgcgcgcgctggacacgggccggcccgcgcaacagcacaacctggtggactgggccaagccgtacctggcggaccggcgtaagctggcccgcctggtcgacccgcggctcgagggccagtacccgtccaaggccgcgctgcaggcggcccagctcacgctgcgctgcctcgagggggaccccaggagccggccctccatggccgaggtcgtcgcggcgctcgaggagatccagcagatcaggatgcggccgccgcgggaggagcggcggcgggagcgggacgacgcggcggcggcgcacgggcaccaccactcgtcgcgccccaggtccgggtccgaccggacggcgagcagccaccaccagtctccgagtacggcgaggtagcatggggttggcgcggtgcttcggccgccgcatttggtgcggatttttttttgaagcctttcatctgggtacagtatctgttcctagtttggtgcggatcttggtcgtttctgcagcgagcggattgaccatgaaggccagatgggccttgtatgacagtttgatcgtagatggcccaaatgttggctagtacagatccatcaggaatcaggaggatgttttttccccctttcaaaaaaaaaaaaaaaaaaaa

SEQ ID NO: 4060 - protein, 443 aa, Panicum virgatum
  misc_feature: Ceres CLONE 1796472
  misc_feature: Great-hit functional homolog of the protein sequence given in SEQ ID NO 9257
  misc_feature (43)..(415): SWISSPROT Homolog: EC 2.7.11.1 Protein kinase APK1A, chloroplast precursor
  misc_feature (55)..(440): SWISSPROT Homolog: EC 2.7.11.1 Protein kinase APK1B, chloroplast precursor
  misc_feature: Useful for making plants with modulated heat sensitivity
MGNCLGSEEAELEPVKSAGRPGQPQAAPARALPMAPPEPDPSMSTSSSGHPSSRSPGSSMSSAATTRSGGSGSSSSNLAAAYPEGRILEGPNLRVFTFAELRSATRNFKPDTVLGEGGFGRVYKGWVDEKTMNPTRSGIGMVVAVKKLNPESVQGLQEWQSEVNFLGRLSHPNLVRLLGYCVEDRELLLVYEFMPKGSLENHLFRKGGSFEPIPWNLRLRIAIGAARGLAFLHTSEKQIIYRDFKASNILLDTHYNAKLSDFGLAKNGPTGGDSHVTTRVMGTYGYAAPEYVATGHLYVKSDVYGFGVVLLEMLTGLRALDTGRPAQQHNLVDWAKPYLADRRKLARLVDPRLEGQYPSKAALQAAQLTLRCLEGDPRSRPSMAEVVAALEEIQQIRMRPPREERRRERDDAAAAHGHHHSSRPRSGSDRTASSHHQSPSTAR

SEQ ID NO: 4061 - DNA, 1703 bp, Panicum virgatum
  misc_feature: Ceres CLONE 1796492
  misc_feature: Encodes the peptide sequence at SEQ ID NO. 4062
gcgagcaagtgatcacggcgcctccctccccggacgcgacccctagcctgcctctcggccggcagcgcacgcataaattcagagcaccgccgccggctcagtttcgtctggctgtggctggcttggcagcagagcacgatggccacccacgctgctctcgcggcgtcgcgcatccccgcaggcgcccggctgcacagcagggcggcgtccaggcagagggtggacttcgccgacttctctgggccgaggccgggatcatgctccatcagcaccgccgccagggaggcgtccttctccgacgtgctcggtgcgcagctcgtcgccaaggccaccggggagaacgcggtgagggcgcccgctgaggccaagctcaaggtggcgatcaacgggttcgggcgcatcggccggaacttcctccggtgctggcacggccgcaaggactccccgctcgatgtcgtcgtcatcaacgacagcggaggcgtcaagaacgcgtctcacctcctcaagtacgactcgatgctcggcaccttcaaggccgacgtcaagatcgtcgacgacaccaccatcagcgtcgacggcaagctcatcacggtcgtctccaacagggacccgctcaagctcccatgggccgagctcggcatcgacattgtcatcgagggtaccggagtcttcgtcgacggcccgggcgccgggaagcacatccaggccggcgccaagaaggtcatcatcaccgctccggccaagggcgccgacatcccgacctacgtcgtcggcgtcaacgagggcgactacgaccacggcgtggccgacatcatcagcaatgcttcctgcacgaccaactgcctcgcgccgttcgtcaaggtcttggacgcggagttcgggatcgtgaagggaacgatgacgacgacccactcgtacacgggcgaccagaggctgctggacgcgtcccaccgcgacctgaggcgtgcccgcgcggcggcgctgaacatcgtgccgacgagcaccggcgcggccaaggcggtggcgctggtgctgccgcagctcaaggggaagctgaacggcatcgcgctccgcgtgccgaccccgaacgtgtccgtggtggacctggtgatcaacaccgagaagaagggcatcaccgccgacgacgtcaacggcgcgttccgcgaggccgccgccggcccgctcaatggcgtcctcgacgtctgcgacgcgccgctcgtgtccgtcgacttcaggtgctccgacgtgtcctccaccatcgactcctcgctcaccatggtcatgggcgacgacatggtcaaggtcgtcgcctggtacgacaacgagtggggatacagccagcgcgtggtcgatttggcgcacctggtggcggccaagtggccgggcgcggcgacggcgggcagcggcgaccccctggaggacttctgcaaggacaaccccgccaccgacgagtgcaaggtgtacgaggcataaggcctccgtgttctgttgttcggaagcgtacattacgatcgatcaggaagagggcagagtaactttgctgtcactgcccgcccggtgttcttccgtagagagtacacacacactaactttgttgttcagaaatgcatctttgtttctgtgtgtgaggtgtaatcatcactgaactcgtacaggcttcagatttcatttcctgttgggaccaaaaaaaaaaaaaaaaaaaa

SEQ ID NO: 4062 - protein, 444 aa, Panicum virgatum
  misc_feature: Ceres CLONE 1796492
  misc_feature (1)..(154): Pfam Name: Gp_dh_N Pfam Description: Glyceraldehyde 3-phosphate dehydrogenase, NAD binding domain
  misc_feature (1)..(158): Pfam Name: Gp_dh_C Pfam Description: Glyceraldehyde 3-phosphate dehydrogenase, C-terminal domain
  misc_feature (1)..(443): SWISSPROT Homolog: EC 1.2.1.13 Glyceraldehyde-3-phosphate dehydrogenase B, chloroplast precursor
MATHAALAASRIPAGARLHSRAASRQRVDFADFSGPRPGSCSISTAAREASFSDVLGAQLVAKATGENAVRAPAEAKLKVAINGFGRIGRNFLRCWHGRKDSPLDVVVINDSGGVKNASHLLKYDSMLGTFKADVKIVDDTTISVDGKLITVVSNRDPLKLPWAELGIDIVIEGTGVFVDGPGAGKHIQAGAKKVIITAPAKGADIPTYVVGVNEGDYDHGVADIISNASCTTNCLAPFVKVLDAEFGIVKGTMTTTHSYTGDQRLLDASHRDLRRARAAALNIVPTSTGAAKAVALVLPQLKGKLNGIALRVPTPNVSVVDLVINTEKKGITADDVNGAFREAAAGPLNGVLDVCDAPLVSVDFRCSDVSSTIDSSLTMVMGDDMVKVVAWYDNEWGYSQRVVDLAHLVAAKWPGAATAGSGDPLEDFCKDNPATDECKVYEA

SEQ ID NO: 4063 - DNA, 1488 bp, Panicum virgatum
  misc_feature: Ceres CLONE 1796499
  misc_feature: Encodes the peptide sequence at SEQ ID NO. 4064
gacgcgcaaacccgaagaaaaatcattttttaataataaaaacaaagcctcgaagagaagctcggcttcttgccttcttcacttcctcgaccgctcaaagctccggccttcgcaatcctcttccttccacgattgggtgcgatattccatgaaaagggagcgatttcgggaggaccgtcgtgagcgaactcgacctgtgtcccgagggaagcatcggtggctgtgggggacttctcagcttcctccccttttctcttatttttataaatttcagttgctggattggaactgagaggggatccagaacatatggcaaggttttactgtttcggtgccggttcagagttcacagggcatgggtcagcggcatctggtaaagggaaaggccgccagggccaagtcaaggtctgctatggctataaccttgtaagagggaagacaaatcatccaatggaggactaccatgtcgccaattttgttgaagtaaagggaagcgagctcggtcttttcgctatttttgatggtcatctaggagatactgttcctgcatacttacagaagaatctgttttcaaatattttgaatgaagaagaattttggacacatccagatagagcgatcacaaaagcttacgaaaaaacagaccaagctattctgtcacatactccagacttgggacaaggtggctccactgctgtaactgccattcttgtaaacggcaggaagttgtgggtagctaatgtcggtgattcgagagctgttcttttcaaaggcggtgaagccatactgatgtcaatagaccatgatccgaatgttgagcgtagcgtaattgaaaataggggtggttttgtttcaaacatgccaggagattgcccccgagtatgtggtcagttggctgtctctagagcttttggagacaggaatcaaaaatcactcctgagatcagagcccgatataaaagttgaaaacatagatcacactgccgagctacttgtccttgctagtgacggtctctggaaggtgatgaacaatcaggaagtcgttgatgtggccaaaaggttcaaggatccatgtgcagctgccaagcaattaaccgccgaggcattaaaacgagacagtaaagatgatatatcatgcattgtcgttcggttcaaggcgtaaatcgatagcagatcgcagctgacacacgggggattgtgaacaagagcagaaaatgatttttacggcacagcttaggctgcctgacgatggctgtggtagtccaaagaataattagttaattactgggttgtttggttgtaaatgatttgtcggctccattgcatgttcatatatataaatgatttgtcagcttcgtttggcaattcaaaggtacaattgtgaggaggccttagagctatgtaaatagctaccatctgtaaataatggttgcagatattggaagttaaccctgtgatcgtccattgtgaaaaaaaaaaaaaaaaaaaa

SEQ ID NO: 4064 - protein, 283 aa, Panicum virgatum
  misc_feature: Ceres CLONE 1796499
  misc_feature (1)..(240): Pfam Name: PP2C Pfam Description: Protein phosphatase 2C
MARFYCFGAGSEFTGHGSAASGKGKGRQGQVKVCYGYNLVRGKTNHPMEDYHVANFVEVKGSELGLFAIFDGHLGDTVPAYLQKNLFSNILNEEEFWTHPDRAITKAYEKTDQAILSHTPDLGQGGSTAVTAILVNGRKLWVANVGDSRAVLFKGGEAILMSIDHDPNVERSVIENRGGFVSNMPGDCPRVCGQLAVSRAFGDRNQKSLLRSEPDIKVENIDHTAELLVLASDGLWKVMNNQEVVDVAKRFKDPCAAAKQLTAEALKRDSKDDISCIVVRFKA

SEQ ID NO: 4065 - DNA, 1482 bp, Panicum virgatum
  misc_feature: Ceres CLONE 1796508
  misc_feature: Encodes the peptide sequence at SEQ ID NO. 4066
gatctcccgctctctcctctctacccgaggcgtgcggtgcctcagatttttcctctgtttgcagcgaatttgcgggagagctgttccgtctccgtctgaatctcgagaaatatcttgggccctccggttttatttctccgccgtttccttgattttctctgtgtgcggggggttcttggccctcgcggcgaagatatcatccagctctttgcgcgcttctctcccgatcttttgttgatttttatgggtttgaattgattgctccttcgccctcggaagtttcctgggttgataatataatatccaaccggataggcactttcccatctccatttgggttgtttcctctttgagaaagggtagcggagagcgatccgggccgttgcaatttcctcacctcatcggttaccctggttcttgatccgatgggggatgtgtcgttgaacccccagccattgatcaacgacgagccactgaccctgcccgctactgctgccaaggacaaccaagttcgagacttgatgtcatccggatggacaaacgagcggcacagttcctacataagcttcatggaggcatccttcgtggaccaactatatggacatcagaaccatgggcatgatgtgaataagagacatctgggtgacaatgggttcaaggtgatccaagagggtgtatgtaagaatatcaagtttgagaggaaccaccctcaccatgatgccagaataaactgcctgcctgagaatccattggtcaggcgtttcaggccacgcagtactggttcaagtcgccgtgatgattgtttcgaagctatggcggaggattacgggtcaggtacagatacggtccgagagaaggtccggatgcatggaagagaagtgaggacttgtgccagacaaaatcttattgaagtatctgatcaaaattttcctgatgaggaggttgaagccagtaatgaaccatccaagaaacagaggcctacatcatccagttctaaatcaaatgatcagggaacgtaataggatcgatgatcctgatctgttgtaagtaatggaagtttgtttttcgtctgaaaaatcacatgctgctacaaaaaggtggtggcatccaaggtgctccgaaacctgaaggatggcatggaatacttattctgagatcgttctgaaactctctgttaggtcgtgctggcagtttgaagttttctttgggtgcaaactgaattatatcctgtgttagctctcgacagtggtttatttgcggtgtgaaagactgcattcataggatgtttcttcactccttgggtgtattacctgatgtttgttaaatcaatttttttttttgcgctcttcgagcaaattcgtttggagaattcgagcagctactgtctgcaaagtttatgttaacattgatgcctttcacggcatcgaaaacgttttgaaatgttcatcctcttaccttgttcaaaaaaaaaaaaaaaaaaaa

SEQ ID NO: 4066 - protein, 197 aa, Panicum virgatum
  misc_feature: Ceres CLONE 1796508
  misc_feature: Great-hit functional homolog of the protein sequence given in SEQ ID NO 9707
  misc_feature: Useful for making plants with modulated biomass
  misc_feature: Useful for making plants with modulated flowering time
  misc_feature: Useful for making plants with modulated drought sensitivity
  misc_feature: The plant flowers significantly late compared to wild-type.
  misc_feature: The plant is abnormally large.
MGDVSLNPQPLINDEPLTLPATAAKDNQVRDLMSSGWTNERHSSYISFMEASFVDQLYGHQNHGHDVNKRHLGDNGFKVIQEGVCKNIKFERNHPHHDARINCLPENPLVRRFRPRSTGSSRRDDCFEAMAEDYGSGTDTVREKVRMHGREVRTCARQNLIEVSDQNFPDEEVEASNEPSKKQRPTSSSSKSNDQGT

SEQ ID NO: 4067 - DNA, 2236 bp, Panicum virgatum
  misc_feature: Ceres CLONE 1796516
  misc_feature: Encodes the peptide sequence at SEQ ID NO. 4068
acttgcacaaggtgcacacgcgctcgccctcgcgtcgctgctccggttctctcccgccgatcgacgccacccccacgtccggacccgcggttcctccgactccgaggaaatggctgcgcttcaaccctcattttcatcgacaatggctctgaggagtagcggcagcagtcttaagttccccaaaactgcacttctacctggttttagtggcatttcacgtcaagacatgcaagaaaggaatagtagccttgcttgtttaatccccaaggttgcttcggtaactgatcagtcaatagcagaaccatcaaaacccaggaaaaataagaacacagtcgaccctacagcaccagaatttctgccactcccatcatttgaagaatgctttccaaggagtaccaaagaatcaagtgaaatcgttcacgaggaatctggtcatgtcctcaaggtcccattccggagagtccacttgactggagatcaaaagcactttgacacatatgacaccagtggtcctcaaaatataagcccaaggactggactcccaaagataaggaaggaatggattgataggagggaaaagctgggtagtcctcgttacacgcaaatgtattatgctaaacagggaatcataacagaggagatgatatattgtgccaagcgtgagaaccttagtcctgaatttgttcggacagaagttgcccatggacgagccataattccttccaacaagaggcacctggaattggaacccatgattgttggaagaaacttccttgtaaaggtgaatgcaaatattgggaattcagctgttgtgagctccatcgaggaggaagttcacaagctccagtgggccacaatgtggggagctgatactgtcatggatctttcaacagggcgacacatccatgagacccgggaatggattattcgtaactctccagttcctattgggaccgttcctatttaccaagcacttgagaaagtaaatggtattgcagaaaatttgagctgggaaatctttagggagaccttgattgaacaagctgagcagggtgttgattacttcacaatccatgctggtgtcctgctccgttacattccacttacaacaaagagaatgactggcatagtttcgcgtggtggctcgattcatgcaaaatggtgcttaacttatcacaaggagaactttgcttatgaacactgggatgacattctggacatatgcaatcaatatgatgtggcattatcaattggtgatggcttgaggcctggttctatttatgatgcaaatgatagtgctcagtttgcagagttgttgactcaaggggaactaacacgtcgagcatgggcgaaagatgtgcaggtgatgaatgaaggcccagggcacatcccaatgcataaaattcctgaaaacatggagaaacagctggagtggtgtaatgaagcacctttctatacgttgggtccactgacaactgatattgcacctggttatgatcacatcacctcagccattggtgctgccaacattggagctcttggcactgcacttctttgttatgtaacaccaaaggagcaccttgggttgcctaatcgtgatgatgttaagacaggtgtgatatcctacaaaattgctgctcatgctgctgacttggcaaagggtcatccctatgcacaagcttgggatgatgcccttagcaaggcaaggtttgagtttagatggctcgatcaatttgctctgtcgctggacccagtaactgccatgtctttccatgatgaaacattgccatccgagggtgccaaagttgcacatttctgctcaatgtgtgggcccaagttttgttcgatgaaaatcacagaggatattagaaagtatgcggatgaacatggttacggaacagtagaggaagctgtgaaggaaggaatgaatgctatgagtgctgaatttttggctgcaaggaagacaattagtggggaacagcatggtgaagctggaggggagatctacgtaccagaaagctatgcagctcacaaatgagatctcctcagaagccacccaacgaagcagatatgctggctagggccttcagcagcagcaattctaccatcttatgttaggagatggtaagcagtatgtgaataaagctgggttgcttaccttaagtatgtgaatgccaatatggattgtaataaaaggaaactctgttctgtgtcccaaaaaaaaaaaaaaaaaaaa

SEQ ID NO: 4068 - protein, 642 aa, Panicum virgatum
  misc_feature: Ceres CLONE 1796516
  misc_feature (149)..(640): SWISSPROT Homolog: EC 2.5.1.3 Bifunctional protein thiEC [ Includes: Thiamine-phosphate pyrophosphorylase
MAALQPSFSSTMALRSSGSSLKFPKTALLPGFSGISRQDMQERNSSLACLIPKVASVTDQSIAEPSKPRKNKNTVDPTAPEFLPLPSFEECFPRSTKESSEIVHEESGHVLKVPFRRVHLTGDQKHFDTYDTSGPQNISPRTGLPKIRKEWIDRREKLGSPRYTQMYYAKQGIITEEMIYCAKRENLSPEFVRTEVAHGRAIIPSNKRHLELEPMIVGRNFLVKVNANIGNSAVVSSIEEEVHKLQWATMWGADTVMDLSTGRHIHETREWIIRNSPVPIGTVPIYQALEKVNGIAENLSWEIFRETLIEQAEQGVDYFTIHAGVLLRYIPLTTKRMTGIVSRGGSIHAKWCLTYHKENFAYEHWDDILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKIAAHAADLAKGHPYAQAWDDALSKARFEFRWLDQFALSLDPVTAMSFHDETLPSEGAKVAHFCSMCGPKFCSMKITEDIRKYADEHGYGTVEEAVKEGMNAMSAEFLAARKTISGEQHGEAGGEIYVPESYAAHK

SEQ ID NO: 4069 - DNA, 1683 bp, Panicum virgatum
  misc_feature: Ceres CLONE 1796529
  misc_feature: Encodes the peptide sequence at SEQ ID NO. 4070
gtctgttctagttctagcacccgcttcgttctcccgtcctcacgcacgcccccccgcctctcccgaggcttgttcggtgcctgcgcgccccgccaccgcagcgcccgagcaagccgcccgccgcccggccggctgagccagctgatcggtcggcgcgaggatgtccgcgtcgctgccgttgccgctcgcggtcgcggtgatgctggcggcggcggcgctcctcctgtgcggcggcgccgaggcccgcgtcctcctcacgctcgacgacttcggcgccgtcggcgacggcattgccaacgacacccaggctttcgtggacgcgtgggccgcggcgtgcgcctccagcgagcaggccgtcctcgccgtgccggtcggcaaggcctaccggatctggccggtgcagctcttcgggccctgcaagaagaagctcaagctgctgatttctggcgcgatcgtcgcgccggcgagcccggacgagtgggcggggcgggacccgatgaagtggctctacatctacggcgtcgacggcctgtccgtcagcggcggcggcaccatcgacggctcggggcagcagtggtgggcgagcacctgcaagcgcaagaagaccccgccttgctactcgggtcctcgtccaaagacggtgcacttcgaggagtgcaggggcgtgagcgtgcagggcgtgacgctgcagaacgggcagcagttccacctgaccttcacgcgctgctccgacgtgagggccagcttcctccgggtgatcgcgccggcggacagccccaacaccgacggcgtccacctcaacgacacctcccacgtccagatcacggacaacctcatctccacaggtgatgattgcgtctccatggtcggcaattgctccgacgtccgtgtaacagatatctcgtgcgggcctggccatggtatcagcatcggaagcctcggcaagaaccggaccaccgacatggtcgagaacgtgagggtcgacacctgcttgctcaccaacaccaccaacggcgtccggatcaagacctggcagggcggcatgggcttcgcacgggacctgcggttcgagagcatcgtgatgaagaacgtgtccaaccctatcatcatcgaccagtactactgcgaccagcccacgccgtgcgcgaaccagacgcgggcggtggaggtgcgcgaggtggggttcgcggacatccggggcacctcggcgacggcgaaggcgatcagcatcgcgtgcagcgacgccgtgccgtgccgggacctggagctcaagaacgtcaacctgacgctggagggcggcggcggcggccgggccaccgcgtcctgctaccgggcgtacgggaagagcgccggcgccgtggtcccgccgtcctgcctcgccaagcccaccgcctcctgatctgatcgaaaagacgccgccgtttgcgggcacagggttgccttcgcttttccttcagtcagcagctcttgtcgcagcgaggcagtgaccgaagcacgtatgcgcgcatgattgagagctttgcaggttcataagctgtagtcataccgaaatttgtagaccgtacacgccattggtgacgagagggaaacagaaaaagtgaaaagaaatgaatactttttttttagaagaagaaatggatgcttttgtcaaacttagcattttaaaaaaaaaaaaaaaaaaaa

SEQ ID NO: 4070 - protein, 412 aa, Panicum virgatum
  misc_feature: Ceres CLONE 1796529
  misc_feature: Great-hit functional homolog of the protein sequence encoded by LOCUS At1g80170
  misc_feature (1)..(345): Pfam Name: Glyco_hydro_28 Pfam Description: Glycosyl hydrolases family 28
  misc_feature: Useful for making plants with altered cell wall content and/or composition
MSASLPLPLAVAVMLAAAALLLCGGAEARVLLTLDDFGAVGDGIANDTQAFVDAWAAACASSEQAVLAVPVGKAYRIWPVQLFGPCKKKLKLLISGAIVAPASPDEWAGRDPMKWLYIYGVDGLSVSGGGTIDGSGQQWWASTCKRKKTPPCYSGPRPKTVHFEECRGVSVQGVTLQNGQQFHLTFTRCSDVRASFLRVIAPADSPNTDGVHLNDTSHVQITDNLISTGDDCVSMVGNCSDVRVTDISCGPGHGISIGSLGKNRTTDMVENVRVDTCLLTNTTNGVRIKTWQGGMGFARDLRFESIVMKNVSNPIIIDQYYCDQPTPCANQTRAVEVREVGFADIRGTSATAKAISIACSDAVPCRDLELKNVNLTLEGGGGGRATASCYRAYGKSAGAVVPPSCLAKPTAS

SEQ ID NO: 4071 - DNA, 1794 bp, Panicum virgatum
  misc_feature: Ceres CLONE 1796553
  misc_feature: Encodes the peptide sequence at SEQ ID NO. 4072
agagatttcttctccccgctcttctatatatagccctggcatcgacgccattctcctctactccattctcctcttcctcctctctcggcgaattggatcgcgcgtcccgtgttcatttcagctttgaagccctccattatattaagtggtgctttctgaatatcaaatcgcaacagagctgggttttaatggccatccctatgaagcaatccggattcttgatatagatgtttccttgttcagaacatgagaagttctcaggtattctggtgttgatgaactgcctccacacctgcagtgacaagaaaacgctgaagaagtggtttttcatcgacaagacagttggctgaattcagtagagaaagaaacaacactcgacacagtctttttccttgattcatccccaatggatatgagcaccagctcacctgtcatcaccgatccggtatcgataagccccccactgttaggaagcttgacgtcaaacctgatgccgttttcagtcatgtccggaggctgctccagtcccggcatgaacgtgagcacctgcaggcgtaagatcgaagaggtccttgtcagtggcctgttggatgcaatgaaatcctcatcgccgcgcaagaagcacaatcttgccttcagcccgggcgattcacctgacgaagatcctgcttatgctgcatggatgtcaaaatgcccttctgctttgacgtccttcaagcacatagtagccaatgcacagggcaggaagattgctgtatttttggattacgacggtaccttatcgcctatagtggatgatcccgacaaagccttcatgccccccgcgatgagagctgcagtgagaaatgttgcaaagtacttccctacagcaattgttagcggaagatcccgcaagaaggtgtctgaatttgtaaaactgaaggaactatactatgccggaagtcatgggatggacatagtgacatctgcagcagaacacaatgctgaaaagggcaaagaagccaatctcttccaacctgctttggagttccttcctatgattgatgaggtttccaaatccctcttggaggcaacaagtggaattaaaggtgcgaatgttgagaacaacaagttctgtgtatctgtacattaccgcaacgtagcagagaaggactgggaagtggttgcacggctcgtaaacgaagtcttggaggcctttcctcgtctcaaagtaaccaatggacgaatggttttagaggttcgtccagtgatcgactgggacaagggaaaggccgtcgagttcctgcttcaatcgctcggcttaaacgattctgaaaatgtgattcccatctacatcggagatgatcgaacagacgaagacgcattcaaggtacttcgagagcgaaactgtggatacggaatactagtttctcaggtgcccaaggacaccgaagccttctactcgctgagagacccatctgaagtgatggcgttcctcaattcattggtgagatggaagaagcactcactgtgacgaaaccgaaaaatacgattggttgatccagaagtcgtgaaaataataactgtagttcgcgcggcggcaattttgtagagttggacacaacgggtggatcattctttcatgtctgtcattgttttctttgtttgattcgtgctcgttgccactgagaaatgatcagtggttgcctcgccctcttgcaactgtaatttgtaagcaagagggccccttttcctgttcaaactggtgaataaaactgagtcgcttaaccttttcaaaaaaaaaaaaaaaaaaaa

SEQ ID NO: 4072 - protein, 368 aa, Panicum virgatum
  misc_feature: Ceres CLONE 1796553
  misc_feature: Great-hit functional homolog of the protein sequence given in SEQ ID NO 9630
  misc_feature (1)..(236): Pfam Name: Trehalose_PPase Pfam Description: Trehalose-phosphatase
  misc_feature: Useful for making plants with modulated drought sensitivity
  misc_feature: Useful for making plants with modulated flowering time
  misc_feature: The plant flowers significantly late compared to wild-type.
MDMSTSSPVITDPVSISPPLLGSLTSNLMPFSVMSGGCSSPGMNVSTCRRKIEEVLVSGLLDAMKSSSPRKKHNLAFSPGDSPDEDPAYAAWMSKCPSALTSFKHIVANAQGRKIAVFLDYDGTLSPIVDDPDKAFMPPAMRAAVRNVAKYFPTAIVSGRSRKKVSEFVKLKELYYAGSHGMDIVTSAAEHNAEKGKEANLFQPALEFLPMIDEVSKSLLEATSGIKGANVENNKFCVSVHYRNVAEKDWEVVARLVNEVLEAFPRLKVTNGRMVLEVRPVIDWDKGKAVEFLLQSLGLNDSENVIPIYIGDDRTDEDAFKVLRERNCGYGILVSQVPKDTEAFYSLRDPSEVMAFLNSLVRWKKHSL

SEQ ID NO: 4073 - DNA, 1399 bp, Panicum virgatum
  misc_feature: Ceres CLONE 1796576
  misc_feature: Encodes the peptide sequence at SEQ ID NO. 4074
aaaaaccctaatcaagctcaatcgacagcgccaaccccatcacccacccccacgcctcggcctctcgcgcgccgccacaatgcaggccgccgccgccgccgccgtccgccatccgcacctcctcgcgccgtgcgccggcagcccccgccgccggcccagcaccgtccgcatggcgctgcgcgaggacgggccctccgtggccatcgtgggcgccacgggcgcggtcggccaggagttcctccgcgtcatcacggaccgggacttcccctaccgcagcctccgcctcctggccagcgagcgctccgcggggaagcgcctcgccttcgaggaccgcgagtacaccgtccaggacctcgccgcgccgggggccttcgacggcgtcgacatcgcgctcttcagcgccggcgggggcgtcagccgcaagtacgggcccgcggccatcgccagcagcgccgtcgtcgtggacaacagctccgcgttccggatagaccccgaggtgccgctcgttatccccgaggtcaacccggaggccatggccaacgtccggctggggcagggcgcaattgtggcgaatccgaattgctcgaccatcatctgcctcatggcggccaccccgctccatcaccacgccaaggtgttaaggatggttgtcagcacttaccaagctgcaagtggtgctggtgctgcagcaatggaagaacttaaactgcagactaaggaggtcttggaagggaaggcgccaacatgcaacattttcaaacaacagtatgcttttaatatattttcgcacaatgcgccagttcttgaaaatgggtataatgaggaagagatgaaaatggtgaaggagaccagaaaaatctggaacaacaaggatgtgaaagttactgcgacctgcatacgggttcctgtgatgcgtgcgcacgctgaaagtgtcaatctacagtttgaaaagccacttaatgaggatactgccagagaaattctgagggctgctcctggtgttaccattgttgatgatcgtgcagctaatcgcttccctacacctctagaggtatcaaataaagatgacgtagcagtaggtaggattcgccaggacttgtcacaaaatgataaccgagggttggagatatttgtctgtggcgatcagattcgtaaaggtgctgcgctcaatgctgttcagattgccgaaatgctactgaagtgattatccttttgtatcactccatgttcctagttagtctagtcattgctgaactgatgtactctggttagtttgagctcaattttgatcgcctatatgtaatctattgtgctagtgcaataattgtgagacgggcttgagtcatctgttgtgcacaaaagtgcattcggaagttcggaaaaaaaaaaaaaaaaaaaa

SEQ ID NO: 4074 - protein, 374 aa, Panicum virgatum
  misc_feature: Ceres CLONE 1796576
  misc_feature (1)..(181): Pfam Name: Semialdhyde_dhC Pfam Description: Semialdehyde dehydrogenase, dimerisation domain
  misc_feature (36)..(373): SWISSPROT Homolog: EC 1.2.1.11 Aspartate-semialdehyde dehydrogenase
MQAAAAAAVRHPHLLAPCAGSPRRRPSTVRMALREDGPSVAIVGATGAVGQEFLRVITDRDFPYRSLRLLASERSAGKRLAFEDREYTVQDLAAPGAFDGVDIALFSAGGGVSRKYGPAAIASSAVVVDNSSAFRIDPEVPLVIPEVNPEAMANVRLGQGAIVANPNCSTIICLMAATPLHHHAKVLRMVVSTYQAASGAGAAAMEELKLQTKEVLEGKAPTCNIFKQQYAFNIFSHNAPVLENGYNEEEMKMVKETRKIWNNKDVKVTATCIRVPVMRAHAESVNLQFEKPLNEDTAREILRAAPGVTIVDDRAANRFPTPLEVSNKDDVAVGRIRQDLSQNDNRGLEIFVCGDQIRKGAALNAVQIAEMLLK

SEQ ID NO: 4075 - DNA, 1992 bp, Panicum virgatum
  misc_feature: Ceres CLONE 1796580
  misc_feature: Encodes the peptide sequence at SEQ ID NO. 4076
attccgccacacttcgccttcctccgccttcgtcgccttcccctaatcccttcccggggcagcagttcccactccccactccacctccttctacaacgcccaccaccgtccaccggtcccccactcccctccgtcgcgcttcccgacccccctcgcgccgtacggagctccccttccggaaggaacgccgacgacatgggggccttcgcgaaggagcaccagttcctcaacgagctcggcctcgcgccgcgcaacccgggatccttcgcctgcggggcctggggcggctcgggccccgtcgtcaccaccaccagcccgaccaacaaccaggttatcgcggaggtggtggaggcgtccgtgaacgactacgaggatggcatgcgcgcctgcttcgatgccgctaggacatggatggcgattccagctccgaagcggggagagattgttcggcaaattggcgacgcactgagagcaaagctccatcaccttggcaggcttgtgtcacttgagatggggaaaattcttccggaagggatcggggaggttcaggaaatcatcgacatgtgtgattatgctgtggggctaagtcgccaattaaatgggtccattataccatccgaacgtccaaaccatatgatgatggaggtgtggaatcctcttggagttgttggtgttataacagcatttaatttcccttgcgctgtgcttggttggaatgcttgcattgctctggtctgcggaaattgtgttgtctggaaaggtgccccgactactccactgatcactattgcaatgactaaaatagtggctagtgtattggagaagaacaacttgccaggcacaattttcacagctttttgtggtggcactgaaattggccaagcaatagctcttgacactaggatacctttggtttcgttcactggaagtacaagggctggtctaatggttcagcaacaagttaatgcaagatttggtaaatgccttctcgaacttagcgggaacaatgccataattgttatgcatgatgcagatattcagctagctgtgcgttctgtgttgtttgctgctgttggcacagcaggacaacgttgcacaacatgccgtaggctgattcttcatgaaagcatatatcatacttttcttgatcaacttgttgaggtatataaacaagtccgaatcggggacccattggagaagggcaccttattgggaccactgcacactcctgcgtcaaaggagaactttttgaaaggtatccagaccatcaaatctcagggagggaaaatcctttttggaggatctgccatcgaatcagaagggaacttcgtacagccaacgattgtggaaatttcagcttctgcgccagttgtgaaagaagaactctttggccctgtgctttatgtgatgaaattccagaccttgaaggaagcaattgaaatcaataactctgttcctcaaggattgagcagttctatatttacaaagaagccagaaattatttttaagtggcttgggccccatggtagtgactgtggtatagtgaatgtgaacatacctacgaatggtgccgaaatcggtggagcatttggtggagaaaaagcaaccggtggtggacgagaagcaggaagtgattcctggaagcagtacatgaggagggcaacttgtacaatcaactatggaagcgagctacccctagcacagggaatcaattttggttaatccggcaggagggggtgcgcatggatcttggtattttctgcggacgtggatgtcacatgggagaactgatgataccgtgttaagatctctgcatagacaaatagtgtctatctgcttcagttgccaaatagtgtctatctgcttcagttgccaaacctaaattggaggacagcagtagtagtgtgtgtacatataataataagatgtttgttgctcgtggtatgattaaccgctggtgtcccaagcctacaaaaaaaaaaaaaaaaaaaa

SEQ ID NO: 4076 - protein, 508 aa, Panicum virgatum
  misc_feature: Ceres CLONE 1796580
  misc_feature (1)..(463): Pfam Name: Aldedh Pfam Description: Aldehyde dehydrogenase family
  misc_feature (1)..(508): SWISSPROT Homolog: EC 1.2.1.3 Aldehyde dehydrogenase 7B4
  misc_feature (1)..(508): SWISSPROT Homolog: EC 1.2.1.3 Aldehyde dehydrogenase family 7 member A1
MGAFAKEHQFLNELGLAPRNPGSFACGAWGGSGPVVTTTSPTNNQVIAEVVEASVNDYEDGMRACFDAARTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKNNLPGTIFTAFCGGTEIGQAIALDTRIPLVSFTGSTRAGLMVQQQVNARFGKCLLELSGNNAIIVMHDADIQLAVRSVLFAAVGTAGQRCTTCRRLILHESIYHTFLDQLVEVYKQVRIGDPLEKGTLLGPLHTPASKENFLKGIQTIKSQGGKILFGGSAIESEGNFVQPTIVEISASAPVVKEELFGPVLYVMKFQTLKEAIEINNSVPQGLSSSIFTKKPEIIFKWLGPHGSDCGIVNVNIPTNGAEIGGAFGGEKATGGGREAGSDSWKQYMRRATCTINYGSELPLAQGINFG

SEQ ID NO: 4077 - DNA, 1563 bp, Panicum virgatum
  misc_feature: Ceres CLONE 1796605
  misc_feature: Encodes the peptide sequence at SEQ ID NO. 4078
cccccgtccccaacccacgcagtgtcccagttccagtggagagataagccgagtccacaagatccccgtagaccacccacccgagcggaggggaaagcccccacgatcctagccgaggcagcagtgagcagccagccatgatgatgatgggcgaaggcgtgggcgtcccgccgtggtcgcaacaccttccggtgagcggcgtcgacgtcggcggcggtgacgagatgacgccgtacctgctggccgcgctgcgccagtacctgccgtgcaacgacgccggcgcgggcgccgacgacgacgaggcggcggccgcggcggcgatggcggccggcgtcgacggctacggctccgacgagttccgcatgtacgagttcaaggtgcggcggtgcgcgcgcgcccgcagccacgactggaccgagtgccccttcgcgcacccgggggagaaggcgcgccgccgggacccgcgcaagtaccactactccggcaccgcctgcccggacttccgcaagggcgggtgcaagcgcggggacgcctgcgagttggcgcacggcgtcttcgagtgctggctccacccggcgcgctaccgcacccagccctgcaaggacggcaccgcctgccgccgccgcgtctgcttcttcgcccacaccccggaccagctgcgcgtgctcctggcgcagcagtccagccccaggggcgccggcgccgcggcctcgccgctcgccgagtcctacgacggctccccgctgcggcgccaggcgttcgagacctacctcaccaagagcatcatgtcgtcctcgcccaccagcaccctcatgtcgccgccaaagtcgcccccgtcggactccccgccattgtcgccggacggggccgccgccttccgccgcggctcctggccgggcgtcgggtccccggtgaatgaggtcctcgcctcgctgcgccagctccgcctcagcaaggccaactcgtcccccgccggcggctggtccggctacccgtcctccgccgtcgcgtacggatcgcccacggctgccgggctctacagcctgccctccaccccgacgaccatgggcggcttcatggccaatctggagccgcttgatgtctccttcatcggcggcgaggaggagcccgtgcagagggtggagtctggtcgagccctccgcgcgaaggtcttcgagaggctgagcagggagggcgccgtctccggcgacgccacggccgcaaccggaggccccgacgtggggtgggtctccgatctcatcaactgaggcggctggtcagtcgttcttgacgtcttttgtgagtagcaaggtggcatggcgacggcaatggcttggagaaaggtggtggtaagccgtgatcgagaagaatggcatccaaaaaaaaaaatcagtcttcttttgttgcttccagtttcatgcgctaattccccctgtacatatctatcgccttgtgaatattcttggccggtagaagaaggatgcaaggtggtggaaggaggggtggatttgttttggggttcttgaggtagtggaaaatatccaaaaaaaaaaaaaaaaaaaa

SEQ ID NO: 4078 - protein, 376 aa, Panicum virgatum
  misc_feature: Ceres CLONE 1796605
  misc_feature: Great-hit functional homolog of the protein sequence given in SEQ ID NO 9307
  misc_feature (1)..(26): Pfam Name: zf-CCCH Pfam Description: Zinc finger C-x8-C-x5-C-x3-H type (and similar)
  misc_feature: Useful for making plants with modulated nitrogen use efficiency
MMMMGEGVGVPPWSQHLPVSGVDVGGGDEMTPYLLAALRQYLPCNDAGAGADDDEAAAAAAMAAGVDGYGSDEFRMYEFKVRRCARARSHDWTECPFAHPGEKARRRDPRKYHYSGTACPDFRKGGCKRGDACELAHGVFECWLHPARYRTQPCKDGTACRRRVCFFAHTPDQLRVLLAQQSSPRGAGAAASPLAESYDGSPLRRQAFETYLTKSIMSSSPTSTLMSPPKSPPSDSPPLSPDGAAAFRRGSWPGVGSPVNEVLASLRQLRLSKANSSPAGGWSGYPSSAVAYGSPTAAGLYSLPSTPTTMGGFMANLEPLDVSFIGGEEEPVQRVESGRALRAKVFERLSREGAVSGDATAATGGPDVGWVSDLIN

SEQ ID NO: 4079 - DNA, 1806 bp, Panicum virgatum
  misc_feature: Ceres CLONE 1796610
  misc_feature: Encodes the peptide sequence at SEQ ID NO. 4080
tcggtgtagtatccccagcctcagttaccatgccttcccgtttcccttctatctgcttcttcggcgaccgtcgtctctgctcgccgccgtgcctcctcctcctgctgatgctgctggttgtgcttgccacaaccagcagcaggtgtgtggtggaggcgcgtcggaatgtgatcacgcatatcaaggggttccgtggtcctctgcccttccacctcgagacagggtacgtcgaggtcgatgaggagcatggcgtgcgtctcttctactacttcatcgagtcggagcggaagccggcggaggaccccctcatcctgtggatcaccggcggcccaggatgctccgcgctctctggtctcctcttcgagataggtcctctcaagttcgatgtggccgggtacacggagggcttcccgcaactgttctatttcaaagatgcctggaccaaggtaagcaacgttatcttcctggacgcaccagtcgggactggtttctcgtacgctcgggaggaggccggctacaacgtcacgctcacgggtttagggcggcgcctgcacaccttcctccgcaagtggcttaccgagcacgaggagttcgcctccaacccgctctacatcggcggcgactcgtactccggcttcaccgtcccggtggccgcagtagacatcgccaacaacaacggcaatggccaggggattaggcggcggcttaacctcaagggctaccttgtgggcaacccggcaaccgatgaagtgtacgacaaggggggcaaggtgcccttcatgcacggcatgggcctcatctccgatgagctgtacgaggaggcgctgcagggctgcgggggtgacttctacgacatgcctcaacattcgaacacgcgctgcaccaacgcgctgaacgccattgatttggtcacctccgacatcaacccggtacacgtcctagagccgttctgcgtcaaggcgctgcgtgtgcgcgatgccggcgtcgtcagcatgttccgtggccatggcgccgccggcagtggcaggaggtccatgctcgtgcgggacgacgtcgagcgccccgacttcttctccaggaggaagctcgacctcccggtggagtgccgggacaatggataccgcctgtcctacatctgggccgacgaccccgaggtgagggtggcgcttggaatccacaacggctccatcggttcctggagtcgctgcagagacctcacgcacttcacgaccgacatagataccgtcattccccaccatgtcaacctcaccaaggcaggctacagggcactcgtctacaacggtgatcatgacctggacatgacctttgtgggcacgcaagcgtggatcaggtcgctcaagttcccgattgtcagcgactggaggccatggcactccaatggacaggtcgcagggttcacaaggacttatgcctacaacctcacttatgccactgttaaaggggcaggtcatacggctccagagtgcaagcccaaggagtgcctggacatgctcaatagatggatgtcaccaactggtcagctttgactgactagggaagtacgtactcgactactcgatcgagagaataagcggagtgtatccctattccctactgtgggctggcaaattaccggtgtacgtcctagcttccatctcattgtcagtgctgtaatataatagggttgctaaaccacgtccttccgtctgatgagcttggatttgctgacattcaaaactgcggtatgattggattttaatgtgaaacaggcattgcccctcattctaaaaaaaaaaaaaaaaaaaa

SEQ ID NO: 4080 - protein, 505 aa, Panicum virgatum
  misc_feature: Ceres CLONE 1796610
  misc_feature (1)..(198): Pfam Name: Peptidase_S10 Pfam Description: Serine carboxypeptidase
MPSRFPSICFFGDRRLCSPPCLLLLLMLLVVLATTSSRCVVEARRNVITHIKGFRGPLPFHLETGYVEVDEEHGVRLFYYFIESERKPAEDPLILWITGGPGCSALSGLLFEIGPLKFDVAGYTEGFPQLFYFKDAWTKVSNVIFLDAPVGTGFSYAREEAGYNVTLTGLGRRLHTFLRKWLTEHEEFASNPLYIGGDSYSGFTVPVAAVDIANNNGNGQGIRRRLNLKGYLVGNPATDEVYDKGGKVPFMHGMGLISDELYEEALQGCGGDFYDMPQHSNTRCTNALNAIDLVTSDINPVHVLEPFCVKALRVRDAGVVSMFRGHGAAGSGRRSMLVRDDVERPDFFSRRKLDLPVECRDNGYRLSYIWADDPEVRVALGIHNGSIGSWSRCRDLTHFTTDIDTVIPHHVNLTKAGYRALVYNGDHDLDMTFVGTQAWIRSLKFPIVSDWRPWHSNGQVAGFTRTYAYNLTYATVKGAGHTAPECKPKECLDMLNRWMSPTGQL

SEQ ID NO: 4081 - DNA, 1713 bp, Panicum virgatum
  misc_feature: Ceres CLONE 1796642
  misc_feature: Encodes the peptide sequence at SEQ ID NO. 4082
aaccacgcgcgcgccgctcgcaatcgcaatcccctgctgccgtgtcctcgccgccgcttctcttctcccctcctctcctctccaagagctcgctcgatcgctggattcgctgctgcgcggctggccggcgtctagctagatcatctatcgtcggaggtggtgatcgatcgttcgatgcgcatggaggggggaggaggaggcggaggcggcgccggcgtcggggggtgcctggggctgggtcacggcggggaggcgcagatcaagggcacgcacacgcacggcggccgctacgtgcagtacaacgtctacggcaacctcttcgaggtctccgccaagtacgtcccgcccatccgccccgtcggccgcggcgcctgcggcatcatctgtgctgctgtcaatgcgcagactcgcgaggaggttgccatcaagaagatcggcaacgcgttcgacaatcagatcgatgcgaaacgcactttgcgagaaattaagctgctgaggcacatgaatcatgaaaacgttatttcggtaaaggacatcatacgcccacccaggagggagaacttcaacgatgtctacatcgtctatgagttgatggacactgatcttcatcaccttctacgatcgaaccagccactatctgatgatcattgtcagtatttcgtgtatcagctgcttcgagggttgaagtacgtgcactcggcaaatgtcttgcacagagacctcaggccgagcaacctgctgctgaatgccaaatgtgatctgaaaattggggattttggcctggcaaggaccacaactgaaactgacttcatgatggagtatgtcgttacgcggtggtacagggcgcctgaactcctgctcaactgctcagagtatactcaggctattgatatgtggtcagtaggctgcatcctcggtgaaatagtcacacgagagcctctgtttcctggaaaggattatgttcatcagctgaggctaataaccgagctggtagggtcacctgatgacacaagccttgggttcctccgaagcgataacgcccgcagatatgtgaggtcccttcctcaataccccaagcaacacttccgtgcgcggttccccactatgtctagtggtgccatggatttgcttgagaggatgcttgtgtttgatccgagcaaaaggattactgttgatgaggctctatgccacccgtacttggcttccctccatgaaataaatgacgaacccgtttgcccagcgcctttcagcttcgacttcgagcagccatcgctcaccgaagaatatatcaaggagctcatatggagggagtctctcaagttcaaccctgatccaatccactaaaatagttcccatgtaaactcgagcaaacaaggattgcaaatctatccactccatgaggaaggcatgaggcaacaagaacttcaagtgaccacccctcatcatctcatctcgtcgtttgtcgattacgacaccctgacatcgaaaacattggacatttgtgaaacaagaagcttgatcaataatttgtagtggcaaaagttggcagcttatctgcatcttgttaggttgtatctatctcctctggtttgtatgctttaagaaatctagaggcttgtcactgcccatggacaggactatatggtactacgatctctacacactctacaaacagcagctcatgtcaccttccaaaaaaaaaaaaaaaaaaaa

SEQ ID NO: 4082 - protein, 389 aa, Panicum virgatum
  misc_feature: Ceres CLONE 1796642
  misc_feature (1)..(389): SWISSPROT Homolog: EC 2.7.11.24 Mitogen-activated protein kinase 2
  misc_feature (20)..(387): SWISSPROT Homolog: EC 2.7.11.24 Mitogen-activated protein kinase 6
MRMEGGGGGGGGAGVGGCLGLGHGGEAQIKGTHTHGGRYVQYNVYGNLFEVSAKYVPPIRPVGRGACGIICAAVNAQTREEVAIKKIGNAFDNQIDAKRTLREIKLLRHMNHENVISVKDIIRPPRRENFNDVYIVYELMDTDLHHLLRSNQPLSDDHCQYFVYQLLRGLKYVHSANVLHRDLRPSNLLLNAKCDLKIGDFGLARTTTETDFMMEYVVTRWYRAPELLLNCSEYTQAIDMWSVGCILGEIVTREPLFPGKDYVHQLRLITELVGSPDDTSLGFLRSDNARRYVRSLPQYPKQHFRARFPTMSSGAMDLLERMLVFDPSKRITVDEALCHPYLASLHEINDEPVCPAPFSFDFEQPSLTEEYIKELIWRESLKFNPDPIH

SEQ ID NO: 4083 - DNA, 1642 bp, Panicum virgatum
  misc_feature: Ceres CLONE 1796643
  misc_feature: Encodes the peptide sequence at SEQ ID NO. 4084
attctctccctccttccggctcacacccccctgattcccccatcagcctcacctcccctccactacctccgagcagcagccaagagagagggagctccgcaagccgcggcacaagaggaggcaaaccctagcacaaagactcactttctccggagcaagccaggccggatagcatagcatccgcatcgccgccgcatcacccaccaccatgatcttcccccctgccttcctggattcctcgagctggaacgataaccagcagcagcagcagcagcagcaagctcaccaccaccagcaggttgccgccagcggaggtggcggcgagggcaatcatgaccttctccagccatcaatcatggggggagcgcttcccgaaggtggtgctgctggcggcggcggcggcgggcaggtggggccggcgaagccgatatccatggccgagcgcgcgcggctggcgaggatcccggtgccggagccggggctcaagtgcccccgctgcgagtccaccaacaccaagttctgctacttcaacaactactcgctgtcgcagccgcgccacttctgccgcgcctgccgccgctactggacgcgcggcggcgcgctccgcaacgtgcccgtcggcgggggctaccgccgccacgccaagcgcgccaagcccaagcaggcggcggccgccgggacgacgtcatcggccaccgccaccgccgcgctggctcccgccgggtccgccacgtcgtcagccgcctgcaccaccacgaccaacgtgcccgcgctccccggcggccccgccatgctcggcggcaaccacttgtccatgctgccaccgctgctgcgcctcgccgacttcgacgccatgagcctcggctcgagcttctccgggatggggaagccgcccctcgacgccgcgggaggctactcggtgggtggcggcagctgtcccggactggagcagtggagggtgcagcagatgcaaagcttcccgttcctgcatgcgatggaccagggcccgctgtggccacctctggccatgacaatggcgcccgggatgttccagctaggtctagacagtggcgatggccgtggcgccggtggagaagacgggtcgggagagctccacgtgatgcaagccaagagggaaggcggcggcggctacccagcaagaggcatctatggcgatcaccacctcgccgctgccggttacgcttcctattccaacaatgctgctacaggtaaccatctcttgtaatggtcagggccatctacaatgatcgttaagacgttagttgttcctacaactagctagagacggagtgtgtgatggtattgtgatatagaaaaggctagcatgcatttgcaatgttttcttcttcaagaactggtgaagagggagagggggagagagagagacaatggtgctcgatttggacatggacgagccgtatgctggatcatgcatgcacaagtattatctatagctgcacgttagctcgcatgatcactagcttggttttatgtatcttctttctttctttctttctttctttttccctatgatgatcgggtccatttaggtttcactgtcgagcatttggggtgaagtaatgtgtactgctgttgatcagaaaaaaaaaaaaaaaaaaaa

SEQ ID NO: 4084 - protein, 345 aa, Panicum virgatum
  misc_feature: Ceres CLONE 1796643
  misc_feature (1)..(63): Pfam Name: zf-Dof Pfam Description: Dof domain, zinc finger
  misc_feature: The sequence is a functional homolog of  SEQ ID NO 2748 in the  10/374,780 US patent application
  misc_feature: The sequence is a functional homolog of  SEQ ID NO 394 in the  10/225,066 US patent application
  misc_feature: Useful for making plants with modulated growth and phenotype characteristics
MIFPPAFLDSSSWNDNQQQQQQQQAHHHQQVAASGGGGEGNHDLLQPSIMGGALPEGGAAGGGGGGQVGPAKPISMAERARLARIPVPEPGLKCPRCESTNTKFCYFNNYSLSQPRHFCRACRRYWTRGGALRNVPVGGGYRRHAKRAKPKQAAAAGTTSSATATAALAPAGSATSSAACTTTTNVPALPGGPAMLGGNHLSMLPPLLRLADFDAMSLGSSFSGMGKPPLDAAGGYSVGGGSCPGLEQWRVQQMQSFPFLHAMDQGPLWPPLAMTMAPGMFQLGLDSGDGRGAGGEDGSGELHVMQAKREGGGGYPARGIYGDHHLAAAGYASYSNNAATGNHLL

SEQ ID NO: 4085 - DNA, 1827 bp, Panicum virgatum
  misc_feature: Ceres CLONE 1796649
  misc_feature: Encodes the peptide sequence at SEQ ID NO. 4086
gctgaccgcaagcagccgccaccgtcacgccaccgcgccgagagggaaaagccgagcggtggcaggctaggaggggacgccgggacggacgaaagggggaaatcgcctgcctgcctgccgcggtgggttggtggctgccgcctccgcatcctctgctcagttccccagcccacccccattcacctcgcctgaccttgcatggattcccgctcgcttcccctccactccacgcgccgatccgccgccacctgccaggagagcgcgacgcgatccaattgaggtgcaggaggcgggggcgccctgcctgctgcctgcgtgcttcccctccagtatccgcccgggcctggccgcgctgccgctggacgccatcgcgcgcctgcacggcgtcttggggcggtcggagcagccgccgccacgcgggcgacccggcgcgaggaagcggtggccgagccgggggagcgcgatgctgtgggtgacgcgcctgtccggcttcttctccgccgccatggtgatggtggtgctgtcgccgtcgctccagtccttcccgcccgccgaggccatccggtcctcgcagttcgacggcagcgtccgcttcccgggccagatcgcgggcggcgccagggggatcgccttccgccgcgccccgtcgttccgcaatgccgccgattgcggcagcggcggcgcgggcaacggcaccgcggccaatgtctgcgacccctcgctcgtccacatcgcgattacgctcgatgaggagtacctcaggggatccgtcgcggcggtccactcggtggttcagcacgccaagtgccccgagagcgtcttcttccacttcctcgtctccgacccgggcctcggggacctcgtccgcgccgtgttcccgcagctccgcttcaaggtctactacttcgaccccgaccgcgtccgggggctcatctccacgtcggtgcggcaggcgctggagcagccgctcaactatgcgcgcaactacctcgccgacctcctcgagccctgcgtgcgccgcgtcatctacctcgactccgacctcgtcctcgtcgacgacgtcgccaagctctggcgcaccgacctcggcggccgcaccgtcggcgcgcccgagtactgccacgccaactttaccaagtacttcacaggccggttctggtcagaccagcggttcgccgggacgttcgcggggcggcggccgtgctacttcaacacaggggtcatggtgctcgatctcgagcggtggcggcaagcgagctacacgcagcgcatcgagcggtggatggagatacaaaagtcgccgccagggcgcatctacgagctggggtcgctgccgcccttcctgctggtgttcgcagggcacgtggcgccgatcgaacaccggtggaaccagcacggcctcggcggcgacaatgtcctgggcagctgccgcgacctccacccgggtccggtgagcctactgcattggtccgggtccggcaagccgtgggcgcggctcggcgccgggcggccgtgcccgctcgatgcgctctgggcgcccttcgacctgtacggccccgccggcgccggcgccgaggagtcccggtaaccgctacactcgaaaaaaaaaaagaaagattcttttccttctttggccgaccccgtataaattctgagcttctaattcttggtttccattacctgttcaaacctatatgttttttcatccctttcttcttcttcttcttttccagttcagttcgattaaatgtttggtgctagattgttcatgtttgttcgtagtgatctcttctcccactttttgatcaaaaaaaaaaaaaaaaaaaa

SEQ ID NO: 4086 - protein, 374 aa, Panicum virgatum
  misc_feature: Ceres CLONE 1796649
  misc_feature: Great-hit functional homolog of the protein sequence encoded by LOCUS At3g62660
  misc_feature (1)..(255): Pfam Name: Glyco_transf_8 Pfam Description: Glycosyl transferase family 8
  misc_feature: Useful for making plants with altered cell wall content and/or composition
MLWVTRLSGFFSAAMVMVVLSPSLQSFPPAEAIRSSQFDGSVRFPGQIAGGARGIAFRRAPSFRNAADCGSGGAGNGTAANVCDPSLVHIAITLDEEYLRGSVAAVHSVVQHAKCPESVFFHFLVSDPGLGDLVRAVFPQLRFKVYYFDPDRVRGLISTSVRQALEQPLNYARNYLADLLEPCVRRVIYLDSDLVLVDDVAKLWRTDLGGRTVGAPEYCHANFTKYFTGRFWSDQRFAGTFAGRRPCYFNTGVMVLDLERWRQASYTQRIERWMEIQKSPPGRIYELGSLPPFLLVFAGHVAPIEHRWNQHGLGGDNVLGSCRDLHPGPVSLLHWSGSGKPWARLGAGRPCPLDALWAPFDLYGPAGAGAEESR

SEQ ID NO: 4087 - DNA, 1646 bp, Panicum virgatum
  misc_feature: Ceres CLONE 1796658
  misc_feature: Encodes the peptide sequence at SEQ ID NO. 4088
aagaggaagaggagagagaggagagagaggagagagagagggtcggtccgtcggacggagcgcgcaggcagctgctcattcatctcgtgaccgcagcagctggcatcaactcaagcaccagcaagcggccacatccatccatccatccgccaatccatttccttcccccaccctcgcccgcggcggcgcatcgtgggaatggggcagatggggagtcccaacggcgacggacgcgggggcggcggcggctcccacccccaccaccagtaccactaccaggcgctcctcgccgcggtgcagaaccccacccagggcctgcacccctttcccctccccttccacgtcgggccacccgccgccgggccagcagctgatgcagccgcgtccacgcacaatgctgctccccactctcagcactcaagaggttttgccgactggagcgcttccagcagtgccttcgcgtccgtttctccccagcccgcccccgctaccaccaacgcaccacccttcccatacaacctctcccagtcttacgcgctatggtcccattacatgcttagcaagaacgcgatgccctactcttcttatcccgcaccacatgaggacaacccccgctcactgcgccatactcacatcccgccggacaaggattcaggttctacatattctatggaaacagcaggttctgcatccagccttggatttgactctttcactacaatgtcccttggaccaaacatatgcgcccacatgtctcccatggaagcatctctacctgccaaagaagctgagaattcagaggatttgcctacagtggttagaaacagtgacgacatggacactataaacagtgaggaagtccatcttgacacagctgccactcttcctgagtcgaagcctagtcatgagagctgcaccatgaagttcaactctggagagtaccaagtcgttttgcgcaaagagttgacaaagagtgatgttgcaaatgtcgggcgaattgtgcttcccaagaaggatgctgaggctagtcttccaccattggtgcaaggtgatcctctgatactgcagatggatgacatggtgcttcctgttacatggaaatttaagtatagattctggccaaataacaaaagcagaatgtatattctggaagctgcaggtgaatttgtgaagacgcatggtctccaggcaggggatgcactcattatctacaagaactccgtgcccggcaaatttattatccgtgcggagaaggccattcagcagacaaacccctaaacccaacttgatgatgtggctgtagcagcgccaaagatggcttttgaggatatgaattcaccataagttcagaactgaaggcattgtcaactttcatgagtgggttaccatcacaatgggatgagtctaacttgttgattcctggtggatggagacgagaaattttgggagaacattggaagtgctgccaatgagcctacatctgagcaggacaagtagtttgcaatttttttccttctaattcggttgtatttggatgctcgagttctgcattgcattctgaacaacattcgcagtacttttttcttgtaaatattttgaacctataagataaaggaagtggtccagaaaaaaaaaaaaaaaaaaaa

SEQ ID NO: 4088 - protein, 359 aa, Panicum virgatum
  misc_feature: Ceres CLONE 1796658
  misc_feature (1)..(104): Pfam Name: B3 Pfam Description: B3 DNA binding domain
MGQMGSPNGDGRGGGGGSHPHHQYHYQALLAAVQNPTQGLHPFPLPFHVGPPAAGPAADAAASTHNAAPHSQHSRGFADWSASSSAFASVSPQPAPATTNAPPFPYNLSQSYALWSHYMLSKNAMPYSSYPAPHEDNPRSLRHTHIPPDKDSGSTYSMETAGSASSLGFDSFTTMSLGPNICAHMSPMEASLPAKEAENSEDLPTVVRNSDDMDTINSEEVHLDTAATLPESKPSHESCTMKFNSGEYQVVLRKELTKSDVANVGRIVLPKKDAEASLPPLVQGDPLILQMDDMVLPVTWKFKYRFWPNNKSRMYILEAAGEFVKTHGLQAGDALIIYKNSVPGKFIIRAEKAIQQTNP

SEQ ID NO: 4089 - DNA, 3368 bp, Panicum virgatum
  misc_feature: Ceres CLONE 1796693
  misc_feature: Encodes the peptide sequence at SEQ ID NO. 4090
aaaccctttttctccttcgtctcctccaacttccgagttccgagaagtgaaagagccccaccgcaccgcagcggcggcacccacccaccactaccacacactggcacaccctccgtctgggggtttagcgcgttaacccctcccccctaatcagcgatcacccaacccctcgccgcctcccgtcctcccctcaaccctcgcccgccgattcggcgattcctctccccaggggctcggcggtaccggcatcttcctccgtccgcccgcgcgaggcggttgggtgccggcggcgcgcgatgccgacggcagcgccgacgcccaaggcggtgctccaccagcggttcggcgccaaggcgcggtacacggtcgaggaggtgcgggaggccgtgggcggctgcccgggcctcgcgccgcagacccggagcgtctaccggtgcgcgctcgagctcccggacctctccgtcaccacgcccggcaccttcgtccggaagaaggacgccgagcaggccgccgcgcagatcgcgctcgacaagcttggtattcagcccacagcaaatattcccagtacaccagaagaagcttgggatgaactgatcgctcgcatatctggtttcttcatagacgagaacttcctgtcatctacccatcctctggttggccatttgagtgtgactctcaggagaactggggacctcattgggaggttacctttgtcggctattgctgcatgtgatgtgaaggtcaatacattgtgtaaagtgattaaccctaaggcagaatatgatcctctcttggtcttgtcattaatgtacaatgctgcaaaacaatctcctggagtctcggtcagtgatagcaacttctggattcagagtcagaagccctattctccggaggctgttgacttggcacttaaacgttggtcttttacatcagaccctgtagaagtaaaagcgattcttattccccatgagttggaggatgaactgaagatattaacaattaatctacgagataatgaacattatatgggttatgtcgcagaaaagctcacagtgagtgattcctctcaagttcttgtatcaagaacaattggaaaagcatcttctgagataaggctgtattttgcagccccaagtgtacattttgtttctgatatgtcaaaaaatgtgcttgcttgtcatggagatggtgacatcaactgccaagtaaataagcgagcctcctatatttctggtcagacaatttacggaggtgcgctcttggcaaatatcggatacacaaggagagattcggaacttcacactgaagatgtcaatctatgcacctattacaggatacttctgggcaagttacctgatggaaattgtaagatgtctagggatgcgattcttgcagcagagcttccatctgcgtactctcgtttcagttggaaaggcctttccccacgagatctcctttgttcattctgtcgcaatcagaggttatcagagcccctttttgctgtcaatagggtctcctgtgatatgttaacatcagctgtgagctctgaagaaagaggagcactagcaaagagtgtagaaaatcagtgcaccaatgatgttataatcgacaaggaaaactcagatattttcacatgtgaagtcaaaatatgttcacggaagcaggagattttactagagtattctgcagctcacacttggagcaaggaatctgatgctattcagaattctgcattgaaggtcttgatttggttcaacgattatttcaagcaactaaacacaaaaatggacaagctatatctttccaattgcactgacagtttcaagatacatccaaatatttttctgcaagaatttgcaatgtgcttatctgtttatagtaatactggatgcaatgattcaggaatgtgcagttcagttggaccttttattgtggatacaccaaagaagcagcttgaaagtactgcaactttaacacgcattgagggcccagattctggtgttttcccatcccatggatcattgacttccataagttatacggcttcccttgtgatgaaggataaagcaaaaatatatttgttggaaagccacaatgagtttgagtttgagatagggacgggtgctgttagtaatcagcttgaatcatgtgtaactcagctatcagtaaatcaagctgcatgttttatcgctgaactgcctcctagggatttgatcctggctgctgcttctgagttctcacatgaactttccaacgtatctagcgagagctgctttctggagttctctgtaaaggttttgcaggtaaccgaaccattagaagatagaatggaaaaggccttgtttagccctccattatcgaaacaaagagttgaatttgctgtccagcatatcaacgagctgcatgctaccacacttgttgattttggttgtggatctggcagcctccttgattcattgttagagcatccaaccacactagaaaagcttgtcggtgttgatatttctcgaaaaggcctcacacgcgccgcaaagagtcttcatcagaagctgagcaagaaattgttggtgcagacaactgttccaactgctgtgctctatgatggatccataacagactttgattctcgcttatatgggtttgatattggcacttgtcttgaggtgatcgagcacatggaggaggaccaagcgagtttatttggcaacgtcgtcttgagctcattccggcccacggtgctcattgtttcaacacccaactacgagtacaaccctatactccagaggtcagctatgcccaacaaggatgacgaggtggacgaaagcactggtccatgcaagttccggaaccacgaccacaagttcgagtggaccagagcgcagttccagtgctgggctactgacctcgcggttaagcataactacagcgtggagttctgcggcgtcggtggctcaggcgaagaaccaggctacgcttcccagatcgctgttttgagaagaatggcgcgcgatacggaagagatgtgtctgaataaagataaggatcagccttacgagcttctctgggaatggcccaacgcatcgatacccgtctgaatagtctgattggctgcagtggaatagtcttcacctcaggcttctaactgaggtgaggggagaaggctggcactaacctgtgacctaggatgaggtggactcatagacatgtcccaggtgtagaactagaactaaacagtacgtgaattattccacgctacaatggtgtgctctgtaattctaaacatgtccctattctatcgaatttgggggtctcataaatatcacgccaaacaacgacgtctaacacaccaaaaaaaaaaaaaaaaaaaa

SEQ ID NO: 4090 - protein, 932 aa, Panicum virgatum
  misc_feature: Ceres CLONE 1796693
  misc_feature (1)..(41): Pfam Name: Methyltransf_12 Pfam Description: Methyltransferase domain
MPTAAPTPKAVLHQRFGAKARYTVEEVREAVGGCPGLAPQTRSVYRCALELPDLSVTTPGTFVRKKDAEQAAAQIALDKLGIQPTANIPSTPEEAWDELIARISGFFIDENFLSSTHPLVGHLSVTLRRTGDLIGRLPLSAIAACDVKVNTLCKVINPKAEYDPLLVLSLMYNAAKQSPGVSVSDSNFWIQSQKPYSPEAVDLALKRWSFTSDPVEVKAILIPHELEDELKILTINLRDNEHYMGYVAEKLTVSDSSQVLVSRTIGKASSEIRLYFAAPSVHFVSDMSKNVLACHGDGDINCQVNKRASYISGQTIYGGALLANIGYTRRDSELHTEDVNLCTYYRILLGKLPDGNCKMSRDAILAAELPSAYSRFSWKGLSPRDLLCSFCRNQRLSEPLFAVNRVSCDMLTSAVSSEERGALAKSVENQCTNDVIIDKENSDIFTCEVKICSRKQEILLEYSAAHTWSKESDAIQNSALKVLIWFNDYFKQLNTKMDKLYLSNCTDSFKIHPNIFLQEFAMCLSVYSNTGCNDSGMCSSVGPFIVDTPKKQLESTATLTRIEGPDSGVFPSHGSLTSISYTASLVMKDKAKIYLLESHNEFEFEIGTGAVSNQLESCVTQLSVNQAACFIAELPPRDLILAAASEFSHELSNVSSESCFLEFSVKVLQVTEPLEDRMEKALFSPPLSKQRVEFAVQHINELHATTLVDFGCGSGSLLDSLLEHPTTLEKLVGVDISRKGLTRAAKSLHQKLSKKLLVQTTVPTAVLYDGSITDFDSRLYGFDIGTCLEVIEHMEEDQASLFGNVVLSSFRPTVLIVSTPNYEYNPILQRSAMPNKDDEVDESTGPCKFRNHDHKFEWTRAQFQCWATDLAVKHNYSVEFCGVGGSGEEPGYASQIAVLRRMARDTEEMCLNKDKDQPYELLWEWPNASIPV

SEQ ID NO: 4091 - DNA, 688 bp, Panicum virgatum
  misc_feature: Ceres CLONE 1796737
  misc_feature: Encodes the peptide sequence at SEQ ID NO. 4092
caggtagggtaaggaagcaggagcgtcccccgccgccgccgccatgaagcgcaacccccgcgtcacgagctcccgccggaagtgccgcaaggcgcacttcacggccccgtcctccgtccgccgcgtgctcatgtccgcggcgctgtcgacggagctccgccacaagtacaacgtgcgctccatcccgatccgcaaggacgacgaggtgcaggttgtgcgcggcaccttcaagggccgcgagggaaaggtggtgcaggtgtaccgccgccgctgggtcgtccacgtcgagcggatcacccgcgagaaggtgaacggctccaccgtcaacgtgggcatccacccctccaaggtcatcgtcaccaagctgaagctcgacaaggaccgcaaggcgctcctcgaccgcaaggtacgcggccgcgccgccgacaaggccaagggcaagttcaccgccgacgacgtcgccgccgctgctggtggggccggcgccaccggtgcctccctccaggagatcgactaggcgctgcgcggcggggatctgatggtggtcgtgctgcctttccctccttatcgctcgctctagttttgctatctatgattatgtggattttatgtgtctgagatttgagatatgaagtactcgttacatggttaatcatttcacttcgttgaaaaaaaaaaaaaaaaaaaa

SEQ ID NO: 4092 - protein, 157 aa, Panicum virgatum
  misc_feature: Ceres CLONE 1796737
  misc_feature: Great-hit functional homolog of the protein sequence given in SEQ ID NO 9414
  misc_feature: Useful for making plants with modulated biomass
  misc_feature: The plant is abnormally small.
MKRNPRVTSSRRKCRKAHFTAPSSVRRVLMSAALSTELRHKYNVRSIPIRKDDEVQVVRGTFKGREGKVVQVYRRRWVVHVERITREKVNGSTVNVGIHPSKVIVTKLKLDKDRKALLDRKVRGRAADKAKGKFTADDVAAAAGGAGATGASLQEID

SEQ ID NO: 4093 - DNA, 1651 bp, Panicum virgatum
  misc_feature: Ceres CLONE 1796745
  misc_feature: Encodes the peptide sequence at SEQ ID NO. 4094
gtagcactagccactctcactccccccggcggcatggagaaggagaagaggcggaggagctggttcgagcgcatcaggcggctcttcacctcctccgagcccaaggagaaacccaaacctgacaagaaggcgaagagcaagcggtggctaccggggaagctgaggacgcagcagtcgttcgctctgccggcgccggcatccgcggccgcggacctgcagatcaggcaggcggaggacgagcagagcaagcacgccgtgaccgtcgctctcgccaccgcggcggccgccgaggccgcggtcgccgccgcgcacgccgccgccgaggtcgtccgcctcaccggccagcaggccgcggccccgccggccgggcgggagcgggagctggaggaggaggagcatgccgccgtcttgatccaatcggcgtaccgcgggtacctggctcggcgggcgctgcgcgcgctcaagggtctggtgcggctgcaggcgctgatccgggggcaggcggtgcggcaccagacggcggccacgctgcgcggcctcgagtccctgatgaggatccaggcccagcaccgctcccgggccggcggccccgaccacccggcggcgctcgacggcaacgacgacgccttcctgctccggcgcggccgggagctctacgccgccgcggtccaccagcagcagcaggcgggcagcaaagggtgggacagcagcatcctcgccaaggaggagatgcgcgccgtgatgcggagccgggaggaggccgccctcaagcgcgtgcgcgcgctgcagtacgcgtccctgcagagcgagcggctgggcgtccggcggccgccgctgcccagggacgaggaggcggacgcgctccaccgccgctggagctggctcgaggagtgggtcggcgcgcagccgcccttcgacaaggacgtccccgtggcgcaccagtcgccctacagcagggacgacgccgccgccgccaggggccgccagacgccgggccgggccgtcgacccgctcgccggcctcggcggcggcgacgccgaccggctcggttgctcggcgcggcggtccttcgtgcggccgaggcgcgcgccggcgcgggcgggcgactacttctacgaggacgccgcgccgtgctcgccggcgacgttcccggggtacatggcgtccacggcctccgccaaggccaagttccggtccatgagcacgcccaaggagcgcttcgccggagccgacgccttctccgagcactgcttcccgttcgccgaccgcatgctctcgccgatcccgtccatgtcgcccatcccctccatcgccagcgacatgggcttcgccaggtccaccaggccgcccgccgcgcagagatcgccgcgggtggcggccaagggccccatgacgccggcgcggtcgcgctcacggaggtcgccgagccaccacagcttcggctccgaggccgcgctgcaccaactgcagatggagcactacaccccagtccggtgaacaagactacagagagtgccttgcttcgttacactcttttgtgaagatacaattccctgctcccattcttttgtttgttcacctttcttgacagaagggttcaactgttcaagtattcagtaatggaatgcaacaacgtaaaaaaaaaaaaaaa

SEQ ID NO: 4094 - protein, 487 aa, Panicum virgatum
  misc_feature: Ceres CLONE 1796745
  misc_feature: Great-hit functional homolog of the protein sequence given in SEQ ID NO 9643
  misc_feature: Useful for biocontainment applications
  misc_feature: Useful for making plants with modulated salt sensitivity
  misc_feature: The plant produces a reduced number of seeds.
MEKEKRRRSWFERIRRLFTSSEPKEKPKPDKKAKSKRWLPGKLRTQQSFALPAPASAAADLQIRQAEDEQSKHAVTVALATAAAAEAAVAAAHAAAEVVRLTGQQAAAPPAGRERELEEEEHAAVLIQSAYRGYLARRALRALKGLVRLQALIRGQAVRHQTAATLRGLESLMRIQAQHRSRAGGPDHPAALDGNDDAFLLRRGRELYAAAVHQQQQAGSKGWDSSILAKEEMRAVMRSREEAALKRVRALQYASLQSERLGVRRPPLPRDEEADALHRRWSWLEEWVGAQPPFDKDVPVAHQSPYSRDDAAAARGRQTPGRAVDPLAGLGGGDADRLGCSARRSFVRPRRAPARAGDYFYEDAAPCSPATFPGYMASTASAKAKFRSMSTPKERFAGADAFSEHCFPFADRMLSPIPSMSPIPSIASDMGFARSTRPPAAQRSPRVAAKGPMTPARSRSRRSPSHHSFGSEAALHQLQMEHYTPVR

SEQ ID NO: 4095 - DNA, 1605 bp, Panicum virgatum
  misc_feature: Ceres CLONE 1796759
  misc_feature: Encodes the peptide sequence at SEQ ID NO. 4096
atacccacgcgcagtaagcaagatccctcgctcgcgctgccgacagccagtggaaaatggcgagctcagactcggacacaagcagcatccacgtgctactcctttcctacccggcccagggccacatcaacccgctcctccagctcggcaagaggctcgctgcccaccgcggcgtgcgctgcaccctcgccgtgacccggttcgtcctcggccagagcaagccgcagaccggcgcggtccacgtcgccgccttcaccgacggctgcgacacgggcggctacgacgaggtcggcgacgcggaggcgtacctcgcgcggttcgagtcggcagggtcggcgtcgctggacgagctcctccgtgctgagtccgctggaggccggcccgtgcgcgccgtggtgtacgactcgttcctcatgtgggcgccgcgcgtggcgcgccggcacggcgcggcgtgcgcggccttcttcacgcaggcgtgcgtggtgaacgtggcgtacgcccacgcgagggccggcctgatggacctgccggtggcgccgggcaagcccctgccggagctgcccggcctgccggcggggctcgggccggccgacttcccgacgttcctcacggagcccgacggcggctgccgcgcctaccttgacctcgtgctgcagcagtgccaggggtttgaggtggcagaccacgtcctcgtcaactcgttctacgagctagaggtcaaggaagctgagtacatggcgtcgcgatggggtgccaagacggtcgggccaaccgtgccgtcggcgtacctcgacaaccgcctcacggacgacgtgtcctacgggttccacctccacactccgatggcggaggaaagcaaggcctggctcgacgcgaggcctccgcgctccgtcgtgtacgtctccttcggcagcctcgccacgcccagcgctggccaaatggccgaggtggcggaggggctcgacaacagtggcaaggatttcttgtgggttgtcagggcctcggagacttccaagttacctggaggtttcgtcgacaaggtgaaggggaggggcctcctcgtgacatggagcccgcagttggaggtcctagcacaccctgcggttggatgcttcgtgacgcactgcggttggaactcgacgatggaagcgctaggcattggtgtgccaatgttggcaatgccacaatggtcggatcagccaacaaacgccaagtacattgagcatgtttggcaagtgggagtgaagctgcaacctgacgcggaaggtgctgtgaggaaggcagaggtggagaggtgcgtcaggcaggtgatggaaggagaaaggagcgaggaatacaggaagaatgctgcaggattgagcgagaaggcgaaaaaagccatgagtgaaggtggcagctcggacagtaacatcgtagagttcctcagcaagatccgattcaagtgattatggcagtacataattttcaaaaaaaaatggcagcagtacataaacatatggggaaatagaagatcatcatagctgtgatgtctgatggccagtacaccgacacatagtgccatgcaataaatccttaatttgttgtcaaaaaaaaaaaaaaaaaaaa

SEQ ID NO: 4096 - protein, 462 aa, Panicum virgatum
  misc_feature: Ceres CLONE 1796759
  misc_feature (5)..(169): Pfam Name: UDPGT Pfam Description: UDP-glucoronosyl and UDP-glucosyl transferase
MASSDSDTSSIHVLLLSYPAQGHINPLLQLGKRLAAHRGVRCTLAVTRFVLGQSKPQTGAVHVAAFTDGCDTGGYDEVGDAEAYLARFESAGSASLDELLRAESAGGRPVRAVVYDSFLMWAPRVARRHGAACAAFFTQACVVNVAYAHARAGLMDLPVAPGKPLPELPGLPAGLGPADFPTFLTEPDGGCRAYLDLVLQQCQGFEVADHVLVNSFYELEVKEAEYMASRWGAKTVGPTVPSAYLDNRLTDDVSYGFHLHTPMAEESKAWLDARPPRSVVYVSFGSLATPSAGQMAEVAEGLDNSGKDFLWVVRASETSKLPGGFVDKVKGRGLLVTWSPQLEVLAHPAVGCFVTHCGWNSTMEALGIGVPMLAMPQWSDQPTNAKYIEHVWQVGVKLQPDAEGAVRKAEVERCVRQVMEGERSEEYRKNAAGLSEKAKKAMSEGGSSDSNIVEFLSKIRFK

SEQ ID NO: 4097 - DNA, 1759 bp, Panicum virgatum
  misc_feature: Ceres CLONE 1796761
  misc_feature: Encodes the peptide sequence at SEQ ID NO. 4098
atacttcattcacaaatatagtgagcttgaacaatacaaggtcgcatgctatctcaaccagcttgtgaacaattgcatcgtctttgctgccaccatgacaatcacaactgccatgatcctcaaggtcacacagatttgccaatactggctactcaccagctggtccactaccaccccacccatctaccaactttgggctttcttactgatcataaccgtagtaaccatcaagtatcttatccaacgtccaagcactgtataccttgttgactatgcttgctttgggcctagctcgaacttccacgtcgacccagcctcctgggctgagactcatcgcttcagctttttctttgatgatgataccatttccttcctaacaaaggtttttagacgctctggccttggcaatgagactagcctcccatctgtaaataattttctcccccaggctcatagattaaggttagctcgtgaggaggcagagatgatcatcttcgcagtcattgatgatctgtttgccaagacatccgtcatgcctaacaatatcgacatactgattgccaattgcagcagcagcacaatggtaccatccatgaccgacatgatcgcaaacagatacaagcttcgtagtgatatccacaatatgcagctatctgggatggggtgcagtgcaggattgatcgcagttggtctagcaagaaacctcttgcagaccatgccctacggtgcacatgcgctggtggtatccacggagctcatgactggcaacttctatgcagggaacaagcgatcgatgcagctgaccaacgtgttgttccggatgggaggcgttgccgcgctactctcgacctcaagggacaatgctcgatttgagcttacgcacattgtgagagaatccacagctgcccaggatagtgcataccattgtgttttccaggaggaagacgacgagggtctcctaggacttaacttgtcgaaggaccttgtggcagtcgccggcgaggcactcagagccaacatcaccacaactgcgccagttttgctcccaatctctgagcagctctcattttttctctccttcgttgtgcaaatggtgttcatcaagaaaagtgcaagaacaaagcagtatgttcctaatttcgacttggcagttgagcatttctgcatacatgccggtgggagagccgtgatcgatgcagtccaacgcagcctcaatctgtccgacgagcaggttgagccatcgaggatgacactgcatcgatttggaaacacatcgagcagctcgctgtggtatgagatggcgtattgtgaggccaagcagcagatgcggaagggggatcgagtttggatgattgggtttggttctggatacaagtgcaacagcgctgtgtggaagtgcattctaccagctcgtagtgctgactctgcatgggcaaactgcatccatcgttacccaatggatgtcgcaaaacaagcctctgtcactaagggtgccctgacaaaaagttaataatgtcaagtacttttcactgggaagaagaatatataatgatattttgaggcatactctcttaagcatgctccggatcttttatgtcacccaaaatgtcagcgtaatcatgcaccatttttcttttctagatatgtaaatgtaccatggggcagatgctgatatttgtatttcacatctatatgtctgaaagtttatagactttgattagttatagttccttttagtaaataataatatcatacgtgc

SEQ ID NO: 4098 - protein, 471 aa, Panicum virgatum
  misc_feature: Ceres CLONE 1796761
  misc_feature (1)..(288): Pfam Name: FAE1_CUT1_RppA Pfam Description: FAE1/Type III polyketide synthase-like protein
MTITTAMILKVTQICQYWLLTSWSTTTPPIYQLWAFLLIITVVTIKYLIQRPSTVYLVDYACFGPSSNFHVDPASWAETHRFSFFFDDDTISFLTKVFRRSGLGNETSLPSVNNFLPQAHRLRLAREEAEMIIFAVIDDLFAKTSVMPNNIDILIANCSSSTMVPSMTDMIANRYKLRSDIHNMQLSGMGCSAGLIAVGLARNLLQTMPYGAHALVVSTELMTGNFYAGNKRSMQLTNVLFRMGGVAALLSTSRDNARFELTHIVRESTAAQDSAYHCVFQEEDDEGLLGLNLSKDLVAVAGEALRANITTTAPVLLPISEQLSFFLSFVVQMVFIKKSARTKQYVPNFDLAVEHFCIHAGGRAVIDAVQRSLNLSDEQVEPSRMTLHRFGNTSSSSLWYEMAYCEAKQQMRKGDRVWMIGFGSGYKCNSAVWKCILPARSADSAWANCIHRYPMDVAKQASVTKGALTKS

SEQ ID NO: 4099 - DNA, 2239 bp, Panicum virgatum
  misc_feature: Ceres CLONE 1796787
  misc_feature: Encodes the peptide sequence at SEQ ID NO. 4100
atgcagctaggttccgcctctccccgtcgcaatggcccagccatgtgagtctcctataggagcctccatctctgaactcagcaccggcagcgccatggccgcttcttggtcctagcagagatcaggagttggagggtgcgctgccacaccgctgaatgcttggagaaggtggagagctcggtgttgacctgcctgttcgattctacacttctgtgtttctgatcatctgctcctgcccggttcttgtctgctgaatctgtctccctaagcatggtcgggcaagcggcaaaggcaaatgagtcagggaaagacgacagacaagaacccggagctgaggtgatgaaagagaagctactgccatctcaccagcaggaagagtctccagcttctgtgatggataaggattcttcagttcctggtgatgtgtcgccggtcctagatggggattctggggagttgaaagtggaggagaacatggatagcaatgggaataaggaaaagaaaacatctcagaagagcagtacaagtgacggcttcgcttctgctaaagtgagtgatgggacaagcagtttgaggaagaccagtggtagtgcaacgatgagtacacgggctgatttcactgagagtgggaagagtagcatgtgccgtgtgagcactggcagtgacattagtgacgagagctcctgtagcagcatgagcagcaccactacgaaaccgcacaaggggaatgattcaaggtgggaggcgatccatgtggtgaagtccagggataacgttcttggtttgaatcattttaggctgcttaagaagctgggttctggtgatattggcagtgtgtatctctctgaattgagtggtacacggagttactttgcaatgaaggtcatggataagacttctttggcaagtcggaagaagctgcttcgagctcagactgagcgggagatcctgcagtccctggatcatccatttctaccaaccctatatactcacttcgagacggataagttttcatgcttggttatggagttctgccctggaggggatcttcacactcttcgccaaaggcaacctggaaaatatttttcggaacaagcagcaaagttctatgtagcagaggtactccttgcattggaatacctgcatatgcttgggattatataccgtgaccttaaaccagaaaatgtccttgttcgggaagatggccacatcattctgtccgactttgatctttcacttcgctgttcagtaagcccaacggtggtcaaatctgccaatccgggcctagatgcactgcagaggaacaatgcagcatactgtgcccagcctgcttgcattgaaccatcctgcattcagccctcgtgtgttgctccaaccacttgctttggcccccgattcttcaagtcgaaatccaagtccaagtccaagtccaagaagaagtcaaagcctgatgctccaaaccaagagaacctatttccggagcttattgctgagcctaccgacgcccgctccatgtcctttgttggcacccatgagtacttggccccagaaataataaaaggggagggccatggaagcgcggtggattggtggacctttggtatattcttgtatgagctgctgttcggcaagacccctttcaagggttcaggcaaccgggcaacgctcttcaatgtcgttggccagcccttgaggttcccagagtcgccgatagtgagtttctctgcgagggacatgataaggggattgctggtcaaggacccacagcaccggcttggatataagcgaggtgctactgagataaagcagcatcctttcttcgagggcgtgaactgggcactcattagatgtgcgagccctccagacattccaaagcctgtagagcttgactgccgcccgaagcaagtgccatcgacaaatggaaaggttgcaccagtcaccaaccaaaaggggccagataattacctagagtttgaattcttctagtttttttttcctttttgtgatatctgaactgaaagagtgcatctgggctgattgtagaagaaagtgaaagatgaggagctactctaggcatatgcttggctggaatttttctgctgttagactgtatgctcactccaggagcccccccaagttgttttacttgttgaactgcttgactctaggatgtactggattcatcatgtatgttgcaattttcgaaaccacctattggtaaaaaaaaaaaaaaaaaaaa

SEQ ID NO: 4100 - protein, 571 aa, Panicum virgatum
  misc_feature: Ceres CLONE 1796787
  misc_feature (11)..(571): SWISSPROT Homolog: EC 2.7.11.1 Protein kinase G11A
  misc_feature (83)..(571): SWISSPROT Homolog: EC 2.7.11.1 Protein kinase PVPK-1
MVGQAAKANESGKDDRQEPGAEVMKEKLLPSHQQEESPASVMDKDSSVPGDVSPVLDGDSGELKVEENMDSNGNKEKKTSQKSSTSDGFASAKVSDGTSSLRKTSGSATMSTRADFTESGKSSMCRVSTGSDISDESSCSSMSSTTTKPHKGNDSRWEAIHVVKSRDNVLGLNHFRLLKKLGSGDIGSVYLSELSGTRSYFAMKVMDKTSLASRKKLLRAQTEREILQSLDHPFLPTLYTHFETDKFSCLVMEFCPGGDLHTLRQRQPGKYFSEQAAKFYVAEVLLALEYLHMLGIIYRDLKPENVLVREDGHIILSDFDLSLRCSVSPTVVKSANPGLDALQRNNAAYCAQPACIEPSCIQPSCVAPTTCFGPRFFKSKSKSKSKSKKKSKPDAPNQENLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELDCRPKQVPSTNGKVAPVTNQKGPDNYLEFEFF

SEQ ID NO: 4101 - DNA, 1641 bp, Panicum virgatum
  misc_feature: Ceres CLONE 1796813
  misc_feature: Encodes the peptide sequence at SEQ ID NO. 4102
atccacatcaaatctgctccacctctcctcggtccctcccggcctcccttcccttcgtccgcgcatcccaccaaccatggccgccgccaccgactccgacgccggcgcccagccgcgcgacgaccccagcctcctctccttcgcatccttctcgctctccctcaacatccgcgcgccgaccgcccccacactcgcttccatcacatccaccatccacctccccacccaaatctccacgctcgccgtctgcctccacccctccgctgcgcagtccccgtcccgccgccccacccgcctcaactccgcctcctcggtcatctccccgctgcccgcctccacgccgggcctctcccgctccttcccgtccggcgcgcccgccgccgccgggcgccgccgcacgctcgtctggttccgcgccgacctccgcctccacgaccacgagccgttccacgccgcggccggggcgtcgtcctccctcctcccggtcttcgtcttcgacccgcgggacttcggcaaatcaccctcgggttttgaccgcacgggcccataccgcgccaacttcctgctcgactctgtcgccgacctacgtcggagcctccgcgcgcgcggcggggacctggtggtgcgcgtgggcaggcccgaggtggtcatccccgagctcgcgcgggcggcgggcgcggaggccgtgtacgcgcacggggaggtgtcccgggacgagtgccgcgccgaggagagggtgcaaaaggccgtggagaaggagggcatcaacgtgaagtacttctggggtagcacgctttaccacgtggaagacctgccattccgcctcgaggacatgccatccaactatggcggcttcagggaggccgtgaatggcttggaggtcaggaaggtgctcgaggcacccgaggaggttaagtgcgttcccatgaagaacgtgctcgagcctggggatatccccacgctttccgagcttgggctcactgcgccacccgccatggcacaggactcgaaacctgctgttggctctactctcattggtggcgagacagaggctctggagaggttgaagaagtttgctgcagaatgctctatgcagccaaacaaagcagacaaaagcaatacccgagatagcatttatggtgctaatttctcctgcaaaatttcaccatggcttgctacaggttgcctctctccacggttcatgtatgaagagttgaagaagcatgctaccagagcaattccttctgggtcaacacccaaaaatgatgatggcacatccgatgctgggacaaattggttaatgtttgagttgctatggagagatttcttcaggttcatcacaaagaagtacagctctgtacagaagacatctgaagttgccactggttgcactcccaccccagcgctagcatgaacatagttagacaagctgattgccggctagtttttgggccatgaacttatgcacactttcaatggagatttaatctttttttccaccaataaatgttggtagtgaaagtggtaatagagtgccctgttcttgcgttttcggttcaattgatctcagaagggatctttgtatctgtcgacattcctctacataactgttccatacttcaaaaaaaaaaaaaaaaaaaa

SEQ ID NO: 4102 - protein, 445 aa, Panicum virgatum
  misc_feature: Ceres CLONE 1796813
  misc_feature (1)..(173): Pfam Name: DNA_photolyase Pfam Description: DNA photolyase
  misc_feature (1)..(56): Pfam Name: FAD_binding_7 Pfam Description: FAD binding domain of DNA photolyase
MAAATDSDAGAQPRDDPSLLSFASFSLSLNIRAPTAPTLASITSTIHLPTQISTLAVCLHPSAAQSPSRRPTRLNSASSVISPLPASTPGLSRSFPSGAPAAAGRRRTLVWFRADLRLHDHEPFHAAAGASSSLLPVFVFDPRDFGKSPSGFDRTGPYRANFLLDSVADLRRSLRARGGDLVVRVGRPEVVIPELARAAGAEAVYAHGEVSRDECRAEERVQKAVEKEGINVKYFWGSTLYHVEDLPFRLEDMPSNYGGFREAVNGLEVRKVLEAPEEVKCVPMKNVLEPGDIPTLSELGLTAPPAMAQDSKPAVGSTLIGGETEALERLKKFAAECSMQPNKADKSNTRDSIYGANFSCKISPWLATGCLSPRFMYEELKKHATRAIPSGSTPKNDDGTSDAGTNWLMFELLWRDFFRFITKKYSSVQKTSEVATGCTPTPALA

SEQ ID NO: 4103 - DNA, 1063 bp, Panicum virgatum
  misc_feature: Ceres CLONE 1796814
  misc_feature: Encodes the peptide sequence at SEQ ID NO. 4104
ttgcggcggcctaaactactctcccactccagccggggggcttcgtccagacagttaaaccggttgctattagtaggcgccaccacgcacgcacaggcgcacagctagcaccccaccccacgcactcaacagcaacagctaggctacacccacaagacagcaacatggctgaggaggaggccaagaaggtggaggtggaggtcgcgcaggagcccgaggcggcaccggcgccggccgcggagccggccaaggaggacgtcgccgaggagaaggccgtcatccccgccaccgagccgccggccgccgaggagaagccagcagccgactccaaggccctggccatcgtcgagaaggttgcagatgaacctgctgcagagaagcctgcagctgaaaagcaagggagctccaatgacagagatctcgctcttgcaagagtggaaactgagaagagaaactctttgatcaaagcatgggaagagaatgaaaagacaaaagctgagaacaaggcttctaaaaaaatatctgctattctttcatgggagaacacaaagaaagcgaacatagaagctgaactgaagaagattgaggagcaactggaaaagaagaaggctgaatatgctgagaagatgaagaacaagatcgcaatcatccacaaggaagccgaagagaagcgggccatggtcgaagcaaaacgcggcgaggaggtcctgaaggccgaggagatggctgccaagtaccgcgccaccggccacgctcccaaaaaactcattggatgctttggagcctaagaaacatcccgagtcacaccgagcagaaagtgaataacgtcaatccatgattgcttggttctctcgctctatcaagtgtgtagtttgtcttcaaaagtgtgtaaagcctaccgttgctgtatatacacatattacttccaagacaggcgtttgatggtgtacatgttgaatgcttgacgagcaacattcttatgtgtagttaagaagtcacattgttgttgttgttgacatttaagcagacatttcgttcttttcaaaaaaaaaaaaaaaaaaaa

SEQ ID NO: 4104 - protein, 207 aa, Panicum virgatum
  misc_feature: Ceres CLONE 1796814
  misc_feature: The sequence is a functional homolog of  SEQ ID NO 1773 in the  11/479,226 US patent application
  misc_feature: The sequence is a functional homolog of  SEQ ID NO 20 in the  10/286,264 US patent application
  misc_feature: The sequence is a functional homolog of  SEQ ID NO 438 in the  10/666,642 US patent application
  misc_feature: The sequence is a functional homolog of  SEQ ID NO 496 in the  11/435,388 US patent application
  misc_feature: The sequence is a functional homolog of  SEQ ID NO 876 in the  10/412,699 US patent application
  misc_feature: Useful for making plants with modulated growth and phenotype characteristics
MAEEEAKKVEVEVAQEPEAAPAPAAEPAKEDVAEEKAVIPATEPPAAEEKPAADSKALAIVEKVADEPAAEKPAAEKQGSSNDRDLALARVETEKRNSLIKAWEENEKTKAENKASKKISAILSWENTKKANIEAELKKIEEQLEKKKAEYAEKMKNKIAIIHKEAEEKRAMVEAKRGEEVLKAEEMAAKYRATGHAPKKLIGCFGA

SEQ ID NO: 4105 - DNA, 2424 bp, Panicum virgatum
  misc_feature: Ceres CLONE 1796829
  misc_feature: Encodes the peptide sequence at SEQ ID NO. 4106
cctccccctcccctttccttctcctccctcgtgccgcggctcctctcccacctcccctctttgcctctcccaggtcatggcaaagctggagcagcagagaaaatagtagcagcaagtgggagataaactgaggagctaggtgaatactacaagtaccaggacaaggaaggaaaagtctatctgcctgtgactgcgagtgagtttggttgggtgctgccgtgtctgttgaggtcacgatgatgggaggtgggctgatgatggatcagggcatggtgttccctggcgtccacaatttcgtggatctcctgcagcagaacggcgacaagaacctcggctttgggtcgctgatgccgcaaacttcgtctggcgaccagtgcgtgatgggagagggtgatcttgtcgatccgccgccggagagcttcccggatgccggggaggacgacagcgatgacgacgtcgaggacatcgaggagctggagcgccgcatgtggcgcgaccgcatgaagctgaagcggctcagggagctgcagcagacccgcggcaaggaccaggcggctggcggcggtggtgggggcgatgggtcgtccaagccaaggcagtcgcaggagcaggcgcggcgcaagaagatgtcccgcgcgcaggacggcatcctaaagtacatgctcaagatgatggaggtgtgccgcgcgcaggggttcgtgtacgggatcatcccggagaagggcaagccggtgagcggcgcctccgacaacctccgtgcctggtggaaggagaaggtccggttcgaccggaacggcccggccgctatcgccaagtaccaggctgacaacgccgtccctggcgccgagaacgagctcgcctccggtgccgccagcccgcactccctgcaggagctgcaggacaccacgctcggctcgctgctctcggcgctgatgcagcactgcgatcccccgcagcggcgctacccgctggagaagggcgtgccaccgccgtggtggcccaccggcgacgaagagtggtggccggagctcggcatccccaaggaccagggcccgcccccctacaagaagcctcacgacctcaagaaggcctggaaggtgagcgtgctcaccgctgtcatcaagcacatgtcgccggacatcgagaagatccgccgcctcgtccgccagtccaagtgcctccaggacaagatgaccgccaaggagatctccacctggctggcggtcgtcaagcaggaagaggaactgtacctgaagctgcaccccggcgcgcgcccgccggcgtctgccggcggcatcgccagcgccatatcgttcaacgccagctcaagcgagtacgacgtcgacatcgttgacgagtgcaagggcgacgaggccggcaaccagaaggcggccgtcaccgacccgaccgcgttcaaccttggcgcggctatgctgagcgacaagttcctcatgccgacgccgatgaaggaggagactgctgacgttgagttcatccagaagaggaacgcgcccgccgccgcggagccagagctgatgctgaacaaccgcgtgtacacctgcaacaatgtccagtgcccgcacagcgactacagctacggattccttgaccggaacgcccgcaacagccaccagtacacctgcaagtacaacgatcctctcccgcagaactctgagaacaagccgccgcctccacagtcacaaaccttccaggggtccttcaaccaacctaaccaggcgctgaacaatctggatttcagcctgcctatggatggccagaggtccatcgcagagctgatgaacatgtacgacaacaacttcatgacgaacaagagcatgagcagcgacagtgtcagcatcatggagaggcctaacgcgctgcccccgaagatgcagatggatgatggtttctttggacagggcaacggtgtgttcgatgatgtcaatagcatgatgcagcaaccacagcaggcgccggggcagcagcagcagcagcagcagcagcaaccggaacagcagcagttcttcatccgcgacgacactccctatgggagccaaatggccgacatcaccggcacatcggagttcaggtttggttctggtttcaacatgtctagcaacgtcgactacccaggcgcggcgcagcagaagaacgatggccccaattggtactactgaagaataaagttgtagggcttaaaaacctctctacaagctttggatttccccatggtgctccttggcttccatgtggggagcgtctcctaagttgtcaagtctataggtcttgtcatataggttttgcaggagctgcaagaaggctggaacttggaagtgatttatacttgtatgtccgtccagccataaacctcttatgaaaacttaatgttatttctagttgaattaaaaaaaaaaaaaaaaaaaa

SEQ ID NO: 4106 - protein, 646 aa, Panicum virgatum
  misc_feature: Ceres CLONE 1796829
  misc_feature: The sequence is a functional homolog of  SEQ ID NO 1358 in the  11/479,226 US patent application
  misc_feature: Useful for making plants with modulated growth and phenotype characteristics
MMGGGLMMDQGMVFPGVHNFVDLLQQNGDKNLGFGSLMPQTSSGDQCVMGEGDLVDPPPESFPDAGEDDSDDDVEDIEELERRMWRDRMKLKRLRELQQTRGKDQAAGGGGGGDGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLHPGARPPASAGGIASAISFNASSSEYDVDIVDECKGDEAGNQKAAVTDPTAFNLGAAMLSDKFLMPTPMKEETADVEFIQKRNAPAAAEPELMLNNRVYTCNNVQCPHSDYSYGFLDRNARNSHQYTCKYNDPLPQNSENKPPPPQSQTFQGSFNQPNQALNNLDFSLPMDGQRSIAELMNMYDNNFMTNKSMSSDSVSIMERPNALPPKMQMDDGFFGQGNGVFDDVNSMMQQPQQAPGQQQQQQQQQPEQQQFFIRDDTPYGSQMADITGTSEFRFGSGFNMSSNVDYPGAAQQKNDGPNWYY

SEQ ID NO: 4107 - DNA, 2342 bp, Panicum virgatum
  misc_feature: Ceres CLONE 1796858
  misc_feature: Encodes the peptide sequence at SEQ ID NO. 4108
aggaactccccctttcttctcttcgctggcaactggcaaggcaaccggagccgccgccggaaacaggaagggcagggggatcccggaggcaggcacgtgcgcgcgcgagcaccggaaccaggcgggcaggcggctgcagtgccggcgggacctcgcaagacctgagcggagcgattgaagcgcctcgtcgacgcgcttgctggccgccgctaggttgcgtaaagggcgcgggttccgagctctggccgcatggcgccgtcggccgcggaggcggactcggcggcgtcctccagcggacgcctcctcgtgctctacgcctcgcaaaccgggaacgccatggtcgccgcggagcgcgtcggccgcgaggcggagcgcgggggctgccctgccgtcgacgtgctctccatggacggcttcgatcccagtcgcttgccgagagagcggttcgtggtcttcgtcgtgtccaccacggggcagggggaccccccggattccatgaaggggttttggagatacctgcttcggaaggatctgggcgcgcaatggcttgagggggtccgtcatgcagtgtttggactcggggattcaggctaccagaagtacaattttgccacaaagaagcttgatagaaggctttcacatcttggtgcagaacgagttgcagagataggcttgggagacgatcagcatccttctggatatgaaggggctttagatccttggttgctgtctttgtggaaatctctgaatgaaactaatcagtcactcttaccgagagtgtctgatatcaatgatcctaatttgagtactttgggggatccaaaagctcatgtcatatattactcttccaatgaggtttcacaagattctgtactttcagaccccaaaaaaataataaatagtgcaagaacaatgtcccctgcgctacagtttcataatgatggagggccaccttacatgcttcgaatggtagcaaatcagcgtctgactgaggagggttctgacagagatgttcgccactttgagttggaagatccatcctctgccatcaattataaaactggcgatactctagaaatactgccaagtcaaaatccatcagctgttgatgccttcattgaacgctgtaacttggatccagattgttacataacgattcaagggacaagtgataataaaatttccaagggttcagctgtgagtagcctgatggatcgcatcaaactgaagacctttgttgctttgacaatggatattgcatcagcatcccctcggcggtacttctttgaggtcatgagcttttttgcaacagctgaacacgaaaaggagaaacttcagtattttgcttctcctgagggaagagatgacctttaccagtacaatcagaaggagagtaggactgttctagaagtgttggaggattttccttcagttcaaatgccttttgaatggttggtgcaactaacacctccattgaagaaaagagccttttccatctcatcatccccattggcacatccgaatcaaatacacttgactgttagcattgtatcatggcttactcctttcaagagaacacgtcatgggctctgttctacttggctggctgggctcaatccaagaaaagacaatcttatcccatgttggatacgccaaggatccctgcctcctccacatccatcagttcctcttgtgcttatcggaccaggaacaggatgtgcgccattccgtgcattcgtggagaaaagagctgcacagactgtagcagaaccaacggccccggttctattcttctttggctgtaggaatcaagataatgattttctatacaaggatttctggttaactcatgcccaggatgagggggtgctttcctccaaaaaaggtggtggtttgtttgttgctttttccagggatcagcctcaaaagatctatgcacaacataagataaaggaacagagtgcaagagtctggaacttattactctctggtgctgcggtgtacattgctggctcttcaacaaaaatgcctgctgatgttacagccgcactagaagaagtaatctgtaaagaacatggtgtcaaaaaagaggacgcctcaaaatggctcagggatctagaaagggttggtagatttaacattgagacttggtcatagttgagagttgtgatgcttctgagttatcgggggcaagaaagtacatactgtcagaattccaacacaaatatatttattgagtatgagatcggggagagcttcagtaaatcgttggtgttgaaaatgtagaaacatacatgtgcagaaatacaaaaagtttcctataaaaaaaaaaaaaaaaaaaa

SEQ ID NO: 4108 - protein, 635 aa, Panicum virgatum
  misc_feature: Ceres CLONE 1796858
  misc_feature (1)..(118): Pfam Name: NAD_binding_1 Pfam Description: Oxidoreductase NAD-binding domain
MAPSAAEADSAASSSGRLLVLYASQTGNAMVAAERVGREAERGGCPAVDVLSMDGFDPSRLPRERFVVFVVSTTGQGDPPDSMKGFWRYLLRKDLGAQWLEGVRHAVFGLGDSGYQKYNFATKKLDRRLSHLGAERVAEIGLGDDQHPSGYEGALDPWLLSLWKSLNETNQSLLPRVSDINDPNLSTLGDPKAHVIYYSSNEVSQDSVLSDPKKIINSARTMSPALQFHNDGGPPYMLRMVANQRLTEEGSDRDVRHFELEDPSSAINYKTGDTLEILPSQNPSAVDAFIERCNLDPDCYITIQGTSDNKISKGSAVSSLMDRIKLKTFVALTMDIASASPRRYFFEVMSFFATAEHEKEKLQYFASPEGRDDLYQYNQKESRTVLEVLEDFPSVQMPFEWLVQLTPPLKKRAFSISSSPLAHPNQIHLTVSIVSWLTPFKRTRHGLCSTWLAGLNPRKDNLIPCWIRQGSLPPPHPSVPLVLIGPGTGCAPFRAFVEKRAAQTVAEPTAPVLFFFGCRNQDNDFLYKDFWLTHAQDEGVLSSKKGGGLFVAFSRDQPQKIYAQHKIKEQSARVWNLLLSGAAVYIAGSSTKMPADVTAALEEVICKEHGVKKEDASKWLRDLERVGRFNIETWS

SEQ ID NO: 4109 - DNA, 1633 bp, Panicum virgatum
  misc_feature: Ceres CLONE 1796863
  misc_feature: Encodes the peptide sequence at SEQ ID NO. 4110
actccaaatcccgtcgccataaatctcgccgcgcgcgccctctatcccgtccccctccccgctccgccaccggcgccgaagcagagcagagctaagccatggccggctccgaggagcgcgtcgtcgccgtcatcatggttggcggccccactaaagggacgcggttccggccgctgtcgctgaacgtgcccaagccgctcttcccgctcgccggccagcccatggtgcaccaccccatctccgcctgccgccggattcccaacctggcacagatatacctcatcgggttctacgaggagcgggaattctcgctgtatgtctcgtctatctccaacgacctcaggatacccgtcagatacctaagagaggataagcctcatgggtcagctggagggctctacagctttagggattacatcatggaggacagtccgtcacacatagttttgctgaactgcgacgtctgttctagcttccccctaccagacatgctagaggcccataaaaaatatggaggaatgggtactttactagttaacaaggtatctgcagagtcagcaaaccagtttggcgagttggtagctgaccctgaaacaaacgaacttctgcactacacggaaaaaccagagacttttgtgagtgatctcataaactgtggagtgtatatatttactcccaatatctttagcgccattgaggatgtcttaaaacagaagaaagacagagcaaatttgcgccgtgtatctagctttgaagctcttcaatcagcaaccaaggcacttccagcagacttcgttaggttagatcaagatattttatcccctctagcgggaaagaaggagctgtatacataccagacacttgatttttgggaacagatcaagacaccagggatgtctttgagatgttctgggttatatctttctcagttccgtcgtacatctcctcatcttttagcctcaggagatggcaaaaggactgcaactattgtaggcgatgtgtacatccatccatctgccaaggtgcatcctacttcaaagattggtcccaatgtctctatatcagctaatgcgcgggttggagctggtgccaggcttatcaattgcataattctggatgatgttgaaattatggagaatgcagttgttatacattcaattgtggggtggaagtcatccattggaaaatggtcacgtgtacagggcgaaggtgatcacaatgccaaacttggcattactattcttggtgaagctgttgatgttgaagatgaagtagttgtagttaacagcattgtgctcccaaacaaaacgctcaacgtcagtgtccaagaggagatcatcctataacagccatcaattttttttttttgttaatcccaaataagttctgaagaccatccacgtagtttctgtttattcgctcttaccacataaggttcagtagattgagattattattagtctgtgtctgtacccttcttgtgatgtgatacggcacaatcttcttgacctgttactaatttggttggttagtgtggtggtttagaaaatgtaaaaacatgcgacaccatttttgttgagaatgaatactttactatcaaatgtcagttgtttaaaaaaaaaaaaaaaaaaaa

SEQ ID NO: 4110 - protein, 415 aa, Panicum virgatum
  misc_feature: Ceres CLONE 1796863
  misc_feature (1)..(204): Pfam Name: NTP_transferase Pfam Description: Nucleotidyl transferase
MAGSEERVVAVIMVGGPTKGTRFRPLSLNVPKPLFPLAGQPMVHHPISACRRIPNLAQIYLIGFYEEREFSLYVSSISNDLRIPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFSAIEDVLKQKKDRANLRRVSSFEALQSATKALPADFVRLDQDILSPLAGKKELYTYQTLDFWEQIKTPGMSLRCSGLYLSQFRRTSPHLLASGDGKRTATIVGDVYIHPSAKVHPTSKIGPNVSISANARVGAGARLINCIILDDVEIMENAVVIHSIVGWKSSIGKWSRVQGEGDHNAKLGITILGEAVDVEDEVVVVNSIVLPNKTLNVSVQEEIIL

SEQ ID NO: 4111 - DNA, 1310 bp, Panicum virgatum
  misc_feature: Ceres CLONE 1796871
  misc_feature: Encodes the peptide sequence at SEQ ID NO. 4112
aaaggatcggaggagaggctgcaagggaggagaaggtcgtcgccgtcgatcgacacatatatgcagggcggtggtgatcaaggagggagcctgggcatggacgtgggcttcgccggcggcgccgagtgctcgtcgtcttcggccgcggcggcggcggccgcggcagccgcggcggaggcggaggagcggcagctgctcaagggggagatcgcggtgcacccgctgtgcgagcagctggtgacggctcacgtggggtgcctgcgcgtggcgacgcccatcgaccacctccccctcatcgacgcgcagctggcgcagtccagcggcctcctccactcctacgccgcccaccaccgccccttcctctccccgcacgacaagcacgacctcgactccttcctcgcgcagtacctgatgctgctgtgctcgttccgcgagcagctgcagcagcacgtccgggtgcacgccgtcgaggccgtcatggcgtgccgcgagatcgagcagtcactgcaggacctaaccggcgcgacactggaggaaggcacaggggcgaccatgtcggaggacgaggacgagccgccgatgctggagggggcactggacatgggctccgacgggcaggacatgatgggcttcggcccgctcctgcccaccgattccgagcgctcccttatggagagggtcaggcaggagctcaagatcgagctcaaacagggtttcaagtcaagaatagaggatgtgagggaagaaatccttcggaaaaggagggccgggaagctgcctggggacaccaccagcatcctcaagcaatggtggcagcagcactccaagtggccataccccacggaagatgataaggcgaagcttgttgaagagactagcctgcagctgaaacaaatcaacaactggttcatcaaccagaggaagaggaattggcacaacaactcccagacgtcaaccctcaaatcaaagcgtaaaaggtgatggagatcgagctgcacaatgtatacctgatacatataccaacaacgctaatcaaacggagctggaccatggtgactctcaaaaaataaaagaggatcgaccgattcaactgtatatctagtcattagtcagaggtgacagtttcatgacacacacacacactagtctgaccactggcatatttgtttgctgtgatttttatttgagctcgtatgctcaaaccatgcatattattcttgttactgtatagatatagtttgtccccactgtacgtatataatctgatctgaggattaattcattccctggaaaaaaaaaaaaaaaaaaaa

SEQ ID NO: 4112 - protein, 306 aa, Panicum virgatum
  misc_feature: Ceres CLONE 1796871
  misc_feature: Great-hit functional homolog of the protein sequence given in SEQ ID NO 9197
  misc_feature: Great-hit functional homolog of the protein sequence given in SEQ ID NO 9492
  misc_feature (1)..(59): Pfam Name: Homeobox Pfam Description: Homeobox domain
  misc_feature: The sequence is a functional homolog of  SEQ ID NO 709 in the  10/374,780 US patent application
  misc_feature: Useful for making plants with altered Lignin content
  misc_feature: Useful for making plants with altered terpenoid content
  misc_feature: Useful for making plants with modulated growth and phenotype characteristics
MQGGGDQGGSLGMDVGFAGGAECSSSSAAAAAAAAAAAEAEERQLLKGEIAVHPLCEQLVTAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEPPMLEGALDMGSDGQDMMGFGPLLPTDSERSLMERVRQELKIELKQGFKSRIEDVREEILRKRRAGKLPGDTTSILKQWWQQHSKWPYPTEDDKAKLVEETSLQLKQINNWFINQRKRNWHNNSQTSTLKSKRKR

SEQ ID NO: 4113 - DNA, 2127 bp, Panicum virgatum
  misc_feature: Ceres CLONE 1796897
  misc_feature: Encodes the peptide sequence at SEQ ID NO. 4114
acagagaatcagagctgtctgggtgaaagggcaaagggactaagggcgtcagaagggtagaggccggctgactgagtttggtgtctccttcaggctcctctcggggctttccatggatttgatcagcagaagggtggttttcaaggccctggtgttcctctgcttcatcagatcatctcaaggaagagatcatttcaccaaactgaatctccctcccttcctgaaggcaagcaggttccccacatttcagcatgaggcatatgactacatcattgtcggcgggggcactgctggatgcccattggcatcgaccctgtcccagaagttcaaggtactcctactggagagaggtgggtctccatacggcaaccgcaacatcacgttactggagaacttccacatttgcctggccgatgtttcgccagaatcaccagcacaaggttttatctcaactgatggtgtgatcaatgcccgtgcaaaggtcctgggtggtggaacctgtataaacgccggcttctacagcagggcaaaaccaagcttcgtgcagcaggcaggctgggatgcagacctggtcaaccagtcctacccttgggttgaagagaggattgttcattggcccaaagttgcaccttggcaagctgcactccgggatggactgctggaagcaggggtctcaccatacaatggatatacttatgaccatctctatggaactaaggttgggggcaccatatttgatgagactgggtaccggcacacagctgctgacctccttgctgctgcaaatcctaacaaccttagggtgctgctttatgctagcgtgaacaaaatagttttcaacacaaaacaagggcataggaagccaagggctattggcgttcaattcaaagatgagaacggcaggcaccaccaagccttcctcagagaagaaaggggtagtgagatcattgtttctgccggtgcaattggcagcccacaactattgttgctcagtggaatcggaccaaggaatgaacttaagaagcacaatatttctgtaaccatccgcaatgaacatgttggtaaagggatgtcggacaatccaatgaactcaatctttgtacctatgaagagtccaacaaagcaatctctcattgaaactgtcggaataaccgatgctggtgtgtttattgaagctagcagtggattcagccagacagatgatagcatccattgccaccatggaatcatgtctgctgagattggccagctatcaacaattccaccaaagaaaagaagtttcaatgcaatccaaaagtatgtggataacaaatatagcctaccgaaagaagtatttgatggaggtttcattcttgagaagatcgatggcccgctgtctactggcaatttagtacttgtggacactgatgttgatagcaaccccagtgtcaccttcaattatttccagcatccaaaggatctcagccgatgtgtctacgggataaaaaccattgagaaaatacttaagacaaaccatttcactaaccttactgccaatggtgctggatacccaatggagacgctgctcaatatgagcatatcagctaacataaacttgataccaaagcacacgaatgacaccacatccttggagcagttttgcagggacacagtaacaaccatctggcattaccatggtggatgccatgtaggcaaagtggttgatcaacagtaccgggtgattggcatttcagggctgcgcgtggttgatgggtcaaccttatttagatcaccaggaacgaacccacaagccacagtcctgatgatgggcaggtacatgggggtgaagattctaagggaaagactaggacaagcagctggagtataacagattcatggaccttatccactctatcatgtaagaatgtgacttaggagataagtacatagtgatttttgaagccattcatcatgattcatgaatagccaaagaaagaaaagttaggagttccatttgtaatgttattgttcatggggaagtatatggaccatcacaattgtgcattggctccacatgtataccactcttgcttcaacagatcttatgataatgttctacattttggacaaaaaaaaaaaaaaaaaaaa

SEQ ID NO: 4114 - protein, 584 aa, Panicum virgatum
  misc_feature: Ceres CLONE 1796897
  misc_feature (1)..(157): Pfam Name: GMC_oxred_C Pfam Description: GMC oxidoreductase
  misc_feature (1)..(284): Pfam Name: GMC_oxred_N Pfam Description: GMC oxidoreductase
MDLISRRVVFKALVFLCFIRSSQGRDHFTKLNLPPFLKASRFPTFQHEAYDYIIVGGGTAGCPLASTLSQKFKVLLLERGGSPYGNRNITLLENFHICLADVSPESPAQGFISTDGVINARAKVLGGGTCINAGFYSRAKPSFVQQAGWDADLVNQSYPWVEERIVHWPKVAPWQAALRDGLLEAGVSPYNGYTYDHLYGTKVGGTIFDETGYRHTAADLLAAANPNNLRVLLYASVNKIVFNTKQGHRKPRAIGVQFKDENGRHHQAFLREERGSEIIVSAGAIGSPQLLLLSGIGPRNELKKHNISVTIRNEHVGKGMSDNPMNSIFVPMKSPTKQSLIETVGITDAGVFIEASSGFSQTDDSIHCHHGIMSAEIGQLSTIPPKKRSFNAIQKYVDNKYSLPKEVFDGGFILEKIDGPLSTGNLVLVDTDVDSNPSVTFNYFQHPKDLSRCVYGIKTIEKILKTNHFTNLTANGAGYPMETLLNMSISANINLIPKHTNDTTSLEQFCRDTVTTIWHYHGGCHVGKVVDQQYRVIGISGLRVVDGSTLFRSPGTNPQATVLMMGRYMGVKILRERLGQAAGV

SEQ ID NO: 4115 - DNA, 2087 bp, Panicum virgatum
  misc_feature: Ceres CLONE 1796914
  misc_feature: Encodes the peptide sequence at SEQ ID NO. 4116
ccttcaggaggcgccsagctagcaccaccaccaccagcagcagcacaaggttggttgaaccaatcgcctgttgcacaaggtcaccaacccgattgacaggccagttcatccgagagcgagctcggtcgccggagagatgggttccgtggacgagtcggtggcggcggcggtggcggcgcccgcggcggaggtggtgttccggtccaagctgccggacatcgagatcaacaacagccagccgctgcacacgtactgcttcggcaagatggccgaggtggcggggcggccctgcctgatcgacgggcagaccggcgcgtcctacacctacgcggaggtggagtccctgtcgcggcgcgccgcggcggggctccgccggatgggcgtgggcaggggcgacgtggtgatgaacctgctccgcaactgccccgagttcgccttctcgttcctgggcgcggcgcggctgggcgccgccaccaccacggcgaacccgttctacaccccgcacgagatccaccggcaggcggaggcggcgggcgccaggctcatcgtcaccgaggcctgcgccgtggagaaggtgcgcgagttcgcagccgcgaggggcatccccgtggtcaccgtggacgggcgcttcgacgggtgcgccgagttcgccgaggtcatcgcggcggaggagctggaggccgacgccgacatccagcccgacgacgtcgtcgcgctgccctactcctccggcaccaccggcctccccaagggcgtcatgctcacgcaccgcagcctcatcaccagcgtcgcgcagcaggtcgacggcgagaacccgaacctgcacttccgcacggacgacgtgctgctgtgcctgctgccgctgttccacatctactcgctcaactcggtgctgctggcggggctccgcgccggctgcgccatcgtgatcatgcgcaagttcgacctgggcgcactcgtggacctggtgcgcgcgcacggcgtcaccatcgcgcccttcgtgccgcccatcgtggtggagatcgccaagagcccccgggtcaccgccgccgacctcgcctccatccgcatggtcatgtccggcgccgcgcccatgggcagggagctccaggacgccttcatgaccaagatccccaacgccgtgctcgggcagggctacgggatgacggaggccgggcccgtgctggccatgtgcctggccttcgccaaggagccgttccaggtcaagtccgggtcctgcggcaccgtggtgcggaacgccgagctcaagatcgtcgaccccgacaccggcgccgccctcggccggaaccagcccggcgagatctgcatccgcggcgagcagatcatgaaaggttacctgaacgaccccgagtccacgaagaacaccatcgacaaggacggctggctgcacaccggggacatcggctacgttgacgacgacgacgagatcttcatcgtcgacaggctcaaggagatcatcaagtacaaggggttccaggtgccgcctgcggagcttgaggccctcctcatcacgcacccggagatcaaggacgctgctgtcgtatcaatgaaggatgatctcgccggtgaaatcccggtcgccttcatcgtgcggacagaagggtctcaactcaccgaggatgagatcaagcaatttgttgccaaggaggtggttttctacaagaagatccacaaggtcttcttcaccgactccatccccaagaatccttcaggcaagatcctaaggaaggacttgagagccaggctcgccgccggtgtccactgaggccgcagtgtttcagtcggccacactgttgagaaaaggccatgcaataggtggtaccattgttcatgaaatggcagcagaaggggcacctaatcttgtggaaacatatatgttgccgaaagaggttttagtttgtttgttggttggccctgtgtggtgtaatgttcataaatgatatatatagatgcatctagctatattgtttttgaccaaacgaacaaggctgattacggcaatacagtaatgtataccatgtttaaatggtatggattcatcttaaagttacgcatggcctgttctt

SEQ ID NO: 4116 - protein, 549 aa, Panicum virgatum
  misc_feature: Ceres CLONE 1796914
  misc_feature: Great-hit functional homolog of the protein sequence encoded by LOCUS At1g51680
  misc_feature: Great-hit functional homolog of the protein sequence encoded by LOCUS At3g21240
  misc_feature: Great-hit functional homolog of the protein sequence given in SEQ ID NO 9251
  misc_feature (16)..(548): SWISSPROT Homolog: EC 6.2.1.12 4-coumarate--CoA ligase 1
  misc_feature (16)..(548): SWISSPROT Homolog: EC 6.2.1.12 4-coumarate--CoA ligase 2
  misc_feature: Useful for making plants with altered cell wall content and/or composition
  misc_feature: Useful for making plants with altered lignin content
MGSVDESVAAAVAAPAAEVVFRSKLPDIEINNSQPLHTYCFGKMAEVAGRPCLIDGQTGASYTYAEVESLSRRAAAGLRRMGVGRGDVVMNLLRNCPEFAFSFLGAARLGAATTTANPFYTPHEIHRQAEAAGARLIVTEACAVEKVREFAAARGIPVVTVDGRFDGCAEFAEVIAAEELEADADIQPDDVVALPYSSGTTGLPKGVMLTHRSLITSVAQQVDGENPNLHFRTDDVLLCLLPLFHIYSLNSVLLAGLRAGCAIVIMRKFDLGALVDLVRAHGVTIAPFVPPIVVEIAKSPRVTAADLASIRMVMSGAAPMGRELQDAFMTKIPNAVLGQGYGMTEAGPVLAMCLAFAKEPFQVKSGSCGTVVRNAELKIVDPDTGAALGRNQPGEICIRGEQIMKGYLNDPESTKNTIDKDGWLHTGDIGYVDDDDEIFIVDRLKEIIKYKGFQVPPAELEALLITHPEIKDAAVVSMKDDLAGEIPVAFIVRTEGSQLTEDEIKQFVAKEVVFYKKIHKVFFTDSIPKNPSGKILRKDLRARLAAGVH

SEQ ID NO: 4117 - DNA, 1415 bp, Panicum virgatum
  misc_feature: Ceres CLONE 1796942
  misc_feature: Encodes the peptide sequence at SEQ ID NO. 4118
atcccccactgcacaacgctccctgctagataactgcatctgcgtccaggcaccggcctatagctgctatagctatcaagattcaaatataatcagccatggcgtctaggcctctcagcagcagcagcaagtccatggtgatcatgcgcgtcgttgttgctgcgctcgtcttctcggcggccacgaccgccatggctgctgggctgcagatggatttctacagcagcacctgcccggacgtggagcagatcgtcaaggaggagatggtggagatcctcagggcggcgccggcgctggccggcccgctgctccgcctccacttccacgactgcttcgtccggggctgcgacgcctccgtgctgctggactcgacgcccaccaatacggcggagaaggacgccaagcccaacctcaccctgcgcggcttcggctccgtgcagcgggtcaaggataggctcgagaaggcctgcccgggcaccgtctcctgcgccgacatcctcgcgctcatggcgcgcgacgccgtggtgctcgccaggggcccctcctggcccgtcaccctcggccgccgcgacggccgcgtctccgtcgccaacgagaccaagcagctgcccccgcccaccgccaacgtcaccaccctcgtccggatgttcgccgccaagggcctcggcgtcaaggacctcgtcgtgctctccggcggccacaccctcggcaccgcgcactgcaacctcttcagcgaccgcctctacaacttcaccggcgccaacaacctcgccgacgtcgacccggcgctcgacgccacctacctggcccgcctccggtcccggtgccggagcctcgccgacaacaccacgctcaacgagatggaccccggcagcttcctcagcttcgacgccagctactaccgcctggtggccaagcgccgggggctcttccactcggacgccgcgctgctcacccacccgaccaccagggcctacgtccagcgccaggccaccggcctcttcgccgacgagttcttccgtgacttcgccgactccatggtcaagatgtccaccatcgacgtgctcaccggagcgcagggcgagatcaggaaaaagtgctacctcgtcttaaactaactcatcatcatgaccatcgatctcgatcgcttttgctgctgcttccgtttcgtttgcattatattatatatattatattgttggtcgattcaattattcgttgcttggttggtacatacatatacatgatcagtatatatcaattacgcgtgaatcaagttctaaagttattttgctttgactctggccgtcagtaactgctgctgccgcctatgtaacatctatatgtaaactcctgatgtatatgtagactgagtgccatggatctttcttctttaaaaaaaaaaaaaaaaaaaa

SEQ ID NO: 4118 - protein, 339 aa, Panicum virgatum
  misc_feature: Ceres CLONE 1796942
  misc_feature: Great-hit functional homolog of the protein sequence given in SEQ ID NO 9530
  misc_feature (1)..(249): Pfam Name: peroxidase Pfam Description: Peroxidase
  misc_feature (13)..(337): SWISSPROT Homolog: EC 1.11.1.7 Peroxidase 1 precursor
  misc_feature (8)..(334): SWISSPROT Homolog: EC 1.11.1.7 Peroxidase 27 precursor
  misc_feature: Useful for making plants with modulated nitrogen use efficiency
MASRPLSSSSKSMVIMRVVVAALVFSAATTAMAAGLQMDFYSSTCPDVEQIVKEEMVEILRAAPALAGPLLRLHFHDCFVRGCDASVLLDSTPTNTAEKDAKPNLTLRGFGSVQRVKDRLEKACPGTVSCADILALMARDAVVLARGPSWPVTLGRRDGRVSVANETKQLPPPTANVTTLVRMFAAKGLGVKDLVVLSGGHTLGTAHCNLFSDRLYNFTGANNLADVDPALDATYLARLRSRCRSLADNTTLNEMDPGSFLSFDASYYRLVAKRRGLFHSDAALLTHPTTRAYVQRQATGLFADEFFRDFADSMVKMSTIDVLTGAQGEIRKKCYLVLN

SEQ ID NO: 4119 - DNA, 2031 bp, Panicum virgatum
  misc_feature: Ceres CLONE 1796946
  misc_feature: Encodes the peptide sequence at SEQ ID NO. 4120
acatactctatcccctgcctttcatcattccttcttcatctcttatcttccaaacacatacggacacacagaagctgaacgggagaagagatagatacaaggttacaaacacaaagatgaggcttggtctaaaaggtctcaccttcctgcttctccttgtcttgcttgttctgtgctccagcatttgtctatgcgatgcgagaagcgggaagcattggaggcgaagcagagcgacctccacctctatgctaagaaaagggaaaccaaagagcagcagttcccacaagcaaaacggcaaaggaattcagaatccataccagccaagtccgagcacaagccctgtcagcccaagcagaagccctgtccatggcaaaggaagccagggtccaacaatgccaacaccaggcggtggaagtggatgtacagtgccacctccaccactgctgcagccgcctccaccgccgtctccaccggcagagcaggacacagtcttcaacgtggtcgattttggagccaagggtgatggggttacggatgatactcaggcttttgaagcagcatgggcagcagcatgcaaggtggaggcatctacggttcttataccatatgaactcgagtttgtcgttggcccaatctcattttctgggccttactgtaaaccaaacattctattccagctggatggaactattttagctcaaactagtgcgagagtgtggggttctggtttgcttcaatggcttgagttcacaaagctaactggaatagcaatccaaggcagtggtgtaataaatggtagggggcaagaatggtggacctactcagatccaaatgatgacgatgacgatgatgcattcagagtggagctagacaagatgccacagattaaacctacggcactgagattttatggcagttccaatgtcacagtaacgggtatcacaattgttaacagctcacagtgccatctgaagtttgatagctgtcaaggagtcatggttcacgatttaaccatctcttcccctgagaatagtcccaacaccgatggaatacacctgcaaaactccagagaagtcaacattcaccacactaacatggcttgcggtgatgactgtgtttccatccagacaggatgcagtgacataaacatacataacgtgaactgtggaccaggccatgggatcagcattggtggtctagggaggtacaacacaaaagcatgtgtatctaacgtcactgtaagagatgtcaacatgttcaaaacaatgaatggtgtcagaatcaagacttggcagggtggttccgggctggttcagggtataaggttctcaaacatacaggtctcagaagttcaaacgcctatcatcatagaccaattctactgtgacaaaacaacatgcagaaatcaaacttcagcagtggctgtttcaggtgttcagtatgagaacatcagggagactttcacaattaaaccggcccacttcgcgtgcagcgacaactcaccttgttcagatatcactcttactggaatacaactcaaacccgtgatagtaccacagtaccacctatacaaccccttctgctggcaagcctttggagtgctgtacacccctaccgtacctcccatagcttgcttgcagatcggcaaaccagctgggaacagcgtgctgtcagatggtgacctttgctgaaaggctgaggctcttgagaaggagcggaagtgctcaagtgccttaatagggacaatattgtttgtgtccatcagacatcagttaaggcggtcgtcgtgattcttccgacccctttgcacaatgccgtgtactgtgcatatatgcagctattgtcaggcatcaggatatggcttccatggcacgtgccaactcgcctcttgataggaaatataggaagtcgatgatatagtatagatagtgtttgtccagtgtttccagtgatgtatcatgcatcgtatgagatgcttcaagggaaaacatagaatcagcagtctgcagccaaaaaaaaaaaaaaaaaaaa

SEQ ID NO: 4120 - protein, 524 aa, Panicum virgatum
  misc_feature: Ceres CLONE 1796946
  misc_feature: Great-hit functional homolog of the protein sequence encoded by LOCUS At1g60590
  misc_feature (1)..(338): Pfam Name: Glyco_hydro_28 Pfam Description: Glycosyl hydrolases family 28
  misc_feature: Useful for making plants with altered cell wall content and/or composition
MRLGLKGLTFLLLLVLLVLCSSICLCDARSGKHWRRSRATSTSMLRKGKPKSSSSHKQNGKGIQNPYQPSPSTSPVSPSRSPVHGKGSQGPTMPTPGGGSGCTVPPPPLLQPPPPPSPPAEQDTVFNVVDFGAKGDGVTDDTQAFEAAWAAACKVEASTVLIPYELEFVVGPISFSGPYCKPNILFQLDGTILAQTSARVWGSGLLQWLEFTKLTGIAIQGSGVINGRGQEWWTYSDPNDDDDDDAFRVELDKMPQIKPTALRFYGSSNVTVTGITIVNSSQCHLKFDSCQGVMVHDLTISSPENSPNTDGIHLQNSREVNIHHTNMACGDDCVSIQTGCSDINIHNVNCGPGHGISIGGLGRYNTKACVSNVTVRDVNMFKTMNGVRIKTWQGGSGLVQGIRFSNIQVSEVQTPIIIDQFYCDKTTCRNQTSAVAVSGVQYENIRETFTIKPAHFACSDNSPCSDITLTGIQLKPVIVPQYHLYNPFCWQAFGVLYTPTVPPIACLQIGKPAGNSVLSDGDLC

SEQ ID NO: 4121 - DNA, 1677 bp, Panicum virgatum
  misc_feature: Ceres CLONE 1797024
  misc_feature: Encodes the peptide sequence at SEQ ID NO. 4122
cctgtcatctcacttggccttctgcgacaccaccccctggccagagctcccggctcggcggcgccgcttcgtttcgttgatggattgcgccacccggttccgcatccggaacccttcgccggccgccgcctcccacttcgccggcgagaggcggcgcccgggcggcagggcgtccttccggcccatgtcgtcggcggctccggtggaggagccggcggcgtccgaggcgaggcggcggccgtccggtgactccttcatccggcgccacctcaggaccctcgcgccgtaccagcccatcttgcccttcgaggtgctatctgctcggcttgggcgtagaccagaggacataatcaagctcgatgcaaatgagaatccatatggtccacccccagaggtggctaccgcattaggtaatctaaagttcccctatgtgtaccctgatcctgaaagccgtcacttgcgtgctgctcttgctgaagattctggacttgaatcagaatacatacttgctggatgcggtgcagatgaactaatcgatttaattatgagatgtgtacttgaaccaggtgacaaaattgttgattgccctccaacattcacaatgtatgagtttgatgcttcagtaaatggtgcacttgttatcaaggttccaaggcttccggatttttctctagacgttgaacgtattgttgaagtggttgaacaggaaaagccaaaatgcatatttctgacatctccaaacaatccagatggcagtgtaatcaacgatgaggatcttttaaagatacttgatcttccaatacttgtagtactggatgaagcttacattgaattttcaagccttcagtcaaggatggcatgggttaagaagcatgataatttgattgttctacgaacatttagcaaacgagcaggtttagctggtcttcgtgtgggttatggagcatttcctctaagcattattgagtatttgtggcgggccaagcagccttataatgtttctgtggcagcagaagtttcagcatgtgccgcattgcagaatccaacctatttggagaatgtgaaaaatttactgctacaagagagggagaggctctttgatcttctaaaaggaataccattcttgaaaccgtttcccagtcattctaacttcattctctgtgaggtcacatcaggaaaggatgcaaagaaaataaaggaagaccttgcaaagatgggtgtgatgatccgccactatgacaagaaggaattgaaggggtatattcgtatttcggttgggaaacctgagcacactgatgcactaatgaaaggcctgaatgcacttcaattgtgagcactagcacaccttcaccagttatggaagcattgaagtacttaaccaatatgtatgcatcaggctatagatgcagtctataagaggagatttgcatcattccaacatctaagcccaaactaacatgggccaatcggttttcaacgaccattttgtttaataagtcaaaaattcgatggttttagcaaggttatcgagcagagcaaggctgtaaaagttgaattccatgtggttattttctgggtttggactgcttgtttggcggttgatggagaactgaaaattctgtaggtaaataaaggccaatgcagccatgtttttgtcaaaaaaaaaaaaaaaaaaaa

SEQ ID NO: 4122 - protein, 417 aa, Panicum virgatum
  misc_feature: Ceres CLONE 1797024
  misc_feature: Great-hit functional homolog of the protein sequence encoded by LOCUS At1g71920
  misc_feature (1)..(316): Pfam Name: Aminotran_1_2 Pfam Description: Aminotransferase class I and II
  misc_feature (36)..(412): SWISSPROT Homolog: EC 2.6.1.9 Histidinol-phosphate aminotransferase, chloroplast precursor
  misc_feature: Useful for making plants with modulated nitrogen use efficiency
MDCATRFRIRNPSPAAASHFAGERRRPGGRASFRPMSSAAPVEEPAASEARRRPSGDSFIRRHLRTLAPYQPILPFEVLSARLGRRPEDIIKLDANENPYGPPPEVATALGNLKFPYVYPDPESRHLRAALAEDSGLESEYILAGCGADELIDLIMRCVLEPGDKIVDCPPTFTMYEFDASVNGALVIKVPRLPDFSLDVERIVEVVEQEKPKCIFLTSPNNPDGSVINDEDLLKILDLPILVVLDEAYIEFSSLQSRMAWVKKHDNLIVLRTFSKRAGLAGLRVGYGAFPLSIIEYLWRAKQPYNVSVAAEVSACAALQNPTYLENVKNLLLQERERLFDLLKGIPFLKPFPSHSNFILCEVTSGKDAKKIKEDLAKMGVMIRHYDKKELKGYIRISVGKPEHTDALMKGLNALQL

SEQ ID NO: 4123 - DNA, 1397 bp, Panicum virgatum
  misc_feature: Ceres CLONE 1797044
  misc_feature: Encodes the peptide sequence at SEQ ID NO. 4124
atcgtcccatgcttacagcaacgacacaacacaaataatcagttccgtaactcgcagatagaaagaaaaaaaaatctttcacaaggtctattgtcccagccagcagttgctgatcgcaagccatgagctctcgcatggccggggcagcgctcctgcgccacctgggcccgcgcctgttcgcggccgagccggccgtgtccgggctcgccgcgagaggcgccatgcccgcggccgcgaggatcctccccgccaggatggccagcacggccgcggaggcggcgagagaagatgccggttcgaagcagcacggcagcgcaggcggcaccgagaagcaggaggaggaggcagccggcgggcagagcaagaaggccatcgtcagctactggggcatcgagccgccgaagctcgtcaaggcggacggcacggagtggaggtggccctgcttcaggccgtgggacacgtacacgtcggacacgtcgatcgacatgaagaagcaccacgagccgacgacgttgccggacaaggcggcgtacctgcttgtcaagtcgctgcgggtgcccatggacctcttcttccagcgccggcacgccagccacgcgctgctgctggagacggtggccgccgtgccgggcatggtgggcggcatgctcctccacctgcgctccctgcggcgcttcgagcacagcggcgggtggatccgggcgctgctggaggaggccgagaacgagcggatgcacctcatgacgttcctcgaggtgacgcagccgcgctggtgggagcgcgcgctcgtgctcgccgcgcagggcgccttcttcaacgcctacttcgtcggctacctcgtctctcccaagttcgcgcaccgcgtcgtcggctacctcgaggaggaggccgtgcactcgtacacggagtacctcaaggacctcgaggccggcgtcatcgacaacacgccggcgccggccatcgccatcgactactggcgcctccccgccgacgccaggctcaaggacgtcgtcaccgtcgtgcgcgccgacgaggcgcaccaccgcgacgtcaaccacttcgcatcggacatccattaccaggggatgaagctcaaggactcgccggcgccgctcgggtaccactaatcgacgtggcctgcccagttcagcattatttttacccggtcgtcgtaatatttttgtgctggccaatttgcttagcggatcaggactggtttgctacttgttagtgaaccagttggctatgtattaggttgtactttgtacagattatcgaatctactagaaaggccgcgcagcgcgagacctgatttttatcatttggttgtattctgtgaaattttatttgatacatgaatgaagaacctgcttagcttggtgaaaaaaaaaaaaaaa

SEQ ID NO: 4124 - protein, 334 aa, Panicum virgatum
  misc_feature: Ceres CLONE 1797044
  misc_feature (1)..(282): Pfam Name: AOX Pfam Description: Alternative oxidase
MSSRMAGAALLRHLGPRLFAAEPAVSGLAARGAMPAAARILPARMASTAAEAAREDAGSKQHGSAGGTEKQEEEAAGGQSKKAIVSYWGIEPPKLVKADGTEWRWPCFRPWDTYTSDTSIDMKKHHEPTTLPDKAAYLLVKSLRVPMDLFFQRRHASHALLLETVAAVPGMVGGMLLHLRSLRRFEHSGGWIRALLEEAENERMHLMTFLEVTQPRWWERALVLAAQGAFFNAYFVGYLVSPKFAHRVVGYLEEEAVHSYTEYLKDLEAGVIDNTPAPAIAIDYWRLPADARLKDVVTVVRADEAHHRDVNHFASDIHYQGMKLKDSPAPLGYH

SEQ ID NO: 4125 - DNA, 1641 bp, Panicum virgatum
  misc_feature: Ceres CLONE 1797055
  misc_feature: Encodes the peptide sequence at SEQ ID NO. 4126
atacagaacatatagccaagaaacagcctaaagaaccccaataatggctgatgaaccatggagggtgccgagcgcagtgcaagagctggcggccaacgtgcaggagccgccgagccggtacctggtgccggagcaggaacgcctcggcgaccagctggccggggcggagatgccggagcccgtcccgaccatcgatctccgccggcttctggcgtccgacggcggcgccggcgaggaagccgccaagctgcgctcggcgctgcagagctggggcttcttcctggttactgaccatgggatcgaggcctctctgatggacgccctgatcgccgcgtcgcgggagttcttccgcaagccgctccaggagaagcaagcgtacagcaacctgatcgaagggaagcagtggcagctagaaggatacgggaacgacccggtgaaatcccaggatcaggtcctcgactggtccgaccgattgcaccttcgtgttgagcccgaagacgagaggaacctcgaccgctggcccggccaccctgaatctttcaggggtctgctgaacgagtacacgcggagctacaagcgagtcaaggacgggatcctccgggcgatggccaggctgctggagctcgacgacgacgggtgcatcctgaaccagttcggcgacaagcagggctccacgaacgccaggttcaactactacccggcctgcccgcggcccgacctcgtgctcggcatccggccgcactccgacgtctgcgtcctcacgctgctcctcatggacgagcacgtcgccggcctgcaggtcctccgggacggcacctggtacggcgtcccgccgccgccggtgtgcggcggccgcgccttgctcgtcaacgtcggcgtctccttggagataatgtcgaacgggatcttcagggggccggtgcacagggtggtgaccaactcggagaaggagaggatgtcgctggccatgttctactccgcggacctcgagaaggagatcgagccgatagctgagctgttggatgagaagcagcagccggcaaggtacaggaagattaagttcggggacttcgtggcgactcactatgagtacttctccaggagggaaagagttatcgactcgctaaagatccagggttaaggtgatgcatctttgggttaatgtatactactcctccgttcaaattgtaagtcattcaaactttcttaaaaaagtcaagatatttcaaatttgaccaaatttatataataaaatactaacatttaagatatcaaataattatcaatagattctttattaaatatacttttatagtatatctatttggtgctagaaaaaactttgtaacttttttctataattttggtcaaacaatgactagcaatttgtaacggagggagtagtacagtgcccgtacaaaataaataaataaatgtatgaaaaactatagacattacgggcatgcggtttgtttaacatatatttgtattttgttaagggtagcataggaacagtagtattgtgtgttctgtttattccgtgtctttttctctattttgggcttattatcagttacactcaacccatatatagaatagcagcgaggcccaaattggtgacaaaaaaaaaaaaaaaaaaaa

SEQ ID NO: 4126 - protein, 365 aa, Panicum virgatum
  misc_feature: Ceres CLONE 1797055
  misc_feature (3)..(101): Pfam Name: 2OG-FeII_Oxy Pfam Description: 2OG-Fe(II) oxygenase superfamily
MADEPWRVPSAVQELAANVQEPPSRYLVPEQERLGDQLAGAEMPEPVPTIDLRRLLASDGGAGEEAAKLRSALQSWGFFLVTDHGIEASLMDALIAASREFFRKPLQEKQAYSNLIEGKQWQLEGYGNDPVKSQDQVLDWSDRLHLRVEPEDERNLDRWPGHPESFRGLLNEYTRSYKRVKDGILRAMARLLELDDDGCILNQFGDKQGSTNARFNYYPACPRPDLVLGIRPHSDVCVLTLLLMDEHVAGLQVLRDGTWYGVPPPPVCGGRALLVNVGVSLEIMSNGIFRGPVHRVVTNSEKERMSLAMFYSADLEKEIEPIAELLDEKQQPARYRKIKFGDFVATHYEYFSRRERVIDSLKIQG

SEQ ID NO: 4127 - DNA, 1528 bp, Panicum virgatum
  misc_feature: Ceres CLONE 1797094
  misc_feature: Encodes the peptide sequence at SEQ ID NO. 4128
acacgcccaccgtttcttccactcgtagtcttgctcttgcgcgcgcgcacccacgcccacggggcgcgaaaaccctctgcgtccatctctgggtcggccgccggggagaggagaggagaggagaggaggcgacgtgctcgcgagtgaatcacgctcacgcacgcgcagtgaggtcgagcgttcctccgggccatgggaggttttaggcggtggctgccgttcggcggcggcggtgggtgctgctgctgcgtcggcggcggcggaggcggaggcaggggcgtggcggatgggctggtgtgggacgtgcccctcaaggcgcacgcgtcgggggactactccatcgccgtggcgcaggccaacgaggcgctcgaggaccaggcgcaggtgctcgcggcgccgggcgccacgctcgtcggcgtctacgacggccacggcgggcccgaggccgcgcggttcgtcaacaggcgcctcttctccctcatccaagattacgcggccgagaacgggggcctgtcggcggaggtgctccagaaggccttcggcgcgacggaggacgagttcgtgggcatggtgcagaagtcgtggccgtcgcacccgcggatcgtgtccgtgggctcctgctgcctggtgggcgccatcgagaacgggacgctgtacgtggccaacctcggcgactcccgcgccgtgctcggccgccgcgacgccgcccccgggcgagggaagcgggtggtggcggagcggctgtcccgggaccacaacgtcgccgacgaggacgtgcggcgggaggtggccgagatgcaccccgacgactcgcacatcgtgctcaacagccacggcgtgtggcggatcaaggggatcatccaggtgtcccggtccatcggcgacgtgtacctcaagaggcccgacatgtgccggagcaacccgatgctgcagcagtcgctgtgcccgttcccgctgcgccgccccgtgatgagcgccgtgccgtcgatcatgacccgggagctgcgcccgggcgaccggttcgtcatcctcgcgtccgacgggctgtgggagcagctcagcgacgacgacgcggtgggcatcgtggcgggcagcccgaggaagggcgtggccatgcgcctggtgcgcgccgcgcagctggaggcggcgcggaagaaggaggtcaagtacgagaagatccggaccatcgagaagggccaccggcggcacttccacgacgacatcaccgtcgtggtgctcttcctcgacagctgccgcggcgcggcgcggtccggcgccggggacatcggcggcacctacgcgcccgtcgacgtgttctcctgcagccccgccggcgaccacgaggacccgaccaggcccgtcctgcggcgttgagactgatctctcggttggtgtgctgttctttcgttcggttcatgagatttcgctcttgaaacgagaggtacgcgaatcgagttgcttcccgtttcaagaagaatccgcctgtaaagaaagaaatgtcatcgaacaaaaaaaaaaaaaaaaaaaa

SEQ ID NO: 4128 - protein, 393 aa, Panicum virgatum
  misc_feature: Ceres CLONE 1797094
  misc_feature (1)..(291): Pfam Name: PP2C Pfam Description: Protein phosphatase 2C
MGGFRRWLPFGGGGGCCCCVGGGGGGGRGVADGLVWDVPLKAHASGDYSIAVAQANEALEDQAQVLAAPGATLVGVYDGHGGPEAARFVNRRLFSLIQDYAAENGGLSAEVLQKAFGATEDEFVGMVQKSWPSHPRIVSVGSCCLVGAIENGTLYVANLGDSRAVLGRRDAAPGRGKRVVAERLSRDHNVADEDVRREVAEMHPDDSHIVLNSHGVWRIKGIIQVSRSIGDVYLKRPDMCRSNPMLQQSLCPFPLRRPVMSAVPSIMTRELRPGDRFVILASDGLWEQLSDDDAVGIVAGSPRKGVAMRLVRAAQLEAARKKEVKYEKIRTIEKGHRRHFHDDITVVVLFLDSCRGAARSGAGDIGGTYAPVDVFSCSPAGDHEDPTRPVLRR

SEQ ID NO: 4129 - DNA, 1779 bp, Panicum virgatum
  misc_feature: Ceres CLONE 1797125
  misc_feature: Encodes the peptide sequence at SEQ ID NO. 4130
atatacagccatacaagcacacagcaaccagaacaagttagtgccgtttacacttgcacaataagcgcccgacgagatgggctccatcgccgccgatgccggcaagccacacgccgtgctggtgccgttcgcggcgcagggccacgtcacgccgatgctgaagctgggcaagatcctccacttctggggcttccacgtcaccttcgtgaacacggattacaaccaccgccgcctccaccgctcccgcggcgccggcgcgctcggcggcctcccgggcttccgtttcgccaccatcccggatggcctgccgcagtccgaggcggacgtcacccaggacctgccctcgctctgccgctccacggcggagacctgcctcccgcacttcaggagcctcctcgcggagctcaacgcctccccggacgcaccgccggtcacctgcgtcgtcggcgacaacgtcatgagcttcaccctggatgccgccagggagatcggcgtgccgtgcgcgctgctctggacgtccagcacctgcggctacgtgggctaccggtactcccgcaccctcatcgacgagggcgtcttccctctcaaagaggagcagctgacgaacgggttcttggacacgccggtggacaacgcgcctgggttgagcaagtacacccggttcaaggacctcccaagtttcatccgctcgacggaccccgacgagttcatgctccacttcgctctcaaggtaacagagcagatagccggcgcggacgctgtcatcctcaacaccttgtacgagctcgagcaggaggcggtggacggcatgcgcgccatgatcccgcctgccgcgtccatccacgccgtcggcccgctcgccttgctcgccgagcagatcgtgccccatggaggccagctcgacgcgctgggctccaacctctggaaggaggacgtctcctgcctcgcctggctggagggccggagcgccgggtccgtggtgttcgtcaactacggcagcaccacggttatgaccaacgcggagctgctgaagttcgcgtgggggctggccaacagcggccacgactttgtgtgggtcatccggcctgacctcgtgagcggcgacgccgccgtgctgccgccggagttcctggaggcgatcgaggggcgcggcctgctggcgggctggtgcccgcaggatgccgtgctgcggcacgaggcggtgggcgtgttcctgacgcactgtgggtggaactcgacgctggagagcctgtgcgccggggtgccgatgctgtgctggcccttcttcgcggagcagcagaccaactgccggtacacgtgcgcggagtggggcgtgggcatggagatcggccaggacgttcggcgggaggccgtggaggggaagatacgggaggccatggacggggagaaagggaaggagatgcggcgccgcgcggcggagtggcgggaggccgccgtgcgcgcgacgcggcccggcgggggctcgtacgccagcctcgagaagctggtgaacgacgtgctcctgtcgggcggcaagggctcttgattgcaacctgctactattaggatcggatgcgtgtatgctgctgtgtcctcttggcggtactgctgtatcttcagtgcccgtactgtaataagctaagatggagacgagttgataaatacgtatgtatgggagtaggtgggtggcctggatccttacatagctattgattcccatcactctctcgatcaaaaccataagcacaaaaactaaatgaaaagttgatcgttccatgt

SEQ ID NO: 4130 - protein, 489 aa, Panicum virgatum
  misc_feature: Ceres CLONE 1797125
  misc_feature (2)..(121): Pfam Name: UDPGT Pfam Description: UDP-glucoronosyl and UDP-glucosyl transferase
MGSIAADAGKPHAVLVPFAAQGHVTPMLKLGKILHFWGFHVTFVNTDYNHRRLHRSRGAGALGGLPGFRFATIPDGLPQSEADVTQDLPSLCRSTAETCLPHFRSLLAELNASPDAPPVTCVVGDNVMSFTLDAAREIGVPCALLWTSSTCGYVGYRYSRTLIDEGVFPLKEEQLTNGFLDTPVDNAPGLSKYTRFKDLPSFIRSTDPDEFMLHFALKVTEQIAGADAVILNTLYELEQEAVDGMRAMIPPAASIHAVGPLALLAEQIVPHGGQLDALGSNLWKEDVSCLAWLEGRSAGSVVFVNYGSTTVMTNAELLKFAWGLANSGHDFVWVIRPDLVSGDAAVLPPEFLEAIEGRGLLAGWCPQDAVLRHEAVGVFLTHCGWNSTLESLCAGVPMLCWPFFAEQQTNCRYTCAEWGVGMEIGQDVRREAVEGKIREAMDGEKGKEMRRRAAEWREAAVRATRPGGGSYASLEKLVNDVLLSGGKGS

SEQ ID NO: 4131 - DNA, 1097 bp, Panicum virgatum
  misc_feature: Ceres CLONE 1797154
  misc_feature: Encodes the peptide sequence at SEQ ID NO. 4132
aaaagccaggccaggccagccagccaagccgcactccctccccgagtcctccaccactgccaccgcacgctccgcgacgcgatggccgcgctacgcctcgcctccttcaccctccgcccggccgccgccgcagcatccccctcctccggcgcggcgccgcggtccgcctccttcgcccgcgccgcgcgggggctcccctcgctccgcctggccccgccccgccgccgcggggacctcgccaggccccgcgccgcggccgacgccgcggcggagggctacgcgaccgcgctgtccgaggtggccgccgagaacggcaccctcgagcagaccgtgtccgacttggagaagctggagaagatcttcgccgacgaggccgtcgccgagttcttcgacaaccccaccgtgccgcgcgatgtgaagtcccagctcatcgacgagatcgccaagtcgtccgagctgcagccgcacgtcgtcaacttcctcaacgtcgtcgtcgacaacttccgcgcggggatcgtgccgcagatcgtcgccgagttcgagaacgtctacaacgcgctcagcggcaccgaggtcgccaccgtcacctccgtcgtgcagctcgagtccaaggacctcgcacagatcgcgcagcacgtccagaagatgaccggcgcccagaacgtccgcctcaagacgcagctcgacccggacctcatcgccggcttcaccgtgcagtacggccgcgacggatccaacttcatcgacatgagcgtccggaagcagattgaggagatcgcctcagagttcgagttgccctccgtcgccctcgaagtctgatccggctttaggcgtcaaccctcgcccttgaagcctagccgctactctctgggatgttgccatgttggtcttcttcccgtcgaacctgcagatcaatggtggtggctcaaatacatacggacggacagtttttttctggatttctctttccatttttttgactgggaacgtatgtaatttttttcctcctatttttgcggttgacactgtaatatgtttaaaacactcaaatatagctgagttttctcttcccctctcaaaaaaaaaaaaaaaaaaaa

SEQ ID NO: 4132 - protein, 245 aa, Panicum virgatum
  misc_feature: Ceres CLONE 1797154
  misc_feature (1)..(175): Pfam Name: OSCP Pfam Description: ATP synthase delta (OSCP) subunit
  misc_feature (1)..(245): SWISSPROT Homolog: EC 3.6.3.14 ATP synthase delta chain, chloroplast precursor
MAALRLASFTLRPAAAAASPSSGAAPRSASFARAARGLPSLRLAPPRRRGDLARPRAAADAAAEGYATALSEVAAENGTLEQTVSDLEKLEKIFADEAVAEFFDNPTVPRDVKSQLIDEIAKSSELQPHVVNFLNVVVDNFRAGIVPQIVAEFENVYNALSGTEVATVTSVVQLESKDLAQIAQHVQKMTGAQNVRLKTQLDPDLIAGFTVQYGRDGSNFIDMSVRKQIEEIASEFELPSVALEV

SEQ ID NO: 4133 - DNA, 1696 bp, Panicum virgatum
  misc_feature: Ceres CLONE 1797178
  misc_feature: Encodes the peptide sequence at SEQ ID NO. 4134
acaatttcttatccccctcctcatccatctgctccccctccgaccggcctcgcgcgagaggtgagagccccagcacgagcatggccgaagcagcagccgccgctgtggcgtccgagatctcggcccggccggccgcgctgaggagggccccggccggccgccgcgcccgggtgccggtcgtgcgggccgcgatatccgtcgagaagggcgagaaggcgtacacggtgcagaagtcggagcagatcttcaacgccgccaaggagttgatgcctggaggtgttaattcgccagtccgtgccttcaaatctgttggtgggcaacctatagtttttgactctgtaaagggttctcgtatgtgggatgtggatgggaatgaatatattgattatgttggttcctggggtcctgcaatcatcggtcatgcagatgataaggtgaatgctgcattgattgaaactctgaagaaaggaactagctttggtgctccatgtgtgctggagaatgtattggctgagatggtcatatctgctgtaccaagtatcgaaatggttcgctttgtcaattcagggacagaagcctgcatgggagcactccgccttgtacgtgcgtacactgggagagagaagattatcaagtttgagggctgctaccatggccatgctgactccttccttgtcaaagctggcagcggtgttgctacccttggtctcccagactcccctggagtccccaagggagcaacctacgagactctaactgcaccatacaatgatgctaaggcggtgaagaaattgttcgaggacaacaaaggggagattgctgctgtcttccttgagccagttgttggcaatgctggcttcattccgccacaacctggtttcctcaatgccctccgcgacttgaccaaacagaatggtgcactcctggtctttgatgaagtgatgactggtttccgtttggcttatggtggggctcaagagtactttgggatcacccctgacgtgacaaccatgggtaagattattggtggaggcctccctgttggcgcttatggtgggaggagggacatcatggagatggtcgccccagcagggccgatgtaccaggcaggaactctcagtggaaacccacttgccatgactgctggaattcacaccctcaagcgtctgacagagcccggcacttacaaatacttggacaagatcactggtgacctcgtccgtgggatactggatgctggtgccaaaacagggcatgagatgtgtggaggacacatcagaggaatgtttggtgtattcttcactggcggaccagttcacaactttggggatgccaagaagagtgacaccgagaagttcggaaggttttaccggggcatgctggaagagggtgtctacctggccccctcccagttcgaggcgggtttcaccagcttggcgcacacctcccaggatatcgagaaaaccatcgaggctgctgagaaggttctgaaacggatatagggttcagctccagcggatttgctacttcaatgtgatgtactctgagtttattcactccactgaagttttgtattgtgcagcagtagcagcagtgcagcgtctcttatgtagttcctcttctttctgaacttagattatcgtgtttttgcagtggtaataaaaccgtggttgacgaaaaaaaaaaaaaaaaaaaa

SEQ ID NO: 4134 - protein, 473 aa, Panicum virgatum
  misc_feature: Ceres CLONE 1797178
  misc_feature (1)..(274): Pfam Name: Aminotran_3 Pfam Description: Aminotransferase class-III
  misc_feature (2)..(473): SWISSPROT Homolog: EC 5.4.3.8 Glutamate-1-semialdehyde 2,1-aminomutase, chloroplast precursor
  misc_feature (5)..(473): SWISSPROT Homolog: EC 5.4.3.8 Glutamate-1-semialdehyde 2,1-aminomutase, chloroplast precursor
MAEAAAAAVASEISARPAALRRAPAGRRARVPVVRAAISVEKGEKAYTVQKSEQIFNAAKELMPGGVNSPVRAFKSVGGQPIVFDSVKGSRMWDVDGNEYIDYVGSWGPAIIGHADDKVNAALIETLKKGTSFGAPCVLENVLAEMVISAVPSIEMVRFVNSGTEACMGALRLVRAYTGREKIIKFEGCYHGHADSFLVKAGSGVATLGLPDSPGVPKGATYETLTAPYNDAKAVKKLFEDNKGEIAAVFLEPVVGNAGFIPPQPGFLNALRDLTKQNGALLVFDEVMTGFRLAYGGAQEYFGITPDVTTMGKIIGGGLPVGAYGGRRDIMEMVAPAGPMYQAGTLSGNPLAMTAGIHTLKRLTEPGTYKYLDKITGDLVRGILDAGAKTGHEMCGGHIRGMFGVFFTGGPVHNFGDAKKSDTEKFGRFYRGMLEEGVYLAPSQFEAGFTSLAHTSQDIEKTIEAAEKVLKRI

SEQ ID NO: 4135 - DNA, 1891 bp, Panicum virgatum
  misc_feature: Ceres CLONE 1797184
  misc_feature: Encodes the peptide sequence at SEQ ID NO. 4136
tccaacctcagctgtcagctcactacctcatcttgccgcctctgcacgtctccgcgtcctccacctcatggctcgctcgagctccaaccgctaccgccaggacctgttcgtcgccttcgccgtcgccgtcgcggcgtgtcttgccgtcggggaggcgtccttcgtcggcttcgacctccaccactgcacctccccggtggtccggcgctgggcggaggcgcggggccgccacgccctcgccgcggagtggccagctaaaggttcgcccgagtactactccgagctctcccgccacgaccgcgccctcctcgcccaccgcggcctcgccggcgccggcgacgaactcctgaccttcgcggatggcaacgcaaccatccaatacctcggatccttgtactacgcggcggtggcgctgggcaccccgaacgcgacgttcctggtggcgctggacaccggcagcgacctcttctgggtgccctgcgactgcaagcagtgcgcgccgctctccaacaacgccacggcggagctccgcgagtacagcccgaggctgtcgtcgacgagcacgccggtgacgtgcgaaaacccgctctgcgaccggcccaacgcctgcagcgccgccaccaacggcagctgcccgtacggcgtccgctacgtgtccgccaacacctcctcctccggggtgctcgtgcaggacgtgctccacctgacccgggagggcccgggccccggcgccgccgcggagcccctgcaggcccccgtcgtgttcgggtgcgggcaggtgcagacgggcgcgttcctggacggcgccggcttcgacggcctgctgggcctcggcatggacagggtgtccgtgcccagcgtgctcgccagccgcggcctcgtcgcctccgacagcttctccatgtgcttcggcgacgacggtgtcggccggatcaacttcggcgacgccggcagccgcggccaggccgagacgcccttcatccccaggagcacacacccgacgtacaacgtgagcttcacgacgatcaacgtcggcagcgagtcggcgccggtggagttcgccgccgtcatggactccggcacgtccttcacgtacctcaacgacccggagtacacggcgctcgccaccagtttcaactctcagattcgcgagaggagggtcaatttcagcagcggatctgcagaccgtttccccttcgagtactgctacagattgagccctgaccagagggaggtggagctcccggtggtgagcctgacgacggcggggggagcactgttcccggtcaccaacccgatcatcgggttgtccgatagcgccagccgccgtgccgtcggttactgcctggccatcgtcaagaacgacatcaccatcaacatcgtcggccagaacttcatgaccgggctcaaggtggtgttcgaccgggagagatccgtcctgggctggcaggaattcgactgttacaagaacgccagagtggcggacggaccgggcgggagccccagccccgcgccggcgccgatggcgacgacgctcacgccgcggcagaacgacgccagcaacaggttccccggcgcggcgcccttgccgcggccgccgtccgccggcgcgcgcggagggatctccctgctgctccctctgctgctgggcgctgccgcccttgtctgacgcccgccggctgctctggaccgtcgtatagagatatagatactgctcgactccgattcagagttcagattttggaattaggattagtttgcaggttgtcgtgtatattggagacgaaatttcttggtggtgactgatgaggggcatttcgtgacataaattattcatattcatatacaaataaacatatatttgataaattaaaaaaaaaaaaaaaaaaaa

SEQ ID NO: 4136 - protein, 533 aa, Panicum virgatum
  misc_feature: Ceres CLONE 1797184
  misc_feature (1)..(363): Pfam Name: Asp Pfam Description: Eukaryotic aspartyl protease
MARSSSNRYRQDLFVAFAVAVAACLAVGEASFVGFDLHHCTSPVVRRWAEARGRHALAAEWPAKGSPEYYSELSRHDRALLAHRGLAGAGDELLTFADGNATIQYLGSLYYAAVALGTPNATFLVALDTGSDLFWVPCDCKQCAPLSNNATAELREYSPRLSSTSTPVTCENPLCDRPNACSAATNGSCPYGVRYVSANTSSSGVLVQDVLHLTREGPGPGAAAEPLQAPVVFGCGQVQTGAFLDGAGFDGLLGLGMDRVSVPSVLASRGLVASDSFSMCFGDDGVGRINFGDAGSRGQAETPFIPRSTHPTYNVSFTTINVGSESAPVEFAAVMDSGTSFTYLNDPEYTALATSFNSQIRERRVNFSSGSADRFPFEYCYRLSPDQREVELPVVSLTTAGGALFPVTNPIIGLSDSASRRAVGYCLAIVKNDITINIVGQNFMTGLKVVFDRERSVLGWQEFDCYKNARVADGPGGSPSPAPAPMATTLTPRQNDASNRFPGAAPLPRPPSAGARGGISLLLPLLLGAAALV

SEQ ID NO: 4137 - DNA, 1640 bp, Panicum virgatum
  misc_feature: Ceres CLONE 1797209
  misc_feature: Encodes the peptide sequence at SEQ ID NO. 4138
acggtcacccgtcacgcacgcttcgctgcgccgcgcacaccggcggacccccctcgccgtcgagccggcgcggccaccgccccgaccgaccatccgatccggcaggcggagggcgcggcatggcctcccccaaccccgacgccgcggcggagctgcagtccgtggccgcggcgggggcaggggaaggcggctcgtcctcgtcgctcggcgccgtcgcggccggggagcaggcgcccaggagggtcctggccgtgcggaaggagcgcgtgtgcacggccaaagagcgcatcagccgcatgccgccctgcgccgccgggaagcggagctccatctaccgcggggtcacccggcataggtggactggtcgatacgaggctcacctctgggacaaaagcacgtggaaccagaatcagaacaaaaaggggaaacaagtatatttaggtgcatatgatgatgaagaggcagcagcaagggcctatgaccttgctgcattaaaatactggggagctggaacacaaattaattttccagtctctgactatgcaagagaccttgaagaaatgcagatgatctccaaggaggactatctcgtgtctcttaggagaaagagcagtgccttctccagggggttgccaaaatatcgtgggcttcctaggcaactgcataattccagatgggatacgtctttgggacatttacttgggaatgactacttgaaccttagttgtggtaaggatatcatgttggatggaaaatttgctggaagctttgccttggagagaaaaattgatcttacaaattacattcggtggtggctacccaagaagacaaggcagtcagatacatcaaaagcagaagagattgctgatgaagtccgagctattgaaagttcaatgcaacagaccgaaccatataagctgccctctcttggcctctgttctgcttcaaagccctcttcagcaggcttatcagcatgtagtatattatctcagtctgatgccttcaaaagcttcatggagaggtctacaaaattatctgaagaatgtaccctcagcaaagaaattgttgaaggaaaggctgttgcctcagcacctgctactggacatgatacagcagcagttaatattaacatgaatgagctgctagtgcaaagagctacttactcaatggcccctgttatgcctacaccaatgaagagtacctggagccccgccgatccttctgttgacccacttttttggagcaactttgtcttgccatctagtcaacctgtaacaatggcgacaataacaacaacaacatttgcaaagaatgaggtaagttcaagtgatccattccagagccaagagtgaccgcaaatgattactgcagcacgatatgttggactggtcaatgctaacattctgtgcttcagctggattcattttgcccagcttttgatgtcaacttgtgagcaatactccttgtgtatccatacttcataggacatgaatagaaagtaagacaagtgcaagcatagttatgtaatatacagtggctagttccctgaaagtgagatttagttgtagagatgtttgtacatattgcggtgattgtttcagctaagtctcaacagatttgaaaaaaaaaaaaaaaaaaaa

SEQ ID NO: 4138 - protein, 410 aa, Panicum virgatum
  misc_feature: Ceres CLONE 1797209
  misc_feature (1)..(73): Pfam Name: AP2 Pfam Description: AP2 domain
  misc_feature: The sequence is a functional homolog of  SEQ ID NO 139 in the  11/479,226 US patent application
  misc_feature: The sequence is a functional homolog of  SEQ ID NO 2210 in the  10/374,780 US patent application
  misc_feature: The sequence is a functional homolog of  SEQ ID NO 24 in the  10/412,699 US patent application
  misc_feature: The sequence is a functional homolog of  SEQ ID NO 50 in the  11/375,241 US patent application
  misc_feature: Useful for making plants with modulated growth and phenotype characteristics
MASPNPDAAAELQSVAAAGAGEGGSSSSLGAVAAGEQAPRRVLAVRKERVCTAKERISRMPPCAAGKRSSIYRGVTRHRWTGRYEAHLWDKSTWNQNQNKKGKQVYLGAYDDEEAAARAYDLAALKYWGAGTQINFPVSDYARDLEEMQMISKEDYLVSLRRKSSAFSRGLPKYRGLPRQLHNSRWDTSLGHLLGNDYLNLSCGKDIMLDGKFAGSFALERKIDLTNYIRWWLPKKTRQSDTSKAEEIADEVRAIESSMQQTEPYKLPSLGLCSASKPSSAGLSACSILSQSDAFKSFMERSTKLSEECTLSKEIVEGKAVASAPATGHDTAAVNINMNELLVQRATYSMAPVMPTPMKSTWSPADPSVDPLFWSNFVLPSSQPVTMATITTTTFAKNEVSSSDPFQSQE

SEQ ID NO: 4139 - DNA, 1744 bp, Panicum virgatum
  misc_feature: Ceres CLONE 1797222
  misc_feature: Encodes the peptide sequence at SEQ ID NO. 4140
ataattgtacgcggcaccccctccccccttgcgcgcgagagagagaaagaggcgagagatttgcatctcccaagggaagaatagaaagggacccaagccaaatcgaatccctggtgcccctccccttcctcctccccccgcacgccgccgccgtgaggactccggcgaatgacgtcccgcgtcgcctcgggcctcctccgccgccgcgccggcgcgacactaggcctcttaaggagttatacacatgtcagaaactacagcagccaactttcagctttgattccagctacgtcccagtgctcgaagctgacaagaagacgttattacatgccgaatgcctctccgtaccaagtatggagtcggtcatttgcttcagacaatggagacaaggttgaggctgttgtgcccttcatgggtgaatctgtaactgatggaacccttgctaactttttgaagaaacccggtgagagagtcgaagctgatgaggctatagcacagatcgaaactgataaggttactatagatgttgctagtcctgaagctggtgttattgaaaagttcattgctagtgaaggtgatacagttactccaggcaccaaaattgcaatcatatcaaagtctgctcaacctgctgaaacacatgttgctccatccgaggaatcaactccaaaagaaccctctccgccaaaagttgaagagaaaccaaaagtagagacagcaccaaaggtagaacctccgaagacacaagcacctaagcctactgcaccatcaaaaacgtccccttcagaaccacagctccctccaaaagaacgtgaacggcgggtgccgatgccaaggctcaggaagcgtattgcaaaccgtttgaaggattctcagaacacctttgcaatgctgacaacatttaatgaagttgacatgacaaatttgatgaagcttcgttctgattataaagatgaattcgtcacaaagcatggtgtcaaattgggtcttatgtcttgctttgtcaaggctgctgtctctgcacttcaaaaccaacccatcgtcaatgctgtcattgatggtgatgacatcatatacagagactatgttgatgtcagtgttgctgtcggcacttccaagggtcttgtggtgcctgttatccgagatgcggataccatgaactttgctgacattgagaaagggataaacaaccttgcaaagaaggcaaatgagggggcactgtcaattgatgacatggcaggaggaacattcaccatctccaatggtggtgtctatggaagccttatcagcacacctatcatcaaccccccacagtcagcgattcttgggatgcattccattgtgcaatgccctgtggttgtgaacggcgacatcctcgcaaggccgatgatgtacctcgccctgacatatgaccacaggctgatcgatggcagagaggccgtcttcttcctgcgccgcatcaaggatgtggtcgaagaccccaggaggttgctgcttgacatttaagttgaggctccagcactgccctgccaactgttttgtgcttatctggaaataataccatgcaaatttttttgactgaatgaaaacgaaatgcttcatcagaaaggcagaatctgagccgaggatatggtgaggttttttcctataattgtagaaagcaccaaactcaacgctgagtttacttctatcgaagatgtccattttcgggatgtagttccctgaaaaaaaaaaaaaaaaaaaa

SEQ ID NO: 4140 - protein, 445 aa, Panicum virgatum
  misc_feature: Ceres CLONE 1797222
  misc_feature (1)..(231): Pfam Name: 2-oxoacid_dh Pfam Description: 2- oxoacid dehydrogenases acyltransferase (catalytic domain)
MTSRVASGLLRRRAGATLGLLRSYTHVRNYSSQLSALIPATSQCSKLTRRRYYMPNASPYQVWSRSFASDNGDKVEAVVPFMGESVTDGTLANFLKKPGERVEADEAIAQIETDKVTIDVASPEAGVIEKFIASEGDTVTPGTKIAIISKSAQPAETHVAPSEESTPKEPSPPKVEEKPKVETAPKVEPPKTQAPKPTAPSKTSPSEPQLPPKERERRVPMPRLRKRIANRLKDSQNTFAMLTTFNEVDMTNLMKLRSDYKDEFVTKHGVKLGLMSCFVKAAVSALQNQPIVNAVIDGDDIIYRDYVDVSVAVGTSKGLVVPVIRDADTMNFADIEKGINNLAKKANEGALSIDDMAGGTFTISNGGVYGSLISTPIINPPQSAILGMHSIVQCPVVVNGDILARPMMYLALTYDHRLIDGREAVFFLRRIKDVVEDPRRLLLDI

SEQ ID NO: 4141 - DNA, 951 bp, Panicum virgatum
  misc_feature: Ceres CLONE 1797250
  misc_feature: Encodes the peptide sequence at SEQ ID NO. 4142
tttgggcagagagagagagagagagtcacagccaaggaagaagtaccgagcggagggttggaggggaaaggttcggtctcggaagggagagagatcatggctccgatgaagctgtacggcccgacgctgtcgtggaacgtgacgaggagcgcgctggcgctggaggaggccggcgcagagtacgagatcgtgcccatcaacttcgccaccggcgagcacaagagccccgagcacctcgcccgcaacccatttggtcaggttccagctttgcaagatggtgacttgtacgtctgggaatcgcgtgcaatttgcaagtatgcagcccgtaaacacaagccggagctgttgaaggaaggcaatcttgaggagtcagcaatggtggatgtctggatggaggtggaggccaaccagtacacctctgtgctgaaccccatcctcttccagtgcctcatcagtcctatgcttgggggatccactgaccagaaggttgttgaggagaaccttgagaagctgaagaaggtgctggaggtgtacgaggcgcgcctgaccaagtacaagtacctggctggagacttcctcagccttgctgaccttaaccatgtctctgccaccctgtgcttgtttgcaacgccccatgcctcggtgcttgatgggtacccccatgtgaaggcctggtggtctagcctgatggagaggccatctgttcagaaggttgcagctctgatgaagccatctgcttgaagtagttgtttcggtagtttgcttgttcaggttctgtgctgttatgatgtgccatctatgtgtaaattgttcctgctttgtgctaggatgcttgtgatccgctgttggattgtactgaaatgagcattcgtgtgctcttctcaggggaacgttatgataataaactctgcctggagctagaggatttctcaaaaaaaaaaaaaaaaaaaa

SEQ ID NO: 4142 - protein, 214 aa, Panicum virgatum
  misc_feature: Ceres CLONE 1797250
  misc_feature (1)..(96): Pfam Name: GST_C Pfam Description: Glutathione S-transferase, C-terminal domain
  misc_feature (1)..(76): Pfam Name: GST_N Pfam Description: Glutathione S-transferase, N-terminal domain
  misc_feature (1)..(214): SWISSPROT Homolog: EC 2.5.1.18 Glutathione S-transferase I
  misc_feature (4)..(214): SWISSPROT Homolog: EC 2.5.1.18 Glutathione S-transferase IV
MAPMKLYGPTLSWNVTRSALALEEAGAEYEIVPINFATGEHKSPEHLARNPFGQVPALQDGDLYVWESRAICKYAARKHKPELLKEGNLEESAMVDVWMEVEANQYTSVLNPILFQCLISPMLGGSTDQKVVEENLEKLKKVLEVYEARLTKYKYLAGDFLSLADLNHVSATLCLFATPHASVLDGYPHVKAWWSSLMERPSVQKVAALMKPSA

SEQ ID NO: 4143 - DNA, 1752 bp, Panicum virgatum
  misc_feature: Ceres CLONE 1797257
  misc_feature: Encodes the peptide sequence at SEQ ID NO. 4144
gccaatcaatcaaggggagcaaatgcaaatgtacatggccagcagcagctccggccaccgctctccacggcgctccgccgcaacggcggcgctggtgctcgcgactgccggcctcctcctcctgctgccaccactggcacgcgggtcgacgtccaccgagcagcagcagctgctgcagcagcaggaggaggaccgcatcctgggactgccggggcagcccaacggcgtggcgttcgacatgtacggcggctacgtcaccgtcgacgagcaggccggccgcgcgctctactactggttccaggagacggccgacccaggcacggcgccgctcctcctgtggctaaacggcgggcccgggtgctcctccatcggcggcggcgcgctggaggagctcggcgcgttccgcgtccacaccgacggtcagacgctcctactcaacgagttcgcgtggaacaaagcggcgaacgtgctcttcttagagtcgccggccggcgtggggttctctgacaccaacaccagctccgacctcctcgtcggcgacgacagaacggctcaagacacgtacactttcctggtgaaatggttcgagagattcccgcagtacaagtaccgcgatttctacattgcgggagagagctacggaggtcactatgttcctcagctgtcccagcttgtgtacaggaacaacatcggcgtcgagaatccttatatcaacttcaaaggattcatggtcggaaacggcgtgaccgatgactttatcgacacgatcggcatgtttgagtactggtggcaccacggcctcatctctgacgagaccctggagagcggtctgaaggtttgcctggacggcagcaccttgaccaagccctcgccggagtgccagaagatcatggacaaggccaccgaggagcaaggcaacatcgacgtctacagcatctacacgccgccgtgtgagaaggggaccccatacgcgcgcaggcgccgccgcacactgatgctgcctccatacgacccgtgcaccgccttctactcgaccaactacctgaacatccccgaggtccagagggccatgcatgccaacgtcaccggcaacaagggcccatggattatgtgcaacatggccatatatgataactggacgacagacacacccatttccatgctgcccatctacaaggagctcattgcagctggcctcaaggtctgggtcttcagtggcgacacggacactgcagtaccgctgagctcgaccaggcgctcccttgctgccctgggccttcctgttaagaccagctggtacccctggtacattgtcaaaactgaggttgctggctggagcatggagtatgaaggcctgacctttgtcaccgtccgcggcgccgggcacgaggttcccctgcaccgtccggagcaggcgctcatcctgttccagcacttcctgcaggacgaacccatgccggccgaggcgaaaaatgccagcgtcatcctccttcctagtgagaaggctacctcttactgagcatgcaagcacctgtcggctgtcgttgtgcttgatgacgaagactccactacgaataaaagatgctgttgatctgcatcttgagaataaaagctggagtatcttgtttccttataatgaataatgtatgaaccgttggcttcgcgatggatctattatattgtttttcttcggaaaagcatatatgaataatgcatgccgagttcagccacgaaaaaaaaaaaaaaaaaaaa

SEQ ID NO: 4144 - protein, 498 aa, Panicum virgatum
  misc_feature: Ceres CLONE 1797257
  misc_feature (1)..(376): Pfam Name: Peptidase_S10 Pfam Description: Serine carboxypeptidase
  misc_feature (19)..(487): SWISSPROT Homolog: EC 3.4.16.6 Serine carboxypeptidase 2 precursor
  misc_feature (57)..(486): SWISSPROT Homolog: EC 3.4.16.6 Serine carboxypeptidase 2 precursor
MQMYMASSSSGHRSPRRSAATAALVLATAGLLLLLPPLARGSTSTEQQQLLQQQEEDRILGLPGQPNGVAFDMYGGYVTVDEQAGRALYYWFQETADPGTAPLLLWLNGGPGCSSIGGGALEELGAFRVHTDGQTLLLNEFAWNKAANVLFLESPAGVGFSDTNTSSDLLVGDDRTAQDTYTFLVKWFERFPQYKYRDFYIAGESYGGHYVPQLSQLVYRNNIGVENPYINFKGFMVGNGVTDDFIDTIGMFEYWWHHGLISDETLESGLKVCLDGSTLTKPSPECQKIMDKATEEQGNIDVYSIYTPPCEKGTPYARRRRRTLMLPPYDPCTAFYSTNYLNIPEVQRAMHANVTGNKGPWIMCNMAIYDNWTTDTPISMLPIYKELIAAGLKVWVFSGDTDTAVPLSSTRRSLAALGLPVKTSWYPWYIVKTEVAGWSMEYEGLTFVTVRGAGHEVPLHRPEQALILFQHFLQDEPMPAEAKNASVILLPSEKATSY

SEQ ID NO: 4145 - DNA, 2384 bp, Panicum virgatum
  misc_feature: Ceres CLONE 1797284
  misc_feature: Encodes the peptide sequence at SEQ ID NO. 4146
atttgtttgcttacagctcatccataccgcaaagccaagatcacattttgattattgattagtgctaaaggagggctagattagcaaggtgtctcatcatcatcctccatccataccatccattctgcaacgcgtcttggcaaaacgtctctgccaaagatacaaattcatccatagccatatatgcaggcgtatctttggaatcaataagtatttgggtgaatataatccgtgttgtcttaattcgcttccatttttaacaatagctcctgattaatgcgtgcatatccagtttgatttccttttggcgtgaggatattcacccctatttatacgcggttttggaacgcaggcgattgatcggagacagatggcgagcgccggattcgtggaggagatgatgagggagcagagcctcctggaggcgacctgcggcgacctgttcgaccacatcgacgacctgctcgacttccccaaggaggagtcctccgccgacgtgctcctcctggacgcgccggcgccgggaagcccgctctccgcgcgcatcatcgacgtcggcggcaatgcgccgcccgcgcccgcgctggagccgctgcccccgcccgcggcgcaggaggacgacgccgccgcgggggcgccggtgttcgacgccaaggacgttggcggccacattggctcgtgcgaggacatggacatggacatggacatggcgcagctggagtggctgtcggggctcttcgacgacgcctccatcccgcacgagctggcgttcccgggggccacctgcgccgccccgatcaagagctccgcgctggcggccaacgccggcgtcgcgctgctgccgccggacaagatggaggacgcgctcttccgcagctccagccccatctcggtgctcgagcacaacagcttcaacgccaacaacaacgtgggctccgcgtcctccgcgtcctcctcggcgtcctcctcgtcagagtccttctccgggagcggcgggcacgcgtggtcggcgcccgtgtcgccgcgcccggagccgccggtgctcgtcataccggcgcgcgcgcggagcaagcgctcccgcccgtccgccttcaccaccaccgcggaggcgcccaccatcctcgtgccgacgcccatgtactcgtccacctcctcgcactcggaccccgagagcatcgccgagtccaacccacaccaggcgccgcccaagaagaagaagaaggccaagaagccggcgcccccagcgccgaccgcctccgacgcggacggtgacaacgacggcgacgccgactacgaggaaggcggcgagcgctcgctgcctcagggcgccgttaggaggtgcacgcattgccagatcgagaagacaccgcagtggcgcgcgggtcccctgggccccaagacgctctgcaacgcctgcggcgtgcgctacaagtccgggcgcctcttcccggagtaccgccccgcggcgagccccaccttcgtgccgtccatccactccaactcccacaagaaggtggtggagatgcgccagaaggccgtccggagcggcgatccgtcctgcgacctcctgcagttcatccgccgccgggattaaatcgtcggtcggtctcgtcccccttagctatatatgtatacatgctagtatgtatgcatgcatggttgcttcatcagtagtcagtcgttgtcgtcgtcttcatcgtggttgtcatcatcatcatcaccgccatggatccacccatcttcacctgcatgtgtgtttctgtcagcatccaccaatccatcgccgggcatcctggcgttagttcattagggcttttttcatcgggggttagtgttattttatctttccttcttgtctattggttaattggttcccctgaatgtttttttttttgtttgtatagagagagaaagagagaggaggggtgggagaggagggcaggagaaatagatgaatcagagtggttgttgcattgcaattgcagtagcttgcaagttaggtaggtgagaaggagagctaaaccagcagcagagggagacagatttagagaggaaactttgcagctagtcagtcagttagaagaaaagtgtttcagcaagtgaaaggggagtttgttggtttgctaattagaaggaagattctgtcagatcaggtagtagctatcacccatcaggatttgaaacttgaagagatggggacagccatcatccatcatagtctgtatttggagcttggtgtactgaactctgaaaattctttttgcagtccatctatgtttagggattgataagtgttgtttggtttcttctatactagtagtgctacattttagtgaataattatatgagaatctctttcgtttcaaaaaaaaaaaaaaaaaaaa

SEQ ID NO: 4146 - protein, 407 aa, Panicum virgatum
  misc_feature: Ceres CLONE 1797284
  misc_feature (1)..(36): Pfam Name: GATA Pfam Description: GATA zinc finger
MASAGFVEEMMREQSLLEATCGDLFDHIDDLLDFPKEESSADVLLLDAPAPGSPLSARIIDVGGNAPPAPALEPLPPPAAQEDDAAAGAPVFDAKDVGGHIGSCEDMDMDMDMAQLEWLSGLFDDASIPHELAFPGATCAAPIKSSALAANAGVALLPPDKMEDALFRSSSPISVLEHNSFNANNNVGSASSASSSASSSSESFSGSGGHAWSAPVSPRPEPPVLVIPARARSKRSRPSAFTTTAEAPTILVPTPMYSSTSSHSDPESIAESNPHQAPPKKKKKAKKPAPPAPTASDADGDNDGDADYEEGGERSLPQGAVRRCTHCQIEKTPQWRAGPLGPKTLCNACGVRYKSGRLFPEYRPAASPTFVPSIHSNSHKKVVEMRQKAVRSGDPSCDLLQFIRRRD

SEQ ID NO: 4147 - DNA, 1881 bp, Panicum virgatum
  misc_feature: Ceres CLONE 1797297
  misc_feature: Encodes the peptide sequence at SEQ ID NO. 4148
acgccggcgcccatgtcgcagtagggctgaccaaaaccctaaccctaacttcctcctcctccgccctccacctgttgccgtatacatggacgcgaaggacatcctcgggctcccgaagacccccttctcgtcctcccaggagaagaagtcgcggccgcccaaggagccgcagcgcaagcccgatggcgtctcgcgcgaggtctatgcgctcacaggaggggtgggaatggccccgctcatgccgactatcgaggcatcacacctgaagcggcggcctgctgcggagaaggagaaggtagcatggcagtggttacctttcacatcctctgcgcgaactgacaaccttcaactctatcactgggttagagttgttaatggtgttccaccaactggtgactatcagttcgcaaaatataacaagaaagtggatgttcttaaatacacagatgaggagtacgagaagtatttaattgatcctgcttggagtagggaggaaacagaccagctttttgaattatgtgaacggtttgaccttcgattcatagtaatagcagataggtttccaacttctcgcagtgtggaagatctgaagagccgttactattctgtttctcgggctcttttaattcatagggcccggtcattcgatgatgtttctgggaacccccttgtgaaggatagctatgatgctgctcatgacactgagaggaagcgtgcgctatcagctctcctctcccaaactaaacagcaagaacgaaaggatgctgagactttggcagaagcaaaacgcattatggaatctcgtgctgctagcaaaactgtggatgaagccggcatgccttcgagctctgataatgctatggttcctgttgatggtgtatctcccttgactagcactcatccaccactaacacatccaaatacagcagcgaacagctccatacctaattcactacgagcgcttcgagtgtatttgagaacccatgcgcttgatcaaatggtccaagcagcaagtgcttcagctggccttagagttatcaaacgggttgatcagacactacaagatctaggggtgaatttgaagcctaaggttccaacgaaagcagtttgtgtagaacatcttgaattgcggaacgagatactcacattgcttaacttacagaagcagctgcaaaataaagaggcagaagtttcagctaaccgagaaagttccttcacggaggcaccaagcacacctaagctttctaacagagatattgatcgtccctttgtccctgatacagttgggtttacaggtgaaagagcaggcaaacgggatcacaagcggaagaacactggaagatttatagatgcgcctccgtcaccaccccaatccaagaggcctaggaaattgaagggatcagattgataatgctgtccaaatagccgacggaaacatttctttagtcaaacaaccctgcttgcatctagagatgaacatcaacaaaataggtcagttccggccttggtggaagtcagtgtggaattcagatggtcaatcttgcaggaatccgcttcatggctagaagatgtgcatgccctgtctctggctctcttctgggtagacctggaatcttatcttggccggatattcgattcagttttgtatttgtaatgtatgtcatgtatgtagaggtaaatgtgagatcaaaatcctacctgttcagctgatttccgagttgatcttagcaccggtgttgttagcgtatgttgctatagtttggcaagcttctcatgtatgggacccataaagctggcagtccgtttttgctcctgctcagtaagagcagtcatcggttcagtcgcctagacgctgaacctgaaaaaaaaaaaaaaaaaaaa

SEQ ID NO: 4148 - protein, 440 aa, Panicum virgatum
  misc_feature: Ceres CLONE 1797297
  misc_feature (1)..(47): Pfam Name: Myb_DNA-binding Pfam Description: Myb-like DNA-binding domain
MDAKDILGLPKTPFSSSQEKKSRPPKEPQRKPDGVSREVYALTGGVGMAPLMPTIEASHLKRRPAAEKEKVAWQWLPFTSSARTDNLQLYHWVRVVNGVPPTGDYQFAKYNKKVDVLKYTDEEYEKYLIDPAWSREETDQLFELCERFDLRFIVIADRFPTSRSVEDLKSRYYSVSRALLIHRARSFDDVSGNPLVKDSYDAAHDTERKRALSALLSQTKQQERKDAETLAEAKRIMESRAASKTVDEAGMPSSSDNAMVPVDGVSPLTSTHPPLTHPNTAANSSIPNSLRALRVYLRTHALDQMVQAASASAGLRVIKRVDQTLQDLGVNLKPKVPTKAVCVEHLELRNEILTLLNLQKQLQNKEAEVSANRESSFTEAPSTPKLSNRDIDRPFVPDTVGFTGERAGKRDHKRKNTGRFIDAPPSPPQSKRPRKLKGSD

SEQ ID NO: 4149 - DNA, 1731 bp, Panicum virgatum
  misc_feature: Ceres CLONE 1797333
  misc_feature: Encodes the peptide sequence at SEQ ID NO. 4150
gtccccacttgtcttctctctctccctccgtgtcacgcttccctcgcctgagtcgccccgcctccgatcgaatcgaaccgggtgggcttgcttcgcctcgtttcgtctcgtctcggctctcagcctctcaggaaaccgcaacgagattcctcgcgcgcgcggctcagcagatcgcgcgcgaatcgaaccgggtgggcttgcttcgtctcgtttcgtctcgtctcggctctcagcctctcaggaaaccgcaacgagattcctcgcgcgcgcggctcagcagatcgcgcgagcgcgagagggaggagcatgggatcggagggacggggctggaacggcgctggcgacggcgccaggggcggggaggagaaaccgaccaccaccgcggcggtggccgcaggggcgccggcggacgtgcccacgtcggcggcctccgtcgacatcttgctgccgctcccggagataacgcctcacatcataggtctctgcaagggatcggtcaaagggtggtcatcgctggacagctcgtgcttctccatcgagacggtgtctggcggcatcacgaatctattgctgaaggtatctgtaaaagaagaaactggaaatgagttttctgttactgttcgtttgtatgggccaaatacagacttggtgattgatcggaaaagggaattgcaggcgataccatatctctcagctgcagggtttggggctcgtctacttggaatttttgagaatggagtagttcagtcattcatccatgctcgaacactgtcacctgcagacatgagagaacctagaatagcagctgagattgccaaggagctccacagattccatcaagtagacattccagggtctaaagaaccacaactgtggaatgatatattcaagtttttgaaaaaagcttcagcactgaagtttgaggataatgagaagcggaagagatatgaaacaatctcatttagagaaatacaagatgaagttaaagaacttaaggatctttccgaccttctgcgtgcacctgtggtttttgcacacaatgacttgctttcaggaaatttgatgctcaatgattcggaagggaagctatattttattgattttgagtatgggtcatacagctaccgcggttatgacattgcaaatcatttcaacgagtacgcaggatttgattgtgactataacatgtacccagataaagatgctcagtatcactttttcaggaattatatgcaacctgacagacccagtgaggcacaagatctggaagcactttatgtggaaacaaacactttcaggttagcatcgcacatttactgggcattatgggccctcatacaggcaaaggtatccccaatcgattttgactatcttgggtacttcttccaacggtatggtgagtacaagaaacagagggagtcctgcttctccttggcacaaagcttcctctctgagctgagaaatggctagagcctgagaatctgttcacaagtcaatattgtggtctgtttacggtgggtatgcgttgtaattttcggcttctgctcggaaactttattatggtgctggcagaagcctctcgttgttgtatctgatgttagattcgtcatggcctgataggaaagccgcacgataggtcctcgggaaagcacatgtacttctattatttgtgattgtaataaacactatcctgatgggttctgctccgtgcaaaaaaaaaaaaaaaaaaaa

SEQ ID NO: 4150 - protein, 387 aa, Panicum virgatum
  misc_feature: Ceres CLONE 1797333
  misc_feature (1)..(204): Pfam Name: Choline_kinase Pfam Description: Choline/ethanolamine kinase
MGSEGRGWNGAGDGARGGEEKPTTTAAVAAGAPADVPTSAASVDILLPLPEITPHIIGLCKGSVKGWSSLDSSCFSIETVSGGITNLLLKVSVKEETGNEFSVTVRLYGPNTDLVIDRKRELQAIPYLSAAGFGARLLGIFENGVVQSFIHARTLSPADMREPRIAAEIAKELHRFHQVDIPGSKEPQLWNDIFKFLKKASALKFEDNEKRKRYETISFREIQDEVKELKDLSDLLRAPVVFAHNDLLSGNLMLNDSEGKLYFIDFEYGSYSYRGYDIANHFNEYAGFDCDYNMYPDKDAQYHFFRNYMQPDRPSEAQDLEALYVETNTFRLASHIYWALWALIQAKVSPIDFDYLGYFFQRYGEYKKQRESCFSLAQSFLSELRNG

SEQ ID NO: 4151 - DNA, 2022 bp, Panicum virgatum
  misc_feature: Ceres CLONE 1797350
  misc_feature: Encodes the peptide sequence at SEQ ID NO. 4152
tatagcttaattattattcttttattcgcatcgtcgtcgcctctccttattaatatcctcgcggcatcgcatcctcggttccatcgtaccattgctcgcccagagttcttcttgttaggcaaggcaaggcgaaagcagaagcaaaaggtttggttggtgatggcgagctcggggttctcgtggacgctgccggaccatccgaagctccccaaggggaagcaggtggccgtcgtcgtgctggacggatggggcgaggccaacgccgacgagtacaattgcatccacgtcgctcagacgcccgtcatggactcgctcaagaatggtgctccagagaaatggagactagtgaaggctcatggaaccgctgtgggtctcccatctgatgatgacatgggcaacagtgaagttggccacaatgctcttggagctggccgcatttttgcccaaggcgctaagctcgtggaccaagctcttgcctccggaaaaatttatgaaggtgatgggttcaactacatcaaagaatcttttgaaaatggtactcttcaccttattgggttgttgagtgatggtggtgtccactcccgtcttgaccaactgcagctacttctgaaaggtgctagtgagaggggagcaaaaaaaatccgtgttcacatccttaccgatgggcgtgatgttttggatggcagcagtgtcggttttgtagagacactagagaatgatctttcacagcttcgagagaagggtattgacgcacagattgcatcaggtggtggaaggatgtatgttaccatggaccgttatgagaatgactgggatgtggttaaacgtgggtgggatgcccaggtgcttggagaagcgccccacaaattcaaaagtgcacttgaagccgtgaaaacactgagagcagagccgaatgctaatgatcagtatttgcccccatttgtgatagttgatgacagtggcaaagctgttgggcctgtactagatggtgatgcagttgtcactatcaacttccgggctgatcgtatggttatgctcgcaaaggcacttgagtatgcagacttcgacaaatttgaccgtgtctgtgtcccaaaaatccggtatgctgggatgcttcaatatgatggtgagttgaagcttcctagccgttatcttgtttctccaccagagatagagagaacatctggtgaatacttggtgaagaatggcatccgcacctttgcttgcagtgagacggtgaagttcggtcatgtcacatttttctggaacggtaaccgttcaggatacttcgatgaaactaaggaagagtatgttgaaattcctagtgacagtggtattacattcaatgttgcacccaagatgaaggcgcttgaaatcgcggagaaagccagggacgctatccttagtggaaagtttgaccaggtacgtgtcaacctgccaaatggtgacatggtgggtcacactggtgatattgaggccacagttgttgcttgcaaggcagctgatgaagctgttaagattattttggatgctgtggagcaagttggtggtatttaccttgtcactgctgaccatggaaatgcagaggacatggtgaaaaggaacaaagctggcaagccactgctcgacaagagtggtggtatccaaattctcacctcgcatacccttcagcccgtcccagtcgccattggaggccctggtctgcaccctggagtgaaattccggaatgacattcagacccctgggcttgccaacgttgctgccactgtgatgaacctccatggcttcgaggcccctgctgactacgagccaaccctcattgaagttgctgacaactaaatactggccaaccttgatgtccaattttgttgttataattttgagaatgcatcggtgatggacatgtcattgaataattcttgtttgcaagcaggctgctcaaactcgcgaaacattgagaggaacacagttcggattgcactcatatgctctattgataactaaaaaaaaaaaaaaaaaaaa

SEQ ID NO: 4152 - protein, 559 aa, Panicum virgatum
  misc_feature: Ceres CLONE 1797350
  misc_feature (2)..(128): Pfam Name: Metalloenzyme Pfam Description: Metalloenzyme superfamily
  misc_feature (1)..(559): SWISSPROT Homolog: EC 5.4.2.1 2,3-bisphosphoglycerate-independent phosphoglycerate mutase
MASSGFSWTLPDHPKLPKGKQVAVVVLDGWGEANADEYNCIHVAQTPVMDSLKNGAPEKWRLVKAHGTAVGLPSDDDMGNSEVGHNALGAGRIFAQGAKLVDQALASGKIYEGDGFNYIKESFENGTLHLIGLLSDGGVHSRLDQLQLLLKGASERGAKKIRVHILTDGRDVLDGSSVGFVETLENDLSQLREKGIDAQIASGGGRMYVTMDRYENDWDVVKRGWDAQVLGEAPHKFKSALEAVKTLRAEPNANDQYLPPFVIVDDSGKAVGPVLDGDAVVTINFRADRMVMLAKALEYADFDKFDRVCVPKIRYAGMLQYDGELKLPSRYLVSPPEIERTSGEYLVKNGIRTFACSETVKFGHVTFFWNGNRSGYFDETKEEYVEIPSDSGITFNVAPKMKALEIAEKARDAILSGKFDQVRVNLPNGDMVGHTGDIEATVVACKAADEAVKIILDAVEQVGGIYLVTADHGNAEDMVKRNKAGKPLLDKSGGIQILTSHTLQPVPVAIGGPGLHPGVKFRNDIQTPGLANVAATVMNLHGFEAPADYEPTLIEVADN

SEQ ID NO: 4153 - DNA, 1604 bp, Panicum virgatum
  misc_feature: Ceres CLONE 1797356
  misc_feature: Encodes the peptide sequence at SEQ ID NO. 4154
gagctcaagccagagcaagaagcagcagcctagctagggaacgcaagcgccccggccccagcgctcccggccatgagtaacttcggtgggcggccccatggcggccatgggacggcgacgatcccgtgcaagtactgccgggcgccgctcagcgtgatccccggcgagcgcgccatccagtgcgcgcactgcaactgcgtgacgcgcatccggcgcgccgaccgcatcccgctgccggtcatggggcccctgacggcgccgttccagcgcgcccgcggcaagaagcgcgccgtcctggtcggcatcacctacgccggcggcatgcgccgtggctgcggcgagctcaggggccccatcaacgacgtcaagtgcatgaggaacctcctctgccagcgcttcggcttccccgccgagtgcatcatcatgctcactgatgaccagagggacccgttcaggctgccgaccaaggacaacatccggatggcgatgcagtggctggtgcagggctgcagctacggcgactccctggtgttccacttctccggcatcggcgcgcaggtggccgacgacgacggcgacgaggtggacgggtacgacgaggccctctgcccgatggacgccttccagaggggccccatcctggacgacgagatcaacgaggccatcgtgcgcccgctcgtgcacggcgtccggctccacgcagtcgtggacgcctcctacagcgccaccgtcctcgacctccccttcctctgccgcgtcgcccggaacggctactggcagtgggaggaccagcgccccccctcgggcgcctggaagggcaccagcggcggccaggccgtgctcttcagcggctacagcaacggcaagagcaactttgccgtgatgccggacgcctacggatccgtcggggccatgacgcacagcttcgtccgggcggtggagtgcgagccgcgcggggtcacatacggccgcctgctcacctccatgaggaccatcatgaagtgcggcggcggcgggggctacgacgacctgcagggacccatcggcgcgccgatgcaacaccaccaggtcgccaacttcagcggcgtgcaggagcctaacctgtcgtcttcggagatgttcgacatctaccgcaagcccttcgtcctgtgaggagcaccattggtggctgtgcttcgagaacgtgacacttcataatatgtatcgtcgtagtcacggaataatcggtcgacacgcgtttagctctgaagcttcgtctgaaagagcgtgacgtgtcccctgcaatgattatcaagaaaacaacgtagctagctcataggtcgtggagggcttggttggtcatacgtgcctcctctgcctttctacacctctcccactgttgtctcttatatatgctgctgcatctcaaacacaaaggcatcataagctgtgagacttatgcagctatgtatgcaaactgaaatcaaactacatgaaaatgtactgctctatgttgtgcagtcatgtaaacaaacttctgttttctgatctggatatgcatgcaagaggtctcaagaagtcagattcagaacttttatggatgccaaaaaaaaaaaaaaaaaaaa

SEQ ID NO: 4154 - protein, 359 aa, Panicum virgatum
  misc_feature: Ceres CLONE 1797356
  misc_feature (1)..(195): Pfam Name: Peptidase_C14 Pfam Description: Caspase domain
MSNFGGRPHGGHGTATIPCKYCRAPLSVIPGERAIQCAHCNCVTRIRRADRIPLPVMGPLTAPFQRARGKKRAVLVGITYAGGMRRGCGELRGPINDVKCMRNLLCQRFGFPAECIIMLTDDQRDPFRLPTKDNIRMAMQWLVQGCSYGDSLVFHFSGIGAQVADDDGDEVDGYDEALCPMDAFQRGPILDDEINEAIVRPLVHGVRLHAVVDASYSATVLDLPFLCRVARNGYWQWEDQRPPSGAWKGTSGGQAVLFSGYSNGKSNFAVMPDAYGSVGAMTHSFVRAVECEPRGVTYGRLLTSMRTIMKCGGGGGYDDLQGPIGAPMQHHQVANFSGVQEPNLSSSEMFDIYRKPFVL

SEQ ID NO: 4155 - DNA, 1802 bp, Panicum virgatum
  misc_feature: Ceres CLONE 1797363
  misc_feature: Encodes the peptide sequence at SEQ ID NO. 4156
agcagctcaaccagtccagcagaccagtaatccagtagtacgatagagccgcacgtgtctgcggtatgagaggagcacaaggagccttgctttccttgcctgcctgcctgctcccatccatcctatctatatatcctccaattcaattcttccttgcttcgttcatcctccgtcctatccgggaggaaaggagctacgtagatggagcagccgcaggtggtgccggcggcgaacaagaacaagtcgtcatcgtcttgtcggttccggcgggtgtgcgtcttctgcggtagcagccccgggaagaaggcggcctaccagctcgccgccgtccagctcggccaccacctggtggagcgcggcatcgacctggtgtacggcggcggcagcgtcgggctgatgggtctcgtctcccgcaccgtccacaacggcggcggccacgtgctggggatcgtgcccaaggccgtgctgccgcgggagctcatcggcgacacgccgggggagctcaaggacgtgtccgggatgcaccagcggaaggccgagatggcgcgcaattccgacgccttcatcgcgctcccgggtggctacggcactctggaggagctccttgaggtgatcacctgggctcagctgggcatccacaacaagccggtgggcctgctcaacgtcgacggctactacgactcgctgctctccttcgtcgacaaggccgtcgaggaaggcttcgtcacccccgccgcgcgccacatcgtcgtcgccgcccgcacgccccacgacctgctcgccaagctcgaggactacgtgcccgtgcacgacgcaacctcgcccaagctcacctgggagatggaccagatcatcaagtcatcatccgacaccaataataacatctcatcatacttctcacgctagcaagctgcaagcctattgctgtgcttattttgctattcattcacaacaaacaacaacaacaacattaattatattggattgttcttaatttgctaatcattactactaatctagctagcttcaacagctcaggacactagctacatgcagcatgtagatagacagtcatccctcacttcattttcttgcttcttaatttatatattatctttctccatctctgtaaatacataatacacttacggtactattattgctgtgctgtaatataatgttattgcatttgttccggcttgccttcaatatagttctacaaattacttgaaaaggcctgcttttatacgccgtccttccccactgcgtctgccgggagagagagagagagagagagagagagagagtttgggagggaggtcagggaggagaaagaagagggtgaggagggtgatcggagatgtcggactgggggccggtggtggtggcggtggtgctgttcgtgctgctctcgccggggctgctgctgcagctgccggccaagggcggccgcttcgtcgagttcggcaacttccagaccagcggcgcctccatcttcgtccacgccatcatcttcttcgccctcaccgccgtcttcctcgtcgccatcggggtccacatcaccaccgactagccaccccggtgatcatggcgctaccactacctgcctgcccagtgaggagcacttcgtgcgatacggcagtctgtatctgcatcagtatttgcagattgtaaatttgtaattgtaccgtacccctctgctagcagttaagcgtttatcttatacatgcaaggatttgtaatcttaccaggctgattttaaaagaattgtacactagcctcaaaaaaaaaaaaaaaaaaaa

SEQ ID NO: 4156 - protein, 234 aa, Panicum virgatum
  misc_feature: Ceres CLONE 1797363
  misc_feature (1)..(134): Pfam Name: Lysine_decarbox Pfam Description: Possible lysine decarboxylase
MEQPQVVPAANKNKSSSSCRFRRVCVFCGSSPGKKAAYQLAAVQLGHHLVERGIDLVYGGGSVGLMGLVSRTVHNGGGHVLGIVPKAVLPRELIGDTPGELKDVSGMHQRKAEMARNSDAFIALPGGYGTLEELLEVITWAQLGIHNKPVGLLNVDGYYDSLLSFVDKAVEEGFVTPAARHIVVAARTPHDLLAKLEDYVPVHDATSPKLTWEMDQIIKSSSDTNNNISSYFSR

SEQ ID NO: 4157 - DNA, 1680 bp, Panicum virgatum
  misc_feature: Ceres CLONE 1797373
  misc_feature: Encodes the peptide sequence at SEQ ID NO. 4158
aaggaaagagtttattagttcctcctttgagtggaacttcaaaggaagaacgatcgatcgagataccagcctgtgagacctgagtcactgactgctggggttcggtacgggacccctgctccgccgtgtgttctgttcattccattgtcatcgtcatccatcaccatgctttgcagtttaccatggaatactatatttttagtactagttattttttgccccctgaacattcatgtgtagcagtagttacaaacgcgtacgccttaccttgttcgtgctatgtatgatgcattcgctgcgtgacgattcatctgatagatctgactgaatggaagctgacagggtttcaatccattgcttttgcttgcttctatgtctcaaacagacatactaactcctatcaagtagcttgctttactcacaacgcaaatgttccttgcatccacaagccaagcaacatcgatctctatttaatgggacaatctggctgctcatctcttcgctcatccatcgcactcatctatctctgatgcacacaccagtcatcagagctagttgcaagttgtcagagaaaactagttaacaatggaggggaagaagcagttgcttgctaccttggtcggctgcaactacgccggcacgccccacgagctgcgaggctgcatcaacgacgtcctcgccatgcgagacaccctcgtcgcccgcttcggcttcgcgcccggcgacatcgccgtgctcaccgacgacgaccgcagcgccgccgccgtgctcccgaccggcgccaacatcaagcgcgcgctcgccgacatggtggcccgcgcctcgcccggggacgtcctcttcttccactacagcggccacggcacgctcgtcccgcaccgccgcggccatggcgcgcgccaggacgaggccatcgtgccctgcgacttcaacctcatcacggacgtggacttccggcagctcgtggaccgggtgccgcagggcgccaccttcaccatggtctccgactcgtgccacagcggcggcctcatcgaccaggagaaggagcagatcgggccctccgccgtcgtcaccgacgacctcgccgtcgacggtaccaccacgcgcgccgcccgcgcccgcttcctcccgtacgccgccgtcgtcggccacctctccggcgcctcgggcgtcgacgcgtcccaccacgtcgccgaccacctcctcgcgctcttcggcgccgacgccagcgccaagttccgccaccaccacgacgcgccgacgccgagccccgacggcggcatcctgctgagcgggtgccagacggacgagacgtccgcggacgtggcggcggacgacgaggcggccgtcggcggaaaggcgtgcggcgcgttcagcagcgcggtgcaggccgtgctggcggcgcacccggcgccggtgagcaaccaggaggtggtgagccgggccagggagctgctccgggaccaggggttcgagcagcacccctgcctctactgcagcgacgccaacgccgacgcgccgttcctctgccagcaggagggggccgccgccattcccgccctgtgattctccatgatttgtgtcagagtggtcttcaaccttcattacctgtgaggctgtgaatatgaacacacacgaaccatcatgatgatgacatgccaaaaaaaaaaaaaaaaaaaa

SEQ ID NO: 4158 - protein, 326 aa, Panicum virgatum
  misc_feature: Ceres CLONE 1797373
  misc_feature (2)..(312): Pfam Name: Peptidase_C14 Pfam Description: Caspase domain
MEGKKQLLATLVGCNYAGTPHELRGCINDVLAMRDTLVARFGFAPGDIAVLTDDDRSAAAVLPTGANIKRALADMVARASPGDVLFFHYSGHGTLVPHRRGHGARQDEAIVPCDFNLITDVDFRQLVDRVPQGATFTMVSDSCHSGGLIDQEKEQIGPSAVVTDDLAVDGTTTRAARARFLPYAAVVGHLSGASGVDASHHVADHLLALFGADASAKFRHHHDAPTPSPDGGILLSGCQTDETSADVAADDEAAVGGKACGAFSSAVQAVLAAHPAPVSNQEVVSRARELLRDQGFEQHPCLYCSDANADAPFLCQQEGAAAIPAL

SEQ ID NO: 4159 - DNA, 1688 bp, Panicum virgatum
  misc_feature: Ceres CLONE 1797378
  misc_feature: Encodes the peptide sequence at SEQ ID NO. 4160
aagcctcttctcttctcgcttggaactctttgcacgccgctatgcgggcaaccattggagccactgatttcttcaacaacaaaaaaaatctgtcggagccacttgatttattatggtttcagagagatgagagtgccgttgaacactgtcagctcgtcaatctagctagctagctagcgtcctttggaattttggcgttcgtcgcaaacatgcatcgaagggaggccatcgaggacgttgtcatcgtgggcgccgggctcgccggcctcgcgacagccctcgggctccacaggaaaggggtgaggagcctggtcctggagtcgtcgccggcgctgcggacggcggggttcgcgttcacggcgtggaggaacgccttccgggcgctggacgccctcggggtgggcgacaagatcagggagcagcatctgcaggcgcaggcgctacgcgtcatgtcttcgtctaccggggaggtcgcgcaggaactggacctgacggcggtgcagaagaaccgatcaggacccaatgagatccgctgcgtcaggcgggacgcgctgctgcagaccttggaggaggagctgccacgaggcaccatccgctactcctccaggattgtgtccatcgaggacggtggcggcgtcaggatcctgcgtctagctgatggctcgactctgagggcaaaggtgctgattgggtgcgacgggatcaactccgtggtggcgaaatggctgggcctcgcggagccgtcctactcggggcgcatggcggcgagaggcctcgcgcatttcccggacggccacggcttggagcccaagttcctgcagttcatcggccgcggcttccgctccggcatgcgaccctgcaaccagactgacgtctactggttcttcacctggactccttccgagaacgataagggcgtcatcgagagtggctcaaagctgaagcagttcgttctggccaacctcacggccctgaaggtgcctccaatggcgctggcggtgatcgagaggagcgagacgagcgaggtcttcgcggtgccgctgcggttccggccgccgctctcgcttctaaccggaagcatcagcaagggcagtgtctgcgtggccggcgacgcgctgcacccgatgacgccggacctgggccagggcggctgcgccgcgctggaggacagcgtcgtcttggccaggtgcctgggcaaggccgttctcggcgacggcgcgaggagcggcacggagagccagaggatcgaggagggattgcgagagtacgctgggatccggcgatggaggagcgtcgagctcgttgccacggcctatgtggtcggtttcattcagcagagtaacaatgccatcggaggcttcctgcgggacaagtttttgtcagggttcctcgcgagacggcttctgaagatggcagaatatgactgtggcacgctctggagctgttaattaggcgaccctaatgtatttggcaaagcagcgcatagaggtggggtccacagcaggtcgtccatagttatggtaaataccatggtaaaagttatattgggtgccaccgaaggttaaaaaaaatccacacggttctgcacttttcgttggctagttttgtttggctactctatgatactcctttcaatacagttatgatagctatattttcactcggtacaaaaaaaaaaaaaaaaaaaa

SEQ ID NO: 4160 - protein, 412 aa, Panicum virgatum
  misc_feature: Ceres CLONE 1797378
  misc_feature (1)..(48): Pfam Name: Lycopene_cycl Pfam Description: Lycopene cyclase protein
MHRREAIEDVVIVGAGLAGLATALGLHRKGVRSLVLESSPALRTAGFAFTAWRNAFRALDALGVGDKIREQHLQAQALRVMSSSTGEVAQELDLTAVQKNRSGPNEIRCVRRDALLQTLEEELPRGTIRYSSRIVSIEDGGGVRILRLADGSTLRAKVLIGCDGINSVVAKWLGLAEPSYSGRMAARGLAHFPDGHGLEPKFLQFIGRGFRSGMRPCNQTDVYWFFTWTPSENDKGVIESGSKLKQFVLANLTALKVPPMALAVIERSETSEVFAVPLRFRPPLSLLTGSISKGSVCVAGDALHPMTPDLGQGGCAALEDSVVLARCLGKAVLGDGARSGTESQRIEEGLREYAGIRRWRSVELVATAYVVGFIQQSNNAIGGFLRDKFLSGFLARRLLKMAEYDCGTLWSC

SEQ ID NO: 4161 - DNA, 1994 bp, Panicum virgatum
  misc_feature: Ceres CLONE 1797390
  misc_feature: Encodes the peptide sequence at SEQ ID NO. 4162
ataatttccggcattaattgctcgtctcctcccctcctctccctccctccccatccgtgtgtcgtcgcctatccgatctgccacctccacgccgtctcgcacgttccttccccaactccgcagcgcaggcggctccccgcgccgcgatccagatccaggttcttcagcatgggtctggtgaaggatagcgccgacatggaggagggaaccctcgagatcggcatggagtacaggactgtctctggtgtggccggacctctggttatattggacaaagtaaagggcccaaagtaccaggaaatcgtaaacatccgacttggagatggcacaactcgccgtggtcaagttttggaagttgacggtgaaaaagctgttgtgcaggtctttgaaggaacttccggaatagacaacaaatacacaactgtgcagttcacaggcgaggttctgaaaactcctgtatcacttgatatgcttgggcgcatttttaatggttctggaaaacctattgacaatggccccccgatattgcctgaggcgtacttggatatctctggaagctctatcaaccccagtgagagaacctatccagaggagatgatccaaacggggatatccaccattgatgtcatgaactctattgctcgtggtcaaaagattcctctcttttctgctgctggtctccctcacaatgaaattgctgctcagatttgtcgtcaggctggtcttgtgaagacattggagaaaggcaagcatgcagagggtggtgaagatgacaactttgctattgtgtttgctgctatgggagtgaacatggaaacagcccagttcttcaaacgcgattttgaagagaatggttccatggagcgggtcactctttttctgaatctggcgaatgaccctaccattgaacgtattatcacccctcggattgcacttacaacagcagaatatttggcgtatgaatgtgggaagcacgtacttgtcatcttgacagatatgagttcttacgcagatgcacttcgtgaggtatctgcagctcgagaagaggtgccaggtaggcgtggttatcctgggtatatgtatactgatttggcaacaatatatgagcgtgctgggcgtattgaaggaagatcaggctccattacgcaaattcccattctaacaatgcctaatgatgatatcacgcatcctactcctgatcttacgggatatattaccgagggacagatatacattgatagacaactccataacagacagatttatccacctatcaatgtgctgccatctctctcccgattgatgaagagtgctattggtgagggtatgacacgccgggaccattccgatgtatctaatcagctttatgccaactatgcaattggaaaggatgtccaggctatgaaggcagtcgttggagaggaggcactctcgtctgaggatctgctttacttggagttcctcgacaagtttgagaggaagtttgtgacacaaggagcatatgacacgaggaacatcttccagtcccttgatctcgcatggacattgcttcgcatcttccctcgcgagctcctccatcgtatccctgcaaagaccttggaccagtactacagcagagacgctacccactgattgttgatcagggttccaatgttttggcaagtgcagctttgaataaattgaacagattggccttgtggccttttcgctgtatttatctatagtcaggtccaattcttttccgttggtgagcgcaagttatttgtagatgactcggtcacggcgacatttgtaatattatgtcatgtatcgctatatcatacacttgagttatttgtttcacctgccagaactgttagcaagggcattctgggccaggatgttcggacgcactggttgtatctacatttgtgaatgaataaaggaggggaaataaactgcagcaaaaaaaaaaaaaaaaaaaaaaaaaaaaacaaaaaaaaaaaaaaaaaaaa

SEQ ID NO: 4162 - protein, 487 aa, Panicum virgatum
  misc_feature: Ceres CLONE 1797390
  misc_feature (1)..(231): Pfam Name: ATP-synt_ab Pfam Description: ATP synthase alpha/beta family, nucleotide-binding domain
  misc_feature (1)..(93): Pfam Name: ATP-synt_ab_C Pfam Description: ATP synthase alpha/beta chain, C terminal domain
  misc_feature (1)..(487): SWISSPROT Homolog: EC 3.6.3.14 Vacuolar ATP synthase subunit B isoform 1
  misc_feature (9)..(487): SWISSPROT Homolog: EC 3.6.3.14 Vacuolar ATP synthase subunit B isoform 2
MGLVKDSADMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKTLEKGKHAEGGEDDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRSGSITQIPILTMPNDDITHPTPDLTGYITEGQIYIDRQLHNRQIYPPINVLPSLSRLMKSAIGEGMTRRDHSDVSNQLYANYAIGKDVQAMKAVVGEEALSSEDLLYLEFLDKFERKFVTQGAYDTRNIFQSLDLAWTLLRIFPRELLHRIPAKTLDQYYSRDATH

SEQ ID NO: 4163 - DNA, 2625 bp, Panicum virgatum
  misc_feature: Ceres CLONE 1797393
  misc_feature: Encodes the peptide sequence at SEQ ID NO. 4164
gaggagagctcgggtcgtcgctgcgtgcctgggttcgtgtgcggctgtgacagctgtgtgaaggagaggggggtcgtggtggtgctgtggccgggccaatggcgccgtcgtggtgggggaaggacgcgagggccaatggcggcggcgggacgccggtggtggtgaagatggacaaccccaactggtccatctccgaggtctccgcgtcggaggtggcgccgggctcgccggcgggcggcggcgggggcaaggccgggcggggcaagaacgcgcgccagatcacgtgggtgctgctcctcaaggcgcaccgcgccgcgggccggctcacgggggcggcctccgccgcgctcgccgtcgcggtcgccgcgcgccggagggtggcggcggggcggacggactccgacgccgcgcccggggagaacaccgcgctgcgcacgggcttctacggctgcatccgggtgttcctcgtgctgtccctgctgctgctcgccgtcgaggtggcggcgtacctccaggggtggcacctcgacgtgggcgaggggctcctcgccgtcgacgggctcttcgccgctgcctacgcgggctggatgcgcacccgcctcgactacctcgcgccgccgctgcagttcctcaccagcgcctgcgtcgtcctcttcttgatccagagcgtcgaccgccttgtcctttgcctgggctgcttctggatcaagctcaagggaatcaagcccgtgccgctggcggccggcaaggaggacttcgaagccggcgtcgaggacttccccatggtgctcgtgcagatgcccatgtgcaatgagagggaggtgtaccagcagtccatcggtgcagtttgcagcctggactggccaaggtcaaacttccttgtccaagtgctcgatgattctgatgatgctaccacttcagcacttatcaaggaggaagtggagaaatggcagctggagggtgtgcgcataatataccggcaccgggtaatccgggatggctataaggctggaaacctaaaatcagccatgaactgcagttatgtgaaagattatgagtttgttgtcatctttgatgctgatttccaaccacaagcggacttcctgaagcacaccgtgccccatttcaagggaaaggatgatgtggggttggttcaggcaagatggtcttttgtaaacaaggatgagaacttgctgaccagacttcagagcataaatctttgcttccactttgaggtggagcagcaggtgaatggtgcgtttctcaactttttcgggtttaacggcactgcgggagtgtggagaattaaggcacttgaggattctggaggatggatggagaggacaacagtggaggatatggacatagctgtccgagcacatcttaagggatggaagtttgtctacctaaatgatgttgagtgtcaatgcgagttgccagaatcctatgaagcttacagaaagcagcaacaccggtggcactcaggtcccatgcaattgtttaggctgtgctttgtggacataatcaaatctaagattggattctggaagaagttcaatctcattttccttttcttcctcctccggaagctcatcctaccattctattcgttcactcttttctgtgtcatccttcccatgacaatgtttgttcctgaagctgaactccccgcatgggtagtatgctacattccagctacaatgtccatcctaaacatcctcccagcccccaaatccttcccgttcattgttccgtaccttctgtttgagaacaccatgtcagtaaccaagttcggtgccatgatttctggcctgttccagctcgggagtgcctacgagtgggttgtcaccaagaaatcaggtcgttcttctgagggtgacctcgttgccctcgttgagaagcactctaagcaacaaagagtaggttctgcacccaatcttgatgcgctaacaaaggaggagtcaaatcccaaaaaggacgcaaagaagaagcacaataggatctacaggaaggaactcgcactgtccttccttctgctaacagcagccgcccgcagcttgctgtccgcccagggcatccatttctacttcctcctgttccaaggggtctcattcttggtcgtcggtctcgacctgatcggcgagcaagtggagtgacagaaataaggagtataatgggttctttctctctttttttttgtctgaagaaatctttgcaagcacctaagcggctctgtgtaaagggaagggcgtcgcactctctgatgcttacacaaggaagctctggtcccctattccaggggtcgagattcaccagagatttacttgagattcaccagagatttacttgaaaaaaagattcaccagagatttacttgaaaaaaagattcaccagagatactgaaatgtggagctgtagataggtatagtttggattagcctgtgagatgcttttattctttcaggtctcgattcttttgtaagaatatttctgtgcctagatgggttctttctttctttctttctttctttctttctttcttgacagactttaccttcaaatgaagataatacttgtggttaccatgtatttgatcaatcaatcaattaccatgattgttgagac

SEQ ID NO: 4164 - protein, 685 aa, Panicum virgatum
  misc_feature: Ceres CLONE 1797393
  misc_feature: Great-hit functional homolog of the protein sequence encoded by LOCUS At4g07960
  misc_feature (1)..(176): Pfam Name: Glycos_transf_2 Pfam Description: Glycosyl transferase family 2
  misc_feature: Useful for making plants with altered cell wall content and/or composition
MAPSWWGKDARANGGGGTPVVVKMDNPNWSISEVSASEVAPGSPAGGGGGKAGRGKNARQITWVLLLKAHRAAGRLTGAASAALAVAVAARRRVAAGRTDSDAAPGENTALRTGFYGCIRVFLVLSLLLLAVEVAAYLQGWHLDVGEGLLAVDGLFAAAYAGWMRTRLDYLAPPLQFLTSACVVLFLIQSVDRLVLCLGCFWIKLKGIKPVPLAAGKEDFEAGVEDFPMVLVQMPMCNEREVYQQSIGAVCSLDWPRSNFLVQVLDDSDDATTSALIKEEVEKWQLEGVRIIYRHRVIRDGYKAGNLKSAMNCSYVKDYEFVVIFDADFQPQADFLKHTVPHFKGKDDVGLVQARWSFVNKDENLLTRLQSINLCFHFEVEQQVNGAFLNFFGFNGTAGVWRIKALEDSGGWMERTTVEDMDIAVRAHLKGWKFVYLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFGAMISGLFQLGSAYEWVVTKKSGRSSEGDLVALVEKHSKQQRVGSAPNLDALTKEESNPKKDAKKKHNRIYRKELALSFLLLTAAARSLLSAQGIHFYFLLFQGVSFLVVGLDLIGEQVE

SEQ ID NO: 4165 - DNA, 1416 bp, Panicum virgatum
  misc_feature: Ceres CLONE 1797394
  misc_feature: Encodes the peptide sequence at SEQ ID NO. 4166
cccgcaaaagccacacacgcgcatccgggaaagcggagccctaatctcaaggccgcggctgccagcgctccctctcctccccagccgccgccagccgcctgccgagctcgccggcgcgctcgcctacctccccgctcctccgggttctcgggatggaggccgaggcggcggccaagagggcgcgggagacctcggaggacgccgtggcggcgggggcgggggccgattcggcggccggtgccggcgagcaggcggggatctccgccgtcatccccggatggttctccgagatcagccccatgtggcccggtgaggcgcactctttgaaggtggagaaggtgctgttccaagggaagtcggactaccaaaatgtcatggttttccagtcctctacgtacggcaaggtgctggtgctggatggagtgatccaggttactgagagggatgaatgcgcataccaagagatgatcacccatctccccctttgctccatcaaagatcccaagaaggtgttagttataggaggaggagatggtggtgttctgcgtgaggtttcacgacattcctctgtggaacaaattgacatttgtgaaattgacaagatggtggtagatgtctccaagcaatttttccctcatctggctgttggatttgaagaccctcgtgtgtcattacacattggagatggcgtggcctttttgaaaaacgttccagagggtacttacgatgcagtgattgtcgattcctctgatccgataggtcctgcccaagagctttttgagaagcctttcttccagtcggtggccagggctttacgtccaggtggagttgtgtgcacccaggcagagagcatttggctacatatgcacatcattgaagacattgttgccaattgccgccaagttttcgaaggctcagttaactatgcttggacaacagtacctacataccctagtggtgtgattggcttcatgctttgctccaccgaggggcctgctgttgatttccagcaccctgtttttaacattgaggaggatgagcattctacgaaatcaaaaggaccgctgaagttctacaactctgagatccacacagcatcattttgtttgccctcttttgcgaagagggtcattgagtcaaaggccaactagatgccaagggattacatcaaatctggtctgttggaccaagaaccttaggaacaacacaaaatttgttttcccctttgaaataagcatccgagatgagatgctagcagttatcggagttgtcgatctatatgattccggtaagtcagatgtcctggctgcatcgtgcagccatgaaaacattttgcgatagctgttttcagcagtcctcagatcatttatcgatatgagtttccagttttggcgtcaaaaaaaaaaaaaaaaaaaa

SEQ ID NO: 4166 - protein, 332 aa, Panicum virgatum
  misc_feature: Ceres CLONE 1797394
  misc_feature (1)..(246): Pfam Name: Spermine_synth Pfam Description: Spermine/spermidine synthase
  misc_feature (1)..(332): SWISSPROT Homolog: EC 2.5.1.16 Spermidine synthase 1
  misc_feature (29)..(331): SWISSPROT Homolog: EC 2.5.1.16 Spermidine synthase 2
MEAEAAAKRARETSEDAVAAGAGADSAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNVPEGTYDAVIVDSSDPIGPAQELFEKPFFQSVARALRPGGVVCTQAESIWLHMHIIEDIVANCRQVFEGSVNYAWTTVPTYPSGVIGFMLCSTEGPAVDFQHPVFNIEEDEHSTKSKGPLKFYNSEIHTASFCLPSFAKRVIESKAN

SEQ ID NO: 4167 - DNA, 1378 bp, Panicum virgatum
  misc_feature: Ceres CLONE 1797398
  misc_feature: Encodes the peptide sequence at SEQ ID NO. 4168
aatgactcgaggccgcgcgccgtcgagcatggggggagatcaccatcaccaccacgacggcagcatggcgcgcggcgcgggcgtcgacgacgggcagcagcaggcgcacgacatggtgatgccgggcttccgcttccacccgactgaggaggagctcatcgacttctacctccgccggagggtggagggcaagcgcttcaacatcgagctcatcaaccttgtcgacctctaccgctacgacccgtgggatctccccgctctggcttcaattggggacaaggagtggttcttctacgtgccaagagaccgcaagtaccgcaacggcgaccggccgaaccgggtcactccatcaggctactggaaggccacaggggcagatcggatggtgcgcgttgagggcaaccggtccatcgggctgaagaagactctggtgttctatgtggggaaagcacccaaggggcttaggagcagctggatcatgaacgagtaccgccttcctcatggcgaggccgaccggtaccaaaaggaaatttccctttgccgagtgtataaacgtcctgggattgaagacaactttcacctcaccaccaccacaagatcatccggctcaaaggcggcagcgtctatgaaaaagaagcaccatcggacatcggcagcgtcaccccgcttggcaccaatgttcgacggtgcccactcagcagctcacatgatcagcaagccatacagtggaacaaaccccatcatggcatcatcagcttcagctcgagcagcaacaatggcacctcagacatcaatggcattcctgtcagccgcctcgcttagctccaccacgtcaacagaagaggatggtacatcactctaccacttgaagggcgccaacccaccgatgctgccttcttcaacacacgccctgcttaacgcaaactccactacaatggcaaccatcccaatagatgagctgagtagggcaattgggtcatacaacaaccagggaaaccctaaccagcccgctttgccgtcacaaggtccattgcttccttttcctagcatggaaaagatttgggactggaaccctctcctagagtctcccaaggtttgcacaagcttcaagtgattttctgagtgcacgctagcacacatatgcaggcatgatctagggctcgaagcatacgcatgccggcacgcgtgcacgtattctatatatatgaatacgattgtatatgcatgtgtagacacttaattatttgggctaggatgaggcagttctagtcccatgcaatatgttccacaatcattcagttccatcacatgaaaagatgacgctgtaacaaaaaatatgtcaatttctatttcaagataaaaaaaaaaaaaaaaaaaa

SEQ ID NO: 4168 - protein, 370 aa, Panicum virgatum
  misc_feature: Ceres CLONE 1797398
  misc_feature: The sequence is a functional homolog of  SEQ ID NO 116 in the  10/225,066 US patent application
  misc_feature: The sequence is a functional homolog of  SEQ ID NO 2476 in the  10/374,780 US patent application
  misc_feature: The sequence is a functional homolog of  SEQ ID NO 88 in the  11/375,241 US patent application
  misc_feature: Useful for making plants with modulated growth and phenotype characteristics
MTRGRAPSSMGGDHHHHHDGSMARGAGVDDGQQQAHDMVMPGFRFHPTEEELIDFYLRRRVEGKRFNIELINLVDLYRYDPWDLPALASIGDKEWFFYVPRDRKYRNGDRPNRVTPSGYWKATGADRMVRVEGNRSIGLKKTLVFYVGKAPKGLRSSWIMNEYRLPHGEADRYQKEISLCRVYKRPGIEDNFHLTTTTRSSGSKAAASMKKKHHRTSAASPRLAPMFDGAHSAAHMISKPYSGTNPIMASSASARAATMAPQTSMAFLSAASLSSTTSTEEDGTSLYHLKGANPPMLPSSTHALLNANSTTMATIPIDELSRAIGSYNNQGNPNQPALPSQGPLLPFPSMEKIWDWNPLLESPKVCTSFK

SEQ ID NO: 4169 - DNA, 1707 bp, Panicum virgatum
  misc_feature: Ceres CLONE 1797413
  misc_feature: Encodes the peptide sequence at SEQ ID NO. 4170
gtctcccgttctgctctccctccctccccctctctcctctcgtggctttcctttcacggcggcggcgccgacttggcgagcgccgacgcccttcgactcccttcgccgggcccttcgacggcgacgagcgcccaccagatccagtgaagcttgccaactcgacataaggtgtttaagaaattcaagcatcgcttcaccataacttcaaggcaatatccttgttaattttggtaacctccagtacgttgctgagagttttcctggacacaggggaataaggatcctaagatttttttatattgcattgtagccagtgttataatggctacaaaacttgtagttcttggtatcccctgggatgttgacactgaaggattacgggagtacatggccaagtttggacccctagatgactgcgttgtcatgaaggagcggtcttctgggcgatcacgtgggtttggctatgtaacattctcatcagctgatgatgcaaagaatgttcttgaatgtgaacatgttcttgggagccggactttagaagtgaagatagctactccaaaggaagaaatgaaatcacaaggaacaaagaaagctacaaggatatttgttgctcgaattccacaatctgtggatgagtcgatgtttcgtaggcattttgaagcttttggagaaattcttgatctttacatgccaaaaaaacatggttcaaaagggcatcgtggaattgggtttatcacgtttcagagtgcagaatctgtggacagcatcatgcaagagtcgcatgaacttgatggtacaactgtagttgttgatcgtgcaactccaaaggatgaagatgtcaggtaccccccgagcagggcatcgcaaggtggctatggtgcatataacgcatatatttcagctgctaccagatatgcagccttaggtgcaccaacactgtatgaccatccaggatcagcttatggaagagggtattatggatcctctcaagcagttggcaagaagatatttgttggtaggcttccacaagaagcaaacacggatgacctgaggcattactttggcagatttggtcgaatcgtagatgcatatattccaaaggaccctaaaagaagtggccaccgaggttttggttttgtcaccttcgctgatgagagtgtggcagaacgggtagctcgcagaagccatgaaattctgggacaagaggttgcaattgacacagctgcaccgcttgagagcgattcatctggtggcgcttatgttgatcccatggacctttatggcgcttatggttcaatgcgatctttcggcaggttctgtggcagtctagattataattatgggtatggtcccagcagtggaagcagcagatcaagaggggattggcgataccgaccttactgaacaagtcgcgcgtgtcggttattgtcaagtgctgttttagttcacctctagagggaggaaactgtggagatggggaaaagaaatacttgtttgagaatgctaagtggtatgtgaaccttaagtggggcgtgtggaacctatctatttgttcatgttgtaatttttaacatggaaatgctatggtgctatttctttgtcattgttaaacattggtgctaaaagatgaaggcagccttgtagttattgtgtggaactgctgcctgtaataaaaaaaaacttttgcaaaaaaaaaaaaaaaaaaaa

SEQ ID NO: 4170 - protein, 360 aa, Panicum virgatum
  misc_feature: Ceres CLONE 1797413
  misc_feature: Great-hit functional homolog of the protein sequence given in SEQ ID NO 9224
  misc_feature: Great-hit functional homolog of the protein sequence given in SEQ ID NO 9517
  misc_feature: Useful for making plants with altered Lignin content
  misc_feature: Useful for making plants with modulated biomass
  misc_feature: The plant is abnormally small.
MATKLVVLGIPWDVDTEGLREYMAKFGPLDDCVVMKERSSGRSRGFGYVTFSSADDAKNVLECEHVLGSRTLEVKIATPKEEMKSQGTKKATRIFVARIPQSVDESMFRRHFEAFGEILDLYMPKKHGSKGHRGIGFITFQSAESVDSIMQESHELDGTTVVVDRATPKDEDVRYPPSRASQGGYGAYNAYISAATRYAALGAPTLYDHPGSAYGRGYYGSSQAVGKKIFVGRLPQEANTDDLRHYFGRFGRIVDAYIPKDPKRSGHRGFGFVTFADESVAERVARRSHEILGQEVAIDTAAPLESDSSGGAYVDPMDLYGAYGSMRSFGRFCGSLDYNYGYGPSSGSSRSRGDWRYRPY

SEQ ID NO: 4171 - DNA, 1495 bp, Panicum virgatum
  misc_feature: Ceres CLONE 1797417
  misc_feature: Encodes the peptide sequence at SEQ ID NO. 4172
gctagggtttctggctgctcccgctccggctctgctttcccctgctgcgctgctgctcgcccgatctcgctcttcctccagctatctgagatcgagcgaaggtagcggccagtggagatggcgcttgtactgcatgctggcagtggtaacaaaaatgcattcaaggctcttattgccgcggaatacagcagtatcaaggttgagttggtgaaggactttcaaatgggtgtctccaacaaaacccctgagtttctcaagatgaaccccattgggaaggttcctgtcctcgagactcctgatggtcctgtttttgagagcaatgcaattgcacgatatgttactcgcttgaaggatgacaacccactttatggatcttcactgattgattatgcccacattgaacaatggatggactttgctgcaacagaggtcgatgctagcattgggaagtggctgtacccacgtatggggttttatccctatgctgctgtgagtgaggaaacagccattgcggctttgaagagagcattgggttccctcaacactcaccttgcattaaacacatttcttgttgggcattcggtgactcttgcggatatcgtgctgacatgcaacctctacttgggctttattcggatcttgaccaagagtttcacctcggagttccctcatgttgagaggtacttctggaccatggtcaatcagccaaacttcaagaaagtcataggcgatgtgaagcaggcggaagctgtgccacctgttccaaagaaggctgcaccagcgaaggagcagaagcctaaggaagccaaaaaggaggccccaaaagagaccctgaagcctaaggcagatgagaaaccggcggaggaagaaccaaagcctaagccaaagaatcctcttgatttgctccctccaagcaagatgatccttgatgattggaagaggctgtactccaacacaaaaaccaacttccgcgaggttgctatcaaaggtttctgggatatgtatgacccagagggctactccctgtggttctgtgattacaagtacaatgatgagaacaccgtgtcttttgtaaccatgaacaaggttggtgggttcctgcagcggatggacctgtgccgcaaatatgcttttggaaaaatgcttgtggttggctctgagccacctttcaaggtcaaggggctctggctattccgtggctcagagatcccaaagtttgtcatggatgaggtctacgacatggagctttatgagtggaccaaggttgacctctccgatgaggcccagaaggaacgtgtcaatgccatgattgaggaccaggagcccttcgaaggcgaggctttgctggatgcgaaatgcttcaagtgagcaccgtttatttgcaatggatctgtgaaagttgttggttttgggggtccagttctaaaatagtcaatgtatctcgagctcatgaatgttaagttttgatactggctaaaaaaaaaaaaaaaaaaaa

SEQ ID NO: 4172 - protein, 416 aa, Panicum virgatum
  misc_feature: Ceres CLONE 1797417
  misc_feature (1)..(93): Pfam Name: GST_C Pfam Description: Glutathione S-transferase, C-terminal domain
  misc_feature (1)..(76): Pfam Name: GST_N Pfam Description: Glutathione S-transferase, N-terminal domain
MALVLHAGSGNKNAFKALIAAEYSSIKVELVKDFQMGVSNKTPEFLKMNPIGKVPVLETPDGPVFESNAIARYVTRLKDDNPLYGSSLIDYAHIEQWMDFAATEVDASIGKWLYPRMGFYPYAAVSEETAIAALKRALGSLNTHLALNTFLVGHSVTLADIVLTCNLYLGFIRILTKSFTSEFPHVERYFWTMVNQPNFKKVIGDVKQAEAVPPVPKKAAPAKEQKPKEAKKEAPKETLKPKADEKPAEEEPKPKPKNPLDLLPPSKMILDDWKRLYSNTKTNFREVAIKGFWDMYDPEGYSLWFCDYKYNDENTVSFVTMNKVGGFLQRMDLCRKYAFGKMLVVGSEPPFKVKGLWLFRGSEIPKFVMDEVYDMELYEWTKVDLSDEAQKERVNAMIEDQEPFEGEALLDAKCFK

SEQ ID NO: 4173 - DNA, 1837 bp, Panicum virgatum
  misc_feature: Ceres CLONE 1797428
  misc_feature: Encodes the peptide sequence at SEQ ID NO. 4174
gtcgtcttctccgtcgccgaatcacgtcctcctgcatcgcatcacaccccatggtgccagctctcactctctccgtggagccgttggctcaccgtcaccaccaccctgcaagacgagggttccggagagttcagggccgcgcggtatcaccgagggcaaggatcacgatgctcagccggcaggatccgccaggaggtggtggtgccgccaccggcgcgcctctgttcctcgggatagacttcggaacatccggggcaagatacgctctgatcgacaggcaaggcgccatccattccgaagggaaacgagcttacgcaccacctgtcggcggcggcgccgcgggctgggcgagctcctggcaggcggcgctgttccagctcctcggcgacatcccgcgggcgcaccgcccgtccatctcctccatctccattgacgggacctcggccaccacgctcatcgtcgacagcgagaccggagagctcctcgccggcccgttcctctacaatgaaagcttcccggacgcgctgcccgccgtggagtcgatagcgccggcgaaccacacggtctgctccgcctcctccaccctctgcaagctcgtctcgtggtggaacacgaccggcggcggcggcggcgccggctccgccgtgctgatgcaccagtccgactggctcctctggctcctgcacggccggtacggcgtctctgactacaacaacgccctcaaggtcggctacgacccggcggccgacgcctacccgagctggctcatggcgcagccgtactcgcgcctgctgccctccgtcatggcgccgggagcccccatcgccgccgtcagagacgacgtgcgctctcagttcgggctctccgaggagtgcgtcgtctgcaccggcacgacggacagcatcgcggcgttcctggcggcgcgcaccggcgggccggggcgggcggtgacgtcgctgggctcgacgctggcggtgaagctcgtgagcgaggcccgcgtggacgacgcgaggttcggcgtgtacagccaccgcctggacggcgcgtggctcgtcggcggcgcgtccaacgccgggggagtcgtcctccggcagctcttcaccgacgaacagctggcggcgctgagcagggacatcgacccggccgccgcgtccccgctagactactacccgctgccgaggaaaggcgagaggttcccggttgccgaccccgacatggcgccgaggttgcagccgcgccccgagagcgacgccgagtacctgcacggcattctggaatcgatcgcgcgaattgaggccaaggggtacaatctgctgagggagctcggcgcgacggcggtggaggaggtgttcacggcggggggaggagcgcagaacgacaagtggacggcgattcgggagagggtgctcggcgtgccggtgcggaaggcggagcagaccgaggcggcgtacggaggggcgttgctggcgctcaagggcgccgatcgccgagaaggagcaatggctagctagagcagatgctaaagaaatttgggcaagcacggcgctaagatctggacaagctacgatgaattgtgtaggtgacgcatgcttgaacattcttccggacagatttctggtgccaagaggagaagtgcacatgatatcttcagtaaggccagctttaacctcgaaccttttgtcaagctgcagattagagttcatttggatccaaaagtgtctgcatgctcaatgttttttttttgcgaagcatgttgattcccgggataaatctaccggttaactcctaaaataaatttataaatttcagatttagacaaaaaaaaaaaaaaaaaaaa

SEQ ID NO: 4174 - protein, 486 aa, Panicum virgatum
  misc_feature: Ceres CLONE 1797428
  misc_feature (1)..(231): Pfam Name: FGGY_N Pfam Description: FGGY family of carbohydrate kinases, N-terminal domain
MVPALTLSVEPLAHRHHHPARRGFRRVQGRAVSPRARITMLSRQDPPGGGGAATGAPLFLGIDFGTSGARYALIDRQGAIHSEGKRAYAPPVGGGAAGWASSWQAALFQLLGDIPRAHRPSISSISIDGTSATTLIVDSETGELLAGPFLYNESFPDALPAVESIAPANHTVCSASSTLCKLVSWWNTTGGGGGAGSAVLMHQSDWLLWLLHGRYGVSDYNNALKVGYDPAADAYPSWLMAQPYSRLLPSVMAPGAPIAAVRDDVRSQFGLSEECVVCTGTTDSIAAFLAARTGGPGRAVTSLGSTLAVKLVSEARVDDARFGVYSHRLDGAWLVGGASNAGGVVLRQLFTDEQLAALSRDIDPAAASPLDYYPLPRKGERFPVADPDMAPRLQPRPESDAEYLHGILESIARIEAKGYNLLRELGATAVEEVFTAGGGAQNDKWTAIRERVLGVPVRKAEQTEAAYGGALLALKGADRREGAMAS

SEQ ID NO: 4175 - DNA, 1936 bp, Panicum virgatum
  misc_feature: Ceres CLONE 1797438
  misc_feature: Encodes the peptide sequence at SEQ ID NO. 4176
gtccgtccctttccccccgcgctctccctcgcctccttctcggctctgactgacagtgacgaccccatgggcgcggcggcgaggaccgtctcatctctgctgccaatctggctcctcagcctcgtctgcgcgtcgagcgcgcagccgtacatcggcgtcaactacggcgaggtggcggacaacctgccgccgccggaggagacggcgcggctgctcaagtccacggccatctccaaggtccggctctacggcgtcgacgcggggctcatccgcgcgctggccggctccaacatctccgtcgtcgtcggcgtggccaacggcgacatcccctcgctggccgcggacccggccgcggcgtcgcggtggctcgccgccaacgtgctcccgttcgtcccggccacggccatctccgccgtggccgtgggcaacgaggtgctcgagtccggggacgcctccctggccgcggcgctgctcccggccatgcagaacctccgcgccgccgccgcgggcggcgccgccgcgggggtcaggttctccaccgtcaacaccatgggcgtgatggcgcagtcggacccgccgtccacgggcgcgttccacccggacatcacgccgcagctgcagggcatcctgagcttcctcagcaagaccggcgcgcccttcatgatcaacccctacccgtggttcgcgtaccagtccgacccgcgcccggacacgctcgccttctgcctcttccagcccaacgccggccgcgtcgacgccggctccaagatcaagtacaccaacatgttcgacgcgcagctggacgccgtcaagtcggcgatggtgcacgccgggtacgggaacgtggacatcgtggtggcggagacggggtggccgacgaggggcgacgccggcgagcccggcgcctcggtggagaacgcccgggcgtacgtgtcgaacctggtggcccacctgcggtccggcgccggcacgccgctgatgccggggaggccggtggagacgtacctgttcgcgctgtacgacgaggacctcaagcccgggccggcgtcggagcgctccttcgggctgtaccacacggacctgagcatggcgtacgacgccggactggcgggggcgggggccgccgcgccggcggcggggcagccgcggggcggcggcggcggcgggtggtgcgtggcgcgggacggcgcgtcggacgcggagctgcaggcgaacctggactacgcgtgcgcgcaggtgggcgtggactgcggcgccatccagcccggcggcgcgtgcttcgagcccaacacggtgcgcgcccacgccgcgtacgccatcaaccagctctaccaggcggcggggcgccacccctggaactgcgacttccgggcgtccgcaacgctcacctccgacaaccccagctacggcgcgtgcgtgtacaccgggggaggccaatgatgggaggcagccactgtctaaccccggcagcgtggcgcacgactcgtcctcctctccgaaggccatggtgatcggcttgggctgctgcggggggccctctggacggaccgaataaagcttcaaataatggcggtggttgtcgacctgttgtggtgtagggacgccaagtgcatgtgcagtggcgagtgcgcaaagcgtccccttgtttggcttcgtcgtagcagcagcagaagtttccccttggctggcggctggcctttgtgttgagagaacagaagattgcctttgtgttgtgagctgtgacagttgtggttagcgctttgggcaggttaattgggtcgttcgcggctttgtgtaaaccgagtgtcagttgctgtcagcctgtcagtgatggcacatggacatgcggcgtgtgttagggggtgtttagtttatttttcaaaattgtgtaaagatgtaaagagggcatttgaagtactaaatgaagtctatttgc

SEQ ID NO: 4176 - protein, 457 aa, Panicum virgatum
  misc_feature: Ceres CLONE 1797438
  misc_feature: Great-hit functional homolog of the protein sequence encoded by LOCUS At2g16230
  misc_feature (1)..(321): Pfam Name: Glyco_hydro_17 Pfam Description: Glycosyl hydrolases family 17
  misc_feature: Useful for making plants with altered cell wall content and/or composition
MGAAARTVSSLLPIWLLSLVCASSAQPYIGVNYGEVADNLPPPEETARLLKSTAISKVRLYGVDAGLIRALAGSNISVVVGVANGDIPSLAADPAAASRWLAANVLPFVPATAISAVAVGNEVLESGDASLAAALLPAMQNLRAAAAGGAAAGVRFSTVNTMGVMAQSDPPSTGAFHPDITPQLQGILSFLSKTGAPFMINPYPWFAYQSDPRPDTLAFCLFQPNAGRVDAGSKIKYTNMFDAQLDAVKSAMVHAGYGNVDIVVAETGWPTRGDAGEPGASVENARAYVSNLVAHLRSGAGTPLMPGRPVETYLFALYDEDLKPGPASERSFGLYHTDLSMAYDAGLAGAGAAAPAAGQPRGGGGGGWCVARDGASDAELQANLDYACAQVGVDCGAIQPGGACFEPNTVRAHAAYAINQLYQAAGRHPWNCDFRASATLTSDNPSYGACVYTGGGQ

SEQ ID NO: 4177 - DNA, 1819 bp, Panicum virgatum
  misc_feature: Ceres CLONE 1797441
  misc_feature: Encodes the peptide sequence at SEQ ID NO. 4178
gcggcctggctccctcctccccctgcaaatccctgcacccacacaaccactcgttttcctctccaggagaggagaaggaggggaagaggggaagagaggggacaggcgaggccggcggcgtccatccgatctgctccgactctgcggtgccgtcctcctcggtctcagcaaaatgggtgccggcggcaggatgacggagaaggagcgggagaagcaggagcggctcggccgtgccggcggcggcacggcgatgcagcgctcgccggtggacaagccaccgttcacgctgggccagatcaagaaggccatccctccgcactgcttcgagcgctccatcatcaagtccttctcctacgtggtccacgacctcgtcatcgtcgcggcgctgctgtacttcgcgcttgccatcatcccggcgctcccgagcccgctgcacctcgccgcctggccgctctactggatcgcgcagggctgcgtgtgcaccggcgtgtgggtcatcgcgcacgagtgcggccaccacgccttctcggactactcgctcctggatgacgccgtcggcctggtgctgcactcgtcgctgatggtgccctacttctcgtggaagtacagccaccggcgccaccactccaacaccggctccatggagcgtgacgaggtgttcgtccccaagaagaaggaagcgctgccatggtacaccccgtacgtgtacaacaaccccgtcggccggctgctgcacatcgtcgtgcagctcaccctggggtggccgctgtacctgaccaccaacgcgtcggggcgcccgtacccgcgcttcgcctgccactacgacccctacggccccatctacaacgaccgggagcgcgtccagatcttcatctccgacgccggcgtcatggccgtgtcgttcgggctgtacaagctggcggcggcgttcgggttctggtgggtggtgcgcgtctacgccgtgccgctgctgatcgtgaacgcctggctggtgctcatcacctacctgcagcacacccacccggcgctcccccactacgactcgagcgagtgggactggctgcgcggggcgctggccaccatggaccgcgactacggcatcctcaaccgcgtgttccacaacatcacggacacgcacgtcgcgcaccacctcttctccaccatgccgcactaccacgccatggaggccaccaaggcgatcaagcccatcctcggcgagtactaccagttcgaccccacgcccgtcgccaaggcgacctggcgcgaggccagggagtgcatctacgtcgagcccgaggaccgcaagggcgtcttctggtacaacaacaagttctagctgctgcttgcggagcctgaggtgatcgcccgtgcttgccgcaggaatgggaggagaagatcaggaagagaagatggtaatcgtcctaccaggtccccatctacctatctatggttagtcatcagtctttaggcaggaaaagagagcatttgggcacagtttgagacggctttactgcagtgccattgctagaggtgcccatcaaccacaagtaggcggatttgtcagtgtagtgtgtgtccgtggaccatggcggcgagctttgggcagctcgttccgagttgtgttttcttctccgtgtgtgttagtcgtcgccgccggtgtagcctggctggcgacgtccgttgtggttggccgtgcctggccgcgcgcgtcgtgtgcgtcttgtcattgcgtcggcgtctctcccgtcccccctcgcgtcgtgttgttgtgaaaccgtatcctctggtgcttttggcggaaaaaaaaaaaaaaaaaaaa

SEQ ID NO: 4178 - protein, 387 aa, Panicum virgatum
  misc_feature: Ceres CLONE 1797441
  misc_feature (1)..(253): Pfam Name: FA_desaturase Pfam Description: Fatty acid desaturase
MGAGGRMTEKEREKQERLGRAGGGTAMQRSPVDKPPFTLGQIKKAIPPHCFERSIIKSFSYVVHDLVIVAALLYFALAIIPALPSPLHLAAWPLYWIAQGCVCTGVWVIAHECGHHAFSDYSLLDDAVGLVLHSSLMVPYFSWKYSHRRHHSNTGSMERDEVFVPKKKEALPWYTPYVYNNPVGRLLHIVVQLTLGWPLYLTTNASGRPYPRFACHYDPYGPIYNDRERVQIFISDAGVMAVSFGLYKLAAAFGFWWVVRVYAVPLLIVNAWLVLITYLQHTHPALPHYDSSEWDWLRGALATMDRDYGILNRVFHNITDTHVAHHLFSTMPHYHAMEATKAIKPILGEYYQFDPTPVAKATWREARECIYVEPEDRKGVFWYNNKF

SEQ ID NO: 4179 - DNA, 2314 bp, Panicum virgatum
  misc_feature: Ceres CLONE 1797445
  misc_feature: Encodes the peptide sequence at SEQ ID NO. 4180
cccctctcgaaaccctagtcccgctccaccccccgccgccgccgcagcgcccccgtctcgccccccacctccggccctcgcgaagcgcctcctcgaccgccgggagtgagagaagagatggcgggcaagggcgacgggccggcgatcggcatcgacctcggcaccacctactcgtgcgtcggcgtgtggcagcacgaccgcgtcgagatcatcgccaacgaccaggggaaccgcaccaccccctcgtacgtcgccttcaccgactccgagcgcctcatcggagatgccgccaagaaccaggtcgccatgaaccccatcaacaccgtctttgatgccaagcgtctcatcggcagaaggttcactgatgcttctgtccagagtgatatcaagctctggcccttcaaggtcatttctggacctggtgagaagcccatgattgttgtccagcacaagggtgaggataagcagtttgctgctgaggagatctcctccatggttctgatcaagatgcatgagattgctgaagcttaccttggcagtactatcaagaacgctgttgtcacagttcctgcctatttcaacgactcacagaggcaggccaccaaggatgctggggtgattgctggcctcaacgtgctgcgtatcatcaatgagccgactgctgctgctattgcctatggtcttgacaagaaggccaccagtgtgggcgagaagaatgtcctcatctttgaccttggtggtggtacctttgatgtgtccctcctcacgattgaggaaggtatctttgaggttaaggccactgctggtgatactcatcttggtggtgaggacttcgacaacaggatggtcaaccacttcgtccaggagttcaagaggaagaacaagaaggacatcactggcaaccctagggctctcaggaggttgaggacagcttgtgagagggcgaagaggactctgtcttccactgcccagaccaccattgagatcgactccctgtatgagggcatcgacttctactccaccatcacccgtgctagatttgaggagctcaacatggacctgttcaggaagtgtatggagcctgttgagaagtgcctgagggatgccaagatggacaagagcagtgtgcacgatgttgtccttgttggtggttctactaggattcccagagtgcagcagctgctccaggacttcttcaacggcaaggagctgtgcaagaacatcaaccctgatgaggccgttgcctatggtgctgctgtccaggccgccatcctaagtggcgagggcaacgagaaggtgcaggacctgcttctgttggacgtcacccctctgtcccttggtctggagactgccggaggagtgatgactgtgctgatcccgagaaacaccaccatccccaccaaaaaggagcaggtgttctccacctactcggacaaccagcctggtgtcctgatccaggtgtacgagggtgagaggaccaggacccgcgacaacaacctcctgggcaagttcgagctctccggcatcccccctgctccccgtggcgtcccccagatcacggtctgcttcgacatcgacgccaacggcatcctgaacgtctccgccgaggacaagaccaccggccagaagaacaagatcacgatcaccaacgacaagggcaggctgtccaaggaggagatcgagaagatggtgcaggacgcggagaagtacaagtcggaggacgagaagcacaagaagaaggtggaggccaagaactcgctggagaactacgcgtacaacatgcgcaacacgatccgcgacgagaagatcgcctcgaagctggcggccgacgacaagaagaagatcgaggacgcgatcgacgcggccatcagctggctggacgccaaccagctggcggaggcggacgagttcgaggacaagatgaaggagctggagagcctgtgcaaccccatcatcgccaagatgtaccagggcgcgggagcggacatgggcggcgccgccggcatggacgaggacgcgcccgcgggcagcggcggcccgggccccaagatcgaggaggtggactaagcagctcgccgtcgcgtcgtggtcttatgcggtggcaggcgccactatctcacgctgctgccgcgagttatcgttttctgctgtatcgaacttaattatggttggtcggttggtactgtggtggtaatttttggacctcgtgatggtcggtcggtcagtatcgtctgtcggtgaacaatgttgcttgattggttgatcaagcgttaagtaatacggtgttattcggtaaaaaaaaaaaaaaaaaaaa

SEQ ID NO: 4180 - protein, 649 aa, Panicum virgatum
  misc_feature: Ceres CLONE 1797445
  misc_feature: Great-hit functional homolog of the protein sequence given in SEQ ID NO 9677
  misc_feature (1)..(607): Pfam Name: HSP70 Pfam Description: Hsp70 protein
  misc_feature: Useful for making plants with modulated drought sensitivity
  misc_feature: Useful for making plants with modulated heat sensitivity
MAGKGDGPAIGIDLGTTYSCVGVWQHDRVEIIANDQGNRTTPSYVAFTDSERLIGDAAKNQVAMNPINTVFDAKRLIGRRFTDASVQSDIKLWPFKVISGPGEKPMIVVQHKGEDKQFAAEEISSMVLIKMHEIAEAYLGSTIKNAVVTVPAYFNDSQRQATKDAGVIAGLNVLRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSSVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEKHKKKVEAKNSLENYAYNMRNTIRDEKIASKLAADDKKKIEDAIDAAISWLDANQLAEADEFEDKMKELESLCNPIIAKMYQGAGADMGGAAGMDEDAPAGSGGPGPKIEEVD

SEQ ID NO: 4181 - DNA, 2382 bp, Panicum virgatum
  misc_feature: Ceres CLONE 1797446
  misc_feature: Encodes the peptide sequence at SEQ ID NO. 4182
gcgcgtggcggcttggcctcatcggacagtcagcgcttctccccacatgcccggacttttcctcttctctcccttcctccaccccgtcaaatttgagtcgtcaaatttcgacaaacaattcctcctcctccacccgtcgatccgtcctcctcctcctcgtcgttcttccgcttagcagaagaaagaaaagaagtccggcgttttcccctcgtcgttcgaggaacaaacaaaatttccaggtttccaagaaaccaggacggaggcgttgaggaagtggcgccgccaccacggcggtctcccctgagcggtataacaagaaaatcctccggccgcgtctcctctgtccatcgatcacttcgcgggtgccgctgccgggtttcgctgccgaatctggttcgagacaaggagagagcatatttgcatgctgaggtatctaaataatggctctagcaccgtcaatggactatgctggttcagttagctcaggccagaagcacctgggctgttttcgagtgcacactagcagtaggttgcaatgtgtgggatatgacaagaaatcaagaacaaatcagtttgttgttagagccatatctgtggatcgtccacaactagatttgtcaaatccaaactggaagaagcagtttcaggaggattttggtaagcgcttcagcttgccacatttaagagatgtgattgatgtggaaccgaggccaacaactttttctctgaagagcaggactcctctcaagaatgtaaatggttctgtgcaagaatcatggaatggctatgtgaacgatgatgacagagtacttttgaaggttattaagtttgcctcaccaacatctgctggagctgattgcattgaccctgattgtagttgggttgaacaatgggtacaccgtgctggtccacgtaaacaaatatatttcgagcctcaatatgtaaaggctgggattgtaacatgtggtgggctctgccctggtctcaatgatgtcatccggcagattgtgcttacactagaaaaatatggagtcaaaaacattgttgggatacaacatgggttccgtggattttttgaggatcacttatcagaagtgccactttctaggcacgtagtccaaaatatcaatcttgctggtggtagcttcttaggagtttctcgtggtggtgcaaaaatttcagacattgttgacagtattcaggcgaggaggcttgacatgctctttgtactaggtggaaacggaactcatgctggagctaatgctatacatgaagagtgccgcaagagaaaactgcaagtgtcgattgtttgtgtccccaaaacgattgacaatgacatattactgatggacaagacatttggatttgatactgcagtggaagcagcacaaagagctatcaactcagcatatattgaggcacattctgcatttcatggcatcggactggtcaagctgatggggagaagcagtggtttcatcacaatgcatgcctctctgtccagtggacaagtagatatctgcctgatacctgaggtaccattcattcttgatgggccgaacggagttcttcgacatcttgagcacttgatagagaccaagggatttgctcttgtttgtgttgctgaaggagcagggcaggaatatctgcagaagtcaaatgcaactgatgcatcaggcaacatggttcttggtgacatcggtgtccaccttcagcagaagatcaaatctcatttcaaggatataggagtccattctgatgttaagtatatcgatcccacatacatgctccgtgcagtgcgtgccaatgcatctgatgccatcctgtgcactgtgctgggtcagaacgctgtacatggcgcgtttgcaggtttcagtggcatcacaacaggggtgtgcaacacgcacaatgtgtacttaccaataccagaagtcatcaagtccacaagattcgtcgatccaaacagccggatatggcatcggtgcctgacgtcaacagggcaaccagacttccactgataagttgttaacaatgaagcatggaagctggtagtagcatctgatgactgatggtacaaggagtcaaggagtaggtggtgtatagccaaagggatttacttccattgtcagtatggcaaaataatcatcagatggacttttcatcttccatctggaaaccctccatgggcccttgagatgcaatatggatagaataagcatctctcaaaccacattcatattttggtagattagcaatatgcaacgcacgtagaaacatacaaatttagtggaggttttgttgtcatggaatttacaagggatgctcagttcccgtttatttagtgcaagagcagaattactttaaaaaaaaaaaaaaaaaaaa

SEQ ID NO: 4182 - protein, 525 aa, Panicum virgatum
  misc_feature: Ceres CLONE 1797446
  misc_feature (1)..(308): Pfam Name: PFK Pfam Description: Phosphofructokinase
MALAPSMDYAGSVSSGQKHLGCFRVHTSSRLQCVGYDKKSRTNQFVVRAISVDRPQLDLSNPNWKKQFQEDFGKRFSLPHLRDVIDVEPRPTTFSLKSRTPLKNVNGSVQESWNGYVNDDDRVLLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLSEVPLSRHVVQNINLAGGSFLGVSRGGAKISDIVDSIQARRLDMLFVLGGNGTHAGANAIHEECRKRKLQVSIVCVPKTIDNDILLMDKTFGFDTAVEAAQRAINSAYIEAHSAFHGIGLVKLMGRSSGFITMHASLSSGQVDICLIPEVPFILDGPNGVLRHLEHLIETKGFALVCVAEGAGQEYLQKSNATDASGNMVLGDIGVHLQQKIKSHFKDIGVHSDVKYIDPTYMLRAVRANASDAILCTVLGQNAVHGAFAGFSGITTGVCNTHNVYLPIPEVIKSTRFVDPNSRIWHRCLTSTGQPDFH

SEQ ID NO: 4183 - DNA, 1524 bp, Panicum virgatum
  misc_feature: Ceres CLONE 1797459
  misc_feature: Encodes the peptide sequence at SEQ ID NO. 4184
atccagatcctccagtcgcccacggcccaccctccgccctctcctcttccttccttcctacctctccctgttcgtgttcgtctcggcttccggtcgctgattccgcgcggagattctgtggtggcggtgctcgctcgctctctcgcgcgcgcttgtggtttcgcgtgcatggggctcgacgtggcggagatcgggatggggctggatctggggctcgacctcaggctcttcgccgcgcggagcgccggcgggatggcggcggccgcggcaaagggcgcgcccgcgggaatcgaggcctgcatcaggagcctcgaggaggagcgccgcaagatcgaggtcttcaggcgcgagctcccgctctgcgtccgcctcctcgccgacgtgatcgaggagttgaaggaggaggccgcgaggaaaggcggcgattcggagttgaggccggacgacggcgacaagaggaaatggatgagcaccgcgcagctctgggtggactccgacgccacatccaagtccgagaaagagcaacgaaatgaggtgacctcgccggagcccaagttgctcggtggccccatgccgatacgggctgttccggcggtgccgctgccgcctccaccgtgcttcaggaaggatgacaacgcttcgggaactgccggattgcccggtctgtcgttgctgccactggctgcaaagacatcggtctctccggtccctgccgttgatgaacaccggcagaacgctggcgccgcaagattgtctgccaccatgtcaccatctggccctggactcaacctgcatgctcagactcagcagcagcaacaacaggcgaggaagacaaggcggtgctggtcgccggagcttcaccggcagtttgttgctgccttgcatcaactcggtggcccacaagttgctactccgaagcagatcagagaggtgatgcaagtggacgggcttacaaacgacgaagtgaaaagccatctccagaagtaccggctgcacaacagaagatcgcccggcgtggctccggtgagccagtcgattgtgttggtgggtggcctctggggttctcaggagcaaagcagctcacagtcagggtctcctcagggcccccttcagttctctgggtcagggacggccatctctgcagccaccgtcggcggcgacggcagcagcagcgacgaagatgacaagtctgatgaaggctacagccggaaatgattgcaaggctgcgtttgcagaagatcggttgagagtgtagatgtagcatcgcggctttgcgcatcggtggcaataacagattcgtcagtcaggagaggctgtagtgcagccaggccatgcatacagggagattgggcggtgcgtgccccagagatgaacttatcatgagtttggttgttggttgtcatgtacatgaaaagctgataccagttttcatgaggcttcttgactttagttcccgggcagatccaaattttcgccctgagaattatatacatgcgagattcacaaaaaaaaaaaaaaaaaaaa

SEQ ID NO: 4184 - protein, 348 aa, Panicum virgatum
  misc_feature: Ceres CLONE 1797459
  misc_feature: Great-hit functional homolog of the protein sequence given in SEQ ID NO 9398
  misc_feature (1)..(52): Pfam Name: Myb_DNA-binding Pfam Description: Myb-like DNA-binding domain
  misc_feature: The sequence is a functional homolog of  SEQ ID NO 132 in the  10/666,642 US patent application
  misc_feature: Useful for making plants with altered Lignin content
  misc_feature: Useful for making plants with modulated growth and phenotype characteristics
MGLDVAEIGMGLDLGLDLRLFAARSAGGMAAAAAKGAPAGIEACIRSLEEERRKIEVFRRELPLCVRLLADVIEELKEEAARKGGDSELRPDDGDKRKWMSTAQLWVDSDATSKSEKEQRNEVTSPEPKLLGGPMPIRAVPAVPLPPPPCFRKDDNASGTAGLPGLSLLPLAAKTSVSPVPAVDEHRQNAGAARLSATMSPSGPGLNLHAQTQQQQQQARKTRRCWSPELHRQFVAALHQLGGPQVATPKQIREVMQVDGLTNDEVKSHLQKYRLHNRRSPGVAPVSQSIVLVGGLWGSQEQSSSQSGSPQGPLQFSGSGTAISAATVGGDGSSSDEDDKSDEGYSRK

SEQ ID NO: 4185 - DNA, 1863 bp, Panicum virgatum
  misc_feature: Ceres CLONE 1797467
  misc_feature: Encodes the peptide sequence at SEQ ID NO. 4186
gatttagttcccggccgtgagcagcagcagcagctggagcagagactgccgtgatggaggcagccagcaggctgaagctaggagtgggcatggacaccgtcgcctccctctcgcctctgcgccacccatcagcgtcgtcggcgtgcaagctgcgcacggcggcgagcactactactagtcgccctgcagcagccacaccgcggctgctcaagctaaagcagaggatcagcagcagagctacagccagtaactctaactcgccagcagcccggccaagatcatcgcctcgtgctaccgcgtctagtgcggcgaagacgacggcagcggagccgccgccgcagagagagaaggacctcgtcttcgtggccggcgccaccggaagagttgggtcccgagccgtaagggagctcatcaagctcggcttccgtgtccgcgctgccgtcaggaacgcgcagagggcgtcgaccctggtgcagagcgttcagcagctgaagctagacgacgacgacgacgcagctgcaatttcgcccgcggagaggcttgagattgtggagtgcgacctggagaagcagccgcaggaaggcatcgtgaaggccataggcaatgcatcattggtggtgtgcgccattggtgccagcgagaaggagatcttggatgtgacggggccataccgcatcgactatttggccaccagcaaccttgtacaagcggcaacagctgccatggtcgagcacttcatcctggtcacgtccctgggcaccaacaagatcggcttccctgcgttcctcttgaacttgttctggggggttctgtgctggaagagacgagctgaagaagcactcatcgccagtggcatcccctacacgatcgtaaggcccggaggaatggagaggccaacggacgctttcaaggagacgcacaacctggtggtggcagccgaggacacctacgtgggtggcctcgtctccaacctgcaggtggccgagctgatcggatgcatggccaagaacaggagggcagcctactgcaaggtggtggaagtggtcgccgagacaaccgcgccgctgctgcccatggagcagctgctctccgccgtcccttccaaaagggaaccccccgctgctccatgggaggaagcggaggaggtgaagcgaaagccagcagcagcgaaagcaggagatgggcgaccattctcaccttacatgacgtacgaggggctgaagccaccttcctccccatcccccacacttagcagggattctcttccaatcaacaagccccaacaagccgaagaagcagagccggcagcatcctcaaggacctcaagccggcccctctctccgtacactgcattcgtggacttgaagcctccaagctccccttcgccttcgccgccttcttcttcttcttcctcggtcacatatggatcaggcaccgcttcttcatcactagcattggactcgaatggcaacagcatccctgctggtagcagcaatccatcggatcaactgcaggggcagaatgaggtgaagaaacagaggccactttcaccatacacaaggtacgtggggctgaaacctccaagctcgccaacaccatctgtgcccaagacatagagataatgttacagttcacaaccaccagttttgctcccgtctctttaagtagctactgcaggagtgcaggtagcatcattcatgccatgcgttttcagttagagctacatatttttgagcgaagttaacagcagtgtgtgtgtgcgcgcgcgtgtgtgtacactactgtctaggaattggaaggttttgcctcatgtgggctcaagagaaagaagcatcttcatattaaaaaaaaaaaaaaaaaaaa

SEQ ID NO: 4186 - protein, 520 aa, Panicum virgatum
  misc_feature: Ceres CLONE 1797467
  misc_feature (1)..(227): Pfam Name: Epimerase Pfam Description: NAD dependent epimerase/dehydratase family
MEAASRLKLGVGMDTVASLSPLRHPSASSACKLRTAASTTTSRPAAATPRLLKLKQRISSRATASNSNSPAARPRSSPRATASSAAKTTAAEPPPQREKDLVFVAGATGRVGSRAVRELIKLGFRVRAAVRNAQRASTLVQSVQQLKLDDDDDAAAISPAERLEIVECDLEKQPQEGIVKAIGNASLVVCAIGASEKEILDVTGPYRIDYLATSNLVQAATAAMVEHFILVTSLGTNKIGFPAFLLNLFWGVLCWKRRAEEALIASGIPYTIVRPGGMERPTDAFKETHNLVVAAEDTYVGGLVSNLQVAELIGCMAKNRRAAYCKVVEVVAETTAPLLPMEQLLSAVPSKREPPAAPWEEAEEVKRKPAAAKAGDGRPFSPYMTYEGLKPPSSPSPTLSRDSLPINKPQQAEEAEPAASSRTSSRPLSPYTAFVDLKPPSSPSPSPPSSSSSSVTYGSGTASSSLALDSNGNSIPAGSSNPSDQLQGQNEVKKQRPLSPYTRYVGLKPPSSPTPSVPKT

SEQ ID NO: 4187 - DNA, 1734 bp, Panicum virgatum
  misc_feature: Ceres CLONE 1797469
  misc_feature: Encodes the peptide sequence at SEQ ID NO. 4188
atggcggtagcccctccacccgctcaccctcgtcagccctaaccctagatcccacccccactctcacaccacaatcacaaacacagaccgcactacgccactcctcccttgtcccctccatctcctccgtccgtctccatggaggcgggcaccggcaccggctgcagcgcccggacgctggcggcgtgcgtcatcggcggcattgtgctgggcgcctccgtgctcgttccgtccctgccgccgctcgacgccgtcaggcgccgcctccgccgccccgtgcgcgtctacatggacggctgcttcgacatgatgcactacggacactgcaacgcgctgcgccaggcgcgcgccctcggggacgagctcatcgtcggcgtcatcagcgacgaagagatcaaggccaacaaagggccgccagttacgccgctccacgagagaatgataatggtccgtgctgtgaaatgggtggatgatatcattccagatgcaccttatgccataaccgaagagttcatgaacaagctattcactgagtacaacatagattacattatccatggtgatgatccttgtttgctaccagatggcactgatgcatatgcccttgccaaaaaggctggccgatataagcagattaaaagaacagagggagtgtcaacaacagacattgttggacggatgcttctttgtgttagagagagatcatcttctgatgcccacaatcactcttcgctacaaaggcaattcagtagtggacatggtcagaaagttgatgatagtggatctggaagtggaactagagtatctcatttccttcctacatctaggcgaatagttcagttctcaaacagcaggggtccaggtccagattctcggataatttacatagatggtgcatttgatctgttccacgctggacatgtcgagatattgcggcttgctcgagaacttggagactttttgcttgtgggcattcacacagatcagaccataagttcaacgcgaggacgacatcgcccaatcatgaatcttcatgaaagaagtttgagtgttttggcttgtcgttatgttgatgaggtgatcattggtgctccatgggacgtttcaaaagacatgattaccacattcaatatttcgttggtcgttcatggaacaattgctgagaatatggactatgcaaaggatgatgcaaatccatatgctgttccaatggctatgggtatttaccataggctggagagccctttggatatcactacaagtactattataaggaagattgttgctaaccatgaagcttaccagaagcggaacgagaagaaggaagccagtgagaagaagtactacgagggtaaaagctttgtcaatggggagtaagttacaactagacatagtaaggtggatgaagattgttgactagatgagttgagattccaagcctccttcacgaaggcaacagatccagagttttacctagcatgtttgatgttttgctaacttagcttaggaagcatcatgtgcaacattgatgagggattaccagaggcgatcgattacttgggctagactagaagcatttctatcatttcccccagtgtctccagctaaaatttttcccctgtatatgcacctttgagttgtcgtttctggctgagttgtattttagatctataggtttcagaattgtgtggagcagtatgaatgttgccctgataaaaaaaaaaaaaaaaaaaa

SEQ ID NO: 4188 - protein, 412 aa, Panicum virgatum
  misc_feature: Ceres CLONE 1797469
  misc_feature (1)..(131): Pfam Name: CTP_transf_2 Pfam Description: Cytidylyltransferase
MEAGTGTGCSARTLAACVIGGIVLGASVLVPSLPPLDAVRRRLRRPVRVYMDGCFDMMHYGHCNALRQARALGDELIVGVISDEEIKANKGPPVTPLHERMIMVRAVKWVDDIIPDAPYAITEEFMNKLFTEYNIDYIIHGDDPCLLPDGTDAYALAKKAGRYKQIKRTEGVSTTDIVGRMLLCVRERSSSDAHNHSSLQRQFSSGHGQKVDDSGSGSGTRVSHFLPTSRRIVQFSNSRGPGPDSRIIYIDGAFDLFHAGHVEILRLARELGDFLLVGIHTDQTISSTRGRHRPIMNLHERSLSVLACRYVDEVIIGAPWDVSKDMITTFNISLVVHGTIAENMDYAKDDANPYAVPMAMGIYHRLESPLDITTSTIIRKIVANHEAYQKRNEKKEASEKKYYEGKSFVNGE

SEQ ID NO: 4189 - DNA, 2589 bp, Panicum virgatum
  misc_feature: Ceres CLONE 1797504
  misc_feature: Encodes the peptide sequence at SEQ ID NO. 4190
aattcctcctccactaatcctaacccaccgttgccctagcttcgacgatccggcgacgctccccctccccttccctcccctcctcccccacccacgaaccctccttgaggggttcgaatttgctcctgatccaagcgccaagctcctagattccgcctcccaaatcatcttcccgatccgatctgccagttccccttcgatcccgcatcccccgccgattcctgcgaagatctgagccctcgccaccatggatccgcgcgccaggtaccctccgggcatgggcaacggccgcggcgggaaccccaactactacggccgcggaccgccgccgcaacagccgcaccagcacaaccaccagcaccagcagacgtcgggggcgcatcaccaccagcagtacgcgcagaggcagcagcagcagcaccaccacaacctcaaccacccccagcaacagcagcaacaccacaatcaccaccaacaacagcagcagtggctgcggcggaaccagatcgcccgcaggcccgcgggcgcggccggtaccagcgagccgaaggccctggtgccatccacggccgccgatggcgtggattcgagttcacaagattggaaggctcaattgaagctgccgcctcaagatacacgctacaggacagaggatgttacagccactaagggaaatgagtttgaagactactttctcaagcgtgaactcttgatggggatatatgagaagggatttgaaagaccctctcctatccaagaagaaagcattcctattgctttaactggtagtaacattcttgcaagagcgaagaatggaactggcaagactgctgcgttttgtattcctgctctggaaaagattgatcaagataataatgctattcaagttgttatattggttcccacaagggaattggctctacagacatcacaagtttgcaaggagctcggtaaacatttgaagattcaagttatggttaccactggtggaaccagcttgaaggatgatattgttcgtctgtaccaacctgtacatttacttgttggaacacctgggcgtattttggatcttacaaagaaaggtgtttgcattttgaaggactgttcgatacttattatggatgaggcagacaagcttctctctcctgagtttcaaccttctgtggaacagttgattcgctacctccctgctagtcgacagattttgatgttctcagcaacatttcctgtgactgttaaggagttcaaggacaaatatctgcctaaaccttacgtgattaaccttatggatgagcttacactgaagggaattacacagttctacgcgtttgttgaagaaagacagaaagttcactgtcttaacacccttttttccaagcttcaaatcaaccagtcaataatattctgtaactctgtcaatcgtgttgaactattggcgaagaagatcacagaacttggttattcttgcttctatattcatgcgaagatgctgcaagaccatcgtaatagagttttccatgatttccgtaacggggcgtgcaggaaccttgtttgtactgatctttttacaaggggaatagatattcaagctgtcaatgtcgttatcaattttgatttcccgaagaactctgaaacatatctccacagggttggtagatctgggaggtttggacaccttggtctggctgtgaatttgatcacctatgaggatcggtttaacttgtataagattgaacaagagctcgggactgaaataaaaccaattcctcctcagatagaccaggctatatattgccaataatctgatagttttcaccttcagtcatttctccaggagtaataaggaggcaacttttgtaaataccagctcatcaggtactatggtgtgaactcctgtggcgcatcgagacaattttatgttggtggatgacgtgagatgaggcatccaacatttctgaaaaccttgttatgctgacactattgtggctatcttgagggcgtacgtcctgccacatttaggcacatagtagtgtatattgctaggtgcctgttcctagggctgtcccggtctagtttctttgtatttctcactttttttttgtcaatctgtgtcgttagctgtttctcacaggacattttaaccctgttgctggttctgggcttgtggcctgtgggtgcacgcaagcgtgtttccaagtccaacttggtgctatgtgccgtggatgggtaattgggtgtgacgagtcggccattgaacttgaggtcagaagtctgaactgtagtagttgactgaaggtgtgtgtcgtgtgaagttgaaacaatttgccaataatctgtggtacgctgcatcatggtaagctgtctttcccttgcagccatgccacttagcttgtgccatgtcgtcatttggattctgtaggccttaagtgagcatgtaattgtcggatagaacgttcttcacctgcctattgtcttgtgcagaattgttttgtcaggcacatgcaacatgtcaaggttatgggtactactgtttcatgatgtttctatcataataagatacttatgtattcaaaaaaaaaaaaaaaaaaa

SEQ ID NO: 4190 - protein, 517 aa, Panicum virgatum
  misc_feature: Ceres CLONE 1797504
  misc_feature: Great-hit functional homolog of the protein sequence given in SEQ ID NO 9637
  misc_feature (1)..(167): Pfam Name: DEAD Pfam Description: DEAD/DEAH box helicase
  misc_feature (1)..(77): Pfam Name: Helicase_C Pfam Description: Helicase conserved C-terminal domain
  misc_feature: Useful for making plants with altered Lignin content
MDPRARYPPGMGNGRGGNPNYYGRGPPPQQPHQHNHQHQQTSGAHHHQQYAQRQQQQHHHNLNHPQQQQQHHNHHQQQQQWLRRNQIARRPAGAAGTSEPKALVPSTAADGVDSSSQDWKAQLKLPPQDTRYRTEDVTATKGNEFEDYFLKRELLMGIYEKGFERPSPIQEESIPIALTGSNILARAKNGTGKTAAFCIPALEKIDQDNNAIQVVILVPTRELALQTSQVCKELGKHLKIQVMVTTGGTSLKDDIVRLYQPVHLLVGTPGRILDLTKKGVCILKDCSILIMDEADKLLSPEFQPSVEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYKIEQELGTEIKPIPPQIDQAIYCQ

SEQ ID NO: 4191 - DNA, 1753 bp, Panicum virgatum
  misc_feature: Ceres CLONE 1797508
  misc_feature: Encodes the peptide sequence at SEQ ID NO. 4192
ctcgattcgattcgcccccctcctcttccttccatccgaggcaacaaggaaccaaacacgagctcctcctcctcccagaaagaccgagaggaagggttccgctctactcttccccgacaccactccgccaccgccgcatcccccaactcccgcaagatccgccgggtgcccgggctgtcgatttctcgatcgcccacggcactccactccgctggggatctcctcctccactccacttcacgcctctcttcctttgcggcggcgactgggctcgccagctcttccccggcgacgagcaccccccgcccccacaaggtctaggcagttcggaccggcggcgcggccatggcttccaacggcatcgcccccagagatgtatgtgttgttggggttgcacgcacccctatgggtggtttccttggcgccttgtcttccttgcctgcaaccaaacttggctctattgcaattcaagctgctctgaaaagagcaagcgtcgatccggcccttgtgcaggaggtctactttggaaacgtcttgagcgctaatttgggacaagctccggcgaggcaagctgctctgggtgcagggataccaaacactgttgtctgtaccactgttaacaaagtctgcgcatctggcatgaaagctactatgtttgcagcacagtcaattcaactgggtatcaatgatattgttgtggcaggtggcatggaaagcatgtccaatgccccaaagtacattgctgaagctaggaaagggtctcgtttcggacatgacacacttgtcgatggcatgcttaaggatggcctttgggacgtatacggtgattgtgccatgggaatgtgtgctgagctttgtgctgacaatcattccctcacaagagaagatcaggatgcttttgctatccaaagcaacgagcgtggaattgctgctcgtgacagtggtgcttttgcatgggagattgttccgattgaagttcctgttgggaggggaaaaccaccagtacttattgagaaagatgaaagcctggacaagtttgaccccataaaactgaagaaactccgcccaagtttcaaggagaatggtggtactgttacagctggaaatgcttctagtataagtgatggtgctgctgcattagtcttggtgagtgggcagaaggctcaagagcttggcctgcaagttcttgcaatgatcaaaggatatgcggatgcagctcaagctccagagctttttacaaccaccccagcacttgccataccaaaggctatcgcaaatgctagattagagtcatctcatgttgatttttatgagattaatgaagctttttcggttgttgcgcttgcaaatcaaaagcttcttgggattccttcagaaaagattaatgttcatggaggagctgtatctttaggtcatcctcttgggtgcagtggtgctcgtattttggtcacccttcttggagtccttagggagaagggtggcaagatcggtgttgctggtgtctgcaatggcggaggtggcgcgtcagcacttgttctcgagcttgcataagaaatactgaccttgtgcaatcgttcagtagttagcaccggcttcctgtggcgaccatgtactattatgtggatgtttatttatgttgtaccttgttgaacattcttagattaattcagcaataagttgtatcgtgcttcagttacttgcatagtattctgcaataagagaaatgaagcagcaaaaaaaaaaaaaaaaaaaa

SEQ ID NO: 4192 - protein, 401 aa, Panicum virgatum
  misc_feature: Ceres CLONE 1797508
  misc_feature (11)..(399): SWISSPROT Homolog: EC 2.3.1.9 Acetyl-CoA acetyltransferase IA
  misc_feature (3)..(400): SWISSPROT Homolog: EC 2.3.1.9 Acetyl-CoA acetyltransferase, cytosolic 1
MASNGIAPRDVCVVGVARTPMGGFLGALSSLPATKLGSIAIQAALKRASVDPALVQEVYFGNVLSANLGQAPARQAALGAGIPNTVVCTTVNKVCASGMKATMFAAQSIQLGINDIVVAGGMESMSNAPKYIAEARKGSRFGHDTLVDGMLKDGLWDVYGDCAMGMCAELCADNHSLTREDQDAFAIQSNERGIAARDSGAFAWEIVPIEVPVGRGKPPVLIEKDESLDKFDPIKLKKLRPSFKENGGTVTAGNASSISDGAAALVLVSGQKAQELGLQVLAMIKGYADAAQAPELFTTTPALAIPKAIANARLESSHVDFYEINEAFSVVALANQKLLGIPSEKINVHGGAVSLGHPLGCSGARILVTLLGVLREKGGKIGVAGVCNGGGGASALVLELA

SEQ ID NO: 4193 - DNA, 1883 bp, Panicum virgatum
  misc_feature: Ceres CLONE 1797512
  misc_feature: Encodes the peptide sequence at SEQ ID NO. 4194
aactcccgaacgcaacggcggcgatgaggaagccgacggtggttgcggcggctacggcggtgttggcagctgctgctgcagccgccgtgctggcgcgccagaggctgcgcgaggtgaagcggtgggcgcgtgcgggcgccgtgctgcaagacctggaggcgcggtgcgcggcgccggcggagcggctgcggcaggtggcggacgcgatggccgcggagatgcgcgcggggctcgcctccgacgaccccgagggcggggacgagggcgtcctcctcaagatgctcgtcacctacgttgactccctcccctccggggatgagaaagggctattttatgcccttgaccttggaggaacaaactttcgtgttttacgagttcagttggggggccaggaacagcgaataatcaagcaagaatctaaaggggtgtccattcctcggcatttgatgtccggaggtgcagatgaactgtttgatttcatcggtgctgcattagcaaaatttgttgcctctgaaggtgaagactatcatattcctgagggcgtgcagagacaactcggctttacattctcctttccagtgaagcaaacttcaattgcctctggcactctcatcaagtggacaaaaggttttacaattgatgaaatggttggcatggatgttgtggcagaattaaacaaggctatcaaacgtcaaggacttgatatgaaagtgacagcattggtcaacgatacagtcgggacattggctgctgcaaaatatgcggataatgacgctattgctgcagtaatactgggtactggtacgaatgcggcatacatagatcatgcacaaacaattcctaaatggcacggcccacttcccaagtctggagatatggtgataaacatggaatgggggaactttaggtcttctcaccttcctctgactgaattcgaccatgccttggatgcagaaagtttgaaccctggtaaacaaatttatgagaagttgatttctggcatgtatatgggggaaattgttcgaagaatcttgctaaaaatggctcaggaagcttctctttttggtgatgatgtacctcaaaaacttgagatcccatatatcctaagtacgcttcacatgctgatgatgcatcaagacacaacacctgacctccagacagctgggatcaagctgaaagaaatcttggggatacaaaacacctgttacaaaacaagaaaagtagtcgtggatgtttgtgaggttgttgccaggcgtggtgcacgacttgctgctgctggaatctacggcatcctaaaaaagctcgggcgagacactgtaggccccgacgaacaaaggacagtgattgctgtgaatggcggagtttacaagtactatacattctttgccaagtgcatggagagcacgctgagggacttgctggtgggagaggtggcatcctctgtcgtgattaagctggcagaagatggatcaggcactggcgctgctctcttggcagccgcctattttcagtgcctccaggatgatttattcagcccgcagttccttagagtctgaatctatatgcaggcatgaagctattaaaacatgccactattcggtatcaggcctacacagctgccccagttgtttccaaggtatttgcactcattaatctttctgaactgcttaggtataatattttattcccgaagttcgaattgcacatcttgaatttgtgcatggacctttagaaattgctggataacagggcaggtttaaattgatggtgctggataactgggcaggtttaaattgatggatttgtttactctggcaaaaataatgtcacacccggtttatgaaggaaaccgaatgcattctcaaaaaaaaaaaaaaaaaaaa

SEQ ID NO: 4194 - protein, 510 aa, Panicum virgatum
  misc_feature: Ceres CLONE 1797512
  misc_feature (1)..(242): Pfam Name: Hexokinase_2 Pfam Description: Hexokinase
  misc_feature (1)..(496): SWISSPROT Homolog: EC 2.7.1.1 Hexokinase-9
  misc_feature (8)..(496): SWISSPROT Homolog: EC 2.7.1.1 Hexokinase-2
MRKPTVVAAATAVLAAAAAAAVLARQRLREVKRWARAGAVLQDLEARCAAPAERLRQVADAMAAEMRAGLASDDPEGGDEGVLLKMLVTYVDSLPSGDEKGLFYALDLGGTNFRVLRVQLGGQEQRIIKQESKGVSIPRHLMSGGADELFDFIGAALAKFVASEGEDYHIPEGVQRQLGFTFSFPVKQTSIASGTLIKWTKGFTIDEMVGMDVVAELNKAIKRQGLDMKVTALVNDTVGTLAAAKYADNDAIAAVILGTGTNAAYIDHAQTIPKWHGPLPKSGDMVINMEWGNFRSSHLPLTEFDHALDAESLNPGKQIYEKLISGMYMGEIVRRILLKMAQEASLFGDDVPQKLEIPYILSTLHMLMMHQDTTPDLQTAGIKLKEILGIQNTCYKTRKVVVDVCEVVARRGARLAAAGIYGILKKLGRDTVGPDEQRTVIAVNGGVYKYYTFFAKCMESTLRDLLVGEVASSVVIKLAEDGSGTGAALLAAAYFQCLQDDLFSPQFLRV

SEQ ID NO: 4195 - DNA, 1727 bp, Panicum virgatum
  misc_feature: Ceres CLONE 1797514
  misc_feature: Encodes the peptide sequence at SEQ ID NO. 4196
gtaatccactctgatctcccggcgctgccacgcaaatccacccgcaaagcagcccgcgggagccttttgctcctttgttcccttcccttctctctcctcgggtctcggcactcggctgctcggcaccactcgccgcggttgccgccggtggcgctccgtgccaatccaggaccttttgctaggacgaggcggcgcgtgcgcgcgagcgagcgaggggacggtccgcctgccgtgccatggcgccgccgtgcgggctgctgctggccctggcggcggcggcggccgtgctcgtggccgcgggcgcgcgggcgcaggagacgtgcgcgggggcgccgccgcggcgcgggccgcgggtgtccgtggccagcttcggcggcgcgggggacggccggacgctcaacacgggcgcgttcgcgcgcgccgtggccagcgtcgagaggctgcgcgcgcccggcggggcggagctctacgtgccgcccggggtgtggctcacgggccccttcaacctcacctcgcgcatgacgctcttcctcgcgcgcggcgccgtcatccgcgccacgcaggacacaccaagctggcctctgatcgagccactgccctcatacgggagaggacgagagctgcctgggggaagatacataagtttaatccatggcagtggactccaggatgttgttatcacaggtgaaaatggaactattgatggtcaaggcggtgtgtggtgggatatgtggaagaaaggtacacttccctacacaaggcctcacctacttgagctaatgagctcttctgatatcatcgtctccaacgtcaccttccaggattctcccttctggaacattcatcctgtttattgcagtaatgttgtgatcagaaatgtgactgtactagctccacatgactcccccaacacggatggaattgatccagattccagcagcaacgtttgcattgaggattgctacatttccacgggtgacgattcaattgccatcaagagcggctgggatgagtatggaatctcctatggccacccgagctccgacatcactgttcggcggatcacaggctcctccccttttgctggctttgcggtcggaagcgagacctccggcggtgtgcagaatgtccttgcagagcacctgaacttcttcggctcagggtacgggatccacatcaagaccaacaccggcaggggaggcttcatcaggaatgtcaccatctccgacgtgaccctggacaacgtccggtacggcctgcggatcgcaggtgatgttggggaccaccctgatgaccgttacaacaggagtgctctcccagttgtcgataccctgacgataaagaatatccaggggcagaacatcaaggaggctgggctgatcaagggcatcgccaactcagccttctcccggatctgtctgtctaacgtcaagctcagtggtggcacgcctgtccggccatggaaatgtgaggctgtcacaggtggcgcgctcgatgtgcaaccgtccccgtgcacggaactgacttccacgtccgggacgagcttctgtacaaatttgctctgatgctgaagttagctgctagtctgctactacatgctctcagacggccagttcgctccatatattcgtcctttttcatatgaaagggattctattttttcattcctctatatattctggaatgaaatttctggatttggttgtgaaaaaaaaaaaaaaaaaaaa

SEQ ID NO: 4196 - protein, 442 aa, Panicum virgatum
  misc_feature: Ceres CLONE 1797514
  misc_feature (1)..(354): Pfam Name: Glyco_hydro_28 Pfam Description: Glycosyl hydrolases family 28
MAPPCGLLLALAAAAAVLVAAGARAQETCAGAPPRRGPRVSVASFGGAGDGRTLNTGAFARAVASVERLRAPGGAELYVPPGVWLTGPFNLTSRMTLFLARGAVIRATQDTPSWPLIEPLPSYGRGRELPGGRYISLIHGSGLQDVVITGENGTIDGQGGVWWDMWKKGTLPYTRPHLLELMSSSDIIVSNVTFQDSPFWNIHPVYCSNVVIRNVTVLAPHDSPNTDGIDPDSSSNVCIEDCYISTGDDSIAIKSGWDEYGISYGHPSSDITVRRITGSSPFAGFAVGSETSGGVQNVLAEHLNFFGSGYGIHIKTNTGRGGFIRNVTISDVTLDNVRYGLRIAGDVGDHPDDRYNRSALPVVDTLTIKNIQGQNIKEAGLIKGIANSAFSRICLSNVKLSGGTPVRPWKCEAVTGGALDVQPSPCTELTSTSGTSFCTNLL

SEQ ID NO: 4197 - DNA, 1365 bp, Panicum virgatum
  misc_feature: Ceres CLONE 1797515
  misc_feature: Encodes the peptide sequence at SEQ ID NO. 4198
aattcctacccctctagctaagctaataccaccaccagcagcagcagcagccatggcggcgagcggcaagaagctcccgccgttcctcttcacgctgctgcttctgctctccaccgccgtgacgcccatcctctcgctgccggccgccgaccacgaggtcgactgcgactgcgacaagcccaaggcgcccaagccgtcgcacccgcccaagaccaaaccctcccacccgtcgcccaagcccaagaaccccaagccgcccaagggcccctcctacccgtcgccagcgacgcgcccgcccaagggccgcccctccaacccgccaatcactcgtcctcgtccgccggtcgtcggcccccccaagggccccgtcacgcgcccgccggtcgtggggccaccggtcacgcgcccgccggtcacacgtccgccggtcgtcatcagcccgccggtgacctacccaccaccgattaccggccctccgacgacgacgccacccgtcactggcccaccggtcacggtccccccgatcaccggcccaccggtcacggtccccccgatcaccggcccgccctcgacgacgcctccggtcaccggcccgcccttgacgaatcctcccggcggtggaagctcgacgccgtgcccgccgcctcctcccgcgaccccgactccgacgccgtcgtcgccgacgtgcccggcggactcgctgaagctgggcgcgtgcgtggacctgctgggcgggctggtgcacgtcgggctcggcgaccccgtggtgaacaagtgctgcccgctgctggagggcctggtggagctggaggcggccgtgtgcctctgcaccaccatcaagctcaagctcctcaacatcaacatctacctgcccctggcgctccagctcctcatcacctgcggcaagacgccgccgcccggctacacctgcaccgtctgatcgatcaatgcaactagctagtaacccttgcacaatgcaggggttttggagtgagtttcttctgtaatttgaagagagatcaaccgacatgagaggatgtcatcgtctgcttcttcctagctatggtagctgtgtttagttgtttttctgttgtggttcgatcgatctcaagttctcgaccggcctgttaagtcgtttcagactttcagttaatttggctggccctcggcagcttgattgttggttttggtgtggtttcagtttgattcgagagagtcgttgatggctgatttctactgccatcaggtgacgatgaagagcttgcatgtccccaataatttttgcacttgttttcccgtgtgatttgtgcttgcttgcttgtggaacttattaattagttctagcaaaaaaaaaaaaaaaaaaaa

SEQ ID NO: 4198 - protein, 295 aa, Panicum virgatum
  misc_feature: Ceres CLONE 1797515
  misc_feature (1)..(82): Pfam Name: Tryp_alpha_amyl Pfam Description: Protease inhibitor/seed storage/LTP family
MAASGKKLPPFLFTLLLLLSTAVTPILSLPAADHEVDCDCDKPKAPKPSHPPKTKPSHPSPKPKNPKPPKGPSYPSPATRPPKGRPSNPPITRPRPPVVGPPKGPVTRPPVVGPPVTRPPVTRPPVVISPPVTYPPPITGPPTTTPPVTGPPVTVPPITGPPVTVPPITGPPSTTPPVTGPPLTNPPGGGSSTPCPPPPPATPTPTPSSPTCPADSLKLGACVDLLGGLVHVGLGDPVVNKCCPLLEGLVELEAAVCLCTTIKLKLLNINIYLPLALQLLITCGKTPPPGYTCTV

SEQ ID NO: 4199 - DNA, 1539 bp, Panicum virgatum
  misc_feature: Ceres CLONE 1797567
  misc_feature: Encodes the peptide sequence at SEQ ID NO. 4200
ggaaaaaaatcagagcagagcgccgccgcccgccgctgcacagcaccgcgctgaccgcggaggcagaggcgacggccagcaggcgcctcccggcgatggccgagcggccgctgccgcggcgctccgcggaccaccggcatggccttcgccttcgcctccgccggctcctcctcctgctcccgctcgccctcctcctcgcgctcctctcgcagctccccgcgctcctcctccgccgcgccaactcgctcggccgccggtgcctgcccggcgcccccgaccgcctcgtccgggacccgcgcctcagcctcgccatcgtaaccctcgccgacgacggcgcgggcgggtcgcgcgggccgcggtccttccgcggcgtgctggcggccagcgcgcggaacaagcgcgcgtacgcggcggcgcgcgggtaccgcctcgtcgcgctccccgcgtccgccgtcgaccccggccgcccgcccagctggagcaaggtcctcgcgctccgcgcgcacctccgccgccaccactggctcttctggaacgacgcggacaccctggttactaatccagaaatcccgctggagagaattttgttctcagtgataggacatagcgattttgatgactcacctgatcttgttctgacagaagatttcggtggtgtgaatgctggagttttcttcataaggaggtcaaaatggagtgagagatttctggatacatggtggaaccagacttcatttatacagtttggttcctcaaaaagtggagacaatgcagcactcaagcatctaattcatcacttatcagctgaagaaatgcaagcgcatgttcgaatagcaaaaatgcagtgcctcttcaattcttacccttgggtcctcacatggaagtcggcccaccgcctcatcttccacctgcccactacatggaaaggggcttattcagatggagacttcatgattcattttgctggtttggatgacaagcaaggttggataaataagattgttggagagagagagaaactgtaagatgagccacgttaaactcatagtttccctaaggaaaaactggaagattatgtaaatcgcctgactgatctgatattcagtgtatagatatggtcatatggacatatggtacagcacgcgccaggttgccatggtcagtagtcaaaattgtggcacctgcaaggtcaaaccgggcagccagaagatatatttccatggtcagtatttcaaacagagtgccaggatgccactgtatataaaaacttaaaggcagtgtcaactacattatctacctaggctgcgttgacttcctgtcgcccgcatggaggagtcaacttcagcatctgataacagaactagctagacaagagaataggttttgtgtaacaggctaagcagttcccatgttgtacattgtttcattataactgtcagtattgattgctcgacaagcactcaagcagtacaggcgaccttgtttctccaaaacccttactgccactaaacggtaaacgccaatatatatttctatctt

SEQ ID NO: 4200 - protein, 309 aa, Panicum virgatum
  misc_feature: Ceres CLONE 1797567
  misc_feature (1)..(64): Pfam Name: Glyco_transf_34 Pfam Description: galactosyl transferase GMA12/MNN10 family
MAERPLPRRSADHRHGLRLRLRRLLLLLPLALLLALLSQLPALLLRRANSLGRRCLPGAPDRLVRDPRLSLAIVTLADDGAGGSRGPRSFRGVLAASARNKRAYAAARGYRLVALPASAVDPGRPPSWSKVLALRAHLRRHHWLFWNDADTLVTNPEIPLERILFSVIGHSDFDDSPDLVLTEDFGGVNAGVFFIRRSKWSERFLDTWWNQTSFIQFGSSKSGDNAALKHLIHHLSAEEMQAHVRIAKMQCLFNSYPWVLTWKSAHRLIFHLPTTWKGAYSDGDFMIHFAGLDDKQGWINKIVGEREKL

SEQ ID NO: 4201 - DNA, 2771 bp, Panicum virgatum
  misc_feature: Ceres CLONE 1797601
  misc_feature: Encodes the peptide sequence at SEQ ID NO. 4202
agagccggcggcagccatgtccgccccgaagctgggccgcaacctgagcatccgcgaccgcgtcgaggacaccctccacgcgcaccgcaacgagctcgtcgccctcctctccaagtacgtgaacaaggggaagggcatcctgcagccgcaccacatcctcgacgagctcgacgaggtccagggctccgggggcggcgcgctcgccgagggccccttcctcgacgtcctccgctccgcgcaggaggcgatcgtgctgccgccgttcgtggccatcgcggtgcgcccgcgcccgggggtgtgggagtacgtccgcctcaacgtgcacgagctcagcgtcgagcagctcaccgtcccggagtacctgcgcttcaaggaggagctcgtcgacggccagcacaatgatccctacatgcttgagcttgacttcgagccattcaatgcctcagtcccacgcccaaatcggtcatcctctattggaaatggcgtgcagtttctcaatcgacacctctcttcgatcatgttccgcaacagggattgcctggaacccctgctggatttcctccgtggccaccggcacaagggtcatgttatgatgctaaatgataggatacagagcttggggaggcttcagtcggtgctgactaaagctgaggagtacttgtcaaagcttccagctgacacaccatactcacagttctcttacaaatttcaagaatggggcctggagaaaggttggggggatacatctgaacatgtgttggaaatgattcatctacttctggatatccttcaagcacctgatccatctacactggagaaattcttggggaggatccccatgatttttaatgttgttgtagtatcccctcatggatactttggtcaagctaatgtattaggtttgccagacacaggaggacagattgtctatatactggaccaagttcgtgcattagagaatgagatggttctccggttaaagaaacaagggcttgatgttaccccaaagattctcattgttactcggctgataccagatgcaaaagggacatcatgcaatcagaggcttgagagaattagtggaacacagcatacatacatattacgagttccttttagaaatgaaaatggtgtactcaagaaatggatatcaagattcgatgtctggccatacttggagaaatttgctgaggacgctgctggagaaattgctgcagaattgcagggcactccggatttcataattggaaactacagtgatggaaatcttgtggcatcgttgctgtcttacaagatgggaattacccagtgcaatattgctcatgctctggagaagacaaaatatccagattcagacatatactggaagaaattcgatgagaagtatcatttctcttgtcagtttactgctgatataatctctatgaacaatgctgattttatcatcaccagcacataccaagaaattgctggaagcaaaaacactgttggacagtatgagagccacacggctttcactcttcctggtttgtaccgtgttgtccatgggattgatgtctttgatccaaagttcaatatagtctctcctggagcggacatgtccatatattttccatacacagagaaggccaagcggctcacttctcttcatggttcaatcgaaagtttgatttatgatccagagcaaaatgatgaacacattgggcatctggatgaccgatcaaaacccatcctcttctccatggcaagacttgacagggtgaagaacataacagggctggttgaagcttatgctaaatgctctaagctgagagagctggtaaaccttgttgtcgttgctgggtataatgatgtaaagaagtccaaggacagagaagagatcgccgagatagagaagatgcacgatcttattaaaacctacaacttgttcgggcagttccgttggatctctgctcagacaaatagggtccgcaatggtgagctctatcgctacatagctgatactcatggtgcctttgtacagccagccttttacgaagcatttggtctcactgttgtggaggcaatgacctgtgggcttcctactttcgcgacactccatggagggccagctgagattattgagcatggcatctcaggcttccacattgacccataccatcctgatcaggctgctaagctgatagctgagttcttcgaacagtgcaagcaagaccccaaccactgggtgaaagtatctgaagcaggacttcagcgcatatacgaaaagtacacatggaagatttactctgagcggctgatgacattggctggggtctacggtttctggaagtacgtgtcgaagctcgagaggcgggagacaaggcgctaccttgagatgttctacatattgaagttccgcgagctggtgaagacggtgccgcttgcagttgaccagccacagtaactgctcctgccccttcgtagcttgctcggctgctactatgtagtactacaaaactgtaccttctcggagggatgggcatgcagtgattgaggtgcggcggatgatagctaataaagtgacatttgtgcgcccgcctgtcttgtgcagttgtgctggatctggttcctccgtgacttgttgaacatcttgggttatgtacatatttgatacttctgtagcgtcaggctgcaggtgtctatgctgtttgtggtcggtactcggtactgtctgtagcgctactgtaatactatcaagctgttggctgcaaaaaaaaaaaaaaaaaaaa

SEQ ID NO: 4202 - protein, 809 aa, Panicum virgatum
  misc_feature: Ceres CLONE 1797601
  misc_feature: Great-hit functional homolog of the protein sequence encoded by LOCUS At4g02280
  misc_feature (3)..(499): Pfam Name: Sucrose_synth Pfam Description: Sucrose synthase
  misc_feature (31)..(807): SWISSPROT Homolog: EC 2.4.1.13 Sucrose synthase
  misc_feature (4)..(804): SWISSPROT Homolog: EC 2.4.1.13 Sucrose synthase 2
  misc_feature: Useful for making plants with altered cell wall content and/or composition
MSAPKLGRNLSIRDRVEDTLHAHRNELVALLSKYVNKGKGILQPHHILDELDEVQGSGGGALAEGPFLDVLRSAQEAIVLPPFVAIAVRPRPGVWEYVRLNVHELSVEQLTVPEYLRFKEELVDGQHNDPYMLELDFEPFNASVPRPNRSSSIGNGVQFLNRHLSSIMFRNRDCLEPLLDFLRGHRHKGHVMMLNDRIQSLGRLQSVLTKAEEYLSKLPADTPYSQFSYKFQEWGLEKGWGDTSEHVLEMIHLLLDILQAPDPSTLEKFLGRIPMIFNVVVVSPHGYFGQANVLGLPDTGGQIVYILDQVRALENEMVLRLKKQGLDVTPKILIVTRLIPDAKGTSCNQRLERISGTQHTYILRVPFRNENGVLKKWISRFDVWPYLEKFAEDAAGEIAAELQGTPDFIIGNYSDGNLVASLLSYKMGITQCNIAHALEKTKYPDSDIYWKKFDEKYHFSCQFTADIISMNNADFIITSTYQEIAGSKNTVGQYESHTAFTLPGLYRVVHGIDVFDPKFNIVSPGADMSIYFPYTEKAKRLTSLHGSIESLIYDPEQNDEHIGHLDDRSKPILFSMARLDRVKNITGLVEAYAKCSKLRELVNLVVVAGYNDVKKSKDREEIAEIEKMHDLIKTYNLFGQFRWISAQTNRVRNGELYRYIADTHGAFVQPAFYEAFGLTVVEAMTCGLPTFATLHGGPAEIIEHGISGFHIDPYHPDQAAKLIAEFFEQCKQDPNHWVKVSEAGLQRIYEKYTWKIYSERLMTLAGVYGFWKYVSKLERRETRRYLEMFYILKFRELVKTVPLAVDQPQ

SEQ ID NO: 4203 - DNA, 1826 bp, Panicum virgatum
  misc_feature: Ceres CLONE 1797604
  misc_feature: Encodes the peptide sequence at SEQ ID NO. 4204
atcctgcgattctttcgtcctctccctgccccccccccccccctctctctcgatttgcccgagaaaatttttcgttgtttctcgcatcactctccactaagccggagccgcccgctcctctccgcgctggtgctcgtcgcttcctgcccaagccggcgtcattcgccctcacccctattaattccctgcctcgatagtcgatggccgattgcctcgtggaagttgcagtttcgctgccgctccggtgttgaatacccacgccgctagggttcaatcgtcgtccggaggcttccccgtcaatcccggcgtggctgcgggcggcggctcaaaggtggtttgtgaataggggggtagatagattgttagggttctaggagttgttttcgtctcccgtattagatggaggaatcggaggaaggtgttaatcttgggaagcaaatggaggaaaaggcggcgagggaatcgggggatgagggtacgatagagaggagccactctatcaatctgaatacggtgccacccgttcctgtggaggcgaggaggactctggagaatggtgagatacatggcacaggggtgtcaggaaccaaggattcaagaactggggagccagagcaacccagtgatactgatcagaagaagctgcccaagtgtgagcaagtggactatgaaagtgaagttgaaggtcgtgagaaagctgccgatgaggctgccttggttactgtggtgggaaatgaagggcatgctggttacggtgatgatgatgagagatctcaggtcctctgtattgtcaagaaggatgaacctgcagatgaaattggcgactctattaatcctgtccctatgacagaggcagggtgtacagaagagaagggcgcaatagttccttctgctggcatttctgcagtgcgacctgctggttctcgatcatcaagtttccatggtgtgaccaggcatagatggagtgggaaatatgaagctcatttgtgggacagttcttgcagagtagaaggacgtagaagaaaagggaaacaagtttatctaggaagttatgatgctgaggagaaagctgctagggcttatgatgttgcagctcttaaatactggggtcaaaatacaagactaaactttccgatttcactgtacgaaaaggagctggaggacataagggacttatctcgagaggaatgcgtgacatatttgagaaggaggagcagctgcttttcaagaggggcttctatttatagaggagtgacaagaaggcagaaagacgggagatggcaagcacgcataggactggttgctggaactagagacatatacctcggaacattcaaaactgaggaagaagctgcggaggcttatgatattgctgccattgagatacgtggcaaaaatgctgtgaccaactttgaccgaagcaactatgttgacaaaggtatgcattgtatagaaggggaaggcttgaggctgctcatgtcgaagccagaataataacttggaacatcgatgcggcggtgtcgtctattgagcggatttgcccagacagatttggaacttagtggtacatacagatagaagaactggttgcattttttcaatattttctgctttcaagtcttaagcttacagttattcgatcacctagcaaaaatgatgtaatgaggattttgagcatgtatcatagggtttgtaggatagatccttctggaaatgttaccgtatcaatggtcatgttctgtcttgatagcttcgttttgtcagattgctcattctggaaatgttacatagtcaatgtttttttttaaaaaaaaaaaaaaaaaaaa

SEQ ID NO: 4204 - protein, 364 aa, Panicum virgatum
  misc_feature: Ceres CLONE 1797604
  misc_feature (1)..(74): Pfam Name: AP2 Pfam Description: AP2 domain
MEESEEGVNLGKQMEEKAARESGDEGTIERSHSINLNTVPPVPVEARRTLENGEIHGTGVSGTKDSRTGEPEQPSDTDQKKLPKCEQVDYESEVEGREKAADEAALVTVVGNEGHAGYGDDDERSQVLCIVKKDEPADEIGDSINPVPMTEAGCTEEKGAIVPSAGISAVRPAGSRSSSFHGVTRHRWSGKYEAHLWDSSCRVEGRRRKGKQVYLGSYDAEEKAARAYDVAALKYWGQNTRLNFPISLYEKELEDIRDLSREECVTYLRRRSSCFSRGASIYRGVTRRQKDGRWQARIGLVAGTRDIYLGTFKTEEEAAEAYDIAAIEIRGKNAVTNFDRSNYVDKGMHCIEGEGLRLLMSKPE

SEQ ID NO: 4205 - DNA, 1599 bp, Panicum virgatum
  misc_feature: Ceres CLONE 1797609
  misc_feature: Encodes the peptide sequence at SEQ ID NO. 4206
gtgaaaggggaaaaaagagggaaccgcacaggaagcgtctcccttccacgcctgtagggttcccggatcggaggagccagccccgcccaggtcgccgcagccatggttcgcggatcgctcgggaagcttgcgtcccgcgccctctcggtcgccgggagatggcagcaccagcagctccgccgcctcaacatccacgagtaccagggcgtggagttgatggggaagtacgggatcaacgtgccaaggggggcggcggctgggtccgtgcaggaggtcaaggacgccttgaagaacgtattccccagcgagaaagagatagttgttaagagtcaaatccttgctggaggccgcgggctgggcactttcaagagtgggctgaaaggtggtgttcatattgttaaggctgaggaagctgaaggaattgcaagtaaaatgctgggccagattctggtcacgaaacaaactggcccaaagggaaagattgtgagcaaggtctacttgtgtgagaaactgtcacttactaacgagatgtactttgccatcacccttgacaggaaatctgctggtccgctcattattgcttgcagcaagggaggaaccagtattgaagatctcgcagagaagtatcctgacatgattattaaggttcctattgatgtattcaaaggaatcacagatgaggatgcagctaaagttgttgatggccttgcgctgaaggcagcagacaggcagtcttctatagaacagattaagaagctctatgaacttttctgcaagtgtgattgcacactgctggagataaatcctcttgcggagacagctgacaacaagcttgttgctgctgatgcaaagttgaactttgatgataatgctgcatttagacagaaagaaatatttgccctgcgtgatacaactcaagaagaccccagggaggtcgctgctgccaaagcagatttgaactacattggtcttgatggagagattggttgcatggtgaatggagcaggattggcgatggctaccatggacattatcaagttgcatggtggtacacctgccaatttccttgatgttggtggaagtgcatcaaagggtcaggttgtggaagcatttaagatcctgacttcagatgatagagtgaaggcaattctagtgaacatttttgggggcatcatgaaatgtgatgtgatagcaagtggaattgtaaatgctgctaaacaggttgacctgaaggtgcctgttgttgttcggctagaaggcactaatgtggaccaaggaaagaggattcttaaggaaagtggaatgacactgatcactgcagaagatcttgatgatgcggcagagaaggctgtaaaagcatccgtcaagtgactctctagtgtatcagtctgaagtttcttttttacaagatgagcggtgctcttttacggatttcggatcagggctgaagtcgtgaactgcaacctttttgaggagggattattttggcttgatttttcctgttaaacgttgtcattgccgaaatggaatgaaacgttgtgatctcatgttaataaacatttatcggcacaattaggcgaaaaaaaaaaaaaaaaaaaa

SEQ ID NO: 4206 - protein, 422 aa, Panicum virgatum
  misc_feature: Ceres CLONE 1797609
  misc_feature: Great-hit functional homolog of the protein sequence given in SEQ ID NO 9525
  misc_feature (1)..(137): Pfam Name: Ligase_CoA Pfam Description: CoA-ligase
  misc_feature (1)..(422): SWISSPROT Homolog: EC 6.2.1.4 Succinyl-CoA ligase [GDP-forming] beta-chain, mitochondrial precursor
  misc_feature (2)..(419): SWISSPROT Homolog: EC 6.2.1.4 Succinyl-CoA ligase [GDP-forming] beta-chain, mitochondrial precursor
  misc_feature: Useful for making plants with modulated biomass
  misc_feature: The plant is abnormally small.
MVRGSLGKLASRALSVAGRWQHQQLRRLNIHEYQGVELMGKYGINVPRGAAAGSVQEVKDALKNVFPSEKEIVVKSQILAGGRGLGTFKSGLKGGVHIVKAEEAEGIASKMLGQILVTKQTGPKGKIVSKVYLCEKLSLTNEMYFAITLDRKSAGPLIIACSKGGTSIEDLAEKYPDMIIKVPIDVFKGITDEDAAKVVDGLALKAADRQSSIEQIKKLYELFCKCDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASKGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 4207 - DNA, 1584 bp, Panicum virgatum
  misc_feature: Ceres CLONE 1797622
  misc_feature: Encodes the peptide sequence at SEQ ID NO. 4208
gaactatggcgccaactctccacagctcctgcccaagaaactcctgccgtcgccatggcactgaccacctccaccttcctctgctcacctccgctcccccgtccacgccgtccccgcctccgccgccgctacagtgccgccgcatccaccgtcaccgactcggcgacgacgcggcggtcggatgagagcatcgtcatcgtgggcgcgggcgtcgcgggcctggccaccgcgctcgccctgcgccggctcggcgtgggcgcggccgtgctggagcagggcgcgaccctgcgcgcgggcggcacgtccctgacgctgttcaagaacgggtggcgcgtgctggacgccatcggcgtcgccgacgagctccgcgccaagtacctgcgcatccaagggatgaggatgcggtcgccggcggcgggcgggcgggatctgcgcgagttctccttcgaggaagaagcccccgggcaggaggtgcgagcggtggagaggagagtgcttctcgagacgcttgcttcaaagctgccaccaggcacgatatcattctcatccaaactgaaatcgattgcagagcaagggcctgatggcaccctgctggaactcgaggatgggagacagattctctccaagattgtgatcggctgcgacggcgtgaactcgccgatcgcgaggtggatgggcttctccgagccccggtacgtcgggcacatggcgttccgggggctcgcggagtacgccgacggacaaccgttcgagcccaaggtgaactacatctacggccgaggtgtccgtgccgggtttgtcccggtctccccgaccaaagtctactggttcatctgctttaacagacaagatccaggcccaaagatcaccgacccggcggcgctcaagggcgagtcgctggacctcgtccgcggctggccatccgacctcctcgacgtgatgcgcagcacgcccgagggcgccgtggtgcggacgccgctcgtggaccggtggctctggccgggccgggcgccgagcgcgtcgaggggcggccgcgtggtgctggccggcgacgcgtggcaccccatgacgcccaacctcggccagggcgcgtgctgcgcgcttgaggacgctgtcgtcctggcgcgccgcctcgcgcccgccgcgggcgcggacggcgtcgaggtggcgatgcgcgcgtacgaggcggagcggtgggcgcgcgtgttcccgctgacggcgcgcgcggggcttgtgggcgcgcttgtgcagtgggagaaccccgcggtgtgcgcggcgcgcgacggcgtggtgatcccgaggctcgtcaggctgggtccgttcctggagcacaccaacttcgagtgcgacctaatcgagccggcgccgcagtcgccatgatcgaaagcctgtagctttccccatggccttgtagatcagtgtcgactccttatacttttttcacttctcagtaatggggattagttggctcaaaggaaaatatcagtaggatgtgtgaaaatattcggatatttatttcaaaaatgaaggccattgagatctgggcctgttttttttttattttaaaaaaaaaaaaaaaaaaaa

SEQ ID NO: 4208 - protein, 441 aa, Panicum virgatum
  misc_feature: Ceres CLONE 1797622
  misc_feature (2)..(38): Pfam Name: DAO Pfam Description: FAD dependent oxidoreductase
MALTTSTFLCSPPLPRPRRPRLRRRYSAAASTVTDSATTRRSDESIVIVGAGVAGLATALALRRLGVGAAVLEQGATLRAGGTSLTLFKNGWRVLDAIGVADELRAKYLRIQGMRMRSPAAGGRDLREFSFEEEAPGQEVRAVERRVLLETLASKLPPGTISFSSKLKSIAEQGPDGTLLELEDGRQILSKIVIGCDGVNSPIARWMGFSEPRYVGHMAFRGLAEYADGQPFEPKVNYIYGRGVRAGFVPVSPTKVYWFICFNRQDPGPKITDPAALKGESLDLVRGWPSDLLDVMRSTPEGAVVRTPLVDRWLWPGRAPSASRGGRVVLAGDAWHPMTPNLGQGACCALEDAVVLARRLAPAAGADGVEVAMRAYEAERWARVFPLTARAGLVGALVQWENPAVCAARDGVVIPRLVRLGPFLEHTNFECDLIEPAPQSP

SEQ ID NO: 4209 - DNA, 1873 bp, Panicum virgatum
  misc_feature: Ceres CLONE 1797641
  misc_feature: Encodes the peptide sequence at SEQ ID NO. 4210
gccttccagaacattccacatctagtaggctgccgccacccccacgcgcgcgctcgtgaccgccgccgttcgctgcgctcggggtgccaggagaagatccccctccttggtggcgaccgcgaggctctccggcgcctttggctcccccgcccccctggcgtggcgctttagtccccagtttgtcggctgtcttttctgcctgcgcttgcagggtggggaagatgggtggggtgctcttgccaggataacaccttatcctgttccccatccccgtgctagatcgatgcgctcttgcgcgtgtgggtgcatcatgtatgtgtgtccggcgtgttaggggcagctgcttgttcttgtgcttggcttagaagggggcttgcttactgacactgaccaactgaccattccattccgggcgccagagtagggattctagtgttgtttcttggctgggaggagggtaggatttggctatggacccagtgctgaacccggtgaaggaggagagccatggggatggtggtttgttgccgggtgcagcggctggggatgggccatccgctgccgcggccgcggcgccgaagccgatggaggggctgcacgacgccgggccgccgccgttcctgaccaagacctacgacatggtcgatgacgcggccaccgatcccatcgtgtcatggagcgccaccaacaacagctttgtggtgtgggatccccacgctttcgccaccgtgctgctgcccaggcacttcaagcacaacaacttctccagcttcgtcaggcagctcaacacctacggtttcaggaaggtggatcctgatcggtgggaatttgcgaatgaggggtttttacggggacaggggcacctcctgaagaacattaggcgtcgaaaacctcctgctcagaatgcctcaaaccagcagtctcttgggtcataccttgaggtgggacactttggatatgatgctgagattgaccggctgaagagggacaagcaattattgatggcagaagtggtgaagctaaggcaggagcagcagaacacaaagacaaatctcaaagccatggaggatacgctacaaggcactgagcagaagcagcagcagatgatggcgttcttggcacgcgtcatgcggaaccctgaattcttgaagcacctggtttcccagaatgagatgagaaaggagctccaagatgctatttcaaagaaaagaaggcgccgcattgatcagggacctgaagtagatgacttgggaaccagtagcagcctagagcaaggttcaccagtcctatttgacccccaggactcggtcgaattccttgttgatgggattccaactgatcttgagagtacagctttcagtggcgaaggcctggttgagccacaggatattgatcttggtacctctgagcagcagcaagacatgccccaggaggacttgactgacaacttctgggagcaattgctgaatgaaggacttggcgaggagcatgacaaccctgttgtcgaggatgatatggatgtgctgtctgagaagatgggctatctcaactcagatggctcgacatccaggaaatagttttgtttcattgcatcacattgctatcaccttttgtaattttctcgtatccgtccgcagctttctgagttctatcagaattcagaacgtgcagtgagtcgtgctgttgatccctgcatgtctcggtaggtggtgatggcataccttgttctgttgatattctaatgttaaagggtgtagacttgtaaatgggctcaaaatatctcactgtaacagcagctgctaatgttcaatccttatttctctggtaccataacgtgtgccagtagtacattcaaaaaaaaaaaaaaaaaaaa

SEQ ID NO: 4210 - protein, 368 aa, Panicum virgatum
  misc_feature: Ceres CLONE 1797641
  misc_feature: The sequence is a functional homolog of  SEQ ID NO 1686 in the  10/412,699 US patent application
  misc_feature: The sequence is a functional homolog of  SEQ ID NO 1687 in the  10/412,699 US patent application
  misc_feature: The sequence is a functional homolog of  SEQ ID NO 1688 in the  10/412,699 US patent application
  misc_feature: The sequence is a functional homolog of  SEQ ID NO 2660 in the  10/374,780 US patent application
  misc_feature: The sequence is a functional homolog of  SEQ ID NO 74 in the  10/225,066 US patent application
  misc_feature: The sequence is a functional homolog of  SEQ ID NO 926 in the  10/412,699 US patent application
  misc_feature: Useful for making plants with modulated growth and phenotype characteristics
MDPVLNPVKEESHGDGGLLPGAAAGDGPSAAAAAAPKPMEGLHDAGPPPFLTKTYDMVDDAATDPIVSWSATNNSFVVWDPHAFATVLLPRHFKHNNFSSFVRQLNTYGFRKVDPDRWEFANEGFLRGQGHLLKNIRRRKPPAQNASNQQSLGSYLEVGHFGYDAEIDRLKRDKQLLMAEVVKLRQEQQNTKTNLKAMEDTLQGTEQKQQQMMAFLARVMRNPEFLKHLVSQNEMRKELQDAISKKRRRRIDQGPEVDDLGTSSSLEQGSPVLFDPQDSVEFLVDGIPTDLESTAFSGEGLVEPQDIDLGTSEQQQDMPQEDLTDNFWEQLLNEGLGEEHDNPVVEDDMDVLSEKMGYLNSDGSTSRK

SEQ ID NO: 4211 - DNA, 1232 bp, Panicum virgatum
  misc_feature: Ceres CLONE 1797648
  misc_feature: Encodes the peptide sequence at SEQ ID NO. 4212
gcaccggacgcatccatctccttccttccttcctcggttcctcccctctcccgcatcgtgacgtcagcagccatggtgaaggcctaccccacggtgagcgaggactacctcaaggcggtcgagaaggccaagcgcaagctccgcggcctcatcgccgagaagaactgcgccccgctcatgctccgcctcgcctggcactccgccggcaccttcgatgtctccaccaagaccggggggcccttcggcactatgaagaaccccgctgagcaggtgcacggagccaacgccggtctcgacatcgccgtcaggctgctcgaacctatcaaggagcagttctccatcctatcctacgctgatttctaccagcttgctggggtcgtggccgtggaggtcaccggcggccctgaggtccccttccacccagggaggcaggacaagcctgagcctccaccggaaggccgccttcctgatgccacccaaggttctgaccacctcaggcaggtgttctccacacagatgggtttgagcgaccaggacattgttgcgctttctggtggtcacaccctgggaagatgccacaaggataggtctggctttgagggagcctggacttccaaccctttgatctttgacaactcttacttcaaggagcttctgagtggtgagaaggaaggccttctgcagctgccaagtgacaaagcactcctctctgacccatccttccgcccgcttgttgagaaatatgcagcggatgaggatgctttctttgctgactatgctgaggcccaccagaagctttctgaattgggatttgctaaggcgtaaggtgcttccagaaaaggtaaaagaagggggctgggggcggttgaagattgttgcctagccaatttatctttgtggctatttgcacctaagaccactacgaaccggaagagtgtggtggcggcttgtctgtaataaacattcgtgggccttgtgaggcaggccatacatctttcgtgtgtttccatgtaacggttagagtactgtgatttcctttccgggggttgatgaattcagctgaaggtgcagtagtgtgtaatgtcatggttcttttggagagatggttgttttggccatctgttgtgatgttggtgaccatatcattctctttgaatcatgaacgtctggactttgcagctgaaaaataaataactagtagtcctttattttaaaaaaaaaaaaaaaaaaaa

SEQ ID NO: 4212 - protein, 250 aa, Panicum virgatum
  misc_feature: Ceres CLONE 1797648
  misc_feature (1)..(209): Pfam Name: peroxidase Pfam Description: Peroxidase
  misc_feature (1)..(250): SWISSPROT Homolog: EC 1.11.1.11 L-ascorbate peroxidase 1, cytosolic
  misc_feature (3)..(249): SWISSPROT Homolog: EC 1.11.1.11 L-ascorbate peroxidase 2, cytosolic
MVKAYPTVSEDYLKAVEKAKRKLRGLIAEKNCAPLMLRLAWHSAGTFDVSTKTGGPFGTMKNPAEQVHGANAGLDIAVRLLEPIKEQFSILSYADFYQLAGVVAVEVTGGPEVPFHPGRQDKPEPPPEGRLPDATQGSDHLRQVFSTQMGLSDQDIVALSGGHTLGRCHKDRSGFEGAWTSNPLIFDNSYFKELLSGEKEGLLQLPSDKALLSDPSFRPLVEKYAADEDAFFADYAEAHQKLSELGFAKA

SEQ ID NO: 4213 - DNA, 2138 bp, Panicum virgatum
  misc_feature: Ceres CLONE 1797650
  misc_feature: Encodes the peptide sequence at SEQ ID NO. 4214
atatcctcctctccaactcttccctcttctctatctaccctctctcgctctctacctcaccaacccctacctccaggggcgaattccgaggcggacgcaagaacagggaagcgtagccatagggaattgcctcatgaggtgatccggcacgcgaacgggtccccgggctgggattctagtcccaatcccctccgcgtcggcgggcgcgccgccacccggatcaggcgtcctcgcgccatcgaccccatctctcgtccttccgtcgccgtctcccttgggcggccgcggagtaaagatccgccggcgccttggggtcgttcgcttctcctttttgtcggtgcgcagctggactcggtgctttacatgcttgacgctggtgctgagctcctgcaatggcccgaaggaatgccggcgcaatgccgcgggaggggtcggcggggtcagtgaaggactggtcggaattcgacccctcgccgtcccccaagctggcgtactcgcattcctacgtcgcgatgagggggctgttgacgtcggtggcctctctggaccctatcctgatgtcaagcagcctcaagtctttgtgggcagctttgtcgtctcacaggcacgctcggtccttggagaggccgaagtccaaaggggtgaactggaggaggcccatggtccatctgcttgtgtgcttcttggtgggaattttcattggattcacaccacccttctctgttgatttatcggataagatagactctgaaaatgagatgcttccgtttgacggagatgtggttgacagacaaatgctggaacttaagagtacaaagttggaaccgtttgcggtagagaccgaagcagtcgaagaacaacaggttgatgagagtcctccagttcctgcgatgttggatgatgaggtggacttcattgaagcctctcatatcgtaccttctgttaatgactctgactttgttgtgaggaagcagctgataattgtgacagcaacttctgttcgcccacaccaggcgtattacttgaatcgtctggcacatgtgttaaaaaatgtgccacctcctcttctgtggattgtggcggagtggccatatcagtcccgtgaaacagcggagatcctgaggtcttctggggttctgtacagacatctcatctgcaaccggaacaccacgaacataagaaagattattgtttgccaaaagaacaatgcaatttttcatataaagaagcaccgcttagatggtatagtccattttgctgatgaggagcgagcatactcggttgatttatttgaagagatgcggaaaatcaggcgatttggtacatggccagtagcaatacatgttggggccaggtatagggtggttttagaagggcccctttgtaggggtaatcaagtcactggatggcatacaaatcagagaaggggtgtacctcgtcggtttccaattggtttctctgggtttgctttcaacagcactatactttgggatccccaaagatggaacagccccactttagagtctattatactccattcaggtggcagaggtggcttgcaggagtcacgattcatcgagaagctcgtggaggatgagactcaaatggaaggcctcgcggacaactgcagtcgggtcatggtctggaatttcgacttggagcctccccagctccactaccctactggctggctgctgcagaagaacctagatgccgtcgtgcctataacctaaccgcattgctgctgccctttttgtttgcgcctcctagtgtggaatggtgatgatgccttcctgaacttggtagcgtccaggatcatgcgaagctgctctgccaagaccctggttcgaataatgtgatgctagtaacaacagttgaagaagcctgcctgacaaaagaaaaattctttctcccccgctgcgctgcattcttttctgtgttaattctttctttccctccatgctcctcaagctagatataggtttgtacatttccttcctttttcttttctcttctgttctattcgttacatacatacatgcatacatatattcattcatacatacatacatcgatacatattaccttacataatgtaaaagaaagcaatttcacgacaaaaaaaaaaaaaaaaaaaa

SEQ ID NO: 4214 - protein, 446 aa, Panicum virgatum
  misc_feature: Ceres CLONE 1797650
  misc_feature (1)..(214): Pfam Name: Glyco_transf_43 Pfam Description: Glycosyltransferase family 43
MARRNAGAMPREGSAGSVKDWSEFDPSPSPKLAYSHSYVAMRGLLTSVASLDPILMSSSLKSLWAALSSHRHARSLERPKSKGVNWRRPMVHLLVCFLVGIFIGFTPPFSVDLSDKIDSENEMLPFDGDVVDRQMLELKSTKLEPFAVETEAVEEQQVDESPPVPAMLDDEVDFIEASHIVPSVNDSDFVVRKQLIIVTATSVRPHQAYYLNRLAHVLKNVPPPLLWIVAEWPYQSRETAEILRSSGVLYRHLICNRNTTNIRKIIVCQKNNAIFHIKKHRLDGIVHFADEERAYSVDLFEEMRKIRRFGTWPVAIHVGARYRVVLEGPLCRGNQVTGWHTNQRRGVPRRFPIGFSGFAFNSTILWDPQRWNSPTLESIILHSGGRGGLQESRFIEKLVEDETQMEGLADNCSRVMVWNFDLEPPQLHYPTGWLLQKNLDAVVPIT

SEQ ID NO: 4215 - DNA, 1793 bp, Panicum virgatum
  misc_feature: Ceres CLONE 1797652
  misc_feature: Encodes the peptide sequence at SEQ ID NO. 4216
acacatgttgcagcgactccactcctcctgaatcagatcgatccgccatgctcctccctcctcctactcctactccatctccagcccagcgatgacctgcgcccctccatggcccgcaccctcctcctcccgctcgccgccaccaccgtcctcgtcgcctccaccatcttcctcttcgccgccgccggcgcgcgctggcgccccgccgacaccggcctcctcgtcccgccccgcgccgtctccgtccccgtgaccgccagcgcctcctccaacaccaccggcgcccgcaaagagctctcctttcttgacgagaacagcggccccgacgacccgggctccggcgcggcgcgatgcgacccgcgcgccgccgccgtcagggtcttcatgtacgacctgccgcccgagttccacttcggcctcctcggctggtcgccgccgtcccccggctccgtttggccggacctcaccaacgacgccgccgcaccgccgccgcggtaccccggggggctcaaccagcaacacagcgtcgcgtactggctcacgctcgacctcctctcctcgtcctcggcgccctgcggcgccgccgtgcgggtcgccgacccccgcgacgccgacctcgtcttcgtccccttcttcgcctccctcagctacaaccgccactccaggcccgtgccgccggagaaggtcagcagggacaaggccctgcaggagaagctcgtcatgtacctcagcgcgcggctggagtggaagaggtacggtggtgctgaccacgtcatcgtggcgcaccaccccaacagcttgctgcacgcccgggcggtgctctcgccggcggtcttcgtgctgtcggacttcgggaggtaccaccccagggtggccagcttggagaaggatgtcattgcgccatacaaacacatggccaagacgttcgtcaatgactcggctgggtttgatcaccgaccaacattgctctacttcaggggagccatttacaggaaggagggagggagcattcgacaggagctatattatatgctcaaagatgaaaaagatgtttacttttcctttggaagtgtccaggaccatggggccagcaaagccagccaaggaatgcactcatcaaaattttgcttaaacattgcgggggacaccccttcttccaatcgtctgtttgatgcaatagtgagtcactgtgtccctgttatcatcagtgacgacattgagctaccttacgaggatgtgttggattattcaaagttctccatctttgtccgatcatctgatgctgttaaaaagggttacctgatgagattgattagtggtgtgagcaaggaacaatggacaaggatgtggaataggctcaaagaggtggataaacattttgagtatcagtatccatcccagaaggatgatgcagtccagatgatctggcaagcactggctagaagggtgccagcaattcagctgaaggtgcatagatctagtagattttccagatctgacagaggaaaataaacagaaagggggtgggtgtcttgtctctgtcggttaatgtaatttatatctaatcaacatctcactgacacaggttcacaggttttctcggttgcacataacagatagattgtagtattcaggttatccttacaaaagatgtgtaacttaggatttgttggtccagttgaggcgtatactggcaagtcaaaagtttcttgtgtttgtaacgtgtattcaatgtaatcatgaaagagagatatgttttttctgtttctgaacaaaaaaaaaaaaaaaaaaaa

SEQ ID NO: 4216 - protein, 467 aa, Panicum virgatum
  misc_feature: Ceres CLONE 1797652
  misc_feature: Great-hit functional homolog of the protein sequence encoded by LOCUS At3g45400
  misc_feature: Useful for making plants with altered cell wall content and/or composition
MARTLLLPLAATTVLVASTIFLFAAAGARWRPADTGLLVPPRAVSVPVTASASSNTTGARKELSFLDENSGPDDPGSGAARCDPRAAAVRVFMYDLPPEFHFGLLGWSPPSPGSVWPDLTNDAAAPPPRYPGGLNQQHSVAYWLTLDLLSSSSAPCGAAVRVADPRDADLVFVPFFASLSYNRHSRPVPPEKVSRDKALQEKLVMYLSARLEWKRYGGADHVIVAHHPNSLLHARAVLSPAVFVLSDFGRYHPRVASLEKDVIAPYKHMAKTFVNDSAGFDHRPTLLYFRGAIYRKEGGSIRQELYYMLKDEKDVYFSFGSVQDHGASKASQGMHSSKFCLNIAGDTPSSNRLFDAIVSHCVPVIISDDIELPYEDVLDYSKFSIFVRSSDAVKKGYLMRLISGVSKEQWTRMWNRLKEVDKHFEYQYPSQKDDAVQMIWQALARRVPAIQLKVHRSSRFSRSDRGK

SEQ ID NO: 4217 - DNA, 1805 bp, Panicum virgatum
  misc_feature: Ceres CLONE 1797653
  misc_feature: Encodes the peptide sequence at SEQ ID NO. 4218
acacaccggatatcgccctccccgaacgggtggctgcgccgcacgcaatcgccttatcctctactacgccccgcgccacaagcgcgagcaagtgatcacggcgcgaccctcggccgcagcgcatgagataaattcggagcaccaccgccggctcagtttcgtcgatctggctggcttggcatcggccatcggcacccggcaggcggcagcagcgcaggatggccacccacgctgctctcgccgcgtcgcgcatccccacaggcacccggctgcacagcagggcggcgtccaggcagagggtggacttcgccgacttctccgggctgaggccgggatcatgctccgtcagcaccgccgccagggaggcgtcattctccgacgtgctcggtgcgcagctcgtcgccagggccaccggagagaacgcggtgagggcgcccgctgaggccaagctcaaggtggcgatcaacgggttcggccgcatcggccggaacttcctccggtgctggcacggccgcaaggactccccgctcgatgtcgtcgtcgtcaacgacagcggaggcgtcaagaacgcgtctcacctcctcaagtacgactcgatgctcggcaccttcaaggccgacgtcaagatcgtcgacgacaccaccatcagcgtcgacggcaagctcatcaccgtcgtctccaacagggacccgctcaagctcccatgggccgagctcggcatcgacattgtcatcgagggtaccggagtcttcgtcgacggcccgggcgccgggaagcacatccaggccggcgcgaagaaggtcatcatcactgctccggccaagggcgccgacatcccgacctacgtcgtcggcgtcaacgagggcgactacgaccacggcgtggccgacatcatgagcaatgcttcctgcacgaccaactgcctcgcgccgttcgtcaaggtcttggacgaggagttcgggatcgtgaagggaaccatgacgacgacccactcgtacaccggcaaccagaggctgctggacgcgtcccaccgcgacctgaggcgggcccgcgctgcggcgctgaacatcgtgccgacgagcaccggcgccgccaaggccgtggcgctggtgctcccccagctcaaggggaagctgaacggcatcgcgctccgcgtgccgaccccgaacgtgtcggtggtggacctggtaatcaacaccgagaagaagggcatgacggcggacgacgtcaacagcgcgttccgcgaggccgccgccggcccgctcaagggcgtcctcgaggtctgcgacgtgccgctcgtgtccgtcgatttcaggtgctccgacgtgtcctccaccatcgactcctcgctcaccatggtcatgggcgacgacatggtcaaggtcgtcgcctggtacgacaacgagtggggatacagccagcgcgtggtcgatttggcgcacctggtggcggccaagtggccgggcgcggcggcggcgggcagcggcgaccccctggaggatttctgcaaggacaaccccgccaccgacgagtgcaaggtgtacgaggcatgagactctggccgggggcattacgatcgatcaggaagagggcagaacaactttgttgttcactgcccgtacgtgttcttccatagagagtacacatactactggtttgccgagagagacagacgacgtagcagaaatggatctttgtttctgcgaggtgtaatcatcactgaactcgtacaggcttcagatttcatttcctgttgggactgttgcgtgtttgtttcaatttttcaaaaaaaaaaaaaaaaaaaa

SEQ ID NO: 4218 - protein, 444 aa, Panicum virgatum
  misc_feature: Ceres CLONE 1797653
  misc_feature (1)..(158): Pfam Name: Gp_dh_C Pfam Description: Glyceraldehyde 3-phosphate dehydrogenase, C-terminal domain
  misc_feature (1)..(154): Pfam Name: Gp_dh_N Pfam Description: Glyceraldehyde 3-phosphate dehydrogenase, NAD binding domain
  misc_feature (1)..(443): SWISSPROT Homolog: EC 1.2.1.13 Glyceraldehyde-3-phosphate dehydrogenase B, chloroplast precursor
MATHAALAASRIPTGTRLHSRAASRQRVDFADFSGLRPGSCSVSTAAREASFSDVLGAQLVARATGENAVRAPAEAKLKVAINGFGRIGRNFLRCWHGRKDSPLDVVVVNDSGGVKNASHLLKYDSMLGTFKADVKIVDDTTISVDGKLITVVSNRDPLKLPWAELGIDIVIEGTGVFVDGPGAGKHIQAGAKKVIITAPAKGADIPTYVVGVNEGDYDHGVADIMSNASCTTNCLAPFVKVLDEEFGIVKGTMTTTHSYTGNQRLLDASHRDLRRARAAALNIVPTSTGAAKAVALVLPQLKGKLNGIALRVPTPNVSVVDLVINTEKKGMTADDVNSAFREAAAGPLKGVLEVCDVPLVSVDFRCSDVSSTIDSSLTMVMGDDMVKVVAWYDNEWGYSQRVVDLAHLVAAKWPGAAAAGSGDPLEDFCKDNPATDECKVYEA

SEQ ID NO: 4219 - DNA, 1662 bp, Panicum virgatum
  misc_feature: Ceres CLONE 1797682
  misc_feature: Encodes the peptide sequence at SEQ ID NO. 4220
aaataggcaaaccgctaacgcgtcctagcctggcggccccatcctgtccgatccaaattcagaacaccaaaaccctcgccggcgacgccctccgccgccgctgttttcgcgagaaatggacttccaggttgtcgtcctcgccggcggcacctccgagacgctctcgcccctcgtctccaaggatgtccccaaggcgctgctcccggtcgcgaaccgccccttgctctcctacgctctggacctcctcgaggccagcgacctcaaggaccttatcgtggtggtggaggggcaggaggcggcgcggctcgtcggtgcctgggtctccagtgcatacctggatcgacttcgtgtggaggtagttgctgtttctgaagatcttggaagtgctggtgcattacgagctatttcaaagcgactgacagcaaatgatattttggtaattagcggtgacctggtaacagatgtgttgcctggggctgttgctgctacacatagaagaaatggtgcagctgttactgctttactatgttctgttcctgttagtggtccttcagaaactgcttcttctagtgggaaagataaagctaagaagccaaatcgtctgaacatagttgggctggacaagactaaacagttcttgttgcatatcgtatcaggaactgatgttgaaaaagatgttcgagttcataagagaaaaatccaggctgtaggtcagatggaaattcgaagtgacctgatggatgcacatctttatgcttttaagagaacaatattacaggacgtagtggaacagaaggaagcataccgtagcattagacttgaagtcctcccgtatctagtgagaagtcaattgagatcagctccattaggtggcattggaacaacagttggtgaaactgggaataatgctgttttctccagtggtaatttgcagtgtttatcacagcatcgtgtcattgcaacatctgctttcaagcaagatgtactgtcaagatcacatggtggacataggtgctgtgcttatattgctactaaaagcaaatactgtcaccgcttgaactcgattcagtcatactgtgatatcaatcgagatgttacaggggaagctagccatctgtctggttattctttctctgcacaaaacaatatcatccacccatcctctgttcttggatcaaagactacaatagggccacattgtattcttgctgagggttcgcagctaggtgacaagtgtagtgttaagagatctgtgattggtcgtcattgccgaattggttccaatgtaaagattgtcaactctgttgtgatgaaccacgttgttattgaagacggctgccacatccaaggttctgttgtatgtaataatgttcaactgcaagaacggtctgttctgaaagattgccagattggagctggatatatcgtgactgctggcagcgagcacaaagcagaatccctagcaagaaagtagagcaaattttcacagttttggcagatcctgaacgattttgtgcactttagatgcaccctctgagaaaaagggggtgacagtatatcttggtccccataattttgattcttgtgtaacagtatggaaggttgtggttaactctattctactagtccgagcttgagctgcaaaaaaaaaaaaaaaaaaaa

SEQ ID NO: 4220 - protein, 452 aa, Panicum virgatum
  misc_feature: Ceres CLONE 1797682
  misc_feature (1)..(214): Pfam Name: NTP_transferase Pfam Description: Nucleotidyl transferase
MDFQVVVLAGGTSETLSPLVSKDVPKALLPVANRPLLSYALDLLEASDLKDLIVVVEGQEAARLVGAWVSSAYLDRLRVEVVAVSEDLGSAGALRAISKRLTANDILVISGDLVTDVLPGAVAATHRRNGAAVTALLCSVPVSGPSETASSSGKDKAKKPNRLNIVGLDKTKQFLLHIVSGTDVEKDVRVHKRKIQAVGQMEIRSDLMDAHLYAFKRTILQDVVEQKEAYRSIRLEVLPYLVRSQLRSAPLGGIGTTVGETGNNAVFSSGNLQCLSQHRVIATSAFKQDVLSRSHGGHRCCAYIATKSKYCHRLNSIQSYCDINRDVTGEASHLSGYSFSAQNNIIHPSSVLGSKTTIGPHCILAEGSQLGDKCSVKRSVIGRHCRIGSNVKIVNSVVMNHVVIEDGCHIQGSVVCNNVQLQERSVLKDCQIGAGYIVTAGSEHKAESLARK

SEQ ID NO: 4221 - DNA, 1454 bp, Panicum virgatum
  misc_feature: Ceres CLONE 1797688
  misc_feature: Encodes the peptide sequence at SEQ ID NO. 4222
ttcaagaacatcgcggaatccacaggacacagccagagctctctctcaaccaccagcagcagccggagctgaggagagcgttgcggtttcagagtgggagggagaaatcaaggagccagcttgatcaattgcagcttcagctttgccggccgatcagcgatcgccatgggagtgccggtgaggagggagagggacgcggaggcggagctgaacctgccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaacggctcgcgccccaaccgcgccgccgggaacggctactggaaggccaccggcgccgacaagcccgtcgcgccgcgggggcgcacgctggggatcaagaaggcgctcgtgttctacgccggcaaggcgccgcgcggggtcaagaccgactggatcatgcacgagtacaggctggccgacgccggccgcgccgccgcggccaagaagggatcgctcaggctggatgactgggtgctgtgccacctgtacaacaagaagaacgagtgggagaagatgcagctggggaagacggagtccgccgccggcgccgtgcccaaggaggaggctatggacatgaccacctcccactcgcactcgcagtcccactcgcactcgtggggcgagacgcgcacgccggagtcggagatcgtggacaacgaccccttcccggagctggactcgttcccggcgttccaggaccccgcggcggcgatgatggtgcccaagaaggagccgcacgcggacgacggcaacaacaacaacgccgccgccaagaacagcaacctgttcgtggacctcagctacgacgacatccagagcatgtacagcgggctcgacatgctgccgccgcccggggaggacttctactcgtcgctcttcgcgtcgccgagggtcaaggggaaccagcccgcgggcgccgctgggttggccccgttctgagaatctgagctgacgcggcacggcaaccatgtgaggatggtggatgatggccgacgaggagaggagacggcgccccaaggctgcggcggcgacctctgtaaatacagcgtaggagtcgaagaagaacctgaaccacggaacctgatcggggtcgcagggttaagagtgtcggtgtagcgtacatggagccggccccggtgggtggcgccaggctcattcttttgttttcacctttcacctgagacgatagatactcgatcgtatatgtgtagctctttcctcttcaacagaaccgacgaaattttgctgttcctctttaaaaaaaaaaaaaaaaaaaa

SEQ ID NO: 4222 - protein, 316 aa, Panicum virgatum
  misc_feature: Ceres CLONE 1797688
  misc_feature: The sequence is a functional homolog of  SEQ ID NO 853 in the  10/374,780 US patent application
  misc_feature: Useful for making plants with modulated growth and phenotype characteristics
MGVPVRRERDAEAELNLPPGFRFHPTDDELVEHYLCRKAAGQRLPVPIIAEVDLYKFDPWDLPERALFGTREWYFFTPRDRKYPNGSRPNRAAGNGYWKATGADKPVAPRGRTLGIKKALVFYAGKAPRGVKTDWIMHEYRLADAGRAAAAKKGSLRLDDWVLCHLYNKKNEWEKMQLGKTESAAGAVPKEEAMDMTTSHSHSQSHSHSWGETRTPESEIVDNDPFPELDSFPAFQDPAAAMMVPKKEPHADDGNNNNAAAKNSNLFVDLSYDDIQSMYSGLDMLPPPGEDFYSSLFASPRVKGNQPAGAAGLAPF

SEQ ID NO: 4223 - DNA, 2170 bp, Panicum virgatum
  misc_feature: Ceres CLONE 1797689
  misc_feature: Encodes the peptide sequence at SEQ ID NO. 4224
aacaatacaatagagcctgctgacgtcacaacccgctggctcctccattcacatctccctcccccgtgaggtctctctcccatctcttcctccgatctcccccgcggccgccgccgccgcatcccgtccgaaccctagacccgtctacgcgcccattgcctccgatcgccatgtccgccgctcagctgttccgtcactcccgcaagctgcggagcttgcaaaatgctgtagattgcgagcgttctagtcttgttcggtatttctctagcagttccggttcctttatcgtcaaggaaaatggtgttggaaagagaactggaggcatcagattatctaagcatagccagcctgcaaaagagctcgagacattctcagtgggagtaaacagaagctacacttggacaagagcatccaacagccgtatcccaagtgctgttagcggtctcaatggttcattttcatgtggacaggtggcttcagctcgaccattctcaagtagtgcagacttgccaccacatcaagaaatcgggatgccgtcactttcgcccacaatgactgagggaaacattgccaagtggcttaagaaggaaggagacaaggtctcccctggtgaggttctctgtgaggtggaaactgataaagccactgtggaaatggagtgcatggaagagggctatcttgctaagattattcatggagatggtgctaaggagattaaagttggcgagatcattgctgtaactgtggaagaagagggtgacattgagaagttcaaagattataagccgtcatcttctgctgaacctgtagctcctactgaatcaaaggctcaacctgaaccttcaccaccaaaggtggaggagaaagaggctagcaagactcctgagcccaaggccccaaagactgaagaagcttctcaatctggagatcgcatatttgccagccctcttgcccggaaactggctgaagataacaatgtccaactgtcaagtgtgaaaggtactggtcctgatgggcgtattttgaaggcagacattgaagattacttggctaagggaggacagagggaggcttttgctgctccagggttaggttatgtcgacattccaaatgcacagataagaaaggttaccgcaaaccgcctgctagcatcaaaacagaccattccacactactacttgacagttgatgcacgtgttgacaaacttgtcaaattgcgaggtgaactgaatcctctgcaggatgcctctggtggaaagaaaatatctatcaatgatcttgtaatcaaggctgcagctttggctcttcgaaaggtccctcagtgtaacagctcatggatgaatgattttattcgccaataccacaatgtgaacatcaatgttgccgtacagacagagcatggattatttgttccagtaattagggatgccgacaagaagggacttggtacaattgctgaggaggtgaagcagttggctcaaaaggcaagggataacagcttaaaaccagcagattacgagggtggcaccttcacggtatcaaacttgggaggtccctttggaattaaacaattctgtgccatcataaatcctcctcagtctgcaattttggccatcggctctgctgagaagaggatgatacctggttccgctgatggtcagtatgagttcggttcattcatgtcagctaccctgagctgtgaccacagggttattgatggtgcgattggtgcggaatttctgaaagcgttcaagggctacatcgagaacccaacctcaatgctgctgtgaagtttaggatgatgaccaacaagacaattcttatgaagctgtggaataactcggccacccggaaagtggtgcctccattttgtataatctcgtgatggtctcaaggaggacctggaaaccaagagcacgcaaccaacacagaatgacctgatttttccgtttcccctttttgatgctgccggtgctaggctggaaaagtaggatcaacttacaaggcctcattgagctcttttttttttttgttgggtttacccctccgggctgttctggcatgagaatgtcactcctcattaagtgtagctttttgcatttttctatgcacagggagaattggtcggaataatcgaagtcgataatcagaaaaaaaaaaaaaaaaaaaa

SEQ ID NO: 4224 - protein, 539 aa, Panicum virgatum
  misc_feature: Ceres CLONE 1797689
  misc_feature (1)..(234): Pfam Name: 2-oxoacid_dh Pfam Description: 2- oxoacid dehydrogenases acyltransferase (catalytic domain)
  misc_feature (3)..(539): SWISSPROT Homolog: EC 2.3.1.12 Dihydrolipoyllysine- residue acetyltransferase component 2 of pyruvate dehydrogenase complex,
  misc_feature (3)..(539): SWISSPROT Homolog: EC 2.3.1.12 Dihydrolipoyllysine- residue acetyltransferase component 3 of pyruvate dehydrogenase complex,
MSAAQLFRHSRKLRSLQNAVDCERSSLVRYFSSSSGSFIVKENGVGKRTGGIRLSKHSQPAKELETFSVGVNRSYTWTRASNSRIPSAVSGLNGSFSCGQVASARPFSSSADLPPHQEIGMPSLSPTMTEGNIAKWLKKEGDKVSPGEVLCEVETDKATVEMECMEEGYLAKIIHGDGAKEIKVGEIIAVTVEEEGDIEKFKDYKPSSSAEPVAPTESKAQPEPSPPKVEEKEASKTPEPKAPKTEEASQSGDRIFASPLARKLAEDNNVQLSSVKGTGPDGRILKADIEDYLAKGGQREAFAAPGLGYVDIPNAQIRKVTANRLLASKQTIPHYYLTVDARVDKLVKLRGELNPLQDASGGKKISINDLVIKAAALALRKVPQCNSSWMNDFIRQYHNVNINVAVQTEHGLFVPVIRDADKKGLGTIAEEVKQLAQKARDNSLKPADYEGGTFTVSNLGGPFGIKQFCAIINPPQSAILAIGSAEKRMIPGSADGQYEFGSFMSATLSCDHRVIDGAIGAEFLKAFKGYIENPTSMLL

SEQ ID NO: 4225 - DNA, 1204 bp, Panicum virgatum
  misc_feature: Ceres CLONE 1797699
  misc_feature: Encodes the peptide sequence at SEQ ID NO. 4226
aaagcaaagcctcacagctgcgcagttccagcctccatagctcggccagcaaactcttccgcctcatcgtatccgtcgcctccgattccttgcgttcccttcctccctgggaggtctcagcgaggagcgaggagcgaggagctgaggagacgccgaatcgatctcggccgggatgaagagccggaggcagagcagcgggggcagctcggccggcgcgaccgccgcgggggaggggaacacgcacagcagcggcggcgggtgcaagctggagaggaaggacgtggagaagaaccggcggctgcacatgaagggcctctgcctcaagctctcctccctcatcccgcccgccgcctgccgcgcgtccctgctctcggaggcggcggcgtccgcgtccaaccccaacaaggacgcggcgacgcagctggatcagctggacaccgcggcggcgtacatcaagcagctcaaggagcggatcgatgcgctgaagcggaggaaggaggacggcggcggccgtgccgccaccgcggggtccggcgccgtgcgcatgccggtggtcgaggtgcggtgccaggacggggcgacgctggacgtggtgctcatcagcgaggccgggcggccgttcaagctgcacgaggtgatcacggcgctggaggaggaaggcgccgaggtcgtcagcgccagcttctccgtcgtcggcgacaagatcttctacaccatccactcgcaggcgctcagcccccgcatcgggctcgacgccgccagggtctccgagaggctgcacgacctgctgctcctcgcctgactctgacggacgaaccacctgaacgaacatcaccagcgacggtgctgacgaggaagatctactgtattgttagcgtagctagctagtcgaggtcaggacgcacggaccataactccataagcatagccggctgatccagggaagggaagctttggtttctttgcagttgtgcatacgtaggagcaagcgagcagactgcttttttttttcagctcgatcttagaacgaaatggccggtgctgtaccacactggagtgagtacatgcatcctgtctctgttctattacgtgctgtttcagcttcctggtgtactactgatactccactgaatcggatgatgcacacttgtgtgcctgtgtgttgcagcacacgttctagaatcaaaaaaaaaaaaaaaaaaaa

SEQ ID NO: 4226 - protein, 209 aa, Panicum virgatum
  misc_feature: Ceres CLONE 1797699
  misc_feature: Great-hit functional homolog of the protein sequence given in SEQ ID NO 9607
  misc_feature (2)..(72): Pfam Name: HLH Pfam Description: Helix-loop-helix DNA-binding domain
  misc_feature: Useful for making plants with altered Lignin content
MKSRRQSSGGSSAGATAAGEGNTHSSGGGCKLERKDVEKNRRLHMKGLCLKLSSLIPPAACRASLLSEAAASASNPNKDAATQLDQLDTAAAYIKQLKERIDALKRRKEDGGGRAATAGSGAVRMPVVEVRCQDGATLDVVLISEAGRPFKLHEVITALEEEGAEVVSASFSVVGDKIFYTIHSQALSPRIGLDAARVSERLHDLLLLA

SEQ ID NO: 4227 - DNA, 777 bp, Panicum virgatum
  misc_feature: Ceres CLONE 1801603
  misc_feature: Encodes the peptide sequence at SEQ ID NO. 4228
aggaacacaatccgctctcggcttcgtctgcacgctaccgcctggccgccgtttctccccgacccagctgagctcttcttcttcgccgccgacgccgcccgcccctcgccccagcatggccgccgcgtcgtccgccacctccgtccacgacttcaccgtcaaggatgcaagcgggaaggacgttgacctcagcacctacaagggcaaggttctcatcatcgtcaacgtcgcatcccagtgtggattaactaactccaactacaccgagctggcccagctctatgagaagtacaaggaccaaggctttgagatcctggcttttccatgcaaccagtttggtgggcaggagcctggcaccaatgaggagattgtccaatttgcctgcacacgcttcaaggctgagtaccccatctttgacaaggttgacgtcaacggtaacaatgccacgcccctctacaagttcctgaagtctagcaagggtggcctgtttggtgacagcatcaagtggaacttttccaagttcttggttgacaaggaggggcgtgttgtggatcgctatgcgccgaccacttcccctctgagcattgagaaggacatcaagaagctgcttgggagctcttaaaccatctgagcgctaaaactgtattcctctgagcgctaaaatttacaatgatattgtattaataaagtagtgctctgctgcagtacccgctcaatttccattgcatgtgtattcgtatattccctttgaatggattccgatgatgtataccggtt

SEQ ID NO: 4228 - protein, 168 aa, Panicum virgatum
  misc_feature: Ceres CLONE 1801603
  misc_feature (1)..(109): Pfam Name: GSHPx Pfam Description: Glutathione peroxidase
  misc_feature (2)..(167): SWISSPROT Homolog: EC 1.11.1.12 Phospholipid hydroperoxide glutathione peroxidase 1, chloroplast precursor
  misc_feature (2)..(167): SWISSPROT Homolog: EC 1.11.1.12 Phospholipid hydroperoxide glutathione peroxidase, chloroplast precursor
MAAASSATSVHDFTVKDASGKDVDLSTYKGKVLIIVNVASQCGLTNSNYTELAQLYEKYKDQGFEILAFPCNQFGGQEPGTNEEIVQFACTRFKAEYPIFDKVDVNGNNATPLYKFLKSSKGGLFGDSIKWNFSKFLVDKEGRVVDRYAPTTSPLSIEKDIKKLLGSS

SEQ ID NO: 4229 - DNA, 660 bp, Panicum virgatum
  misc_feature: Ceres CLONE 1801643
  misc_feature: Encodes the peptide sequence at SEQ ID NO. 4230
aacacccaagaagccgatcatctctcccctgacaagttcgcagagaaacatctgatcttgcttcgttgaccagccatggccgaggagaagcaccaccacctgttccaccaccgcaaggaggaggagagctccggcgaggtcaactacgagaaggaggagaagcaccacaagcacctggagcagcttggcggcctcggcgccatggccgccggcgcctacgctctgcacgagaagcacaaggccaagaaggaccccgagaacgagcacggccaccggatcaaggaggaggtggccgccgtcgccgccgtgggcgccgctgggttcgccttccacgagcaccacgagaagaaggacgccaagaagcacggcgataactgaacgcgcgcgcgtgtttatttgcctgaagcatccatctattatttgcttgatttttcttttctctttcaactcgtgtgcgctaggtcttgatttggactgatttatctgcacctaggatgaattcgatccggatcctcggtgttcctgaatcaagtgcaaaatcaggcctcgaataataaccgtgtggtgctgtctgcgtttgtgtaccgtgtactggatcatctttgtatttttcttaacgagacgtctcgagaataatatggatttaacatgtttctattt

SEQ ID NO: 4230 - protein, 100 aa, Panicum virgatum
  misc_feature: Ceres CLONE 1801643
  misc_feature (1)..(54): Pfam Name: ABA_WDS Pfam Description: ABA/WDS induced protein
MAEEKHHHLFHHRKEEESSGEVNYEKEEKHHKHLEQLGGLGAMAAGAYALHEKHKAKKDPENEHGHRIKEEVAAVAAVGAAGFAFHEHHEKKDAKKHGDN

SEQ ID NO: 4231 - DNA, 991 bp, Panicum virgatum
  misc_feature: Ceres CLONE 1801677
  misc_feature: Encodes the peptide sequence at SEQ ID NO. 4232
gaacccaatccaacgtccgcagcaaacacacccgctgactccccttgtttccactccactccgaccagatcctccccatccccaagcactccaccaagaaccccccaactccgagttactcgaggaatccatgtgcggcggcgccatcatcttcgactacatcccggcccggcgccgggtgtccgccgccgacttctggccggactccgaagccgacgccgaggactcccacgccccgcgcgcctccggcgagagagcgccgcgcgcgaagcggtgccgcaagaatcagtaccgcggcatccggcagcggccgtggggcaagtgggcggcggagatccgcgaccccgtgaagggcgtccgcgtctggctcggcacctaccccaccgccgaggccgccgcgcgcgcctacgaccgcgccgccaggcgcatccggggcgccaaggccaaggtcaacttccccaacgacacctcgtccccagtctccgtgccgccgccgccaccagctgctgcagccccggccgtgctcccggcgcccaaggcgaaggcaggggtgtccgacgaggtcaaggagctgtccgaggagctgatggcctacgagaactacatgaacttcctcggcatcccctacatggagggcgggagcacggccgcgcccgccgccgccgccgccgccgccgcccccgcccccgtcgcagaggagcagccgcaggcgccgatgcccaccgggctgtggagcttcgaggactactacccggcgtccctgtcgctcttcaccgaataacggacgcctcctgaatcctgatgttcttttttcagtaaatttggtgaaaaaatttcccctgctcgtccgcagtcgccgtgagtggctggctaacgccgagctgatgatccttgtcttgtgtcgttgaacccatccattgtttcatttcatttgtaaccttgctctgtaactccccaagtcaatcgtgtaatcaagatttgcagttcgatc

SEQ ID NO: 4232 - protein, 216 aa, Panicum virgatum
  misc_feature: Ceres CLONE 1801677
  misc_feature: Great-hit functional homolog of the protein sequence given in SEQ ID NO 9580
  misc_feature (1)..(65): Pfam Name: AP2 Pfam Description: AP2 domain
  misc_feature: Useful for making plants with altered terpenoid content
MCGGAIIFDYIPARRRVSAADFWPDSEADAEDSHAPRASGERAPRAKRCRKNQYRGIRQRPWGKWAAEIRDPVKGVRVWLGTYPTAEAAARAYDRAARRIRGAKAKVNFPNDTSSPVSVPPPPPAAAAPAVLPAPKAKAGVSDEVKELSEELMAYENYMNFLGIPYMEGGSTAAPAAAAAAAAPAPVAEEQPQAPMPTGLWSFEDYYPASLSLFTE

SEQ ID NO: 4233 - DNA, 849 bp, Panicum virgatum
  misc_feature: Ceres CLONE 1801713
  misc_feature: Encodes the peptide sequence at SEQ ID NO. 4234
aagtagaaggcacatcgcaacgaacggaatctggtgagcaagttcttcaagagctcacatggaagatggcagtgttccaagaaggtctactccccctactcgtagaagcagatctgctgagtttcacaatttttcagaaaggaggagaagggataggatcaacgagaagctgaaggcactgcaggagttacttccaaattgcaccaagaccgacaaagtgtctatgctagatgaagcgatcgactaccttaaatcacttcagctacagcttcagatgctggtcatggggaagggaatggcgccggtggttcctcctgagctgcagcaatacatgcactacatcaccgctgatccttcccagatgccaccattgcgcccttccggccagcagcctcggccatttcagataactcaagctaactcacagcgacaatctaacgtcgagtcagacttcttgagccagatgcagaacttacacccttctgagccgcctcagaacttcctcaggccaccaaaattacaactctataccccggaacagagaggcggccttgctagcacgagccacaacggtggctggattcctgagaggagttcctcctacaacttcatggaatgatgtgcttctgattacaaaatttgactccagacgcatgctgccttgtgatctgaagagagctttcagtctgggacgtgcagtgttcgttgttcttcatcagagaagttcatgaatgtgttgcagttaactagtagttgtgttcttaaataaaacgttgtgactgtgatgttgctcactttgctatctgaatggatctcacccttgaattccaaaaaaaaaaaaaaaaaaaa

SEQ ID NO: 4234 - protein, 186 aa, Panicum virgatum
  misc_feature: Ceres CLONE 1801713
  misc_feature (1)..(50): Pfam Name: HLH Pfam Description: Helix-loop-helix DNA-binding domain
MEDGSVPRRSTPPTRRSRSAEFHNFSERRRRDRINEKLKALQELLPNCTKTDKVSMLDEAIDYLKSLQLQLQMLVMGKGMAPVVPPELQQYMHYITADPSQMPPLRPSGQQPRPFQITQANSQRQSNVESDFLSQMQNLHPSEPPQNFLRPPKLQLYTPEQRGGLASTSHNGGWIPERSSSYNFME

SEQ ID NO: 4235 - DNA, 609 bp, Panicum virgatum
  misc_feature: Ceres CLONE 1801728
  misc_feature: Encodes the peptide sequence at SEQ ID NO. 4236
agctgtagcaaattaagctctcgcacagctgtccctcgtgtcacagcggctagctaactactcctataatggagaggctgatggcggagcaggagctggacctcgagctcagcctcctccacccctgctcggctgcggcggctcaggcggagcctcccggcttcttcgtctgcacctactgcgaccgcaagttctacagctcgcaggcgctcggcggccaccagaacgcgcacaagtacgagcgcaccctcgccaagcgccgccgggagatcgccgccgccatgcgcgcgcacggcgcccgggtcgacgccgccggcggcaggcccgggggcgccggagacgtagctgcaggcgccgctgaggctttgatggcgaggctgctggacgcgcggcaagctggcccggtgcctggtgggcaatcgagcggccatctgcgcagcaagagcagctcgttggagcacggcgtcgagcgcgccgacgagctggacttgtcgctcaaactgtaattgggttcttgccttgtatggcgcttggcgcctctgttttagttatttctaccctttgactttaatttgcatcttttctatacgaaaaaaaaaaaaaaaaaaa

SEQ ID NO: 4236 - protein, 145 aa, Panicum virgatum
  misc_feature: Ceres CLONE 1801728
  misc_feature: Great-hit functional homolog of the protein sequence given in SEQ ID NO 9760
  misc_feature (1)..(23): Pfam Name: zf-C2H2 Pfam Description: Zinc finger, C2H2 type
  misc_feature: The sequence is a functional homolog of  SEQ ID NO 2312 in the  10/374,780 US patent application
  misc_feature: The sequence is a functional homolog of  SEQ ID NO 520 in the  10/225,066 US patent application
  misc_feature: Useful for biocontainment applications
  misc_feature: Useful for making plants with modulated biomass
  misc_feature: The plant is abnormally small.
  misc_feature: The plant produces a reduced number of seeds.
  misc_feature: Useful for making plants with modulated growth and phenotype characteristics
MERLMAEQELDLELSLLHPCSAAAAQAEPPGFFVCTYCDRKFYSSQALGGHQNAHKYERTLAKRRREIAAAMRAHGARVDAAGGRPGGAGDVAAGAAEALMARLLDARQAGPVPGGQSSGHLRSKSSSLEHGVERADELDLSLKL

SEQ ID NO: 4237 - DNA, 959 bp, Panicum virgatum
  misc_feature: Ceres CLONE 1801750
  misc_feature: Encodes the peptide sequence at SEQ ID NO. 4238
acaccaccggccggccagcctccgcatcctagccttgtgatcgctcgagcggcgaaccatgaggaatcaggtcttcgcggtgctagccctcgccggcgccgcgctgctcgccgcggccggcggcgccagcgggcagcagagcatcatcacgcggcaggtgttcgagagcatgctcagccaccgcggcgacagcggctgccagggcgccttctacacctacgacgccttcacccaggccgcggccaggttccccgccttcggcaccaccggcgacgaccggacacgccggcgggagctcgccgccttcttcggccagacctcacatgaaaccaccggtggatggtcaactgctccgggcggaccgttcgcctggggatactgccgcgtggaagaacagagtcagacggacccaccctactacggacgtggacccatacaactcactcacaaatacaactacgagcaggccggtcgggcgttgaacctggacctggtgggcaaccctgacctggtgtcgcgcaaccccgtggtggccttcgagacggcgctctggttctggatgacgccgcaggcggcgaagccgtcgtgccacgacgtgatcaccggccgctgggcgcccggcgccgacgaccgccgcgcggggaggctccccggctacggcctcctcaccaacatcatcaacggcgggctcgagtgcggcaagggccagccgaccgacggcgacaacgaccgggtcgggttctacaggaggtactgccagatgctcggagtggcggaaggtggcaacctgtcctgcgagaaccagacgccgtacgcacccgcgggctaaatcgcaactgaaatatataagcagtgctaataataataataataaacagccaccgcacccccactgcgcctggttacattatagtagtacttgcttatgactacgcttgctatatatagctttcacatgt

SEQ ID NO: 4238 - protein, 256 aa, Panicum virgatum
  misc_feature: Ceres CLONE 1801750
  misc_feature (1)..(232): Pfam Name: Glyco_hydro_19 Pfam Description: Chitinase class I
  misc_feature (18)..(253): SWISSPROT Homolog: EC 3.2.1.14 Endochitinase precursor
  misc_feature (21)..(252): SWISSPROT Homolog: EC 3.2.1.14 Endochitinase A precursor
MRNQVFAVLALAGAALLAAAGGASGQQSIITRQVFESMLSHRGDSGCQGAFYTYDAFTQAAARFPAFGTTGDDRTRRRELAAFFGQTSHETTGGWSTAPGGPFAWGYCRVEEQSQTDPPYYGRGPIQLTHKYNYEQAGRALNLDLVGNPDLVSRNPVVAFETALWFWMTPQAAKPSCHDVITGRWAPGADDRRAGRLPGYGLLTNIINGGLECGKGQPTDGDNDRVGFYRRYCQMLGVAEGGNLSCENQTPYAPAG

SEQ ID NO: 4239 - DNA, 991 bp, Panicum virgatum
  misc_feature: Ceres CLONE 1801817
  misc_feature: Encodes the peptide sequence at SEQ ID NO. 4240
acaatccgccagtcattcctatctccccggctccccgtttctccgcgaaccccacttcctgaccaagatggcggcgccggccaactccaccaccttctccggcgacgtgtgggcggagctccgcctggcggacgcccgcgacgtgccccacatccacagcctcatccaccagatggccgagttcgagctcctcaccgaccttttcgccgccaccgaggagctcctcacctccacactcttcccctcgccgacgccgcctcccttcacctccttcacggccctcatcctcgatctctctccgtcccccgtagtcccggactcgacttccactatcgcctctcgccgcttcgacctctccgcgtccccgctcgcggacccggaggcggccgccttcgcctcgccgcgcggcggcggtcgcgtcacggcggggttcgtgatctgcttccccaactactccaccttcctctccaaacccgggctgtacgtggaggacatcttcgtgcgcgccccctggcggcgccgcgggctcggccgaatgatgctctccgccgtcgccggcagggcggcggagatcgggatggggcgggtggagtggtgcgtcctagactggaacaagaacgccatcgacttctacgaggggatgggcgccgatgtgctcccgcagtggcgcatctgccggctcaccggcgcggcgctggataagtacaagggcaaccaggaggaggccgctgatgggaaagctgccgcataggaggaccagaaaaattggttcttgagtgccaaataataaaggtggtggatttgcttctgctgcttagctcgcggtacggtgattcggagtatttgatcatcagctcattagtgacgatggattcaggttgtctgctgagcaattgggacttgttcttgtggtaaactctgatgcattatgcaaaattatctttgaattagatgcaagtatgtctttatcaaaaaaaaaaaaaaaaaaaaa

SEQ ID NO: 4240 - protein, 227 aa, Panicum virgatum
  misc_feature: Ceres CLONE 1801817
  misc_feature (8)..(84): Pfam Name: Acetyltransf_1 Pfam Description: Acetyltransferase (GNAT) family
MAAPANSTTFSGDVWAELRLADARDVPHIHSLIHQMAEFELLTDLFAATEELLTSTLFPSPTPPPFTSFTALILDLSPSPVVPDSTSTIASRRFDLSASPLADPEAAAFASPRGGGRVTAGFVICFPNYSTFLSKPGLYVEDIFVRAPWRRRGLGRMMLSAVAGRAAEIGMGRVEWCVLDWNKNAIDFYEGMGADVLPQWRICRLTGAALDKYKGNQEEAADGKAAA

SEQ ID NO: 4241 - DNA, 743 bp, Panicum virgatum
  misc_feature: Ceres CLONE 1801869
  misc_feature: Encodes the peptide sequence at SEQ ID NO. 4242
ctgcccccggacagtgctccttagctttttcgtcagtgagtcagtgatcagtgggtaggtaacctcttctgccggagctaagagggaaggaggaaggcgaggcgaagatgctggagaagatgtgggacgacgtggtggccgggccgcacccggagactgggctcgagaagctccgcaaggccaccacctcccgcccgctcgtcatcgacaaagacgcgggcgccgccggcgggagtagcttcaagcgtgcgcagtcgatgccgacgaccccgacgacgccgtcgtcgacgacccctcgcggcggcggcagcaacagcaacgtgtggcgcagcgtgttccacccggggagcaacctggccaccaagagcatcggcgccaacctcttcgaccgcccgcagcccaactcgcccaccgtctacgactggctgtacagcgacgagaccaggagcaaccaccgctagatcggagacggacggatgggatcggcggaggagcggtggccggtccctgtcgacccatgtttgctggtcctcgtggttatctaaaaaaaatgcgcaggcactgtactagccgcgtcgctgtccgaggctaaaggactcttaattttgccgtttgttttcttccaatgctatggagtgagtaatgcttgtactagtggtctgttgcactgactcagcttggccgctaccaagtggtgggtagcgacccgcgggccagtgactggaaaaaaaaaaaaaaaaaaa

SEQ ID NO: 4242 - protein, 117 aa, Panicum virgatum
  misc_feature: Ceres CLONE 1801869
  misc_feature (1)..(121): Pfam Name: Auxin_repressed Pfam Description: Dormancy/auxin associated protein
MLEKMWDDVVAGPHPETGLEKLRKATTSRPLVIDKDAGAAGGSSFKRAQSMPTTPTTPSSTTPRGGGSNSNVWRSVFHPGSNLATKSIGANLFDRPQPNSPTVYDWLYSDETRSNHR

SEQ ID NO: 4243 - DNA, 718 bp, Panicum virgatum
  misc_feature: Ceres CLONE 1801885
  misc_feature: Encodes the peptide sequence at SEQ ID NO. 4244
gtctgttcctctgccaaacgaaaaccctagccgccgccgccgatcatcttgattgagatgggtggcaagtgcccgcaccgcaaggtcaagaagcgccgcctctcgcacaagacggcgcgtcgtggcaagttcctcctcaaggccgacgatgccgtctacgaggagctcgtcaagctggccgaccaggggaaggatgcccaagccaaggacctccccgtagacgaggaccttcccggcatggggcagttctactgcctccactgcgaccgttactttgcaagcgagagcgtgaaggatgagcactaccgctcaaagcgccacaagaaaagggtgaaggtaatgtcaggaccagctccacacacgcaacttgacgctgaacttgctgctggaatgggaatgcctgacaatggcctgaagctcatgtccatgtgaagtaacaaggaacctcttgttagtacttgtaccgtgtttttcttgctgtcatatatctgaagtttctttgcttggtagctaatggagttagtagatggtgttatgtcaaagacttgttctaagagaggcttcatcagaatgagagggtttttgtgagggtcagggtttaatgcctgtatcatgaaatgtcttgtatcatttgactgcagagcgtgtgttgtcaatgaaataggaagttggctttacaggcaaaaaaaaaaaaaaacaaaaaaaaaaaaaaaaaaaa

SEQ ID NO: 4244 - protein, 124 aa, Panicum virgatum
  misc_feature: Ceres CLONE 1801885
  misc_feature: Great-hit functional homolog of the protein sequence given in SEQ ID NO 9560
  misc_feature: The sequence is a functional homolog of  SEQ ID NO 1130 in the  11/479,226 US patent application
  misc_feature: The sequence is a functional homolog of  SEQ ID NO 494 in the  10/412,699 US patent application
  misc_feature: Useful for making plants with altered Lignin content
  misc_feature: Useful for making plants with modulated growth and phenotype characteristics
MGGKCPHRKVKKRRLSHKTARRGKFLLKADDAVYEELVKLADQGKDAQAKDLPVDEDLPGMGQFYCLHCDRYFASESVKDEHYRSKRHKKRVKVMSGPAPHTQLDAELAAGMGMPDNGLKLMSM

SEQ ID NO: 4245 - DNA, 1235 bp, Panicum virgatum
  misc_feature: Ceres CLONE 1801941
  misc_feature: Encodes the peptide sequence at SEQ ID NO. 4246
aagataagataacagctgggaagcaggaaagatcgatgtcgtctccgccggtgaagctcatcggcttcttcgggagcccgtacgcgttccgcgcccaggcggccctttgcctcaagggcgtgccttacgagctcctcctggaagacctgttcgggatcaagagcgacctcctgctcaagctcaaccccgtgcacaagaaggtgcccgtgctcctccatggcggccgggccatcagcgagtccctcgtcatcgccgagtacatcgacgaggccttcgacgggccgccgctcctgcccaccgacccatacggtcgcgccatggcccgtttctgggctgacttcatcgaaaacaagctgacgaagccgttcttcatggcgcactgggtcgaaggcgaggcgcgagagaggttcgagaaagagggcttggagctgctgtcgcttctggaggcgcagctcaaggggaacaagttcttcggcggcgaccggcccggctacctcgacatcgccgcttccgcactgggtccctggagcagcgtgattcaggaggtgatgggggtgaccgtggtgaaggaggacgagcaccccgccatcgtccagtgggccaaggattacagctcccaccaagctctgaaaccgtgcattccggacagagacaaactcctcgcctacttcactgagaacctggagaggaacaaaactgctgtcaacacaatgttgcagcaacagtgatacacaagaagaacacgcctctgcgcctggatcccagtgaaatatgtgcatgccttgttttctgcgaataaatatgtgcatgtctcacatgaatggattttaatcaggtctgctaaactttattttgattcagtgcaacgactacattggtcttgtttcaacaactttaatttcttccggccctgttgagtacaaatctgcgtacctctcttctccaatccttaccttgctcctcatggtactcttgttctcagttctgaagttgcaactagtagtgatcttgtcatgtggggccgccactaccagcgccgtgggcgcgcccaagctgacggccagcagtggctgattttcaagatagcttgttagttggttttccatttggttgagattaggattcgatttgttggcttgggattaggggctctgtgcctatttaaacatttgtactcagagatttaaggattaagcaagattaatctacttccccaaaaaaaaaaaaaaaaaaaa

SEQ ID NO: 4246 - protein, 230 aa, Panicum virgatum
  misc_feature: Ceres CLONE 1801941
  misc_feature (1)..(96): Pfam Name: GST_C Pfam Description: Glutathione S-transferase, C-terminal domain
  misc_feature (1)..(76): Pfam Name: GST_N Pfam Description: Glutathione S-transferase, N-terminal domain
MSSPPVKLIGFFGSPYAFRAQAALCLKGVPYELLLEDLFGIKSDLLLKLNPVHKKVPVLLHGGRAISESLVIAEYIDEAFDGPPLLPTDPYGRAMARFWADFIENKLTKPFFMAHWVEGEARERFEKEGLELLSLLEAQLKGNKFFGGDRPGYLDIAASALGPWSSVIQEVMGVTVVKEDEHPAIVQWAKDYSSHQALKPCIPDRDKLLAYFTENLERNKTAVNTMLQQQ

SEQ ID NO: 4247 - DNA, 792 bp, Panicum virgatum
  misc_feature: Ceres CLONE 1801965
  misc_feature: Encodes the peptide sequence at SEQ ID NO. 4248
  misc_feature (772)..(772): n is a, c, t, g, unknown, or other
aagctgcagaaccctgaacggctgcatcgcaccacacagcggctcatcgacgaggcagcgatggtggggcgaaagccgatgcgccgccgcagaactgatcggcagccgcctccgcagtccttcggcgccacggctcgcccgacctccccacgttcgtccgcctccgccgccgcggtggccgccgacctggacgagctgctgctcacggcgccgccgccgtcggcgtcggagccccggagcttcccgtacgcggtgaagcagcagtgctgggagaaggcggagcgagtgccggggcgcgacccggagaggtggcgccgcgacgcgctcggcaacatcgtcttccgcaagctcgtcggctgccccggctgcctctgccacgactacgaccacatcgtcccctactccaagggcgggaagagcacattggagaattgccaggttttgcaggctacagtgaatcgatctaaaggtaacaagactgaggtatctaaatccgagctcatacagaagagtgcatattgtagggtttcaggacgcgatatggatcttgttgaactctctgcctatggaaatgtccggcgaggaccagattcagggggctgcaaaatccaatgaagttcagagtagatatatctgatgagttgtgttaatcagtttgaagtagttgcctgaatctaaatggagaaagcttgattaatttttctgtcaaacatgttcgatcatgtttgtactatgtagcttgacgcttcaagtgattcatccgagaacagcnaattgtgatatctttgaatc

SEQ ID NO: 4248 - protein, 184 aa, Panicum virgatum
  misc_feature: Ceres CLONE 1801965
  misc_feature (1)..(43): Pfam Name: HNH Pfam Description: HNH endonuclease
MVGRKPMRRRRTDRQPPPQSFGATARPTSPRSSASAAAVAADLDELLLTAPPPSASEPRSFPYAVKQQCWEKAERVPGRDPERWRRDALGNIVFRKLVGCPGCLCHDYDHIVPYSKGGKSTLENCQVLQATVNRSKGNKTEVSKSELIQKSAYCRVSGRDMDLVELSAYGNVRRGPDSGGCKIQ

SEQ ID NO: 4249 - DNA, 1104 bp, Panicum virgatum
  misc_feature: Ceres CLONE 1801978
  misc_feature: Encodes the peptide sequence at SEQ ID NO. 4250
gaccaaagagccactcgttggtgtcctgggagtggggagtggcagccagtagcgtgagagctagcgagcagggttcaatatgggttccaggttcgcactactgtgcctccttggagtgctgggagcatcacctgccattgctgactccggcatctactaccagctcgctcttatgtggcccggagcgtactgcgagcagaccagcgccgggtgctgcaagccgacgaccggcgtgtcgccggcgagcgacttctacgtctccggcttcaccgtctacaacgcgacgaccaacgctccggtgaccggctgcaacaacgctgctcctttcgaccctaacgagattaccgacatccagggcctgtaccagtactggagcagcatcaagtgccccagcaacaacggcaagaaaaactggaagaacgcctggaagcagtccggcgcctgctccggcctcgaggagaaggactacttcgaagccgccctctacttccgcagccggatcaacccgctggtccgcctcaaggcccagcacatcgagccggacttcgggctgtacggcgtgaaggcgatcaagaacgtgttcaaggcgggcatcgccgcggagccggtggtccagtgcagcaagggccccttcgacaagttccagctgtaccagctctacttctgcgcggcggagagcggcaagttcatcgactgcccggcgccgaagcagtacacctgctccaaggagatcctcttccaccccttccagaagtggatgctcaagcagcagctcaacgagaccgccgccgccgaccccttggtgctgccaggcgtcgccgtggaaatataagcgatcgatctgctgcggcgctgcgcacgtcgcgtgccgtttggttcgtgatgagtttgcgcgttggggtggcacgcgcgtggaataatgtttcctgcttggctgctttgttggacgatgctagctcctcgcggagcaataatgtactgtgtagtaatgctcgacgaataagctagtgtggctagctctgttgcttcagcttcgccttcatgtatcgaaataaaccatgagacgtactcgggtcatccttccaaaaaaaaaaaaaaaaaaaa

SEQ ID NO: 4250 - protein, 250 aa, Panicum virgatum
  misc_feature: Ceres CLONE 1801978
  misc_feature (1)..(186): Pfam Name: Ribonuclease_T2 Pfam Description: Ribonuclease T2 family
MGSRFALLCLLGVLGASPAIADSGIYYQLALMWPGAYCEQTSAGCCKPTTGVSPASDFYVSGFTVYNATTNAPVTGCNNAAPFDPNEITDIQGLYQYWSSIKCPSNNGKKNWKNAWKQSGACSGLEEKDYFEAALYFRSRINPLVRLKAQHIEPDFGLYGVKAIKNVFKAGIAAEPVVQCSKGPFDKFQLYQLYFCAAESGKFIDCPAPKQYTCSKEILFHPFQKWMLKQQLNETAAADPLVLPGVAVEI

SEQ ID NO: 4251 - DNA, 1033 bp, Panicum virgatum
  misc_feature: Ceres CLONE 1802002
  misc_feature: Encodes the peptide sequence at SEQ ID NO. 4252
ctgacagcatccaatccaagaaaaagaaagagagcagctattgccatttgctagccgatccagccgctggcagcaatggcggaggagaagaacgagggcctggtgctgctggacttctgggtgagcccgttcgggcagcgctgccgcatcgcgctggcggagaagggcatcccctacgactactccgagcaggaactcctcggcgccaagagcgacctcctcctccgctccaaccccatccacaaaaagatccccgtcctcctccacgacggccgccccgtctgcgagtccctcgtcatcctcaactacctcgacgaggccttcccgaatcaaggctcctccggcaagctcctcctccccgccgacccctacgcgcgcgcgcaggcccgcttctgggccgcctactccgacaaggtctacgagctcggcacgcggctctggaagctcaagggcgaggcgcgggcgcaggcgcgcgccgagctgctgcaggtgctcgccaacctcgacggcgagctcgggggcaagccgttcttcggcggcgaggagttcgggttcgtggacgtcgcggtcgctcccttcgtgccgtggctgcccagctacgagaggtacggggagttcagcgtggaggcggccgtgccgaggctggcggcgtgggcgcggcggtgcgaggggagggagagcgtcgccgggagcctccacccgccggagaaggtggacgagttcatcaccatgctcaagaagcactacggcatcgagtagtagtaggggagcggatccacagaccacggatccatcatcgatcggctccgcggatagatgctgctgcgggtgggtgagactcagacgtgtggctgccatgcgcgcagctgttcttgttctctccagtccagtgggtggatcaactgtagcgtgtggttgtctgatgcgtgcgacgtggctgcaaataaagctgctgctgcattgtttggtcgtcggtgtcaccaactgttcgtatggtttggttgtaaggctctaaaaaaaaaaaaaaaaaaaa

SEQ ID NO: 4252 - protein, 227 aa, Panicum virgatum
  misc_feature: Ceres CLONE 1802002
  misc_feature (1)..(76): Pfam Name: GST_N Pfam Description: Glutathione S-transferase, N-terminal domain
  misc_feature (1)..(96): Pfam Name: GST_C Pfam Description: Glutathione S-transferase, C-terminal domain
MAEEKNEGLVLLDFWVSPFGQRCRIALAEKGIPYDYSEQELLGAKSDLLLRSNPIHKKIPVLLHDGRPVCESLVILNYLDEAFPNQGSSGKLLLPADPYARAQARFWAAYSDKVYELGTRLWKLKGEARAQARAELLQVLANLDGELGGKPFFGGEEFGFVDVAVAPFVPWLPSYERYGEFSVEAAVPRLAAWARRCEGRESVAGSLHPPEKVDEFITMLKKHYGIE

SEQ ID NO: 4253 - DNA, 893 bp, Panicum virgatum
  misc_feature: Ceres CLONE 1802039
  misc_feature: Encodes the peptide sequence at SEQ ID NO. 4254
gccacatcgcagaacgcaaagcagcataggaagaaccagcagagctctcgccacccataatcctccatcgagttgcagcgagctgcagcagcgtccagcgaggagggagtaaggaaggaagccatgacggagctgttcgacacggccgtgaccagcctcctccacctgccggaggttctcgaccgcctcgccgcagcggacggcgaccgccgctccggcggccaccacggcgcgcaccaccacggccggcacgcgcgcgtccacggccttggcaccggcgccggcggcgcgccggtggacatcgtggagactcccggcgagtacaccttcctgctcgacgtccccggtctctccaagtccgacatccaggtgacgctggaggaggaccgggtgctggtgatgaagggcggcggcggcggcagcagcaacaacaacaacgggaagcggaagcgcgaggaggaggagggcgaggggtgccgctacatctgcctggagcggcgcgcgtcgccacggtcgttcgtgcgcaagttccggctgccagaggacgcggacgtgggcggcatcgcggcgcgctgcgagaacggggtgctcaccgtcaccgtgaagaagcagccgccgccggagaagaagaccaagtccgtgcaggtcaccatcgcctgagctcccccagacgagggaagcgagtgagcagtcggtcaggggtggcagtctatccgtaggagtgtagtctacgtagaaggttgggtgctctgtttgtgttcgatgcagagcagggagtgtggctgatcgtctttcgtgatgtctctgtggaatggaacgagtattctaatgtcatcagttgctactatcggtgaactcgcgagagattccagtaaaaaaaaaaaaaaaaaaaa

SEQ ID NO: 4254 - protein, 178 aa, Panicum virgatum
  misc_feature: Ceres CLONE 1802039
  misc_feature: Great-hit functional homolog of the protein sequence given in SEQ ID NO 9713
  misc_feature (1)..(113): Pfam Name: HSP20 Pfam Description: Hsp20/alpha crystallin family
  misc_feature: Useful for biocontainment applications
  misc_feature: The plant produces a reduced number of seeds.
MTELFDTAVTSLLHLPEVLDRLAAADGDRRSGGHHGAHHHGRHARVHGLGTGAGGAPVDIVETPGEYTFLLDVPGLSKSDIQVTLEEDRVLVMKGGGGGSSNNNNGKRKREEEEGEGCRYICLERRASPRSFVRKFRLPEDADVGGIAARCENGVLTVTVKKQPPPEKKTKSVQVTIA

SEQ ID NO: 4255 - DNA, 1052 bp, Panicum virgatum
  misc_feature: Ceres CLONE 1802072
  misc_feature: Encodes the peptide sequence at SEQ ID NO. 4256
acaactcactccggcggcctccagctattgcagagcgacgacctccgagtccagcggctaacccaccagcttcccatccagttctcatcactggctagctagacagccagccagccagccagccaaggcaagccaccggtcatcgcacacgagacgctagttagcttctacatcaagcttattagcctccgatcctgctgcgagagagccgagcgagcgaggatgtcgagccggaggtcgtcgcgtggcaacatctccgaggacgagatcaacgtgctcatctccaagctccaggccctgctccccagctcccgccgccgcggctccggccaggcgtcgacgacgaagctgctaaaggagacgtgcagctacatcaagagcctccaccgggaggtggacgacttgagcgaccggctctcgaacctcatgtccaccatggacagcaacagccccggcgcggagatcatccgcagcatccttcgctcctgatcgtgcgctccgcgggcggccccggcgcggcccggccgcgagaggaggtcaacggcgacgactacgacggccgcggccattccccggccggccacgtgcgggctcaattagctagctagggtatatatataatatatctacaaatatgtgtatctttctcttcttcctttcactacctgtcgatcgatctccctagatctgagatcatgtggctagccccccataccaaaatgtactagctgcacgcacgcgtatgctgatctccctgctgctaagctccaccgggtagctagctaggacactagcgctagggcctaagcaagctaagctttatccaccctcctcactttagctcgctcgccgacctcctcctctcgctccctctccatgtgatctctctgtcgtcctccgcgctagctcttcttttgatgccccgcttgtattgttatccctgtaaatttagtcggtggcttggatcgagttggctagctctcttcagacaaccgaccgaccactactacctagagcaaattgattatcatcaaaaaaaaaaaaaaaaaaaa

SEQ ID NO: 4256 - protein, 88 aa, Panicum virgatum
  misc_feature: Ceres CLONE 1802072
  misc_feature: Great-hit functional homolog of the protein sequence encoded by LOCUS At1g26945
  misc_feature (1)..(49): Pfam Name: HLH Pfam Description: Helix-loop-helix DNA-binding domain
  misc_feature: Useful for making plants with modulated nitrogen use efficiency
MSSRRSSRGNISEDEINVLISKLQALLPSSRRRGSGQASTTKLLKETCSYIKSLHREVDDLSDRLSNLMSTMDSNSPGAEIIRSILRS

SEQ ID NO: 4257 - DNA, 851 bp, Panicum virgatum
  misc_feature: Ceres CLONE 1802076
  misc_feature: Encodes the peptide sequence at SEQ ID NO. 4258
cctcgtctagctctgttgaacgaagcacatcggccgcgccgatggtaagttgatgtgggacacgaacacgacgggacatggtggttggtttgtgttgcagggaggcgacggaggagtacggcgaggaggtggtgcagctgtgccggagggtgatgcggctgctgtcgacggggctggggctggaggccgggaggctgcaggcggcgttcggcggggagggcggcgagggggcgtgcatgcgcgttaacttctacccgcggtgcccgcagccggagctcacgctcggcgtggcggcgcactccgaccccggcggcatgaccatgctgctggtcgacgaccacgtcaggggcctgcaggtgaggagccccgacgccggcaagtggatcaccgtcgaccccgtccccgatgccttcatcttcaacataggcgaccagatccaggtgctgagcaacgcggcgtacaagagcgtggagcaccgggtggcggtgagcgcggcggaggagcggctgtcgatggccttcttctacaacccgcggagcgacctgccgatcgcgccgatgccggagctggtggcgcccggccgcccggcgctgtacccggagatgacgttcgacgagtaccgcgtcttcatccggcagcggggcctggccggcaaggcgcagctccagtcgctgcaggcaaaggccaccgccgctcctgccgacgacccagctgccggcggctcgccgtcctctagctagcacacacagctgtaacctagcagctaccgagctaccttactatatatcatctgcccgcaggtcaggtttcagctacctgtgctgtgcatatatattggatcgatctcggtg

SEQ ID NO: 4258 - protein, 220 aa, Panicum virgatum
  misc_feature: Ceres CLONE 1802076
  misc_feature (2)..(101): Pfam Name: 2OG-FeII_Oxy Pfam Description: 2OG-Fe(II) oxygenase superfamily
MVVGLCCREATEEYGEEVVQLCRRVMRLLSTGLGLEAGRLQAAFGGEGGEGACMRVNFYPRCPQPELTLGVAAHSDPGGMTMLLVDDHVRGLQVRSPDAGKWITVDPVPDAFIFNIGDQIQVLSNAAYKSVEHRVAVSAAEERLSMAFFYNPRSDLPIAPMPELVAPGRPALYPEMTFDEYRVFIRQRGLAGKAQLQSLQAKATAAPADDPAAGGSPSSS

SEQ ID NO: 4259 - DNA, 716 bp, Panicum virgatum
  misc_feature: Ceres CLONE 1802082
  misc_feature: Encodes the peptide sequence at SEQ ID NO. 4260
cgtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacggcggcggcggcggcggctacgggcgccgcgagggcggcggtggctacagcggcggcggcggctacggtggccgtggaggctacggcggcggcggcggctacggcaactccgatgggaactggaggagctgagcggtggggcccgcgtggccaagttatcctgtccttgctactgttacctgagttatcctgtgccatgatctacctgtgtttggtgcctttcgtgttcgttgttgcccatctgtgtttttgatcgcaagctcgttcgtctagtggtaaaaaaaaaaaaaaaaaaa

SEQ ID NO: 4260 - protein, 151 aa, Panicum virgatum
  misc_feature: Ceres CLONE 1802082
  misc_feature: The sequence is a functional homolog of  SEQ ID NO 1039 in the  10/374,780 US patent application
  misc_feature: The sequence is a functional homolog of  SEQ ID NO 849 in the  10/666,642 US patent application
  misc_feature: Useful for making plants with modulated growth and phenotype characteristics
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRREGGGGYGGGGGGYGRREGGGGYSGGGGYGGRGGYGGGGGYGNSDGNWRS

SEQ ID NO: 4261 - DNA, 904 bp, Panicum virgatum
  misc_feature: Ceres CLONE 1802096
  misc_feature: Encodes the peptide sequence at SEQ ID NO. 4262
gagacaccgcgcaccacaccgagggatcgattcaattaaaaaccaccgcttggcttggcctctagcgccggcgggtacgaacgcctgtacttgcaccggcccgcgacgtcgtggtgcgagaagccaggggagcgaggcgcggcgcggcgggcggagacggcggcgggcgtgtcgtaggacggaggagctgagctagcgagccgccgccgccatgcaaggggaggaaaagagggggaaggtgaagaaggggtggctggcggtgcgcgtcggcgccgagggcgacgagcgcggcttccagcggttcgtcatccccatcgcctacctctaccacccgctcttccggcggctgctggaggccgcgcgcgacgcctacggctacgactactcggcggggccgctgcgcctgccctgctccgtcgacgagttcctccgcctgcgcgcgctcgtcgagcgggagacgcaggcggcgccggcctcctcctcctcctcctcctcgcaccgcgtgcacgccggcggccacgggcactactccctctccccgtgcacccgcgccaaggtcagctcctgagatggtttgatcatcaggatcggagggcctgcctgcccagctgccctgtgcctagtcgagtcgagctcggcttccattcatcatgtcgtgcccgcgcggcgcgacaacgaggagtccatgcccatcgatcgatcgagcccggaggtgtagagacagacagaggcagtagttgtagattagcctggggatgcttcctctgtgatttcgagtgttggcttttgccttctcttttttgcgtctcattttgcagatgcgcatgtactgtataaatagatgcatcgatgtataattactagttgaattgacactctcatacaaaaaaaaaaaaaaaaaaaa

SEQ ID NO: 4262 - protein, 118 aa, Panicum virgatum
  misc_feature: Ceres CLONE 1802096
  misc_feature (2)..(85): Pfam Name: Auxin_inducible Pfam Description: Auxin responsive protein
MQGEEKRGKVKKGWLAVRVGAEGDERGFQRFVIPIAYLYHPLFRRLLEAARDAYGYDYSAGPLRLPCSVDEFLRLRALVERETQAAPASSSSSSSHRVHAGGHGHYSLSPCTRAKVSS

SEQ ID NO: 4263 - DNA, 961 bp, Panicum virgatum
  misc_feature: Ceres CLONE 1802100
  misc_feature: Encodes the peptide sequence at SEQ ID NO. 4264
aatccatcctctcctcgcgagctccaacagcaatcaagctagagagaagcttaggctgcaagaagaagccagcaagaggcgaggacgcgagcagggcaagcgagatcactcggaccaagcgatccatggcgccgaggaggtcgacttcgccggccgggagcggcagcagcggcggcggcggcggcgcggagcagccgaggctgcgcggcgtgcggaagcggccgtggggccggtacgcggcggagatccgcgaccccgtgcggaaggcgcgcgtgtggctggggaccttcgacacgcccgaggaggcggcgcgcgcctacgacgccgccgcgcgcaggctccgcgggccgcgcgcagccaccaactaccccgcccacgcccaggacccgaaggcggcggccgcggcgattccggcgtcgagcgctagcgcgagcgggagcggggtgctgtcgtcggaggacgcgtcgtcgtcgtcctcctgccgggactcgccgctggcgcccccgtcgctggacctgagcctggcgctcccggccgtggcggccgcgccgccgccgtattcgtaccagcagctgttcctggacccggcggcgatggtggccgcggcgccggcgctgctgcagttcctgccgcccaagagtgaggaagaacagagctgctcagggtcgagctcctcctcgtcggtggtggtcgacgcggcgccggcggtgggcctggggctggacctgaacctggcgctcgcggccgggatggtgatgtagagacaagaccaatgatttggttaattagtggctcctagctcaccgatccagatgttcacccggtgtaaatagtcggcccgcagggatttatttgtgcatctgcgcagccagttctctttgcttcctttttgtacccacagatttcgcgtcccgcaaagatgcgcgccaacgcaagaaggaagaaactttgccccagccac

SEQ ID NO: 4264 - protein, 211 aa, Panicum virgatum
  misc_feature: Ceres CLONE 1802100
  misc_feature (1)..(60): Pfam Name: AP2 Pfam Description: AP2 domain
MAPRRSTSPAGSGSSGGGGGAEQPRLRGVRKRPWGRYAAEIRDPVRKARVWLGTFDTPEEAARAYDAAARRLRGPRAATNYPAHAQDPKAAAAAIPASSASASGSGVLSSEDASSSSSCRDSPLAPPSLDLSLALPAVAAAPPPYSYQQLFLDPAAMVAAAPALLQFLPPKSEEEQSCSGSSSSSSVVVDAAPAVGLGLDLNLALAAGMVM

SEQ ID NO: 4265 - DNA, 843 bp, Panicum virgatum
  misc_feature: Ceres CLONE 1802148
  misc_feature: Encodes the peptide sequence at SEQ ID NO. 4266
atggtcatagcctgcccccgcctgctctgctcctgctgctgcccccgagacgaatccgagcccgtcagccaagagacgccgtcggcgatggcgccccctgccgccaccaccggcagcgacgaccggaacactgacagcaccaccaccgtcacgcaccgcaccgtggaggtgggccccggcgtgcgcctgcacgtggcggaggccggcccggccggcgcgcccacggtgctgctgctccacggcttcccggagctgtggtacacctggcgccaccagatgcgcgcgctggccgcggcgggctaccgcgccgtggcacccgacctgcgcggctacggcggctccgacgcgcccgcgctcgacgacgccgggcagtacacggcgctgcacgtggtgggcgacctggtggcgctcatcgacgccctcggcgagaagcgggtgttcgtggccgcgcacgactggggggcgctcatggcgtggagcctctgcctgttccgccccgacagggtgcgcgcgctcgtcgcgctcagcgtcgcctacacgccccggagcgccgcgcggaggcctatcgacgggctcagggcgctcttcggcgacgactactacatctgccggatccaggtaccgtgtagtacacacttattacgatcgacatgtgtcatgcaggcacctcagctcgccgccatgatagatgcttccttgcacactacttttgtgtgctgttcagtactactctgtcttgttgtaattgagctgatccatgcaggtaattaatactttgctttgtacgctctttatttgattcctttcaaacggtagctttgataaaaaaaaaaaaaaaaaaaa

SEQ ID NO: 4266 - protein, 227 aa, Panicum virgatum
  misc_feature: Ceres CLONE 1802148
  misc_feature (1)..(106): Pfam Name: Abhydrolase_1 Pfam Description: alpha/beta hydrolase fold
MAPPAATTGSDDRNTDSTTTVTHRTVEVGPGVRLHVAEAGPAGAPTVLLLHGFPELWYTWRHQMRALAAAGYRAVAPDLRGYGGSDAPALDDAGQYTALHVVGDLVALIDALGEKRVFVAAHDWGALMAWSLCLFRPDRVRALVALSVAYTPRSAARRPIDGLRALFGDDYYICRIQVPCSTHLLRSTCVMQAPQLAAMIDASLHTTFVCCSVLLCLVVIELIHAGN

SEQ ID NO: 4267 - DNA, 921 bp, Panicum virgatum
  misc_feature: Ceres CLONE 1802197
  misc_feature: Encodes the peptide sequence at SEQ ID NO. 4268
atcgccaagcgttcagctagctactgagagctcgatttggatcgtgcacacactgcacagccgcctcccgcgatcaacgtctcggtcaccggccggccgctcatcagccgcgacgaacccggccggtcgtctccgccgccgcattatccgtctctctccgacgacgatgtcgagcaggaggtcccgcgcgtcggtctcggaggaggagatcaacgagctcatcgcgaggctccagacgctgctccccagcgcgcgccgccgtggcggcagccatgcgtcgacgacgaagctgctcaaggagacgtgcagctacatcaagagcctgcaccgggaggtggacgacctgagcgaccgcctctccgacctcatggccaccatggaccacaacagccccgccgccgagatcatccgcagcttcctccgctagcgatcgaccgagccgacggccacggccggccctggcgacggccggatacccatcgccatggaggggsctcggcctagctttattagctagctctcagcgggtcggagctgagtgtaccatattcttccccggcggcagctgcctgctaaggacgacggagtctggtttaattggtagtagtacaagtttttaagctctttggtagggcattagccattagctagctagggccgcctaagtatggttcatttctcccttccatttgttgtttttttttttgctagtagctccctccaacttctttgtactcttcgatcgtttcctcctccactccatctccttcttcctcctcctcgcgtagcctatccgtggtccggatcgagttgtttcccctgcgcagacaaccgaccgaccgcgagctaccgactgatccatcgacatgtactggtggtaatatatatatctatatatattatatataatatcgttgtctc

SEQ ID NO: 4268 - protein, 86 aa, Panicum virgatum
  misc_feature: Ceres CLONE 1802197
  misc_feature: Great-hit functional homolog of the protein sequence encoded by LOCUS At1g26945
  misc_feature (1)..(49): Pfam Name: HLH Pfam Description: Helix-loop-helix DNA-binding domain
  misc_feature: Useful for making plants with modulated nitrogen use efficiency
MSSRRSRASVSEEEINELIARLQTLLPSARRRGGSHASTTKLLKETCSYIKSLHREVDDLSDRLSDLMATMDHNSPAAEIIRSFLR

SEQ ID NO: 4269 - DNA, 632 bp, Panicum virgatum
  misc_feature: Ceres CLONE 1802255
  misc_feature: Encodes the peptide sequence at SEQ ID NO. 4270
tgatcacaagcgaagcagagcacacaggaagcactccaccttcttcagccgcgctacctgctttccttcctgcttgctcgtgatcaccgagatcaggatgtctggttgcagcggcggcaactgcgggtgcggctccgcctgcaactgcggcggcggatgcaacggctgcaagatgttccctgacgtggaggccgcctccaccaccaccaccaccatggtcatcgccgccgccagcaacaaggcgagctccggcgggttcgaggcggccaccgagagcggcggctgcgactgcaacacctgcaagtgcggcaccagctgcggctgctcctgctgcagctgcaactgaggcggccatgcgccgcggccatggaagcacgaggagaaagccccccggcgtagtatataggagcagagtctaaataagatcttgccaactgcgccatccatcatctaccgtgtcgtgtcgtgacatccatggtcgcctgccgtgtctcagctggggttgttgtctgaacgtctctggtgatcgacgacgcatgccggtcgtcgatctttagcttgtgtgtccgtcctcctcgtgcacgccacctttaatatatgtatttcagaaccaaaaaaaaaaaaaaaaaaaa

SEQ ID NO: 4270 - protein, 82 aa, Panicum virgatum
  misc_feature: Ceres CLONE 1802255
  misc_feature (3)..(83): Pfam Name: Metallothio_2 Pfam Description: Metallothionein
MSGCSGGNCGCGSACNCGGGCNGCKMFPDVEAASTTTTTMVIAAASNKASSGGFEAATESGGCDCNTCKCGTSCGCSCCSCN

SEQ ID NO: 4271 - DNA, 848 bp, Panicum virgatum
  misc_feature: Ceres CLONE 1802257
  misc_feature: Encodes the peptide sequence at SEQ ID NO. 4272
agcagcagcttgagagaaccggatccgaatggagagcccttcctctccccgtcctgagaacaacggccaggtgagcggcggcggcgggagctcgaaggtgcgcccgaggtccttcgatgaaaagacccggttggcgtgctggcggaaggcggcggtggtggcggggcggcacccggaacgctggcggcaggatgccgccggcaacgtcgtctgccgccgattctggagctgccacggctgcctctgctacgagtacgaccacatcgtccccttctccaaaggaggagagtccactgttgacaactgccagatccttcagactagggtgaaccgatccaaatctgataaagcatgggtagatgatgcagagatgcgtggtttctcttgtgacatcaagtttactgacaaggaacttgatataattgagatggccatttatggggatgttattcgtccaggtaagcaatgccattgcaggacagtagctgagatgctagggaaagtgaagacaaagaatcgtatggctgcttgcgagctaccagacaaaaacacatcttaacatgttctagggctctttacatgaaatcaatcccagtgtcttctgctcctgtcagggagtgcaacatattgtctcagctgattccattgaacaattgtgctctcaaattccgtccaccagcatgtcatttagcaaaaacaatgcggttgagtccatctgagctcttgcaagtaactgcatgattgaacattctggtgatgtatgtttttttgttggaatttgattcttgatctgtagcatatagatggcaatgccataaagatacagtcaaaaaaaaaaaaaaaaaaaa

SEQ ID NO: 4272 - protein, 176 aa, Panicum virgatum
  misc_feature: Ceres CLONE 1802257
  misc_feature (1)..(43): Pfam Name: HNH Pfam Description: HNH endonuclease
MESPSSPRPENNGQVSGGGGSSKVRPRSFDEKTRLACWRKAAVVAGRHPERWRQDAAGNVVCRRFWSCHGCLCYEYDHIVPFSKGGESTVDNCQILQTRVNRSKSDKAWVDDAEMRGFSCDIKFTDKELDIIEMAIYGDVIRPGKQCHCRTVAEMLGKVKTKNRMAACELPDKNTS

SEQ ID NO: 4273 - DNA, 756 bp, Panicum virgatum
  misc_feature: Ceres CLONE 1802277
  misc_feature: Encodes the peptide sequence at SEQ ID NO. 4274
ctacacgccaagaaaagtttcccccgacactagccgaatcgccccccatttccctcgaccccgcgaagcggtgacccccgaccctccgaggctccgacccgatggcgccaaaggccgagaagaagccggcggaggagaaggccgagaaggcggagaagacgcccgcggggaagaagccaaaggcggagaagcgcctccccgcctccaagaccgccggcgagaagaaggggaagaagaaggccaagaagagcgtggagacctacaaaatctacatcttcaaggtgctcaagcaggtgcacccggacatcggcatctcctccaaggccatgtccatcatgaactccttcatcaacgatatcttcgagaagctggcgcaggaggccgcccgcctcggccgctacaacaagaagcccaccatcacctcccgcgagatccagacctccgtgcgcctcgtcctccctggcgagctcgccaagcacgccgtctccgagggcaccaaggccgtcaccaaattcaccagcaactgaacgaaccgcgacatccacggatttgttaggtctccgccacttctaggcttcttcgttgtgttccccccttccttcctctggtactcatgatgtagtatctgctgtgaaaatgtttatgtagtactagctggcttgcctgctttgtaaatcatgccaggttgtgatgaacgtcttggatttaaggtaacgggtgtggagccctcgccgctaaaaaaaaaaaaaaaaaaaa

SEQ ID NO: 4274 - protein, 141 aa, Panicum virgatum
  misc_feature: Ceres CLONE 1802277
  misc_feature: Great-hit functional homolog of the protein sequence given in SEQ ID NO 9491
  misc_feature: Useful for biocontainment applications
  misc_feature: Useful for making plants with modulated flowering time
  misc_feature: No seed is being produced by the plant
  misc_feature: The plant flowers significantly late compared to wild-type.
MAPKAEKKPAEEKAEKAEKTPAGKKPKAEKRLPASKTAGEKKGKKKAKKSVETYKIYIFKVLKQVHPDIGISSKAMSIMNSFINDIFEKLAQEAARLGRYNKKPTITSREIQTSVRLVLPGELAKHAVSEGTKAVTKFTSN

SEQ ID NO: 4275 - DNA, 1021 bp, Panicum virgatum
  misc_feature: Ceres CLONE 1802280
  misc_feature: Encodes the peptide sequence at SEQ ID NO. 4276
gctgctcttcgctctagcttgcttccgtgctgatctttactagtagtggttgcctggtgtcgagaggaagcccccggagcacgggaggccggggagcttctcgaggagcgaggggggcggccatgaggatccagtgcgacgcgtgcgagggcgcggcggccacagtggtgtgctgcgcggacgaggcggcgctgtgcgcgcgctgcgacgtcgagatccacgccgccaacaagctcgccggcaagcaccagcgcctcccgctcggcgccggcgccggcgccggcggggacgtcccgcgctgcgacgtctgccaggagaagccggccttcatcttctgcgtcgaggacagggcgctcttctgccgcgactgcgacgagcccatccacgtccccggcacgctctcggggaaccaccagcgctacctcgccaccggcatccgcgtcggcttcagctccgtctgcggcgccggcgccggcgccggcgccgacgtccttccgccgcctaagggcagctcaaagcccgcggctgccgccgggtccgctaaggcgccggccagtaagcccgcgcagccgcaggaggtgccgtcgtcgccgttcctgccgccgtccgggtgggccgtcgaggacctcctgcagctctccgactacgaatccagcgacaagaaggactcgcctctcgagttcaaggagctggagtggttcgcggacatcgacctgttccacggccacgcgccggccaaggccacgacggccgaggtccccgagctcctcgccacgccgcagccggcgagcaacgcggggttctacaagacgagcggtgcgcgccagagcaagaagccgcgggtggagctgcccgacgacgaggacgacttcttcgtcgttcctgatcttggctgagacgtaaagtcttctcatggttcccctcatcccctgtcatgtgatgtgtatgtatgcaaagtatgtgtgtatgcactgatcgcttacgctgggcttatgtaattataaggcagtttggggccggt

SEQ ID NO: 4276 - protein, 257 aa, Panicum virgatum
  misc_feature: Ceres CLONE 1802280
  misc_feature (3)..(48): Pfam Name: zf-B_box Pfam Description: B-box zinc finger
MRIQCDACEGAAATVVCCADEAALCARCDVEIHAANKLAGKHQRLPLGAGAGAGGDVPRCDVCQEKPAFIFCVEDRALFCRDCDEPIHVPGTLSGNHQRYLATGIRVGFSSVCGAGAGAGADVLPPPKGSSKPAAAAGSAKAPASKPAQPQEVPSSPFLPPSGWAVEDLLQLSDYESSDKKDSPLEFKELEWFADIDLFHGHAPAKATTAEVPELLATPQPASNAGFYKTSGARQSKKPRVELPDDEDDFFVVPDLG

SEQ ID NO: 4277 - DNA, 846 bp, Panicum virgatum
  misc_feature: Ceres CLONE 1802300
  misc_feature: Encodes the peptide sequence at SEQ ID NO. 4278
attcttcatcctcttcctcacagctgcttgctgcttagccgcccttggctgctctctgctcctccgaattccatggatctgcaggcggagctgcggcgcccggcggcggcccacgaggcggcgctgagggccgtgcagaagccgcccgccaagccctggcgcgggggaggcgccgcttcgaccccgcccccgccgcccaaggtgtaccgcgtcgagccccgggagttccgggacctcgtgcagaggctcaccggcgcgccgcccgctcccacgggcaggggcggcgtggcgcggccgcagcatcatcagctgccggcggcggtgcagccgcaccagccggtggccgttcgcgctacaggggaccaccaccaccagcagcagcagcagctttacggctcgccgtggttctccttcccgctggccgggctggacggcgccaacgccggcggcctcatgtagtcgtcgtgacgcaacgcacgcatcaagggaagagaagggaagggatcgatgtagcaaatcaaagctttctcccttttttttcttggttattacaggacagagtagtttgtttctgaaacaaggaagggaatcgagcatacaagaatcaacagcagcagtcacctcaccacgcatgcattagacaggcaggcagacatacatagatgaattaattaatgatgttgaataataatgtcaatagtcatactctagttagttattctctgttaattactactactaccagcaagtaccggtgttcatatagacagacttggtatatcactgtaacaagtgtatgtgtaatgttgaaggatgaaggtgttgcagtagtccagctgcatgctg

SEQ ID NO: 4278 - protein, 128 aa, Panicum virgatum
  misc_feature: Ceres CLONE 1802300
  misc_feature: Great-hit functional homolog of the protein sequence given in SEQ ID NO 9407
  misc_feature: Useful for making plants with modulated biomass
  misc_feature: The plant is abnormally small.
MDLQAELRRPAAAHEAALRAVQKPPAKPWRGGGAASTPPPPPKVYRVEPREFRDLVQRLTGAPPAPTGRGGVARPQHHQLPAAVQPHQPVAVRATGDHHHQQQQQLYGSPWFSFPLAGLDGANAGGLM

SEQ ID NO: 4279 - DNA, 814 bp, Panicum virgatum
  misc_feature: Ceres CLONE 1802303
  misc_feature: Encodes the peptide sequence at SEQ ID NO. 4280
agggttcttcttggttcctcccactcgccgccgccacctcacgagcaacaggggctccagctcccggagctcgcccgccttgccagcatgatcatccctaagaagaatcgcaatgagatctgcaagtacctcttcaaagagggcgtgctgtacgccaagaaggactacaacctggcgaagcacccgcagattgacgtgcccaacctggaggtgatcaagctcatgcagagcttcaagtccaaggagtacgtcagggagaccttctcctggcagtactactactggtacctcaccaacgatggcattgagcacctgcgcaactacctcaacctggcttctgagatcgtgcctgccacactcaagaagtctgccaggccgcctggccgcccgtttggctctggtcctcctggtgaccgcccaaggggcccacctcgctttgaaggcgacaggccaaggtttggtgacagggaagggtaccgtggtggtcctcggggtgctcctggtgacttcggtggtgagaagggtggagctcctgctgagtttcagccatctttcaggggttctggtgccagacctggctttggccgtggtggtggcagcggctttggcgccggcccgacctcttcttccatggagtgaagttgcccctagtttggacatggtgtttcccttcgtgaggcgtttaattttgaaggacagttattatgtactagtattgttatccagatcggcagagtgctgacaaatgcagaaaattgtgctatcttgataccttggttccagtataatagtcttttgtaaacgcttcggtttc

SEQ ID NO: 4280 - protein, 183 aa, Panicum virgatum
  misc_feature: Ceres CLONE 1802303
  misc_feature: Great-hit functional homolog of the protein sequence given in SEQ ID NO 9569
  misc_feature: Useful for making plants with modulated nitrogen use efficiency
MIIPKKNRNEICKYLFKEGVLYAKKDYNLAKHPQIDVPNLEVIKLMQSFKSKEYVRETFSWQYYYWYLTNDGIEHLRNYLNLASEIVPATLKKSARPPGRPFGSGPPGDRPRGPPRFEGDRPRFGDREGYRGGPRGAPGDFGGEKGGAPAEFQPSFRGSGARPGFGRGGGSGFGAGPTSSSME

SEQ ID NO: 4281 - DNA, 880 bp, Panicum virgatum
  misc_feature: Ceres CLONE 1802327
  misc_feature: Encodes the peptide sequence at SEQ ID NO. 4282
acacagatacattcgtcgatccaccactgtccagtgcttggcggttacgcacgcacgcacacagataggattatcttttactacaccaactcaccaagatactagcaagccgaatcgacaaacaagcagcaggaagaggaggcatggcgctcgcggaggggaacgtcatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctcgagaagaaccccaagctcaagaaccacgccatgtccgtcttcgtcatgacctgcgaggcggcggcgcagctacggaaggccgggaaggtcaccgtcagggagacgacgctcaagcggctgggcgccacgcacttcaagtacggcgtcgccgacggccacttcgaggtgacgaggttcgcgctgctggagacgataaaggaggcgcttcccgccgacatgtggagcctggagatgaagaacgcctggagcgaggcttacaaccagctggtggcggccatcaagcaggagatgaagcctgccgcatgatgctgctgctgctactgagatgaagcctgcccgcatgatgctgctgctgctactcggcctccgcgctgagttccccctacgatgcaccaccatctccaaattcttcatcgctgtttttttttttttgctgttttgacttgtattgtgcattttccaaatctctcgatggagacaagtgtgatgactaatttttgagagcatgtatatatgttgtgatgagcattgaataaaaaaaaaaaaaaaaaaaa

SEQ ID NO: 4282 - protein, 162 aa, Panicum virgatum
  misc_feature: Ceres CLONE 1802327
  misc_feature: Great-hit functional homolog of the protein sequence given in SEQ ID NO 9685
  misc_feature: Useful for making plants with modulated cold sensitivity
  misc_feature: Useful for making plants with modulated salt sensitivity
MALAEGNVIFGEEQEALVLKSWALMKKDSADLGLRFFLKIFEIAPSAKQMFSFLRDSDVPLEKNPKLKNHAMSVFVMTCEAAAQLRKAGKVTVRETTLKRLGATHFKYGVADGHFEVTRFALLETIKEALPADMWSLEMKNAWSEAYNQLVAAIKQEMKPAA

SEQ ID NO: 4283 - DNA, 1102 bp, Panicum virgatum
  misc_feature: Ceres CLONE 1802380
  misc_feature: Encodes the peptide sequence at SEQ ID NO. 4284
aagaagctcgccagctttcatcagcaccgtgttccggcgacttggagaaagacgaacccacaaaatccggtctaattttggtgcttgcaaggcgaggggagttgatttcggtgcgcggtgagggaagtggatttgaggatttctgtgcgcggatggggcaggcgttccgcaagctgttcgatgccttcttcggcaccagcgagatgagggtcgtgatgcttgggctggatgccgcgggcaaaaccaccatcctgtacaagctgcatatcggggaggttttgtcgactgttcccacgattggtttcaatgtcgagaaagtgcagtacaagaatgtgatgtttactgtttgggatgtcggtggccaagagaaattgaggcccctgtggaggcactacttcaacaacacagatggcttgatctacgtggttgattcattggatcgagagagaattggaaaagccaaagctgaatttcaggcaataattaatgatcctttgatgcttaacagtgtcatattggtatttgccaataaacaagatatgaaaggggcaatgacaccaatggaggtctgtgagggccttggtctttatgatttgaaaattcgaatctggcacatccagggctcctgtgccctaaaaggcgacggtctatatgagggcttggactggttggcaagcacgctgaaggaactggaagcttcaggtcgcctaccgtcaggagggacctcgttgttctaagcagcaagcctgcctgtaaaatccttcggctggaggatgcgcttttgtcctagatcgtaccgatccctgggataaggggatgaccatttcttgtctatgatctaacctgtgatgtaggtctggtaaatttcgttgcaagtttatacaaagctaactgggcggatgcatttgttcatatatgagaactgataagtcaaaatccttgtgatgctaatgtaaacgtttctgtaaatttgagttggcaaatgcaatttatctcgacaagttggtctcattataaatttatactgatctcatggttcatcgggatggaggtctacacgaaacatgagcactgtgcctgccaaaaaaaaaaaaaaaaaaaa

SEQ ID NO: 4284 - protein, 194 aa, Panicum virgatum
  misc_feature: Ceres CLONE 1802380
  misc_feature (1)..(174): Pfam Name: Arf Pfam Description: ADP-ribosylation factor family
MGQAFRKLFDAFFGTSEMRVVMLGLDAAGKTTILYKLHIGEVLSTVPTIGFNVEKVQYKNVMFTVWDVGGQEKLRPLWRHYFNNTDGLIYVVDSLDRERIGKAKAEFQAIINDPLMLNSVILVFANKQDMKGAMTPMEVCEGLGLYDLKIRIWHIQGSCALKGDGLYEGLDWLASTLKELEASGRLPSGGTSLF

SEQ ID NO: 4285 - DNA, 714 bp, Panicum virgatum
  misc_feature: Ceres CLONE 1802384
  misc_feature: Encodes the peptide sequence at SEQ ID NO. 4286
agcagcagctcgagcacacacgtagacttgaagctagagagtccacagctagcccctgctcgaggctgcgaggatgtcgctggtaaggctgctcgacacgctggccccgggctcgtggaggaaccccttcagcatcttcggcacggcggtggccgccgacacgtggctggcgagcgacacctcggcgttcgccaacacctacatcgagagccgggacacggcgggcgcgtacgtgttcagcgcggcgctgccgcccggcgtgaggaaggaggaggtgctggtggaggtggacgagggcaacgtgctggtcatcaccggggagcgcagcgtccgccgggaggagcgcggcgacaggtggcaccacatcgagcgcagctgcgccacgttcctcggcaggttccacctgcccagggacgccgccgtggacggcgtcagggccgccatggacgccggcgtgctcacggtcaccgtgcccaaggtcggggccatcgccgccgccgccgcctccgtcgagaagccggtcggggagccgacggtggccgtggaggccggcccctgctgatttgacgcgccggcgcgcgcgttccatcacgggcgaggcacgcccctgttgaacgaacactaaggtctctcgtccgtaccgtctgaagcttcctcctcctctggtttggtattgcatactttcccgtgtgatggatctgcctgcacgcatgt

SEQ ID NO: 4286 - protein, 162 aa, Panicum virgatum
  misc_feature: Ceres CLONE 1802384
  misc_feature (1)..(103): Pfam Name: HSP20 Pfam Description: Hsp20/alpha crystallin family
MSLVRLLDTLAPGSWRNPFSIFGTAVAADTWLASDTSAFANTYIESRDTAGAYVFSAALPPGVRKEEVLVEVDEGNVLVITGERSVRREERGDRWHHIERSCATFLGRFHLPRDAAVDGVRAAMDAGVLTVTVPKVGAIAAAAASVEKPVGEPTVAVEAGPC

SEQ ID NO: 4287 - DNA, 1064 bp, Panicum virgatum
  misc_feature: Ceres CLONE 1802438
  misc_feature: Encodes the peptide sequence at SEQ ID NO. 4288
aagcctagacgccaccccctcctcccctacacacacgccgcaggcgcgcgcctcccgcacaaaggaaaagaacgaggccatggcgccgagaacgtcggagaaaacgatggcaccggcggcgtccccggggctcgcgctcggcgtcggcggcggcggcggcccgcacttccgcggcgtcaggaagcgcccgtggggccggttcgcggcggagatccgcgacccggccaagaagagccgcttgtggctcggcacgttcgacacggccgaggaggccgcgcgggcctacgacgccgccgcgcgcgagtaccgcggcgccaaggccaagaccaacttcccctacccttcgtcggcgtccgtgcccccggccgccaccgccggcagccggagcggcgacagcagcaccgtggagtccttcggcggcgacgtgcaggcgcccatgcaggccatgccgctgccgccgtcgctcgagctggacctgttccaccgcgcggcggccgcgggcgccggcgccggcgtgcgcttcccgttcagcggctaccccgtgacgcacccctactacatcttcagccaggccgccgcggccgccgccgcggggtgccacatgcagctgaagctgccgccgacggtgaccgtggcggccgtggtgcagagcgactccgactcctcgtcggtcgtggacctgtcgccgccgccgctcgccgccgccgggtcggcgaagaaggcctccgcgttcgatctcgatctgaactccccgccgccggcggaggcggaggcctagtagccggagtttagctgatgactggcactagttcctttcttcgtttcttccttcgcctttttcccctagaagaaacttggctgtatgtttacgcgtaggccctctctcttaccagaccagagagggaggacatttttgtaaatagtttttccgccggggatctaagctctagctgatgataaaaaaaaaagctgtattgtcatccaagacaggtcctgccggcgttgtcatggaccggattatattaattaattaagtgttttgataaaaaaaaaaaaaaaaaaaa

SEQ ID NO: 4288 - protein, 232 aa, Panicum virgatum
  misc_feature: Ceres CLONE 1802438
  misc_feature: Great-hit functional homolog of the protein sequence given in SEQ ID NO 9387
  misc_feature (1)..(65): Pfam Name: AP2 Pfam Description: AP2 domain
  misc_feature: Useful for making plants with altered alkaloid content
MAPRTSEKTMAPAASPGLALGVGGGGGPHFRGVRKRPWGRFAAEIRDPAKKSRLWLGTFDTAEEAARAYDAAAREYRGAKAKTNFPYPSSASVPPAATAGSRSGDSSTVESFGGDVQAPMQAMPLPPSLELDLFHRAAAAGAGAGVRFPFSGYPVTHPYYIFSQAAAAAAAGCHMQLKLPPTVTVAAVVQSDSDSSSVVDLSPPPLAAAGSAKKASAFDLDLNSPPPAEAEA

SEQ ID NO: 4289 - DNA, 1037 bp, Panicum virgatum
  misc_feature: Ceres CLONE 1802445
  misc_feature: Encodes the peptide sequence at SEQ ID NO. 4290
ccccgcagagacccctcgatcgagccaaacaaaagccaagaagaatccagccggccgtgtcgcgccgagccaacaagcacacgcgcctcgccctccccagcgcacaccaaccacagcctcctcctcgccgccatgcagcagcagccgcgccgccgcgcctccccggccgcgtcgctctgacgtgcggcgccgtcgtccgtcctctcgaccgtgctgccatctgtccgatcgatcgatccatgggggttcacctgcagctgctgaagaagcagccctcgtcggcgtcgctggagggctcgaggagcggggggtcgtcgccgccgatgccgcccaaggggtgcatggcggtgcgcgtggtggggcctggcggcggggaggaggaagaggaggagcgtttcgtggtgccggtggggtacctgaagcacccgctgttcgtggcgctgctcaaggcggcggaggacgagtacggcttcgagcagaagggcgccatcaccatcccctgcggcgtcgaccacttccgccacgtccagggcatcatccaacaccagaagcaccaccaccacatctcatccggcttcgtctccggcgacggcggccaccatggccaccacaacaacaaccaccacttccacatcgctgggtgcttccgcgcctgatgcgatgcgggttcgagatctccagcggatgcatggatccaaaaacaataatacatagtacctattttatttaggttttttgtcttgattattagtactttttagatgcaggcaagccgcggatcgtatgatcgaaggatcgtggatcgtggttggttgcttgagttattagcgtaatcgtggatctgcaggtttggatggatgggtcgatcgatcattagagttagtttttctctaggtttcttatgatgatgatgaaaaggaaatcaaagaatcgtcgatcattagagttagtttttctctaggtttcttatgatgatgatgaaaaggaaatcaaagaatcgttcatgtttcagtgttcaaaaaaaaaaaaaaaaaaaa

SEQ ID NO: 4290 - protein, 138 aa, Panicum virgatum
  misc_feature: Ceres CLONE 1802445
  misc_feature (1)..(99): Pfam Name: Auxin_inducible Pfam Description: Auxin responsive protein
MGVHLQLLKKQPSSASLEGSRSGGSSPPMPPKGCMAVRVVGPGGGEEEEEERFVVPVGYLKHPLFVALLKAAEDEYGFEQKGAITIPCGVDHFRHVQGIIQHQKHHHHISSGFVSGDGGHHGHHNNNHHFHIAGCFRA

SEQ ID NO: 4291 - DNA, 688 bp, Panicum virgatum
  misc_feature: Ceres CLONE 1802464
  misc_feature: Encodes the peptide sequence at SEQ ID NO. 4292
atacggcgtacacacaccggcgccattaacacaaggcagttccctctcctcccggctagcgatcgagtagcttgtggaatggcgacgacggcggccgccgagctgaagccgcgcgcggcgctgtcgctgctgctggccctgatcctgatcttgggcctgggcggcggcgccgacgcgcaggaggcgacgtgcgcggggcagctgagcgggctggccccctgcgcgcgctacagcgtgccgccgccgccggggcaggcgccgcccgcgccggggccggagtgctgctccgcgctgggggccgtgtcccgggactgcgcctgcgggacgttcgccatcatcaacagcctgccggccaagtgcggcctcccgcgagtctcctgccagtgatgaacagtagctcgcgaggtgaatgaaggtgcaagaccaataagcagccaagaagaagaataaagatggaagatcgtctctgatggatggtcatccagaatctagacctagctgctgttatcgggcgtagtgctcctgtttacatcagtgtcgttggccgttttttcttttccctcctttttctttcccttttttattaaggtttgatagattcatcagtagttcagctcgtcctgtccgctggtctcggtgaatgttaagaaaacgctgacagcagttcgaaaaaaaaaaaaaaaaaaaa

SEQ ID NO: 4292 - protein, 102 aa, Panicum virgatum
  misc_feature: Ceres CLONE 1802464
  misc_feature (1)..(64): Pfam Name: Tryp_alpha_amyl Pfam Description: Protease inhibitor/seed storage/LTP family
MATTAAAELKPRAALSLLLALILILGLGGGADAQEATCAGQLSGLAPCARYSVPPPPGQAPPAPGPECCSALGAVSRDCACGTFAIINSLPAKCGLPRVSCQ

SEQ ID NO: 4293 - DNA, 843 bp, Panicum virgatum
  misc_feature: Ceres CLONE 1802481
  misc_feature: Encodes the peptide sequence at SEQ ID NO. 4294
atccatccccagcagcagcaaccatcttaattagcttctctctcgagctctagctgctagccggctagctatctagtagctgttgttgatcgtcgacgcgagtaggcagccagccagcagctagaacaggtagtagcccagccgatcaaggagcaaggatgtctggcgtgtgggtgttcaagaacggggtggtgcggctggtcgagaacggcgcggcggccggcggcgaggcggtgcggaagcggaaggcgctggtgcacacgccgagcgggcaggcggtgcggtcgtacgcggagctggagggggagctgcgggcgctggggtgggagcgctactacgaggacccggcgctgtaccagttccacaagcggggctccctcgacctcatctccctccccgccgacttcgccaggttctcctccgtccacatgtacgacatcgtcgtcaagaaccgcgactccttcagggtcgtcgacatctgaatcatcctcatctctcgctcatccgccattgttgctgccgatcgtgcttattagcttcagtgttctctgatcaatcgatcgacgatctagggatccatgcagctagcttgttaattaattgtgactttgtgacttgtgaggagggccgcagccttcatcagctagtgtgacagccgttaattctcgtttacgtcagtgacagtgaggttgctagctatgttttgcttaatttctcgatgcagtgtgtgagtgtccgtcagagtgtgtgagactgaatcagtagtgcgagtggtgtctgggagtgctgctggtcctgatgtaatctgctctctcatgtgactgtaaatctatcgtttgtgcc

SEQ ID NO: 4294 - protein, 107 aa, Panicum virgatum
  misc_feature: Ceres CLONE 1802481
  misc_feature: Great-hit functional homolog of the protein sequence given in SEQ ID NO 9508
  misc_feature: Useful for making plants with modulated flowering time
MSGVWVFKNGVVRLVENGAAAGGEAVRKRKALVHTPSGQAVRSYAELEGELRALGWERYYEDPALYQFHKRGSLDLISLPADFARFSSVHMYDIVVKNRDSFRVVDI

SEQ ID NO: 4295 - DNA, 1046 bp, Panicum virgatum
  misc_feature: Ceres CLONE 1802523
  misc_feature: Encodes the peptide sequence at SEQ ID NO. 4296
aattcaggaccccggtcacacacagtcaccctcggcgttctcttcctctctgcggctccggggcgttttgttcctctcggcggctccggagatggcgggcgtcggctcggcggtgcggcggctctacctggctgtctacaattggatcgtcttcgccggatgggcgcaggtgctatactacgcgattttggcgctgttggagagcggccatgaggctgtctacggcgctgtcgagcggccgctgcagttcgctcaaacagccgccatcatggagattctacatggacttgtaggtcttgtgaggtctccaatctctgcaactcttccacaaattggatcaaggttgttccttacatggggcatcttgtggagttttcctgagactcgctctaatattcttgttacttcattggtcataagttggtccattactgagattattagatattctttctttggtacgaaggagacatttggattcgcaccatcgtggctattgtggctaaggtatagcacttttatggtattataccctactggcatctcgagcgaggttggtctaatttttgctgctctacctcatatgatggcatctcagaaatattgtctaaggttgccaaacaaatggaatttctcttacgattacttatatacatctattcttgctctcgcggtttacattccaggaagtccacatatgtttaaatatatgctttcccagcgtaagaaggcattgtcgaagtcaaaaaccgtgtaatgttgctcaatggccttttagaatagcacatgcgtcatctctcgaagtgccccatgagtatttttaaaacttttccagcagaagttagtgaaatggggaatgacactctttacgtgattgcccaaaagtatgttgtaccttaaaatatccgcttttatttggttattaaaattattggcccaaatcgcccagcatggacattgtgacattacgatatgatatatggctacttactgtaacttaagtttgtaattttccatgattctttgctacttatatttctttgtac

SEQ ID NO: 4296 - protein, 221 aa, Panicum virgatum
  misc_feature: Ceres CLONE 1802523
  misc_feature: Great-hit functional homolog of the protein sequence given in SEQ ID NO 9475
  misc_feature (1)..(165): Pfam Name: PTPLA Pfam Description: Protein tyrosine phosphatase-like protein, PTPLA
  misc_feature: Useful for making plants with modulated drought sensitivity
MAGVGSAVRRLYLAVYNWIVFAGWAQVLYYAILALLESGHEAVYGAVERPLQFAQTAAIMEILHGLVGLVRSPISATLPQIGSRLFLTWGILWSFPETRSNILVTSLVISWSITEIIRYSFFGTKETFGFAPSWLLWLRYSTFMVLYPTGISSEVGLIFAALPHMMASQKYCLRLPNKWNFSYDYLYTSILALAVYIPGSPHMFKYMLSQRKKALSKSKTV

SEQ ID NO: 4297 - DNA, 990 bp, Panicum virgatum
  misc_feature: Ceres CLONE 1802618
  misc_feature: Encodes the peptide sequence at SEQ ID NO. 4298
tggagttcggagacgccaatcggcaatctcaccccaattccgtcggaaactagccagccacagccaccgcacccatatctccctcgctcgctcgccggggcgcgccaatggcatccaccggcgccgacgagtcagctgcggcggcgcagcccagggccgccatctcgcacgtcatcttcgacatggacggcctcctcctcgacacggagggcttctacacggaggtgcaggagaagatccttgcgaggtacagcaaggtcttcgactggtccgtcaaggccaagatgatgggcaagaaggccatcgagtctgcgcgcatcttcgtcgacgagttcggcctcgccggcctgctcacccccgagcagttcctcgagcagcgcgagagcatgctccaggcgctcttcccatcctgcattaagctgccaggggtactacgtctggtccatcatcttcatgccaatggaataccaatggctgttgcaacaggatcccataaaagtcattttgcactgaagacacagaaccaccaagagatgttctccctgatgcatcatgttgtcatgggggatgacccggaggtgaaggctggcaagccatctcctgatattttccttgctgctatgaggaggtttgagggcaatgtagaacccagtaaatgcttggtttttgaagatgcaccatcaggtgtagcagcagcgaaaattgctggaatgtctgctgtgatggtcccagatccgcggcttgatgtttcgtatcacaaaggagctgaccaagttctcagttcgttgttggacttcaaacccagcgaatggggcttgccgcctttcaaagagtagacaaattccgtatgatgattttaaaactgaggaacgagagaatttcaaacactcacagcattgatcagagaaattccataagatgttgcacaagattctgtttatcctaggccttaggccttagcagtaacaatttgagcatttgttgtctcgt

SEQ ID NO: 4298 - protein, 242 aa, Panicum virgatum
  misc_feature: Ceres CLONE 1802618
  misc_feature (1)..(191): Pfam Name: Hydrolase Pfam Description: haloacid dehalogenase-like hydrolase
MASTGADESAAAAQPRAAISHVIFDMDGLLLDTEGFYTEVQEKILARYSKVFDWSVKAKMMGKKAIESARIFVDEFGLAGLLTPEQFLEQRESMLQALFPSCIKLPGVLRLVHHLHANGIPMAVATGSHKSHFALKTQNHQEMFSLMHHVVMGDDPEVKAGKPSPDIFLAAMRRFEGNVEPSKCLVFEDAPSGVAAAKIAGMSAVMVPDPRLDVSYHKGADQVLSSLLDFKPSEWGLPPFKE

SEQ ID NO: 4299 - DNA, 561 bp, Panicum virgatum
  misc_feature: Ceres CLONE 1802625
  misc_feature: Encodes the peptide sequence at SEQ ID NO. 4300
aagccacagctcaacttcatcagcgagttgcagcagagatcgagatggagatccgcggcatgggcaccaccgccgtcctcgctctcctcgtcggcggctacgtgtgccgcgactgggtcgtgagcctgctcgagccgcccgtgtgcacgccgaggccgtgggactgctgcgacgccgccgtctgcaccagggagtacatccccttctgccgctgcgccgacgaggtggaggcgtgccccagcaactgcagcgagtgcgagctggcggaggcggacccgccccgctaccgctgcctcgaccagttccacggctaccctgggcccaagtgcacgccgttgccgtggatgggcaactagcccagcacgtacacgcccgatcagctatatctacggacacgtacgtacgcccacaaataaataaaattagctactgtagcaagtgattgttcatccgacgtggacaattagctaccctgctcgctagctcctactgtatttcgtgcaactcaataagagacgtggccaagtagacctcggtccagaaaaaaaaaaaaaaaaaaaa

SEQ ID NO: 4300 - protein, 103 aa, Panicum virgatum
  misc_feature: Ceres CLONE 1802625
  misc_feature (1)..(25): Pfam Name: Bowman-Birk_leg Pfam Description: Bowman-Birk serine protease inhibitor family
MEIRGMGTTAVLALLVGGYVCRDWVVSLLEPPVCTPRPWDCCDAAVCTREYIPFCRCADEVEACPSNCSECELAEADPPRYRCLDQFHGYPGPKCTPLPWMGN

SEQ ID NO: 4301 - DNA, 1153 bp, Panicum virgatum
  misc_feature: Ceres CLONE 1802646
  misc_feature: Encodes the peptide sequence at SEQ ID NO. 4302
tccttgtccaccccaccccaacagcaatccggcgttcctcgacagcaccgtcccgaggccgccgccccccaccagcgccaggagtaagtttattacgtgaccaatatgtcgagggaggagaacgtttacatggccaagctggccgagcaggctgaaaggtatgaggagatggttgagtatatggagaaagtggccaagactgtagatgttgaagagctcactgttgaggagcgtaacctcctctcagttgcatacaagaatgtgattggggctcgccgtgcttcatggcgcatcgtctcatccattgaacagaaggaggagagccgtaagaatgaggagcatgttactttgatcaaggaataccgtggcaagattgaagctgagctgagcaatatctgtgatggcatcctgaagctgcttgactcacacctggttccttcttctactgctgctgagtcaaaggtcttctacctcaagatgaagggtgactatcacaggtatcttgctgagtttaagaccggcgctgagaggaaggaatctgccgagagcacgatggttgcttacaaggctgctcaggatattgctctggctgaactggcgcctactcatccgataagacttgggctcgctcttaacttttcggtgttctattacgagatcctgaactccccagacaaagcttgcaaccttgcaaagcaggcgtttgatgaggctatctccgagttggacacccttggggaggagtcatataaggatagcaccctgatcatgcagctcctgagggacaacttgaccctctggacctctgacctaacggaggatggtgctgaggaggggaaagaagccccaaaaggtgacgccggcgatggccagtaacccttgagtgcatgttcttgaagcccattgttttagatgcctctgtgctgtttgaagctgtgcgctgcgccattattgtagctgctttcatcactgctcgcttctttccttatagtaggctggtagtggtcgaattagttgtcattgctttgcattgccgctagttggcactaggtccgtgtggactggtattgttgtcctggatttgacaagcatgtgtgttgtccctctagcgttttattgagcaatattgaagttgtcattttcatctagttgc

SEQ ID NO: 4302 - protein, 256 aa, Panicum virgatum
  misc_feature: Ceres CLONE 1802646
  misc_feature: Great-hit functional homolog of the protein sequence given in SEQ ID NO 9428
  misc_feature: The sequence is a functional homolog of  SEQ ID NO 2350 in the  10/374,780 US patent application
  misc_feature: The sequence is a functional homolog of  SEQ ID NO 344 in the  10/412,699 US patent application
  misc_feature: The sequence is a functional homolog of  SEQ ID NO 786 in the  11/479,226 US patent application
  misc_feature: The sequence is a functional homolog of  SEQ ID NO 789 in the  11/479,226 US patent application
  misc_feature: The sequence is a functional homolog of  SEQ ID NO 790 in the  10/225,066 US patent application
  misc_feature: The sequence is a functional homolog of  SEQ ID NO 797 in the  11/479,226 US patent application
  misc_feature: The sequence is a functional homolog of  SEQ ID NO 801 in the  11/479,226 US patent application
  misc_feature: The sequence is a functional homolog of  SEQ ID NO 805 in the  11/479,226 US patent application
  misc_feature: The sequence is a functional homolog of  SEQ ID NO 809 in the  11/479,226 US patent application
  misc_feature: Useful for making plants with modulated drought sensitivity
  misc_feature: Useful for making plants with modulated growth and phenotype characteristics
MSREENVYMAKLAEQAERYEEMVEYMEKVAKTVDVEELTVEERNLLSVAYKNVIGARRASWRIVSSIEQKEESRKNEEHVTLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEGKEAPKGDAGDGQ

SEQ ID NO: 4303 - DNA, 937 bp, Panicum virgatum
  misc_feature: Ceres CLONE 1802649
  misc_feature: Encodes the peptide sequence at SEQ ID NO. 4304
agtgatcagtcccaaattaagacgacacagtacttccaacacagctctcactttagccacagtactccaacaacaatgccagctgaggcgtcgtcggtcgtgcgtgtgatcggcctatggccgagcccgttcgtcatccgcgtcctgatcgcgctgaagctgaagggcgtcgagtacgagttcgtggaggagcaggtgggcaagaagagcgagctgctgctcaggtccaacccggtgcacaagaagatccccgtcctgctccaccacggcaagcccatctccgagtccctcgtcatcgtccagtacgtcgacgaggcctggtcatcctccgccgcgccggccatcctcccggccgacccgtacacccgcgccgtccatcggttctgggcgcagtacatcgacgacaagttccctccggcgatccgcactctcaagggatcggacgacggcgacaaggagcaagcggcggggcagctgtccgccgccctgcagctgttggaggccgccttcgtggagctcagccaggggaagagctacttcggcggcgacggcgtcgggtacatggacatcgccctggtgtcgcacgtcgggtgggtgagggcggtcgagaagatcgccggggtcgcgctcctggacgaagcgaaagtcccgaacctggcggcgtgggccggtcggctgtgcgcgcacgcggcggtggcggacgcgatccctgacgcggacaagttcgtggagttcagcgtcaagtacgggtcgttttcgaagcctattaacagtggtgccaagtgagccaaagcgatctgtgttcaaaaaaaaaaaaagtgagccaaagcgatctgatgtggccgcttacttagtggtagccatcgactttcagtgcacgtgtgacagtgtctatcaataagatgttttttttgtataaaaaaaaaaaaaaaaaaaa

SEQ ID NO: 4304 - protein, 236 aa, Panicum virgatum
  misc_feature: Ceres CLONE 1802649
  misc_feature (1)..(74): Pfam Name: GST_N Pfam Description: Glutathione S-transferase, N-terminal domain
  misc_feature (1)..(102): Pfam Name: GST_C Pfam Description: Glutathione S-transferase, C-terminal domain
MPAEASSVVRVIGLWPSPFVIRVLIALKLKGVEYEFVEEQVGKKSELLLRSNPVHKKIPVLLHHGKPISESLVIVQYVDEAWSSSAAPAILPADPYTRAVHRFWAQYIDDKFPPAIRTLKGSDDGDKEQAAGQLSAALQLLEAAFVELSQGKSYFGGDGVGYMDIALVSHVGWVRAVEKIAGVALLDEAKVPNLAAWAGRLCAHAAVADAIPDADKFVEFSVKYGSFSKPINSGAK

SEQ ID NO: 4305 - DNA, 959 bp, Panicum virgatum
  misc_feature: Ceres CLONE 1802685
  misc_feature: Encodes the peptide sequence at SEQ ID NO. 4306
ataagcatacgcaccggcataggagtcacttctcggcaagcaccagccacagccagccaccagagggacgcaccaagcttaagcagcagcacacagcgccacggcctcctcggctagccggccggtagctcctaaaagtttccagatggcgatgctgcagcggtctacggtgcttgtggcggtggcggccgtggcgctggcgttcgcgatggcggcggcggcccagggcccggcggcggctccggggccggcggccgggatcagcgacgagtgcctgaacgcggtgctcaacatgtcggactgcctgtcgtacgtgaccaacgggagcacggtgcggcacccggacaaggcctgctgcccggagctggcggggctgctcgagtcccaccccatctgcctctgccagctgctcgccggcggcgccgactcctacggcgtcagcgtcgactacaagcgcgcgctcgcgctccccggcatctgccgcctcaccgcgccgcccgtcagcgcgtgcgcagcattcggagtccctatacctgcaggactggtgcctactgcagcgccctcgcccatgtcatcaacaggcctctctccttccatcggcccagaagtgcctgcgaacacgccggccggctcggcagcgaagtcgacgaaccacgccccgggccgcgccgccgcagccggcctcgccgccctcgccgcgctacccctcgccgtcgcggccgccgccgggatgctctagaccgccgcctctgatttctttctccattcttaccacacatatggttgttcattactatgaattactagacacctacgtacagacagttgtttccacgcgcgagattcttccgggtttgtttgtttgttttttccatgtattaattcctttctttcggtgtactgtaatttgctactagagatcgtgacgctgtgtcgggatcattttctacggtttgatg

SEQ ID NO: 4306 - protein, 197 aa, Panicum virgatum
  misc_feature: Ceres CLONE 1802685
  misc_feature (1)..(80): Pfam Name: Tryp_alpha_amyl Pfam Description: Protease inhibitor/seed storage/LTP family
MAMLQRSTVLVAVAAVALAFAMAAAAQGPAAAPGPAAGISDECLNAVLNMSDCLSYVTNGSTVRHPDKACCPELAGLLESHPICLCQLLAGGADSYGVSVDYKRALALPGICRLTAPPVSACAAFGVPIPAGLVPTAAPSPMSSTGLSPSIGPEVPANTPAGSAAKSTNHAPGRAAAAGLAALAALPLAVAAAAGML

SEQ ID NO: 4307 - DNA, 694 bp, Panicum virgatum
  misc_feature: Ceres CLONE 1802698
  misc_feature: Encodes the peptide sequence at SEQ ID NO. 4308
tcacttcgccgcttcagttgcaattgccaagtcgcaacaatctacggcacctaccgcgcgcagcggcaaccagcccgagcccccccccccccccaccccctaagcaccgagcggcgcgatggcgacggagctgacggcggcgctgctgcgggcgtacgacggcaccgacccctccaagccgatctacgtctccgtccgcggcaaggtctacgacgtcacctcgggccgcagcttctacggccccggcggcgcctacgccatcttcgccggccgcgaggccagccgcgccctcgccaagatgtccaaggaagaggccgacgtctccggcgacctctccggcctcaccgagaaggagctcggcgtcctcgctgactgggagaccaagttccaagccaagtaccccgtcgtcgcccgcctcgtcgacgcctgaactcggaatctgaagtcaaaaccccccaatcagcggcgaccaccaccacctcggcaagtatcagtgtaactgtctgtatcctacctcttgcagccttgtgcttgcctgcttgctacattagctaccaaataatctcaagggtccaagctatgatgtatgttcctgctacaaaactctctgcatacactgtggtatctgtcaagatgtatgtgcttatttgctgtgcaattgcatgctgtagcacaaaaaaaaaaaaaaaaaaaa

SEQ ID NO: 4308 - protein, 103 aa, Panicum virgatum
  misc_feature: Ceres CLONE 1802698
  misc_feature: Great-hit functional homolog of the protein sequence encoded by LOCUS At2g24945
  misc_feature: Useful for making plants with modulated nitrogen use efficiency
MATELTAALLRAYDGTDPSKPIYVSVRGKVYDVTSGRSFYGPGGAYAIFAGREASRALAKMSKEEADVSGDLSGLTEKELGVLADWETKFQAKYPVVARLVDA

SEQ ID NO: 4309 - DNA, 699 bp, Panicum virgatum
  misc_feature: Ceres CLONE 1802778
  misc_feature: Encodes the peptide sequence at SEQ ID NO. 4310
gcattccaggtccttccccagcattccaactttctccccagacgcggcgccgtcaggccgtcacgccgacttccgcgcggacgcggtgatcaccggaaccctagctgcggcgcctctaccgcctggctctattccatcgctgtgcgtgtcctctcgaacttcctcgccggattgatcgctggttgcgatggcaacgccacttatagcaggacttgcagttgcagcaactgctctagccagtagatatggcatccaagcttggcaagcttataaggcaaggcctatagttccaaggatgcgcaaattctatgaaggtggctttcaacctacaatgaaccgaagggaagctgcattaatccttggtgtcagggaatctgccaacgcagagaaggtcaaagaggcgcacaagagggtaatggtcgccaaccatccggatgcgggtggaagtcattaccttgcttcaaagattaacgaggcaaaggatgtgttaacggggaaaaccagaggaggtgggtcggccttttgattggaggatgaacattgtgttcgtccactggaaggataattttgtacctccggacttagcattagaagatagacacaagtcttggcgctataaaaatttttggacaaagaatgttattaacttcttaataaaactcaaggctcagttgtgcccaaaaaaaaaaaaaaaaaaaa

SEQ ID NO: 4310 - protein, 112 aa, Panicum virgatum
  misc_feature: Ceres CLONE 1802778
  misc_feature (1)..(57): Pfam Name: DnaJ Pfam Description: DnaJ domain
MATPLIAGLAVAATALASRYGIQAWQAYKARPIVPRMRKFYEGGFQPTMNRREAALILGVRESANAEKVKEAHKRVMVANHPDAGGSHYLASKINEAKDVLTGKTRGGGSAF

SEQ ID NO: 4311 - DNA, 1072 bp, Panicum virgatum
  misc_feature: Ceres CLONE 1802858
  misc_feature: Encodes the peptide sequence at SEQ ID NO. 4312
cgctctcattctctccctgcgcgccgccgccgccattgctgaccggaaaatacggaaggggaggggaggatggagggaactagccgcgcggacgggaggaacccaaaccagctccggcccttcagctgcaccggcaacccgctcaaccgcgcccacggctccgctcgctgggcgcagggcgacaccgtcgtgctggccgccgtctacgggcccaagccggggaccaggaagggagagaaccccgagaaggcctccatcgaggtcgtctggaagcccaagaccggccagatcggaaggcaggagagggagtatgagatgacactcaagaggacgttgcagagcatctgcgtgctcaccgttcatccaaacaccaccacctctgtcgtgcttcaggttgtgggtgatgatggctctcttctaccttgcgcaattaacgcttcctgtgctgcccttgcatttgctggcatccctttgaaacatcttgcagtggcaattggctgtggggtgatggagaatggtgcggttattttggacacaaacatggcagaagagcagcaattgaagtcctttgctcatctggtgttccccagttcacgcaagtcggtggattcgaaggaagcaaaacagaaagacgaggagtttgagcgaggattgataacctcaatctcccatggagtgatgtctgaggatgactacttgaactgcatagagagaggtcttgcggcgtcctcacggatctcggattttatgaggaagactctacagaaggaggcgtcatctgtaggtgcttgagtgacatcatggttgacagctagtgtgattttggtgtcagctcgctcatgttgcagtggaggaggcaaccaattagcaggaggaaatgctacccgatctgatgaggatctgatgttgttctcagcctcgctaggattggggggcattgaaaacgttgagatggaatgtggctggagtactagttagctagttagttggttttgacgagtttgtgcacaatatatactagtatcagctttactgcaggtttgtgttggcagaaaaaaaaaaaaaaaaaaaa

SEQ ID NO: 4312 - protein, 240 aa, Panicum virgatum
  misc_feature: Ceres CLONE 1802858
  misc_feature: Great-hit functional homolog of the protein sequence given in SEQ ID NO 9459
  misc_feature (1)..(121): Pfam Name: RNase_PH Pfam Description: 3' exoribonuclease family, domain 1
  misc_feature: Useful for making plants with modulated nitrogen use efficiency
MEGTSRADGRNPNQLRPFSCTGNPLNRAHGSARWAQGDTVVLAAVYGPKPGTRKGENPEKASIEVVWKPKTGQIGRQEREYEMTLKRTLQSICVLTVHPNTTTSVVLQVVGDDGSLLPCAINASCAALAFAGIPLKHLAVAIGCGVMENGAVILDTNMAEEQQLKSFAHLVFPSSRKSVDSKEAKQKDEEFERGLITSISHGVMSEDDYLNCIERGLAASSRISDFMRKTLQKEASSVGA

SEQ ID NO: 4313 - DNA, 869 bp, Panicum virgatum
  misc_feature: Ceres CLONE 1802877
  misc_feature: Encodes the peptide sequence at SEQ ID NO. 4314
tgaccgacttgctctgcctttccccagcagagagagagagagagagagagagagagagagagagagagagaggaggaaggactgaggagaggagcgatggcgccgcggaagctgtacgggatgccactgtcggcgaacgtgatacgcgttgccaccgtgctcaacgagaagggcctcgacttcgagatcgtccccgtcgacctccgcaccggcgcccacaagaacccggaattcctcgccctcaaccctttcggccagatccctgcgctggaggacggagatgaagttctctacgagtcccgggcgatcaaccggtacatcgcttccaagtacaagtcggagggccccgacctcctcccgacgccgtcggcgaagctggaggtgtggctggaggttgagtcgcaccacttctaccccaacgtgtcgccgctggtgttccagctcctcgtcaagccgctcctgggcggcgccccggaccccgtggtggtcgacaagcacgcgcaccagctcgccaaggtgctcgacgtctacgaggcgcacctcgccggcaacaagtacctcgccggcgaccagttctcgctcgccgacgccaaccacatgtcctacctcttctgcctcagcaagacccccaaggcgggcctcgtcgacgagaggccccacgtcaaggcctggtgggaggacatcgccgcccgccccgccttcaagaagaccgtcgccgccatccccttgccgccgcccccgtccgcatgagctcacgcgcccgcgtcgactcacaaaagcttagctttggtaccgtagatccgttgaataaataacaactgcgcgttggatgtgctcaattatatatgtgatgaatttgcctttgctcc

SEQ ID NO: 4314 - protein, 217 aa, Panicum virgatum
  misc_feature: Ceres CLONE 1802877
  misc_feature (1)..(96): Pfam Name: GST_C Pfam Description: Glutathione S-transferase, C-terminal domain
  misc_feature (1)..(76): Pfam Name: GST_N Pfam Description: Glutathione S-transferase, N-terminal domain
  misc_feature (1)..(212): SWISSPROT Homolog: EC 2.5.1.18 Glutathione S-transferase I
  misc_feature (1)..(217): SWISSPROT Homolog: EC 2.5.1.18 Glutathione S-transferase III
MAPRKLYGMPLSANVIRVATVLNEKGLDFEIVPVDLRTGAHKNPEFLALNPFGQIPALEDGDEVLYESRAINRYIASKYKSEGPDLLPTPSAKLEVWLEVESHHFYPNVSPLVFQLLVKPLLGGAPDPVVVDKHAHQLAKVLDVYEAHLAGNKYLAGDQFSLADANHMSYLFCLSKTPKAGLVDERPHVKAWWEDIAARPAFKKTVAAIPLPPPPSA

SEQ ID NO: 4315 - DNA, 681 bp, Panicum virgatum
  misc_feature: Ceres CLONE 1802883
  misc_feature: Encodes the peptide sequence at SEQ ID NO. 4316
ccggacccccacggccaccccagcccagcctgccctgcgccgcgccgcgctgtccctgacccggcggccatggcggaggagcagcagcggcagaggtggcaggagggccaccgcctgtgcgccaacaactgcggcttcttcggcagccccgccacgctggacctctgctccaagtgctaccgcgacctcaaccagaaccagcccgcccccgtgccaccgccgccggcctgcacgccgccatccgcctccgtctcagctcccgaggcgggcgccgccgcggcctcttctgcgcccgggcctccgtcgacgccccctgcgcaggccggcaggtgcgcgagctgccggaagcgcgtgggcctgacggggttcgcgtgccgctgcggcgccaccttctgcggcgtgcaccggtacccggagcgccacgcgtgcgccttcgacttcggcgccgccggccgcgacgccatcgcgcgcgccaaccccatcgtcaggggcgacaagctcaaggacaaggtctgaggatcccgacgcggcgccggagggaggaggaggacggcgacccgaacgaatcgtcggactgctccgtaaagcacttccgtgtaccctgcaattggtgtagcctcctcagctgcatgtgtaacccgacgcaccgtaaagctgaaatcgaaagctaaactgatttcg

SEQ ID NO: 4316 - protein, 148 aa, Panicum virgatum
  misc_feature: Ceres CLONE 1802883
  misc_feature (1)..(41): Pfam Name: zf-AN1 Pfam Description: AN1-like Zinc finger
MAEEQQRQRWQEGHRLCANNCGFFGSPATLDLCSKCYRDLNQNQPAPVPPPPACTPPSASVSAPEAGAAAASSAPGPPSTPPAQAGRCASCRKRVGLTGFACRCGATFCGVHRYPERHACAFDFGAAGRDAIARANPIVRGDKLKDKV

SEQ ID NO: 4317 - DNA, 585 bp, Panicum virgatum
  misc_feature: Ceres CLONE 1802916
  misc_feature: Encodes the peptide sequence at SEQ ID NO. 4318
atctcaacgaaccaagcatcacaaagaacgcgcacaaacttgattagattgctgtgtcgtcgtctccgatcatcatcaccaacaagcacccagcacttctgttctagctaattcagccggcatccacaccgtccaaatggcgcaccacttcctgggcaagcaccacaacaaggccggcggcggcggcggcgaggcgcccaaggtcaccgactggcgcaaggaggagaagcaccacaagcacatggagcagctcgcccagctgggcgccgtcgcagcgggagcgtacgccatgcacgagaagcacaaggccaagaaggaccccgaccacgggcactcccacaagatcaaggaaggtgtcgccgccgccgtcgccgtcggcagcgccggctttgccttccacgagcaccacgagaagaaggacgccaagaagcaccgccgcaacgggcaccaccattagtgtagcatatactatagtatagcacaataaattggacgtcgatcgttctactactgtatgtgtgtcctgtaccgcttattcacatttcattgagtacgttgatttattaaaaaaaaaaaaaaaaaaaa

SEQ ID NO: 4318 - protein, 106 aa, Panicum virgatum
  misc_feature: Ceres CLONE 1802916
  misc_feature (1)..(54): Pfam Name: ABA_WDS Pfam Description: ABA/WDS induced protein
MAHHFLGKHHNKAGGGGGEAPKVTDWRKEEKHHKHMEQLAQLGAVAAGAYAMHEKHKAKKDPDHGHSHKIKEGVAAAVAVGSAGFAFHEHHEKKDAKKHRRNGHHH

SEQ ID NO: 4319 - DNA, 658 bp, Panicum virgatum
  misc_feature: Ceres CLONE 1802926
  misc_feature: Encodes the peptide sequence at SEQ ID NO. 4320
cttcagttgagtgtgctccatcaccaagcaaagcaacctcgctcgctctcccaatcatccttatcagatcatcttcttccaagatgtcttgcagctgcggatcaagctgcaactgcggctccagctgcaactgcggcaagatgtaccctgaccttgaggagaagagcagcggcggtgctcaggccaccgtcgtcctcggcctggccccggagaagaaggccggccacttcgaggcggcggcggagtccggtgagaccgcccacgcctgcaagtgcggcaacagctgcacctgcgacccctgcaactgctgatttggatggggaacgtacacgcctgcgtgcatgctagctactgcctactctgcttgtgtgtgacttgattgaacaagaataaggatgagcctgagccaacgtgcctgatgtatcggtttggctccggcctcatccagcatgcatgcgtcgtctgcccttatgtgtgctttgctacctccttattaccttgtgcttggcgtccgtcatgtatctgtatgtgttgatcattgcaaataaaccatgcaggcatgatgcatctctgcatgtgtctctgtaatgatcggtccagagtggtgaatatataaaactggtttgctttatctgcccaaaaaaaaaaaaaaaaaaaa

SEQ ID NO: 4320 - protein, 75 aa, Panicum virgatum
  misc_feature: Ceres CLONE 1802926
  misc_feature (1)..(73): Pfam Name: Metallothio_2 Pfam Description: Metallothionein
MSCSCGSSCNCGSSCNCGKMYPDLEEKSSGGAQATVVLGLAPEKKAGHFEAAAESGETAHACKCGNSCTCDPCNC

SEQ ID NO: 4321 - DNA, 891 bp, Panicum virgatum
  misc_feature: Ceres CLONE 1802938
  misc_feature: Encodes the peptide sequence at SEQ ID NO. 4322
atcctagctacctcacccgggaagcaccgtagcgcgcgccatggccactctcttgggcagctcgccggcgttcctcgcccgccccgtcgccaagccgcacagcatctcctgcgcgcaggtcccgcgcccgcccagcgcccagaaccagccgccgcccggcgagcagccgcagcaacagcaatccgtgcaggcgcagccgcagcaggcggcgaggccgaagcgcgcgggcggcgcggactccacggactgggtggcctcgtcgctgacgcggcggttcggtatcggcgccgggctggcgtgggccgggttcctcgccgtcggcgtcgtgtccgagcagctcaagacccgcttcgaggtcgcccagcagcaggccaacaccaaggacgtggagcaagagcaggaggtcgtgctccccaacgggatccggtactacgagctgcgcgtcggcggcggcgacgccccgcgccccggcgacctggtggtgatcgacctgcagggccgggtggccggcggcggggaggcgttcgtggacacgttcggcgagggcaagcggccgctggcgctggtgatggggtcccggccctacaccaggggcatgtgcgagggcgtcgagtacgcgctgcgctccatgagggccggcggcaagcggcgggtggtcgtgccgccggggctcgggttcggcgacgacggcgccgacttcggggaggagcacgtgcagataccgcccggcgccacgctcgagtacgtcgtgcaggtcgacaaggtatccatcgcgccggcgtgaggcgcgactgaggcgcgagtagatacatcacagttctgtgttgccatgagacgagtttctactcgattgtttcacactgctatctcgttaaatgaattgtttttcgg

SEQ ID NO: 4322 - protein, 247 aa, Panicum virgatum
  misc_feature: Ceres CLONE 1802938
  misc_feature (1)..(104): Pfam Name: FKBP_C Pfam Description: FKBP-type peptidyl-prolyl cis-trans isomerase
MATLLGSSPAFLARPVAKPHSISCAQVPRPPSAQNQPPPGEQPQQQQSVQAQPQQAARPKRAGGADSTDWVASSLTRRFGIGAGLAWAGFLAVGVVSEQLKTRFEVAQQQANTKDVEQEQEVVLPNGIRYYELRVGGGDAPRPGDLVVIDLQGRVAGGGEAFVDTFGEGKRPLALVMGSRPYTRGMCEGVEYALRSMRAGGKRRVVVPPGLGFGDDGADFGEEHVQIPPGATLEYVVQVDKVSIAPA

SEQ ID NO: 4323 - DNA, 645 bp, Panicum virgatum
  misc_feature: Ceres CLONE 1803008
  misc_feature: Encodes the peptide sequence at SEQ ID NO. 4324
cccttctcactctgtttcttaaagcttttccttctctctcggactctctcctcgcttgctcttccttccggcgacgactgggcgagcggcggcgccttttgtcctgtattcgcccagccctttgccggcaatgagcgaagaatcgtccagagacgatgatgaacttgttgatcaaaagaagtatcttgaggaacggtgcaagccacagtgtgtaaaatcactttacgagtatgataaatgtgtcaagagagtggagaatgatgatactgggcacaaacactgcaccgggcaatattttgattactggtcatgcatcgacaaatgtgtagccccaaagctgtttaagaagctaaaatgatgtctgggatggagcttttggcaagtgattctgatgataacatgatgctactttctgcgagcgacttatccatttgtgttaaccttggcgcctttggaacctggctgagctcacgaactattatgcctgtgccttgattctgtgaacttgtaataaatcaacaattttccttcgcaagcatgtgtgttcctctggacttgacatggataagttgatgtttggtgaatctaatgtcatttgccccagtgccattcctttgaactgagcaaaaaaaaaaaaaaaaaaaa

SEQ ID NO: 4324 - protein, 75 aa, Panicum virgatum
  misc_feature: Ceres CLONE 1803008
  misc_feature (9)..(75): SWISSPROT Homolog: EC 1.10.2.2 Ubiquinol-cytochrome c reductase complex 7.8 kDa protein
MSEESSRDDDELVDQKKYLEERCKPQCVKSLYEYDKCVKRVENDDTGHKHCTGQYFDYWSCIDKCVAPKLFKKLK

SEQ ID NO: 4325 - DNA, 653 bp, Panicum virgatum
  misc_feature: Ceres CLONE 1803029
  misc_feature: Encodes the peptide sequence at SEQ ID NO. 4326
atcatacagatagcccaagcacgaacgatcgagctcgtcccaaacaagtagagtaactcgccactgatccttgcaaaagagaaacaaccatgaagccccaggtgctgctcgtcgcggtggccgtcctcgccgtcctcgcagctctgcccctcgccgaaagcaaagggcacgggatcggggagcacggggaggccgcgacggcgagcgcgtggccgtgctgcgacacctgcggctcgtgcaccaggtccatcccgccgcagtgcctgtgcgaggacgaggcgccaggcgggtgccacccggagtgcaggaactgcgtcaagtccaccgacggcggcagcgacgtcttccgctgcgccgaccgcatcaccaacttctgcaagcgccgctgcacgccgaccgcgtccgcgtgattggttggacgccgggatcctgctctgctgtcacctgaataataccatgccggcagctgccgatcgattagctccggcctgcctttggtttcagtcttccagtgttccctctgcgtcctgctctggatggggagaagaaatcagttgtgttttttttttctaatgtttggtctggactcatggatttcttactgtttgtcgaataaagacccgtgttccacgcaaaaaaaaaaaaaaaaaaaa

SEQ ID NO: 4326 - protein, 106 aa, Panicum virgatum
  misc_feature: Ceres CLONE 1803029
  misc_feature (1)..(27): Pfam Name: Bowman-Birk_leg Pfam Description: Bowman-Birk serine protease inhibitor family
MKPQVLLVAVAVLAVLAALPLAESKGHGIGEHGEAATASAWPCCDTCGSCTRSIPPQCLCEDEAPGGCHPECRNCVKSTDGGSDVFRCADRITNFCKRRCTPTASA

SEQ ID NO: 4327 - DNA, 770 bp, Panicum virgatum
  misc_feature: Ceres CLONE 1803031
  misc_feature: Encodes the peptide sequence at SEQ ID NO. 4328
tcctcgcatctcaaacagatcctcagagagaagagagaagctcctcgagagagatacagagaaagagctagcgcagagttgaacggagagctgaagttcaattagtcccctgcttgcttcttccatggagagagttgcatcaagctgcgtcggccacctggctcaaaggagggcctactccgtggccgcggccatggcgaagggagccgggcggagggccgacgacgagaagaaagcggcggccaagcgcgtgatgggcaagaaggaagtgaacaccgcagctgcggagaagacggcgtgggtgccggacccggtgaccgggtactaccgcccggcgggtggcgccaaggaggtggacgcggcggagctgcgcgccaagctgctcacgcaggcggccaactgatgatgaacccaagtcactttgacttttcgaaccatgagttatcagccgaggtagcttgtcttgctttgagatcggcgctcgttgatcgccgggctccgtggcctagagctagcgtgagggtgctgtatctttgcagcatagtagtttcttcggcgactgcttcatctgatttaggttttgagacatgcaagtctgcgatcttcttgcctgctgcctcgtgacctacttgactgctattcagtccagaaagaaagaacgaactaagcgtgcaaggttcagtgttaattattgtatttcagcttgtgttttccctttacgtttcatggttaatttcagtttagtccgttaaaaaaaaaaaaaaaaaaaa

SEQ ID NO: 4328 - protein, 92 aa, Panicum virgatum
  misc_feature: Ceres CLONE 1803031
  misc_feature: Great-hit functional homolog of the protein sequence given in SEQ ID NO 9715
  misc_feature: Useful for making plants with modulated nitrogen use efficiency
MERVASSCVGHLAQRRAYSVAAAMAKGAGRRADDEKKAAAKRVMGKKEVNTAAAEKTAWVPDPVTGYYRPAGGAKEVDAAELRAKLLTQAAN

SEQ ID NO: 4329 - DNA, 953 bp, Panicum virgatum
  misc_feature: Ceres CLONE 1803035
  misc_feature: Encodes the peptide sequence at SEQ ID NO. 4330
agcaaacacacccgctgactccccttgtttccactccactccgaccagatcctccccatccccaagcactccaccaagaaccccccaactccgagttactcgaggaatccatgtgcggcggcgccatcatcttcgactacatcccggcccggcgccgggtgtccgccgccgacttctggccggactccgaagccgacgccgaggactcccacgccccgcgcgcctccggcgagagagcgccgcgcgcgaagcggtgccgcaagaatcagtaccgcggcatccggcagcggccgtggggcaagtgggcggcggagatccgcgaccccgtgaagggcgtccgcgtctggctcggcacctaccccaccgccgaggccgccgcgcgcgcctacgaccgcgccgccaggcgcatccggggcgccaaggccaaggtcaacttccccgacacctcgtccccagtctccgtgccgccgccgccaccagctgctgcagccccggccgtgctcccggcgcccaaggcggaggcaggggtgtccgacgaggtcaaggagctgtccgaggagctgatggcctacgagaactacatgaacttcctcggcatcccctacatggagggcgggagcgcggccgcgcccgccgccgtccccgcccccgtcgcagaggagcagccgcaggcgccggtgccctccgggctgtggagcttcgaggactactacccggcgtccctgtcgctcttcaccgaataacggacgcctcctgaatcctgatgttcttttttcagtaaatttggtgaaaaaatttcccctgctcgtccgcagtcgccgtgagtggctggctaacgccgagctgatgatccttgtcttgtgtcgttgaacccatccattgtttcatttcatttgtaaccttgctctgtaactccccaagtcaatggggtaatcaagatttgcagttggatc

SEQ ID NO: 4330 - protein, 210 aa, Panicum virgatum
  misc_feature: Ceres CLONE 1803035
  misc_feature: Great-hit functional homolog of the protein sequence given in SEQ ID NO 9297
  misc_feature: Great-hit functional homolog of the protein sequence given in SEQ ID NO 9376
  misc_feature (1)..(65): Pfam Name: AP2 Pfam Description: AP2 domain
  misc_feature: Useful for making plants with altered Lignin content
  misc_feature: Useful for making plants with altered alkaloid content
MCGGAIIFDYIPARRRVSAADFWPDSEADAEDSHAPRASGERAPRAKRCRKNQYRGIRQRPWGKWAAEIRDPVKGVRVWLGTYPTAEAAARAYDRAARRIRGAKAKVNFPDTSSPVSVPPPPPAAAAPAVLPAPKAEAGVSDEVKELSEELMAYENYMNFLGIPYMEGGSAAAPAAVPAPVAEEQPQAPVPSGLWSFEDYYPASLSLFTE

SEQ ID NO: 4331 - DNA, 1219 bp, Panicum virgatum
  misc_feature: Ceres CLONE 1803061
  misc_feature: Encodes the peptide sequence at SEQ ID NO. 4332
atcgccgccaccagatgccgcctgcgccctccccttctcttcattagagctccgaatcgcagcagaggtagctgactggtcgccgcgtccgccctctccctgcgtagcagaagagcacccccgatcgagctagcaatggatgcggggggcgtgggcctggcgctgcagacgcgggcggcgggcttcggcactggccggcgccggggcgggctgcagtcgccgatcgggagcttgagggtcgcggacccggcgggagcagcggtcgccgtgcgggctcgcgggtccaagcccgtcgccccgctccgcgcgaagaaatcgtccggaggtcatgaaaacttgcataactccgtcgacgaagcacttctgttgaagagaaaatcagaagaagttttgttctacttgaacgggaggtgtatttacttagtaggaatgatgggttctggaaaaagtaccgtggggaagattatgtctgaagttttgggttattcattctttgatagtgacaaattggtggagcaagctgtgggaatgccttcagttgcccaaatattcaaggttcatagtgaagccttcttcagggacaatgagagtagtgtcttgagggatttgtcctcaatgcggagattagttgttgccactggaggtggtgctgttatccgaccagttaactggaaatatatgaagaagggcctatctgtttggttagatgtgcccttggacgctcttgctaggcgtattgctaaagtgggaactgcctctcgtcctcttctggatcaaccatctggcgatccatacacaatggccttttctaagctcagcatgctcgcggagcaaaggggtgatgcttatgcaaatgcggatgtaagagtttctctagaagagattgcgtctaaacagggtcatgatgatgtctgtaagttgacaccaactgatatcgctattgagtcacttcataagatcgagagcttcgtcattgagcacaccgctgacaacgcagctggtgactctcaagctgagtcgcaggtccaaaggatacagaccttgtagaatgttggccctttttttgtaccccgtagtgtaccaccacctagagcatcgttgagctatttgttcattgcagtgccatcaagaggccaagaaagagacctggagcctctttctgttgtaagtttgtaaaggaatggaataaggaagctaatccgaagtgtgccgttggccg

SEQ ID NO: 4332 - protein, 303 aa, Panicum virgatum
  misc_feature: Ceres CLONE 1803061
  misc_feature (1)..(177): Pfam Name: SKI Pfam Description: Shikimate kinase
  misc_feature (71)..(279): SWISSPROT Homolog: EC 2.7.1.71 Shikimate kinase, chloroplast precursor
  misc_feature (89)..(248): SWISSPROT Homolog: EC 2.7.1.71 Shikimate kinase
MDAGGVGLALQTRAAGFGTGRRRGGLQSPIGSLRVADPAGAAVAVRARGSKPVAPLRAKKSSGGHENLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMRRLVVATGGGAVIRPVNWKYMKKGLSVWLDVPLDALARRIAKVGTASRPLLDQPSGDPYTMAFSKLSMLAEQRGDAYANADVRVSLEEIASKQGHDDVCKLTPTDIAIESLHKIESFVIEHTADNAAGDSQAESQVQRIQTL

SEQ ID NO: 4333 - DNA, 910 bp, Panicum virgatum
  misc_feature: Ceres CLONE 1803072
  misc_feature: Encodes the peptide sequence at SEQ ID NO. 4334
agcgccatggggtccgcgcaggtccttccctgcctcgccggcgtgcttgctgctgctgctgctgctgcggccgctccggcccagcactcgcagtgcctcagcaacccgccggacctgtctctgaccggcggcgaggccggcgaggtcgtcagcgaccttcccggggggttcagagcctatgtcaccggcccggccaagtcccgccgcgccgtcgtcctcgcctccgacgttttcggtttcgaggcgcctatactcagaaagatagcagataaagttggtgaggcaggatacttcgtcttggtccctgatttcttcaatggagatttttacgacgcaagtaaaaacatttcagagtggatcaagtctcattccccgataaaagctgctgaagacgccaagccactctttgctgctttaagaaaggaaagaaagtccattgctgttggaggttattgctggggtggaaaatttggcgccgaggtggcaaaaactgatgatatcaaagtagtttgcctttctcatccttcaacggtgactgctaatgatatgaaagaggtcaaatgcccaattgagatccttggagctcagaatgacacatcgacgccacctaaactagtgtaccagtttgtgaacgtcttgcgtcaaagaacagggattccatacttcgccaagatctttccaggagttgcgcatggatttgcttgcagatataatacaaccgacccttttgccgttagaactgctgaagaagctcttgcttacatgcttgactggttcaagaaatacttgaagtgaagactgcttgaaggttattcatattgatttagagataataatatttcttgccgatcgcattgtaaacttgcatgttgccattgaatgaatattattggatatgttttattcgttc

SEQ ID NO: 4334 - protein, 262 aa, Panicum virgatum
  misc_feature: Ceres CLONE 1803072
  misc_feature (1)..(210): Pfam Name: DLH Pfam Description: Dienelactone hydrolase family
MGSAQVLPCLAGVLAAAAAAAAAPAQHSQCLSNPPDLSLTGGEAGEVVSDLPGGFRAYVTGPAKSRRAVVLASDVFGFEAPILRKIADKVGEAGYFVLVPDFFNGDFYDASKNISEWIKSHSPIKAAEDAKPLFAALRKERKSIAVGGYCWGGKFGAEVAKTDDIKVVCLSHPSTVTANDMKEVKCPIEILGAQNDTSTPPKLVYQFVNVLRQRTGIPYFAKIFPGVAHGFACRYNTTDPFAVRTAEEALAYMLDWFKKYLK

SEQ ID NO: 4335 - DNA, 1039 bp, Panicum virgatum
  misc_feature: Ceres CLONE 1803694
  misc_feature: Encodes the peptide sequence at SEQ ID NO. 4336
aacggatgctgccagccaagtgccgcccctcgccggcggcggcccgccactccttgccggccgctccttgctgcgagctcacctcacgctcgccggccccaccccgaatccgcgcaggcagctccccgtcgctccctgccgtgcagctcctcaccgaccgcggcccgccgctccttgccgtgagctcgcgtcgcattcgccggcagctccccaccgcgccgcgccgctccatggtggggatcgacctcggcaccaccaacttcgccgtggccgccatggagggcggcaagcccaccgtcgtcaccaacgccgagggcgcgcgcaccacgccctccgtcgtcgcctacaccaagaccggggagcgcctcgtcggccagatcgccaagcgccaggcggtcgtcaaccccgagaacaccttctccgtcaagaggttcatcggccgcaagatgtccgaggtcgacgacgaggccaagcaggtctcgtacgacgtcgtcgcccggccaccggccgctgctcctcgccgacccccgcccgttgctcctcgcccggccgcagcccgccgcccactgcgcttcctccccgtcgcgctgccttgccacggggttgccacgccggccgcctcatcttgggcccacctccggctgctccccacctcgccggctgccccccgctgtggtcccacctcgcgtgccggccgtgccccgccgggtgcagcgacgggtgccggcggcggggatggaggtcggggtgccgcgctggagagagaaggacggaggcggtttgcgtcgtggagagagagactcatttttgcgtccctcctcggctgatacgcaaaatgggtggccagtttgggtcgtccgttggagtccattttcagtaggcaaaagtactgtgggtgacccattttgggtttgggtcatcgaatggatgagctgttggagatagtcttagcttgtaaacgcaaaaaatttttgcgtgggaattttatcaatttgaagtactaaatgaagtctatttacaaaaaaaaaaaaaaaaaaaa

SEQ ID NO: 4336 - protein, 273 aa, Panicum virgatum
  misc_feature: Ceres CLONE 1803694
  misc_feature (1)..(89): Pfam Name: HSP70 Pfam Description: Hsp70 protein
MLPAKCRPSPAAARHSLPAAPCCELTSRSPAPPRIRAGSSPSLPAVQLLTDRGPPLLAVSSRRIRRQLPTAPRRSMVGIDLGTTNFAVAAMEGGKPTVVTNAEGARTTPSVVAYTKTGERLVGQIAKRQAVVNPENTFSVKRFIGRKMSEVDDEAKQVSYDVVARPPAAAPRRPPPVAPRPAAARRPLRFLPVALPCHGVATPAASSWAHLRLLPTSPAAPRCGPTSRAGRAPPGAATGAGGGDGGRGAALEREGRRRFASWRERLIFASLLG

SEQ ID NO: 4337 - DNA, 1358 bp, Panicum virgatum
  misc_feature: Ceres CLONE 1803864
  misc_feature: Encodes the peptide sequence at SEQ ID NO. 4338
agtcgcgtcccccctccccccatccacggcgacagcggagagctcgtgtcgtgacagcaccaaggcgaatccaccgcgccgcacccccatggcgacggacggcgagcagcagcagcaggcgccgccggcggaggaggtcgtgtccgtcgagatgcccgcgcccgaggggtggaccaagaagtttactccccagagaggggggagatctgagattgtttttgtttcaccaactggagaggaaattaagaacaagaggcaactaagtcagtacctaaaggcacaccctggaggtcctgctgcttctgagtttgattggggaactggtgataccccaagacgttctgctcgtattagtgagaaagtcaaggtttttgatagcccggaaggtgagaagatcccgaaacgcagcaggaactcaactggcagaaagggcaagcaggagaaaaaggaggcccctgaaactgaagaagccaaagatgctgaagctggcaaggatgcagaggaggcccctaatgaagatgctgcgaaggacactgatgtggagatgaagcctgctgaagaggcgaaagaggctcctactggaactgaagacgcagagaaggctgcagacaaggctgatgctcctgctcctgcaacagaagaagataagaaggaaaccgagaaacctgctgaatctgatgtcgccccttctgcgtcattggaggagaagaaagacgcagcagaagagaagaaggaagatcccaagccagctgagcctgaaactccagctacagcaagcaaccctactgaaaactcggcccctgctcccaccgagactgccgcaactgctgctccagtgtctgaaaccgaatcagacgccgctgctccagcatctggaaccaaaccagatgctgctgctccagtagagaactccactgacaaaggtgctagccaggagagccagcccgtcaacaatgggcagctgccgccctccgcggtgaagtgcacctgaacccaacccagaaccggaaggaagcctgaatccacccttccggggctgtgtatctcatttaggaacatctgcattcgcattgtaatcagtcaaaaaatcggtggattggtaagcatgttaattagtcagtctgacgctgctgggtgacagtcggtaagttaaaagtaggctctgcattttagcttttggtatggctggtgtcagccgccgtacatgtatccatcatcgacatcttcttttgcattgtacttaactgtgcaagttaatcttaggacatgtatactcctctctgaatgtctgtattatgtacctgtgctgcgtattgtgtaacctgcataaccagttgcaaaaaaaaaaaaaaaaaaaa

SEQ ID NO: 4338 - protein, 300 aa, Panicum virgatum
  misc_feature: Ceres CLONE 1803864
  misc_feature: Great-hit functional homolog of the protein sequence given in SEQ ID NO 9587
  misc_feature: Great-hit functional homolog of the protein sequence given in SEQ ID NO 9666
  misc_feature (1)..(71): Pfam Name: MBD Pfam Description: Methyl-CpG binding domain
  misc_feature: Useful for making plants with altered Lignin content
  misc_feature: Useful for making plants with modulated drought sensitivity
MATDGEQQQQAPPAEEVVSVEMPAPEGWTKKFTPQRGGRSEIVFVSPTGEEIKNKRQLSQYLKAHPGGPAASEFDWGTGDTPRRSARISEKVKVFDSPEGEKIPKRSRNSTGRKGKQEKKEAPETEEAKDAEAGKDAEEAPNEDAAKDTDVEMKPAEEAKEAPTGTEDAEKAADKADAPAPATEEDKKETEKPAESDVAPSASLEEKKDAAEEKKEDPKPAEPETPATASNPTENSAPAPTETAATAAPVSETESDAAAPASGTKPDAAAPVENSTDKGASQESQPVNNGQLPPSAVKCT

SEQ ID NO: 4339 - DNA, 1048 bp, Panicum virgatum
  misc_feature: Ceres CLONE 1803885
  misc_feature: Encodes the peptide sequence at SEQ ID NO. 4340
agcgtagccgccgcccgctggccagatccttggggcccacacgacggcgatggcggctcctcccgcggcgtcccccgcgaccgcgatctccccctgcgcccggctgcccagcgcgcccctgggggccacgcccgccgctgtctccttcccctcccgccctgcagcacgaccggccgcgctggcggcgcgcgctgggccgtcgcggcgcctcgacgtggtccccgccgccgccgcggggcaccagaagctcatggggtcgctgaccagcaacgaggggctcaggtttggtgtggttgtggcacggttcaacgaggttgtgacaaacttgttactgcagggggccctggagacattcgagcgatactctgtcaaagctgaaaatataacagttgttagtgttcctggaagcttcgaagttcccatcacagcacaaaagcttgggaagtctggaaaatttgatgcaattctgtgcattggagccgttattagaggggacacgactcattatgatgctgttgcaaactcagctgcatctggtgtactgaatgctggattatctgccggcatcccttgtatatttggtgtactaacctgtgaagatatggaccaggcgctaaaccgtgctggtggcaaggcaggaaacaagggcgctgaagctgctcttactgctatcgagatggcctctctgtttcggcatcacttaggctgacacctggtggtctcggagtctcaacttttcgtcccatccaccgttaccagagttttaagttttggccatagagcttttggctgcagactagcagttaagcaaaagctcagaaatggctagtccggataccgacgcttgttgttgttgtccttgattcttgatggtttgcaaggctcaagaggcctgtcgttcaactgggatctaccacaaacttgagagtttagccatgaataattgccgccatgtattgcacacgctcatgaataaagcttcatttctttgtgtttttcaataaatcttggagtgtctttacctttccaaaaaaaaaaaaaaaaaaaa

SEQ ID NO: 4340 - protein, 219 aa, Panicum virgatum
  misc_feature: Ceres CLONE 1803885
  misc_feature (2)..(144): Pfam Name: DMRL_synthase Pfam Description: 6,7-dimethyl-8-ribityllumazine synthase
  misc_feature (31)..(218): SWISSPROT Homolog: EC 2.5.1.9 6,7-dimethyl-8-ribityllumazine synthase, chloroplast precursor
MAAPPAASPATAISPCARLPSAPLGATPAAVSFPSRPAARPAALAARAGPSRRLDVVPAAAAGHQKLMGSLTSNEGLRFGVVVARFNEVVTNLLLQGALETFERYSVKAENITVVSVPGSFEVPITAQKLGKSGKFDAILCIGAVIRGDTTHYDAVANSAASGVLNAGLSAGIPCIFGVLTCEDMDQALNRAGGKAGNKGAEAALTAIEMASLFRHHLG

SEQ ID NO: 4341 - DNA, 1237 bp, Panicum virgatum
  misc_feature: Ceres CLONE 1803889
  misc_feature: Encodes the peptide sequence at SEQ ID NO. 4342
aagccctcctcccctcttcctaccattagcagaagagaagaagacagaggctctgcgcagagcagcagcaacagctgagcgcgatcgatcgagagagagagacagacacgatgagcggcggcggtcaggacctgcatctgccgccggggttccggttccacccgacggacgaggagctggtgatgcactacctctgccgccagtgcgctgggctccccatcgccgtccccatcatcgccgagatcgacatctacaagttcgacccatggcagctccccagaatggcgcagtacggcgagaaggagtggtacttcttctccccgcgggaccgcaagtacccgaacgggtcgcggccgaaccgcgccgccgggtctgggtactggaaggccaccggtgccgacaagcccgtgggcacgcccaagcccctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggctggatgactgggtcctgtgccgcatctacaagaagaagggcgggctggagaagccgccggtgggcgccggcgaccgcaagccggcgctcgccgcggcggcgggctccccgccggagcagaagccgttcgtggcgtcggcgggcgggctgccccccgcgttcgcggacctggcggcgtactacgaccggccgtcggactcgatgccgcggctgcacgcggactcgagctgctcggagcaggtgctgtccccggagcagcagttcgcctgcgaccgggaggtgcagagccagcccaagatcagcgagtgggagcgcaccttctcctccgaccccgtgaaccccgccggctccatgctcgaccccggcgccggcgacccgctgctgcaggacatcctcatgtactggggcaagccgttctagaggtcacgtacgcgcgcgaaccaagggaacggcagagcgttgcgcagccccatcctggggtgcggttggttggcctgcctctctctcggcggcgcaaccgccgcggcgtgggcttgactcaggcgagccgccatagctgactagtactaagagctttaaaaaatggatggattggacggagatgtcatcgtcatcatcccatcataaactaaaacaagatgatggactgggattcgaggcggcaaaaaaaaaaaaaaaaaaaa

SEQ ID NO: 4342 - protein, 287 aa, Panicum virgatum
  misc_feature: Ceres CLONE 1803889
  misc_feature: The sequence is a functional homolog of  SEQ ID NO 104 in the  10/225,068 US patent application
  misc_feature: The sequence is a functional homolog of  SEQ ID NO 2014 in the  10/374,780 US patent application
  misc_feature: The sequence is a functional homolog of  SEQ ID NO 22 in the  10/286,264 US patent application
  misc_feature: The sequence is a functional homolog of  SEQ ID NO 314 in the  10/412,699 US patent application
  misc_feature: The sequence is a functional homolog of  SEQ ID NO 734 in the  11/479,226 US patent application
  misc_feature: The sequence is a functional homolog of  SEQ ID NO 890 in the  10/374,780 US patent application
  misc_feature: Useful for making plants with modulated growth and phenotype characteristics
MSGGGQDLHLPPGFRFHPTDEELVMHYLCRQCAGLPIAVPIIAEIDIYKFDPWQLPRMAQYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYKKKGGLEKPPVGAGDRKPALAAAAGSPPEQKPFVASAGGLPPAFADLAAYYDRPSDSMPRLHADSSCSEQVLSPEQQFACDREVQSQPKISEWERTFSSDPVNPAGSMLDPGAGDPLLQDILMYWGKPF

SEQ ID NO: 4343 - DNA, 1242 bp, Panicum virgatum
  misc_feature: Ceres CLONE 1803900
  misc_feature: Encodes the peptide sequence at SEQ ID NO. 4344
ctgagcatcccttgcaactgtctgagaaaatggtgagctcaagcaagggtaaagtgtgcgtgactggggcttcaggcttcattgcctcttggcttatcaaacagcttctcgagtctggatatcatgtggtagggactgtcagagacccaggaaatcgccagaaagtggcacacctttggaaattgcctggtgctaaagagaggctgcagattgtgcgagctgatctgttggaggaagggagttttgacgaagctgtgatcgattgtgatggcgtcttccacactgcatcgcctgtccttgctaaatctgattctagtagcaaggaagcaacacttgttcctgcagtaaacggaactctgaatgtgctaagatcgtgcaagaagaacccatttctgaaaagggttgttcttacatcttcgtcatctgcggtgaggatcagggatgatgctcagccgaatatctcactggatgaaacaatatggagctctgtgccactctgtgaaaagatgcagctatggtatggcctggcgaaggtatttgcagagaaagcagcatgggagttcgccaaagagaatggcattgacgttgtgactgttcttccctcatttgtgatcgggcccagtttatcccacgaattatgcgttacagcatcagatgtccttggcttattccaaggtgacactgccaggttcagctgttacggaaggatgggatacgtccacatcgacgacgtcgcgagcagccatatcctcgtgtacgagacgcgcgaggccaccgggagatacctgtgcagctcggtggtgctggacaacgacgagctggtctccttccttgccaaacgataccctgtcttccccatacctcggaggctggacaacccctacggcaagcagacgtacaagctgaacacgtccaagctgcaggcgctgggcttcaagttcaggggattgccggagatgttcgacgactgtgtccagtcgctcaaagaccagggccacctgctggagtgcccgttgtgatggagtgggggagctgtcgtcggcaaggagaggccatagccaaacagagttggatcacgtccacaaaatcgttggctccaagccaatatatgcttcaatataataattccatgtcgtgtcagcgtcctttctttaagcagctgctctcagttcatcgatcacggattgtacgactacttaaataaaatctagccattctatttaaaaaaaaaaaaaaaaaaaa

SEQ ID NO: 4344 - protein, 329 aa, Panicum virgatum
  misc_feature: Ceres CLONE 1803900
  misc_feature (1)..(248): Pfam Name: Epimerase Pfam Description: NAD dependent epimerase/dehydratase family
MVSSSKGKVCVTGASGFIASWLIKQLLESGYHVVGTVRDPGNRQKVAHLWKLPGAKERLQIVRADLLEEGSFDEAVIDCDGVFHTASPVLAKSDSSSKEATLVPAVNGTLNVLRSCKKNPFLKRVVLTSSSSAVRIRDDAQPNISLDETIWSSVPLCEKMQLWYGLAKVFAEKAAWEFAKENGIDVVTVLPSFVIGPSLSHELCVTASDVLGLFQGDTARFSCYGRMGYVHIDDVASSHILVYETREATGRYLCSSVVLDNDELVSFLAKRYPVFPIPRRLDNPYGKQTYKLNTSKLQALGFKFRGLPEMFDDCVQSLKDQGHLLECPL

SEQ ID NO: 4345 - DNA, 1156 bp, Panicum virgatum
  misc_feature: Ceres CLONE 1803904
  misc_feature: Encodes the peptide sequence at SEQ ID NO. 4346
acgtcgcaccttccctcccgcagcgcggcagcagcggccatggatctgctcccgccgccgacggacgcgccggccgccggcggtcccggcgcgggtggctctggccgggggctgcggcgcggggtcgggttccggtcgctgaagctggtcagcgtcgccatggacgagcccctgcccgtcgaccccgtcggcgcaacctacggccgcctcgccaacggcctcacctactacgtccgctccaaccccaagccgcgcatgcgcgccgcgctctcgctcgccgtcaaggtcgggtccgtggtggaggaggaggacgagcgcggggtggcgcacatcgtcgagcacctcgccttcagcgccacttccaggtacaccaaccacgacatcgtcaagttcctcgagagcatcggggccgagttcggcgcctgccagaacgcgctcacctcatcggaccagaccatctatgagctgcttgtgcccgtcgacaagccaggcctgctgtcccaggccatctctgtcctcgcagagttcagctccgaggtccgggtgtcggcagaggatttggagaaagagaggggtgctgtgctggaggagtacaggggcggacgcaatgccacgggcaggatgcaggactcccactgggcactgttgtttgaaggttccaagtgttccgaaggattcatgcataccaggatgaggcgcagggttgagtctctgatccaggctttggaccgagcgaagtctgacgcggagaagctgaagaagttggtcaatggcggatccttcaaaagactgagcctgaagaatgaagggaattgaagcctgcgcttggaaatgtttgacaaatgaggttggactttccttgatgctacttggtgcattgagcacaagatcgaaaggggtggaaccggggttcttctcttatacttcgacgaatatttgtattcagtgctacttggttggtgatgtccgttcaattctatggagcacaagattgaaggggtggaacaaaacggcatcatattgttcttcgtttatatttgggtgaatatttgtattcagttctcacaacggaatattgatgagaaatactaggtgcaacatgcctctgtaaatcattgagcagatgctttaataacttatgaaaattttgttttgc

SEQ ID NO: 4346 - protein, 258 aa, Panicum virgatum
  misc_feature: Ceres CLONE 1803904
  misc_feature (1)..(122): Pfam Name: Peptidase_M16 Pfam Description: Insulinase (Peptidase family M16)
MDLLPPPTDAPAAGGPGAGGSGRGLRRGVGFRSLKLVSVAMDEPLPVDPVGATYGRLANGLTYYVRSNPKPRMRAALSLAVKVGSVVEEEDERGVAHIVEHLAFSATSRYTNHDIVKFLESIGAEFGACQNALTSSDQTIYELLVPVDKPGLLSQAISVLAEFSSEVRVSAEDLEKERGAVLEEYRGGRNATGRMQDSHWALLFEGSKCSEGFMHTRMRRRVESLIQALDRAKSDAEKLKKLVNGGSFKRLSLKNEGN

SEQ ID NO: 4347 - DNA, 1780 bp, Panicum virgatum
  misc_feature: Ceres CLONE 1803909
  misc_feature: Encodes the peptide sequence at SEQ ID NO. 4348
tcgcatgaccgccgccgccgcgctccgcccgccgccgaccgccgcccctcttcttcctcctccccgcgcgctcctcgtgggagcggtgggccccgcgccccggtcctccccctcctcctcgctttcctcctcccccaggtgcgtggcagacccgccgctccccagctgcaataaacaatatctcgaggagcaaaatccgagcaagcaatcgcctcgctagtcaaacttttagtgggtgaggtcggtggaggattagaaggggggaggttagcggattcggctactcctcgtggtttactttgacctggggtgattgatccgcgctcggtgcgctgcgccgtgctgtgctgaggctgcagggaggcgttcgggtgggcgtcgctgctgcggaggcggagggggcggaggaggagggcggcggcggcgggggcgcacacgaagatggcgcggccgccgatcctgtccgtcgcgctgccgtccgacaccggtcgcgtgctcagcatccagtcccacaccgtccaggggtatgttggcaacaaatcagccgtctttcccctgcaactccttggctttgatgtggatccaataaactctgtacagttttctaatcatacaggatacccaacatttagaggtcaggttctcaatggaaaacagctctgggaccttattgaaggactagaggaaaaccagttactccattatacccatttattaacaggttatataggctcagtttcctttttatatactgtgctacaagttgttgacaaattacgatcagtcaatcctgatcttgtatatgtttgcgacccagttctaggtgatgaaggaaaactatatgttccacaggagctaatatctgtttatcaacagaaggttgttccagttgcttcaatgcttacacctaaccaatttgaagttgaactacttactggattgaggatcacctctgaacaagatggcttgacggcttgcaataccctccacagtgctggaccacggaaggtggttataactagtgcgtttattgaaggcaggctgctccttatcggaagtcacaaaaaaacagcggaacaaccgccagaacaatttaagattgagataccgaagataccagcatatttcacgggaactggagatttaacgactgctcttctacttggatggagtaataaatatcctgatagcctcgagacagcggcagaactggcagtatccagtttgcaggcactcctaaaaagaactgtggaagactataaaaggtctggctttgacccgtcaaccagcagcttagagatccggttgattcaaagccaagactacatccgaaacccagctgtcacatgcaaggctgtgaagtatggcaactgaatcaatagtgctcatgagaatcacagtcaataaggccaggtgcctgaagaagtgttgttagatcaatttggtctctgctctttcacaagtatactaggacaagcctgccccgactttcatgaatcgttggcttcagttttggaatacagttctgttatattatagccccaagaccataaataatcaggtttcaggggggagaaaaagaataacggggcaggctgcttttagttacagtttgtcaagatgctgtggccttgagacttagattgtagaaatggcagatgcatccgttacatacaatgaataacagcctggttcttcctgcttctgttgttttggcaatgagttgaggctttttctggagcttcattgatagttctgtcaaaaaaaaaaaaaaaaaaaa

SEQ ID NO: 4348 - protein, 310 aa, Panicum virgatum
  misc_feature: Ceres CLONE 1803909
  misc_feature: Great-hit functional homolog of the protein sequence given in SEQ ID NO 9199
  misc_feature (1)..(57): Pfam Name: Phos_pyr_kin Pfam Description: Phosphomethylpyrimidine kinase
  misc_feature (12)..(281): Pfam Name: PfkB Pfam Description: pfkB family carbohydrate kinase
  misc_feature (1)..(308): SWISSPROT Homolog: EC 2.7.1.35 Pyridoxal kinase
  misc_feature: Useful for making plants with modulated salt sensitivity
  misc_feature: Useful for making plants with modulated nitrogen use efficiency
MARPPILSVALPSDTGRVLSIQSHTVQGYVGNKSAVFPLQLLGFDVDPINSVQFSNHTGYPTFRGQVLNGKQLWDLIEGLEENQLLHYTHLLTGYIGSVSFLYTVLQVVDKLRSVNPDLVYVCDPVLGDEGKLYVPQELISVYQQKVVPVASMLTPNQFEVELLTGLRITSEQDGLTACNTLHSAGPRKVVITSAFIEGRLLLIGSHKKTAEQPPEQFKIEIPKIPAYFTGTGDLTTALLLGWSNKYPDSLETAAELAVSSLQALLKRTVEDYKRSGFDPSTSSLEIRLIQSQDYIRNPAVTCKAVKYGN

SEQ ID NO: 4349 - DNA, 1459 bp, Panicum virgatum
  misc_feature: Ceres CLONE 1803927
  misc_feature: Encodes the peptide sequence at SEQ ID NO. 4350
tgaggtctgcgaagtgagtcctaaatatcaaaatttctcgcatcagcgggggacgcttcgctcggacgctcccgagacgcattgccgccggtcactccctccccgccgctactctctctgtctggtggaggcggagatccgcgcaggctaggggtctgctccgctcgcgttggtcagaaggagcacactcgtgtttgtactgtacctgactgaggagattaggtctacgcatgggggctccaaagcagaggtggacttctgaggaagaggctgctcttagaactggagtcgcaaaacatggagttggaaattggcgcacaatattgaatgatccagaacttagttccacattgcgctaccgctcgaatgttgacctaaaggacaagtggcgtaacatgaatgtaactgtcaccgcatcgagttctcgtgacaaggcaagggctgccatgaagaaaacccgagctgctcctaagaacaatgaccacacggcaacaatcatcacagttacttctgatgctgatgatgagattgttgatgcaaagcctatagcatcagtgtctgctgaagcgtggaatacttctacatcaaagaaatctcactcaaggctagacaatattataatggaggctataaagaacttgaatgagcctacggggtcacacagaactactattgctaattacatagaggagcaatattggccacctagtgattttgatcacttattatctgcaaaactgaaggacttggcctccagtgggaaattgataaaggtgaatcggaagtacaggatagcacctagttcaccacgcttagagggccgaagccccaagatgttgctgctggaagatgtgcaaaaggagcccctgaaagtaatgaatgatgctagtaaaagccttacaagatctcaagttgatgatgaattggctcgcatggcaactatgaccccggaggctgcagcagcagctgctgctcgtgcagttgcagaggcagaggctatcatggcagaagctgaagcagctgcgagagaggcagaggttgcggaagcagaggcccaagctgcacaggcctttgctgaagcagcacttttgacattgaagaacagaaatgctgcaaaattgatggcccaaggttgatgctacgcggagctcttcctgcccagtgttggcgcaggtgcaggccacctatgtatgtagttcatgtttactgttgtttaggcaagcacagccgtctcccccctagttgcatcaaatgtgtcgttggatccactcatccgtgtgagctccgacgccgcaacgaaggtgcatctgctcggtattccgcttcggacaccatttcggaactcggtgccgtggtaaactcttcgtcagtgtcgtcaaaccgttgcatgttttcgctggcggtgcgcatggcacaacgctgcgtcgtgttcgtgtgccaaaaaaaaaaaaaaaaaaaa

SEQ ID NO: 4350 - protein, 301 aa, Panicum virgatum
  misc_feature: Ceres CLONE 1803927
  misc_feature (1)..(53): Pfam Name: Myb_DNA-binding Pfam Description: Myb-like DNA-binding domain
  misc_feature: The sequence is a functional homolog of  SEQ ID NO 1220 in the  10/666,642 US patent application
  misc_feature: Useful for making plants with modulated growth and phenotype characteristics
MGAPKQRWTSEEEAALRTGVAKHGVGNWRTILNDPELSSTLRYRSNVDLKDKWRNMNVTVTASSSRDKARAAMKKTRAAPKNNDHTATIITVTSDADDEIVDAKPIASVSAEAWNTSTSKKSHSRLDNIIMEAIKNLNEPTGSHRTTIANYIEEQYWPPSDFDHLLSAKLKDLASSGKLIKVNRKYRIAPSSPRLEGRSPKMLLLEDVQKEPLKVMNDASKSLTRSQVDDELARMATMTPEAAAAAAARAVAEAEAIMAEAEAAAREAEVAEAEAQAAQAFAEAALLTLKNRNAAKLMAQG

SEQ ID NO: 4351 - DNA, 1357 bp, Panicum virgatum
  misc_feature: Ceres CLONE 1803934
  misc_feature: Encodes the peptide sequence at SEQ ID NO. 4352
aaggttcgcactcactccgagctcgccattgacatgagcaccgcgtcggcagctctgctgttccttgctgcgcactgcctgctgctgctcatggggtcggaggcgggcggcggcgtgttcgacctcgggcgccacggcgtcaggctcgcccgggtcgacgaggcccgggcgccgtcgaggtgcgggggcggcgcgccgacggccccgcccggcgcgggcgcgctgccgccgcccaagccgctgctcgtcgccgcgccgcgcgaggccggggagtacccggtgctcgtcttcctccacggctacctcgtcgtcaactccttctactcgcagctgctccagcacgtcgcctcccatggctacatcgtcgtcgcacctcagttgtacacgatatccggggccgacaccaccgaggagatcaacgcggcggcggccgtcatcggctggatccccggcggcctctcctccgcgctgccgcccggcgtccgcgcggacgccaccaaggtatccgtctccggccacagccgcggcgggaaggtggccttcgcgctggcgctgggccacgccaagctcgccctcccgctcgccgcgctcgtcgccgtggaccccgtggacggcatgggcgtgggcaggcagacgccgccgccgatcctcacgggtcggggcggctccctccgcgtgccggcgccggccatggtcctcggcacggggctcggggagctgccccggggcccgctgctcccgccgtgcgcgccccggggcgtcagccacgccgcgttctacggcgagctggaccgcgccgcggcggccggggcgtgccacctcgtggccgcggactacgggcacacggacatgatggacgacgacatgccgggcgccaggggaatgctcacgcgcgccatctgcaggagcggcggggccagggcgcccatgcggcggttcgtgggcggcgccgccgtcgcgttcctggacaagtgggttcgtggggacggcgcggcgctggatggcatcagggcgcggccggagcaagcgcccgtggcgctgtcggtcgtggagtttctcgacgaggaggcgccggcagagtagcttgcaggatctgtcatctgcaggaccgtgacggcagaaatttgacacgtcgaaattacagcaggttgataagatgaaatggacatgcgtagatttttttttagaaaacgaacacggagggatgtagtatgtactgtagactctactctcctgttgggtgctaccagcggatgacgcaaaaaccgtccctagcgcactcttcaggctcatgttggaaggctaagcacttgtcgtataaaactagattaattattaaaaaaaaaaaaaaaaaaaa

SEQ ID NO: 4352 - protein, 349 aa, Panicum virgatum
  misc_feature: Ceres CLONE 1803934
  misc_feature (34)..(347): Pfam Name: Chlorophyllase Pfam Description: Chlorophyllase
MSTASAALLFLAAHCLLLLMGSEAGGGVFDLGRHGVRLARVDEARAPSRCGGGAPTAPPGAGALPPPKPLLVAAPREAGEYPVLVFLHGYLVVNSFYSQLLQHVASHGYIVVAPQLYTISGADTTEEINAAAAVIGWIPGGLSSALPPGVRADATKVSVSGHSRGGKVAFALALGHAKLALPLAALVAVDPVDGMGVGRQTPPPILTGRGGSLRVPAPAMVLGTGLGELPRGPLLPPCAPRGVSHAAFYGELDRAAAAGACHLVAADYGHTDMMDDDMPGARGMLTRAICRSGGARAPMRRFVGGAAVAFLDKWVRGDGAALDGIRARPEQAPVALSVVEFLDEEAPAE

SEQ ID NO: 4353 - DNA, 1209 bp, Panicum virgatum
  misc_feature: Ceres CLONE 1803957
  misc_feature: Encodes the peptide sequence at SEQ ID NO. 4354
tggctgacctttcctgcccaaggagaagctaagcttagcgcaagtacggcacggcaccgcgaggcagcagtatgttccgagccgcgtggagtgttctccttctcgggggcaagagctcggccatgtccgccgccgtcagccgcttctccgcggcggccgcctcgcagaggctggccggaaaggtggcggtgatcactggcggcgcaagcggcatcggcaaggcgacggccgccgagttcgtcaggaacggcgcgagggtcgtcctcgccgacgtccaggacgaccttggccacgccgccgccgcggacctcggcgcggacgcagtggtctacacccgctgcgacgtcaccgacgaggcgcaggtcgctgccgccgtagacctcgccgtcgcgcgccacggccgcctcgacgtcgtcttcaacaacgccgggatcggcggcaacctggcgccggtccccgtgggcgccctggacatggacgacttcgaccgcgtcatggcggtcaacgcccgcgcgatggtggccggcgtcaagcacgccgcgcgcgtcatggtgccccgccgcgccggcagcatcatctgcacggctagcaccgcgggcgtggtgggcggcgtggcgctggcgccgtacagcgtgtccaaggccgccgtggttgggctggtgcgcgccgtggccggcgagctggcgcgctctggcgtgcgggtcaacgccatctcgcccaactacatcccgacgccgctggtgatggccgccatggccgagtggtaccccgggatgggcgtcgaggagcgcaggcgggtcgtggagagggacatgaacgagatggacgggccggtgctggaggtggaggacgtggcgcgggcggcgttgtacctcgcgtccgacgagtccaagtacgtcaacggccacaacctcgtcgtcgacggcgggttcacggtggggaaggcgcccaacatgccgaaacctgcacagtgaactcgttgccaagagagatgacatcatgcatggcttcgcttgttcgtctctgatttgttcttcccgttattgggattggaaaacatggttcgctccggtccttcattgttaacggcttgtcgtccataaaattactctgtgtcctccattggtccataatgttccaaatgtatttttgtaataacacataataacgagcattttccataaattttatgagtgatatattatccat

SEQ ID NO: 4354 - protein, 300 aa, Panicum virgatum
  misc_feature: Ceres CLONE 1803957
  misc_feature (1)..(169): Pfam Name: adh_short Pfam Description: short chain dehydrogenase
MFRAAWSVLLLGGKSSAMSAAVSRFSAAAASQRLAGKVAVITGGASGIGKATAAEFVRNGARVVLADVQDDLGHAAAADLGADAVVYTRCDVTDEAQVAAAVDLAVARHGRLDVVFNNAGIGGNLAPVPVGALDMDDFDRVMAVNARAMVAGVKHAARVMVPRRAGSIICTASTAGVVGGVALAPYSVSKAAVVGLVRAVAGELARSGVRVNAISPNYIPTPLVMAAMAEWYPGMGVEERRRVVERDMNEMDGPVLEVEDVARAALYLASDESKYVNGHNLVVDGGFTVGKAPNMPKPAQ

SEQ ID NO: 4355 - DNA, 1113 bp, Panicum virgatum
  misc_feature: Ceres CLONE 1803974
  misc_feature: Encodes the peptide sequence at SEQ ID NO. 4356
attcgcgccctgcccgaacgctcgcgtcatccgcagctgcctcgtcgtccctcgccccttctctctcgccgcccggggaggcggagggcgctccggctccggggaagaggccgccattgctgctgccgctctgagtggggaagatggttgtccaggagttcacagttgatctcaacaagcctcttgttttccaggttggccatcttgaggaacgttaccaggaatgggttcaccaacctatcgtcagcaaggagggtcctcgtttttttggaaatgatgtcctggagttcttgacccgcacaaagtggtgggctgtgccaaccatatggctgcctgttgtttgctacttgttcgcgaaatctattttgatgggccataccgttcaggaagtagttctgatggctctgtttggaatatttatttggacgttgattgaatatactttgcaccgcttcctattccacattgagactaaaacctactggacaaacactgcacattaccttcttcacggatgccaccataagcacccaatggactcgctcaggcttgtatttcctcctactgcaacagcgattttgtgtttcccgttctggaaccttgttgcgttctttgcaactccatctaccactcctgcattgtttgcgggtggtctactgggatatgtgatgtatgattgcactcactactacctgcaccatggacaaccatccaaagacccagcgaaacatctcaagcggtatcacctcaatcaccactttagaatccaagacaagggctttggcatcacctcaacgctctgggacactgttttcggtacattaccaccatcgacaaccgggaagaactgacgcacatagcacaattcttggcatgagattctaggggatttgtaatatattcaagctaggtacaattctagttgtcttggtgcgatgggttccgcatgtccattcagttcatcctgtgtaccgattctgttgatctattctgatgtgaagtgatttcgttggctcaacattctatgcattgccagcggtctacaaaaccgcctgttaggctcatacttctttctgtttatttttcaaaattagatcatttctttcccctccc

SEQ ID NO: 4356 - protein, 235 aa, Panicum virgatum
  misc_feature: Ceres CLONE 1803974
  misc_feature (1)..(144): Pfam Name: FA_hydroxylase Pfam Description: Fatty acid hydroxylase
MVVQEFTVDLNKPLVFQVGHLEERYQEWVHQPIVSKEGPRFFGNDVLEFLTRTKWWAVPTIWLPVVCYLFAKSILMGHTVQEVVLMALFGIFIWTLIEYTLHRFLFHIETKTYWTNTAHYLLHGCHHKHPMDSLRLVFPPTATAILCFPFWNLVAFFATPSTTPALFAGGLLGYVMYDCTHYYLHHGQPSKDPAKHLKRYHLNHHFRIQDKGFGITSTLWDTVFGTLPPSTTGKN

SEQ ID NO: 4357 - DNA, 1337 bp, Panicum virgatum
  misc_feature: Ceres CLONE 1804038
  misc_feature: Encodes the peptide sequence at SEQ ID NO. 4358
actcatcccctgtgctacacatctcatcgcatcttcttctttgcctactaagctctgtcgtgttcttgattttgcttgcgagagatggccagcctcaccgatctcgttaacctcaacctcagcgactgcaccgacaagatcatctccgagtacatctggattggagggtccggcatagacctcaggagcaaagcaaggacggtgaaaggccccatcaccagtgcgagccagctcccaaaatggaactacgatggctccagcaccgggcaggctcccggagaggacagcgaagtcatcctctaccctcaagccattttcaaggacccgttcaggaggggtgacaacatccttgtgatgtgcgactgctacacgccacaaggcgagccaatccccactaacaagagatacaatgctgccaagatcttcagccacccggatgttgcagctgaggtgccatggtacggtattgagcaggagtacaccctccttcagaaggatgtgaactggcccattggctggcctgttggtggataccctggtccccagggaccatactactgcgctgccggtgccgataaggcctttgggcgcgacgtcgtcgacgcccactacaaggcctgcatctacgccggcatcaacatcagcggcatcaacggcgaggtcatgcccggccagtgggagttccaagttggcccatccgttgggatctctgccggcgacgagatatgggttgcccgctacatcctcgagaggatcaccgagatggccggagttgtgctgtccctcgacccgaagccaatccagggtgactggaacggcgccggcgcccacaccaactacagcaccaagtcgatgagggagcccggcggctacgaggtgatcaagaaggcgatcgagaagctggggaagaggcacgcggagcacatcgcggcctacggcgagggcaacgagcgccgcctcacgggccaccacgagaccgccgacatcaacaccttcaaatggggcgtggcgaaccgcggcgcgtccatccgcgtggggcgcgacacggagaaggagggcaagggctacttcgaggaccgcaggccggcctccaacatggacccctacgtcgtcaccggcatgatcgccgagaccaccatcctgtggaagggaaactgaagacagtcgatctcgataataccgcacgacgttggtgtccgtttggatttttggatttcgatttcccgtcggcaacggcaaggcctctgatggtcctttttagatacttggcttccctgtgctctgaataatggctgtactgaatttgcttttgcccgtaggtatatgttggattggac

SEQ ID NO: 4358 - protein, 357 aa, Panicum virgatum
  misc_feature: Ceres CLONE 1804038
  misc_feature (1)..(253): Pfam Name: Gln-synt_C Pfam Description: Glutamine synthetase, catalytic domain
  misc_feature (1)..(357): SWISSPROT Homolog: EC 6.3.1.2 Glutamine synthetase root isozyme 1
  misc_feature (1)..(357): SWISSPROT Homolog: EC 6.3.1.2 Glutamine synthetase root isozyme 5
MASLTDLVNLNLSDCTDKIISEYIWIGGSGIDLRSKARTVKGPITSASQLPKWNYDGSSTGQAPGEDSEVILYPQAIFKDPFRRGDNILVMCDCYTPQGEPIPTNKRYNAAKIFSHPDVAAEVPWYGIEQEYTLLQKDVNWPIGWPVGGYPGPQGPYYCAAGADKAFGRDVVDAHYKACIYAGINISGINGEVMPGQWEFQVGPSVGISAGDEIWVARYILERITEMAGVVLSLDPKPIQGDWNGAGAHTNYSTKSMREPGGYEVIKKAIEKLGKRHAEHIAAYGEGNERRLTGHHETADINTFKWGVANRGASIRVGRDTEKEGKGYFEDRRPASNMDPYVVTGMIAETTILWKGN

SEQ ID NO: 4359 - DNA, 1073 bp, Panicum virgatum
  misc_feature: Ceres CLONE 1804058
  misc_feature: Encodes the peptide sequence at SEQ ID NO. 4360
aaaccctcaagttcacagccagcgatcaatcccccatcgccagtgagagcaaggagcaagcgatggcaggcggcgggcaggcggcggtgtcgttcctgacgcggattgcgaaggtggctgcggggatcggcgtggcggcgtccgcggcctccacgtccctctacacggtggacggcggggagcgcgccgtcatcttcgaccgcatgcgcggcgtgctcccggggacggagtcggagggcacccacttccgcgtccccttcctccagaagcccttcatcttcgacatccgcacccgcccccacagcttcgcctccacctccggcaccaaggacctccagatggtcagcctcacgctccgcgtcctctcgcgccccgacgtcgaccacctcccggagatcttcacctccctcggcctcgagtacgacgagaaggtcctcccctccatcggcaacgaggtgctcaaggccgtcgtcgcgcagttcaacgccgaccagctcctcaccgagcgcccccacgtctccgcgctcgtccgcgagtccctcacccagcgcgcccgcgagttcaacatcgtcctcgacgacgtcgccatcacccacctcgcctacgggccggagttcgcgcaggccgtcgagaagaagcaggtcgcgcagcaggaggccgagcgctccaggttcctcgtcgcgcgcgccgagcaggagaggcgcgccgccatcgtccgcgccgagggggagagcgaggccgcgcgcctcatctccgaggccacgacaaccgcgggcaacggcctgatcgagctcaggaggatcgaggcggccaaggagatcgccggcgtgctggcgcgctcgcccaacgtctcctacattcccgccggggacaacggccagatgctgctcgggctcaacgccgcccggtgaatggatcgtctcctgcccttcaattagttattagagttctattgaaatacttagtaattcagatgcatcgacttagttttggggtattttggtacgaccggagactaggtcaagatggtactgtgcaccacgaataaagttctgcagatgtagaatttatcg

SEQ ID NO: 4360 - protein, 282 aa, Panicum virgatum
  misc_feature: Ceres CLONE 1804058
  misc_feature: Great-hit functional homolog of the protein sequence given in SEQ ID NO 9527
  misc_feature: Useful for making plants with modulated biomass
  misc_feature: The rosette leaves do not appear in the normal fashion, i.e., their phyllotaxy may be abnormal or too many leaves may be emerging in comparison to the control.
MAGGGQAAVSFLTRIAKVAAGIGVAASAASTSLYTVDGGERAVIFDRMRGVLPGTESEGTHFRVPFLQKPFIFDIRTRPHSFASTSGTKDLQMVSLTLRVLSRPDVDHLPEIFTSLGLEYDEKVLPSIGNEVLKAVVAQFNADQLLTERPHVSALVRESLTQRAREFNIVLDDVAITHLAYGPEFAQAVEKKQVAQQEAERSRFLVARAEQERRAAIVRAEGESEAARLISEATTTAGNGLIELRRIEAAKEIAGVLARSPNVSYIPAGDNGQMLLGLNAAR

SEQ ID NO: 4361 - DNA, 1250 bp, Panicum virgatum
  misc_feature: Ceres CLONE 1804067
  misc_feature: Encodes the peptide sequence at SEQ ID NO. 4362
actgatccgtctctgctttctcctgaagcaggtccatcttcaaaacactagctaagctgcttagctagctacccgccccaagaaacgttccatgcgagctcgcaatttagcagagctcgcaattgcaatcgagctgaggcagtcgtccggggcctcgtcctcgccgccgcagtcgccagctgaggtagagccccggcgcagccgccggggaggcgacaagcgagcgcgggacgccggtggcgggaaccacccgtcgtaccgcggcgtgcggatgcgggcgtgggggaagtgggtgtcggagatccgtgagccgcgcaagaagtcgcgcatctggctcggcacgttccccacgcccgagatggcggcgcgcgcgcacgatgccgccgcgctcgtcgtcaagggccccgccgccgtgctcaacttcccggagatggccgccgcgctcccgcgcccggcctccgccgcgcaccgggacgtccaggcggcggcggcgcgcgccgctgccatggaaccgcctgcggtgccgggcgcctccgccgcggccgccgttgccgcactgcccacctcggcgccggcgcccccggtggcggggcagcaggaggactacgagctcgaggcgatcgtcgagctcccgccgctcgacgaggacgccgccgagctcgtgacgatcggcgccacgccgttctcgtttcacgacgctgcggaggtgtcttggtgcgtcccggagtcggagtggatcgacggcggcgctggctacatggaggcggcgcacgacgagctgttcggactctggccggacggcgaccacggctggggccaatcggttggtgccctcctgtggaacttgtaataatttctggtcggtctgctaatcaactagtgtgtaattaactccgatcctgtcaatctgttctcctcacagtttctttttatatttcttctgaatgaactgtaaatagggagttgcaacatcggacagggagaagtgtccggaaaataaaaaattggcagggtgggaacagttagaaaaacaagagggagcttgcagggggggacgaatagtatcgtgatagtccggtgggtttttgccacctttgatgggagggtcgatttttgtgattcttgtcaggggggcggagcttatggaaaaacaccagcaacgcggcctttttacggttcctggccttttgctggccttttgctcacatgttctttcctgcgttatcccctgattatgaggataaccgtat

SEQ ID NO: 4362 - protein, 252 aa, Panicum virgatum
  misc_feature: Ceres CLONE 1804067
  misc_feature (1)..(65): Pfam Name: AP2 Pfam Description: AP2 domain
  misc_feature: The sequence is a functional homolog of  SEQ ID NO 1050 in the  10/666,642 US patent application
  misc_feature: The sequence is a functional homolog of  SEQ ID NO 2848 in the  10/374,780 US patent application
  misc_feature: The sequence is a functional homolog of  SEQ ID NO 456 in the  10/225,066 US patent application
  misc_feature: Useful for making plants with modulated growth and phenotype characteristics
MRARNLAELAIAIELRQSSGASSSPPQSPAEVEPRRSRRGGDKRARDAGGGNHPSYRGVRMRAWGKWVSEIREPRKKSRIWLGTFPTPEMAARAHDAAALVVKGPAAVLNFPEMAAALPRPASAAHRDVQAAAARAAAMEPPAVPGASAAAAVAALPTSAPAPPVAGQQEDYELEAIVELPPLDEDAAELVTIGATPFSFHDAAEVSWCVPESEWIDGGAGYMEAAHDELFGLWPDGDHGWGQSVGALLWNL

SEQ ID NO: 4363 - DNA, 1177 bp, Panicum virgatum
  misc_feature: Ceres CLONE 1804068
  misc_feature: Encodes the peptide sequence at SEQ ID NO. 4364
attctcttccttccgccacgcaggcactcctccctattagcaccccaagtctaatccctaatcaccgtctaatcaggctccccaaccatggcggcggcggcggcggtggaggtcccagtgtcagcgccggtgaggacagtaaaggtcaccaacgtctcacttagcgcaactgtacaagacattaaggagttcttttccttttcaggagatattgaacatgtggagatgcaaagtggtgatgagtggtctcaagttgcatatgtgactttcaaagatgcacaaggtgcagagactgcacttcttctttcgggtgccacaatagttgatctttctgtcatcattgcacctgctccagaatatcagccaccccctactgcctctgctccaccaatgagtggaaccagagttccagttggtggagacaacaacgttgtccacaaggccgaggatgttgttagcactatgcttgctaagggtttcgtcctaggcaaagacgcggttggcaaggccaaagctttcgatgagaagcacagcttcacatccacagctggtgccaaggtggcctccattgacaagaaaatcggcctgagtgagaagatcaccacaggcacttccatggtgagtgagaaggtgaaggagatggaccagaagttccaggtctctgacaagaccaagtccgcctttgccgccgccgagcagaaggtgagcagcgctggatcggccattatgaaaaacaggtacgtcttcaccggcgcatcgtgggtcaccaacgcattcaacaaagttgccaaggctgccacagatgttggggcgatgacaaaggagaagatggctgctgagcagcagcacaagacttcggtgccttctggggggcactcgtatacgcccatccaatgattctttggctttggtcttatgtgcctcccccagcgtgttgtattattggtggatgtaaaacatagatatagaacagatcaggcctcttgccatatgttcatcgttccatgtgttaaatttcatactgcaggaattttgtttttgtagaccagaaaagtatgatggtggtaccaatgcattggcttatgaatccatgttcaggctggttctggttgagattagaatgaacttttgatgaagtggtaggattggaactacaatatcatgacggcctttccag

SEQ ID NO: 4364 - protein, 269 aa, Panicum virgatum
  misc_feature: Ceres CLONE 1804068
  misc_feature: Great-hit functional homolog of the protein sequence given in SEQ ID NO 9441
  misc_feature: Useful for making plants with altered Lignin content
MAAAAAVEVPVSAPVRTVKVTNVSLSATVQDIKEFFSFSGDIEHVEMQSGDEWSQVAYVTFKDAQGAETALLLSGATIVDLSVIIAPAPEYQPPPTASAPPMSGTRVPVGGDNNVVHKAEDVVSTMLAKGFVLGKDAVGKAKAFDEKHSFTSTAGAKVASIDKKIGLSEKITTGTSMVSEKVKEMDQKFQVSDKTKSAFAAAEQKVSSAGSAIMKNRYVFTGASWVTNAFNKVAKAATDVGAMTKEKMAAEQQHKTSVPSGGHSYTPIQ

SEQ ID NO: 4365 - DNA, 1196 bp, Panicum virgatum
  misc_feature: Ceres CLONE 1804072
  misc_feature: Encodes the peptide sequence at SEQ ID NO. 4366
agctacagcttaaacacaagaagaagaggagaggagaggagaggagtggagtggagaggagactaccaccacaccgtcacccccatcacagaaagaaagagagagagccctacctacaatggcggcggccctcgagtctgcctggcaggtcctgaccgccaacttctccgagttccagctcgccaccgtcttcaccttcctgatccacgagaccgccttcttcctctccggcctcccctccctcctcttcgagcgcttcggactcttcgccaagtacaagattcagaagaagagcaacacctctgcttatcaaaacagatgtgtcctgcgtctcatactctaccatgtctgtgtgaacttgcctgtcatcattttctcctaccctgccttcaaattcatgggccttaggagctctcttcctctgccacactggacggttgttgtatctcaagttgcattctactttgtactggaggattttgtattctactgggggcaccgggcactgcacaccaaatggctatacaagcatgtccacagcgtccaccacgaatatgctacaccctttgggttaacttctgaatacgcccaccctgctgagattttgttcctgggattcgccacagttgttggtcctgctcttactggccctcatttgttgaccctgtggctttgggtggtgttgagggtattggagacagttgaagctcacagcggctaccacttcccatggagcccctcaaatttcctgccactgtatggaggctcggacttccatgactaccatcaccgtgtgctctacaccaagtcagggaactatgcctcgacttttgtgtacatggactggttgtttgggacggacaaggattaccgcatggtgaaggccatggaggagaaggaagggaacaaggatatgtagatgatgcatgcatgggatctgcgaataatgaagacaggcggagctagcaatatgtactgtctgtgtactacaatcgtacgtacgtaatccttggggtttgtgttcctgctttgtttaatttggccgggatcggatgtatatatacatttggatcggagctagctagtagcaagatggtcgatgaggttgatgtgaccttagtttgcttgtgtgatgaattaacaataatgtcagcaattaaataaagccacaactgcaaaaaaaaaaaaaaaaaaaa

SEQ ID NO: 4366 - protein, 266 aa, Panicum virgatum
  misc_feature: Ceres CLONE 1804072
  misc_feature: Great-hit functional homolog of the protein sequence given in SEQ ID NO 9408
  misc_feature: Great-hit functional homolog of the protein sequence given in SEQ ID NO 9661
  misc_feature (1)..(213): Pfam Name: Sterol_desat Pfam Description: Sterol desaturase
  misc_feature: Useful for making plants with altered sterol content
  misc_feature: Useful for making plants with modulated cold sensitivity
MAAALESAWQVLTANFSEFQLATVFTFLIHETAFFLSGLPSLLFERFGLFAKYKIQKKSNTSAYQNRCVLRLILYHVCVNLPVIIFSYPAFKFMGLRSSLPLPHWTVVVSQVAFYFVLEDFVFYWGHRALHTKWLYKHVHSVHHEYATPFGLTSEYAHPAEILFLGFATVVGPALTGPHLLTLWLWVVLRVLETVEAHSGYHFPWSPSNFLPLYGGSDFHDYHHRVLYTKSGNYASTFVYMDWLFGTDKDYRMVKAMEEKEGNKDM

SEQ ID NO: 4367 - DNA, 1241 bp, Panicum virgatum
  misc_feature: Ceres CLONE 1804142
  misc_feature: Encodes the peptide sequence at SEQ ID NO. 4368
aaataaatatcccatcctccgcctcctcggaaaccctccgccgcgccgccgcctcccgttcccaatccaaccccccacgccaccgaaaaccctcctacatccgccgccgtcgccatgggcagcgccgccacctcgccgccgccgtccatgaagctggcgcaggaggacttgaagcgtgtggcggcgcacatgggcgacgccgccgccgcctcgccaccgcccgtgaagctgacgcaggaggacttgaagcgcgtggcggcgcaccgcgcggtggagttcgtggagcccggcatggcgctgggactcggcacgggttccacggcggcgcacgcgctggaccgcctgggcgacctcatccgcgcgggcgcgctcccgggcgtggcgggcgtgcccacctccctcaagacggagctccacgcgacccgcgtcgggatccctcttctcccgctcgggggcgaccgcgggcccgccaggatccacctctccatcgacggcgccgacgaggtggacccggacctcaacctagtcaagggccgcggcggctcgttgctccgggagaagatgatcgagggggctggagagaaattcgttgtcatcgtcgacgagtccaagctggtgccccgcctcgggtgttcgggcgcggtgcccgtcgaggtcatccccttcggcgctgcccacacgctgggcctcatccgcaaggtgttcgatggattgcctggcttccacgccaggctcaggatggtcaagaaagatgccgatgaggacacaccgttcatgactgacaacggaaactacatcgtggagatgtttttcgaggatggcatccgcggcgacctccaaaacatcagcgatcaactccttcggatcaccggcgttgttgagcacggcatgttcctcagcatggccaccactgtcatcgtcgccaacaaggatggcaccatcactgtgatggacaaaaagaattaactcggtgatgcggcatgatgctatgaataagctgccaagatcccatcattctagttctaacgaaggaaaagaacaagaaaaagaagagcatagcagctctcagcatgctctcaagttttgttgctctcctgttgtcgtactagtactgttgttaccttgtttgcgccagtttcacgggtaataacatgatagaattacccggatgaatgtgacgaaaccaataagttttggatgtctctgagatattatctagtcaaatttcttcattgctttcg

SEQ ID NO: 4368 - protein, 283 aa, Panicum virgatum
  misc_feature: Ceres CLONE 1804142
  misc_feature (1)..(187): Pfam Name: Rib_5-P_isom_A Pfam Description: Ribose 5- phosphate isomerase A (phosphoriboisomerase A)
MGSAATSPPPSMKLAQEDLKRVAAHMGDAAAASPPPVKLTQEDLKRVAAHRAVEFVEPGMALGLGTGSTAAHALDRLGDLIRAGALPGVAGVPTSLKTELHATRVGIPLLPLGGDRGPARIHLSIDGADEVDPDLNLVKGRGGSLLREKMIEGAGEKFVVIVDESKLVPRLGCSGAVPVEVIPFGAAHTLGLIRKVFDGLPGFHARLRMVKKDADEDTPFMTDNGNYIVEMFFEDGIRGDLQNISDQLLRITGVVEHGMFLSMATTVIVANKDGTITVMDKKN

SEQ ID NO: 4369 - DNA, 1277 bp, Panicum virgatum
  misc_feature: Ceres CLONE 1804287
  misc_feature: Encodes the peptide sequence at SEQ ID NO. 4370
ctccttcaattccctctcatctcgcgtctccgcacggagggccgccccctcctcgtccgccgcctgccgccggcgcgctctccattaccccggcgatggccggcctatccaaaaccagcctcaccaatcacgtctagcaagcacagagccacgcgtcacaacaacacatcctccgcgtcaggccggatcggcaggaagaagatggaggcgagcgtgggcatccgggcgcggcccggtgcctgggccgggctcgagaagccgcgcggcgcctactctgcaagagccccgccggtgaggctcacgccggagaagctgccggagaggctggctctgggaaccggtccgcggcggagcacggatcctgtgctccgtgccgcaaagctgaaagcttcgtgctgcaagaaatcggcaggtactgaaaaggtccactactctgctgatgaagctctcatactacagcaaaaagcccaggatgttctcccttacttggatggccgatgtgtttatctagtcggaatgatgggttcaggcaaaactacagttgggaagatattagctgaagtactaggttattctttctttgacagtgataagttggtagagaaggctgtcggtatatcatctgtagctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgaccgtgtggttagatgttccactggatgcacttgcaagaaggattgctgccgtgggaactgcatctcggcccctcttgcatcaggaatatggtgacccatatgcaaaggcttatgcaaaacttacatcactttttgagcaaagaatggactcatacgctaatgcggatgccagagtttcacttgaacatattgcattaaaacaagggcataatgatgtcactatacttacacctagtaccattgccattgaggcattgctaaggatggaaagttttcttaccgagaaggcctcggtcagaaactgaccgcttgatgttggggaaaaggaccccaacagcatatggcccctgtttgtttaattgtgctggtacatatgccttggcttgagatagtcttattgttgtttgcccccgtaaaaatggagatttgatttttgtgatgcttgtcaggggggcggagcatatggaaaaacgccagcaacgagacctttttacgg

SEQ ID NO: 4370 - protein, 294 aa, Panicum virgatum
  misc_feature: Ceres CLONE 1804287
  misc_feature: Great-hit functional homolog of the protein sequence given in SEQ ID NO 9205
  misc_feature (1)..(177): Pfam Name: SKI Pfam Description: Shikimate kinase
  misc_feature (48)..(292): SWISSPROT Homolog: EC 2.7.1.71 Shikimate kinase, chloroplast precursor
  misc_feature (96)..(255): SWISSPROT Homolog: EC 2.7.1.71 Shikimate kinase
  misc_feature: Useful for making plants with modulated salt sensitivity
MEASVGIRARPGAWAGLEKPRGAYSARAPPVRLTPEKLPERLALGTGPRRSTDPVLRAAKLKASCCKKSAGTEKVHYSADEALILQQKAQDVLPYLDGRCVYLVGMMGSGKTTVGKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQEYGDPYAKAYAKLTSLFEQRMDSYANADARVSLEHIALKQGHNDVTILTPSTIAIEALLRMESFLTEKASVRN

SEQ ID NO: 4371 - DNA, 1159 bp, Panicum virgatum
  misc_feature: Ceres CLONE 1804320
  misc_feature: Encodes the peptide sequence at SEQ ID NO. 4372
aaggatccggagttccggacgacgagcgagagagagccaggaacgagctcgcctcggcggcggcccgcgacgacgacctcctcctcctcttcggctccgccgccagacaactccgccgccggcagcgttggcgggcattgtagcgaggagggggcgtggaggcgcggcgattgttcgcggcatgagcttcggcggcagcagctccgtcgcgtccggtgcgaagaggccattcgagtacgggaggacgcatgtggtgaggccgaagggcacgcacaaggccaccattgtctggctccacggcctcggggacaatggagctagctggtctcaactattggaaactcttcctcttcctaatttaaaatggatatgcccaactgccccttcgagacccgtgtctgtgtttggaggattcccctccacagcatggtttgatgttgctgatctttcagaggatgctcctgatgatgttgaggggatggatgcctcagcagcacatgttgcaaatttgttgtcaactgaacccgcggacatcaagcttggtgttggtggctttagtatgggtgctgctactgctctgtactctgcaacttgctttgctcatggaaaatatggaaatggcaatccataccctgtgaacctaagtttggctgttggtcttagtggctggcttccatgtgccaggaccttgaagaacagaattcaatcctcaccagaggctgcacaaaaggcttcttccatacctcttttgctgtgtcatggaaaagctgatgatgtagttctctacaagcacggggaaagatctgctgatgccttgaaggcaaatggattttctaatgtgctcttcaagtcatacaatagtctcgggcactacacggtaccagaggagatggaagaagtctgcaaatggctcacggcaaatttggagctcggcacttcatcatcttgattggaaagttgtcgcgagaaagactcggggtagtggtgtccaaataatacctgtgtttgttccagggtgttaaatgatttaaatagcaaatttgggcttgggtatacggccatgttgtagcttttctttttacgcacgtgtctatgggaattatgtactcttataattttctacgttttggtttgtctagaaaaaaaaaaaaaaaaaaaa

SEQ ID NO: 4372 - protein, 255 aa, Panicum virgatum
  misc_feature: Ceres CLONE 1804320
  misc_feature (1)..(230): Pfam Name: Abhydrolase_2 Pfam Description: Phospholipase/Carboxylesterase
MSFGGSSSVASGAKRPFEYGRTHVVRPKGTHKATIVWLHGLGDNGASWSQLLETLPLPNLKWICPTAPSRPVSVFGGFPSTAWFDVADLSEDAPDDVEGMDASAAHVANLLSTEPADIKLGVGGFSMGAATALYSATCFAHGKYGNGNPYPVNLSLAVGLSGWLPCARTLKNRIQSSPEAAQKASSIPLLLCHGKADDVVLYKHGERSADALKANGFSNVLFKSYNSLGHYTVPEEMEEVCKWLTANLELGTSSS

SEQ ID NO: 4373 - DNA, 947 bp, Panicum virgatum
  misc_feature: Ceres CLONE 1804341
  misc_feature: Encodes the peptide sequence at SEQ ID NO. 4374
aaaatcctcgtgctcttgctcgcacggactcgcgggaaggatggagaccatggccgtgctcgctaggacggcgccgccgctcgccgggaccgggcgccggccctccgccgcggtgcggccgtcggctttcctctcctttgccgccgcctccacggggacccgcggccgggttgcgcgtgggctgagcacgacgacggtggggagtgggagcgcggccagggctcgcgccgttccgcgcggcatcgttgcctcctcggaggttgagcaaagttacattatgataaaacctgatggtgttcagcgtggcctggttggggagatcatttctcgctttgagaagaaaggctttttgttgaagggcttaaagctttttcagtgttcaaaggacttggctcagaaacattacaaggatttgaaagacaaacctttctttccaactctgattgattacataacttctggccctgttgtttgcatggcctgggagggtgatggtgttgttgcatcagctcgcaaattaattggagctactaatccccttcaagctgaaccaggaaccataaggggtgatctcgcagttcaaacaggaaggaatgttgttcatggaagtgatagtcctgttaacggcaagcgtgaaatcgatctgtggttcaaagaaggcgagctctgccaatgggaatctgttcaaacaccttggcttgtagagtgatatctgctgatggctgtgagatctgtattggatgtgtgtttgttcaactttcgtcatggggccatgtatgggcatatgagtttagttcggcgtagtaaattagctcatcagcaattcagctcaggaaactatctccctccagaggggtcctatttttgcaatttaccccctttaaagagaacaaaacctggagctcctcactcggtggcggccgctctagaaataaaggatcccccgg

SEQ ID NO: 4374 - protein, 222 aa, Panicum virgatum
  misc_feature: Ceres CLONE 1804341
  misc_feature (1)..(135): Pfam Name: NDK Pfam Description: Nucleoside diphosphate kinase
  misc_feature (55)..(222): SWISSPROT Homolog: EC 2.7.4.6 Nucleoside diphosphate kinase II, chloroplast precursor
  misc_feature (64)..(222): SWISSPROT Homolog: EC 2.7.4.6 Nucleoside diphosphate kinase 2, chloroplast precursor
METMAVLARTAPPLAGTGRRPSAAVRPSAFLSFAAASTGTRGRVARGLSTTTVGSGSAARARAVPRGIVASSEVEQSYIMIKPDGVQRGLVGEIISRFEKKGFLLKGLKLFQCSKDLAQKHYKDLKDKPFFPTLIDYITSGPVVCMAWEGDGVVASARKLIGATNPLQAEPGTIRGDLAVQTGRNVVHGSDSPVNGKREIDLWFKEGELCQWESVQTPWLVE

SEQ ID NO: 4375 - DNA, 620 bp, Panicum virgatum
  misc_feature: Ceres CLONE 1804446
  misc_feature: Encodes the peptide sequence at SEQ ID NO. 4376
aagcagcagcacaagtaatccacaccaccgatcgatcctattgtcactctcgcacttagcttgaaggttccggcccattaataattaagtttcatccatggcggaggagaagcaccaccaccaccacctcttccaccacaagaaggacgaggaggagcagcccgccggcgggtacggcggcgaggccgccaccgctgagtacactgagaccaccgtgacggaggtggtgtccaccggcgaggacgagtacgagaagtacaagaaggaggagaaggagcacaagcacaagcagcacctcggcgagtcaggcgccatcgccgccggcgccttcgcgctgtacgagaagcacgaggcgaagaaggaccccgagcacgcgcaccggcacaagatcgaggaggagatcgcggcggcggcggccgtgggcaccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcgcatctt

SEQ ID NO: 4376 - protein, 142 aa, Panicum virgatum
  misc_feature: Ceres CLONE 1804446
  misc_feature (1)..(54): Pfam Name: ABA_WDS Pfam Description: ABA/WDS induced protein
MAEEKHHHHHLFHHKKDEEEQPAGGYGGEAATAEYTETTVTEVVSTGEDEYEKYKKEEKEHKHKQHLGESGAIAAGAFALYEKHEAKKDPEHAHRHKIEEEIAAAAAVGTGGYAFHEHHEKKKDHKDAEEAGGEKKHHHLFG

SEQ ID NO: 4377 - DNA, 1019 bp, Panicum virgatum
  misc_feature: Ceres CLONE 1804529
  misc_feature: Encodes the peptide sequence at SEQ ID NO. 4378
atcactagcaaaatcctcgcctcgattcgattaaacagagagaaattcgaagcagctcgccgtcgccagtcgccagtcgccatgaccgtgaaggtgtgcgtgaaggccgccgtcggggcccccgacaccctcggcgactgtcccttctcccagagggtgctgctcacgctggaggagaagaaggtcccctacgagatgaagctcgtcgacctcagcaacaagcccgaatggttcctgaagatcagtccagagggtaaggtgcctgtgtttaacagtggtgatggcaactggattgctgactctgatgtgatcactcaagtcattgaggagaagttaccaactccatctctggtcacccctccagaatatgcatcaatgggatcaaagattttcccatcctttgtcaagttcctgaagagcaaagatgctagtgatggttcagagaaggcacttcttgatgagctgcaggcactagacgaccatctgaaagctcatggtccgtacatcaacggagagaatgtatcagctgctgatcttagcctggggccgaagcttttccacctccaggttgcactggagcatttcaagggctggaagatcccagaaaacctgaccagcgtccatgcatataccaaggcactgttcagccgcgaatcttttgtgaagactaagccatgccaaggagcacctgattgcgggatgggcacccaaggtgaaagcgtaagcgcccatccccctggtgtctttggtgctaccttgtggacaccatgcgtttatcttatcagttgctgtcagtggtgagggtaggggtcgagtctgtagcatgaacgcaggattggagtggaataatgcagcaccatgttttgagtacttgtggttgttgcaagtttgggggcattttatagtgaccttccttgccggtggggttggagaccatgatcatctattggttttaggtatgggagtgtgcatactgtattgttaaccatggtatcaaataatggagccgtttttatgtt

SEQ ID NO: 4378 - protein, 239 aa, Panicum virgatum
  misc_feature: Ceres CLONE 1804529
  misc_feature (1)..(72): Pfam Name: GST_C Pfam Description: Glutathione S-transferase, C-terminal domain
  misc_feature (1)..(74): Pfam Name: GST_N Pfam Description: Glutathione S-transferase, N-terminal domain
MTVKVCVKAAVGAPDTLGDCPFSQRVLLTLEEKKVPYEMKLVDLSNKPEWFLKISPEGKVPVFNSGDGNWIADSDVITQVIEEKLPTPSLVTPPEYASMGSKIFPSFVKFLKSKDASDGSEKALLDELQALDDHLKAHGPYINGENVSAADLSLGPKLFHLQVALEHFKGWKIPENLTSVHAYTKALFSRESFVKTKPCQGAPDCGMGTQGESVSAHPPGVFGATLWTPCVYLISCCQW

SEQ ID NO: 4379 - DNA, 1247 bp, Panicum virgatum
  misc_feature: Ceres CLONE 1804616
  misc_feature: Encodes the peptide sequence at SEQ ID NO. 4380
atccatctctgcaacctctgtttgcaacagccaagcgttcgagcggcaaccacaatcgctgagcatttagcaagctgccaaccatccagcgtctccagtgatcggtcttgcacgtacgatggcctcttcctcctgcttctcgccgctcgtgctgctgctagcggcgctctgcgggctcctgatgctcgcctcggctcacggctacccacctagcgccgccggctccgcgctgagctccgcgttctacgacgcgtcgtgccccggcgcccacgacgtcgtccgccgcgtcatccaggacgcgcgcgtctccgacccccgcatcccggccagcctcatccgcctccacttccatgactgcttcgtcaacggttgcgacggctcgcttctgctggacgacgacctcccgacgatccggaccgagaaggccgtgcccgccaacgacaactcggcgcgcggcttcccggtggtcgacgacatcaaggccgcgctggagcacgcgtgcccgggcgtcgtctcctgcgctgacatcctcgccctcgcagccgagatctccgtcgaactcgctggagggccacgctggagggtgctgctcggccggcgggacggcacgacgaccaacatcgagagcgccaagaacctgccgagccccttcgacgccctggacgttctccaggagaagttcagaaacgtcaacctggacgacactgacctcgtcgccctccaaggagcgcacactttcggcaaagtgcagtgccagttcacgcgggagaactgcacggccgggcagcctgagggtgcactggagaacctggatcaggtcactcccaacctgttcgacaacaagtattacggcaacctcttgcacggccaagctcagctgccgtccgaccaggtcatgctgtccgaccctgtggcgccgacgacgaccgcccccattgttcatcggttcgcgagcaaccaaaaggacttcttcaggaacttcgcggcgtccatgattaagatggggaacatcagccagctgacagggaaggacggggagatcaggaagaactgccggagggtcaatagcaaaggctattgaagactctgattcagactgatgttttttttccaattataatgcatgcacaaatcattcttctgattcgtttttcgttcctttttgtaaagtatgagctgatccgctcatgccatttcgtgaagcaagtgtaaaaatgtttttactcgaaaaaaaaaaaaaaaaaaaa

SEQ ID NO: 4380 - protein, 320 aa, Panicum virgatum
  misc_feature: Ceres CLONE 1804616
  misc_feature (1)..(230): Pfam Name: peroxidase Pfam Description: Peroxidase
  misc_feature (2)..(212): SWISSPROT Homolog: EC 1.11.1.7 Peroxidase 54 precursor
  misc_feature (34)..(212): SWISSPROT Homolog: EC 1.11.1.7 Peroxidase 53 precursor
MASSSCFSPLVLLLAALCGLLMLASAHGYPPSAAGSALSSAFYDASCPGAHDVVRRVIQDARVSDPRIPASLIRLHFHDCFVNGCDGSLLLDDDLPTIRTEKAVPANDNSARGFPVVDDIKAALEHACPGVVSCADILALAAEISVELAGGPRWRVLLGRRDGTTTNIESAKNLPSPFDALDVLQEKFRNVNLDDTDLVALQGAHTFGKVQCQFTRENCTAGQPEGALENLDQVTPNLFDNKYYGNLLHGQAQLPSDQVMLSDPVAPTTTAPIVHRFASNQKDFFRNFAASMIKMGNISQLTGKDGEIRKNCRRVNSKGY

SEQ ID NO: 4381 - DNA, 1120 bp, Panicum virgatum
  misc_feature: Ceres CLONE 1804642
  misc_feature: Encodes the peptide sequence at SEQ ID NO. 4382
atcgccgatcgacaccgctgcgacttgctcctgctcctctccccatttcctcgggaacccagtagcggcgacctgctcccaccagggcacgggcaggaggatcggggggagctctcccgcggatggcgaggcccgcgcgcgtcccgctgctccggcgcctgctcctgctggcggccctcgcggcgtcctgctcctactacctcctcgtcctccaggcgcaggccacggccccgccgcgctacgacggcttcgcctacggcgggggcgccgccgcggcgtggaaggacgccgtcctcgtcgaggccttcctcgacccgctctgccccgacagccgcgacgcctggcacccgctcaagctcgccgtcgagcgatacgcgccgcgggtctcgctcatcgtccaccccttcccgctgccataccacacatatgcattccatgcctgccgtgcactttacatagctaacaagctgaattcgtcatcaacatatccattgttggagctgttcttcaagaaccaggaaaagttctacaactctgccacatcatcgctctcgggccctgctgtagctgtagaaatgtcaaagatggccgcgcaggctgtaggcaattcagcatctgagttcctccaaggcttcagcgataggaggacagactcggcagctagagtttctttcaagtacgggtgcacgaggggagtatatggcgcgcccttcttcttggtgaatggtttccttcagcctgggggtgggtcgcctatcgactacagcacatggatcggcatcctggatcccctcgtttcccagcagggtgaaagaatcgagatgttcacttctatctaagcgcttgaagcggccttatgaaggatacagtagcacagatgcttggctcctgccgagagcccgaggggcaacagctctgatgtccgttgtatgcatgctttgcgttgatgaagttacaggacgcattcaactttgcctgttgtacttattgtaccatgtagctagcgattgtgtaaaacgcctaaaagttgtataagaacgggaaatcccgtgatgttatgatttgcaggagcttgcagcttgctcgatcgatgagcagccaatctggcagtttcctgttt

SEQ ID NO: 4382 - protein, 238 aa, Panicum virgatum
  misc_feature: Ceres CLONE 1804642
  misc_feature (1)..(159): Pfam Name: DSBA Pfam Description: DSBA-like thioredoxin domain
MARPARVPLLRRLLLLAALAASCSYYLLVLQAQATAPPRYDGFAYGGGAAAAWKDAVLVEAFLDPLCPDSRDAWHPLKLAVERYAPRVSLIVHPFPLPYHTYAFHACRALYIANKLNSSSTYPLLELFFKNQEKFYNSATSSLSGPAVAVEMSKMAAQAVGNSASEFLQGFSDRRTDSAARVSFKYGCTRGVYGAPFFLVNGFLQPGGGSPIDYSTWIGILDPLVSQQGERIEMFTSI

SEQ ID NO: 4383 - DNA, 1011 bp, Panicum virgatum
  misc_feature: Ceres CLONE 1804674
  misc_feature: Encodes the peptide sequence at SEQ ID NO. 4384
acatcgctccctctccctctcccccacagcaggctagctagggttttctggggtttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgacgagttcaccgtcggcgccgacaacgacggccgcgccaaggccatcgacgtctccgcgcccggcggcggcgcgctcgccggcggggagcgcccggacmrcggctacggsggacgcggcggcggcggctacggcggaggcggcgaccgcggctacggtggaggaggtgaccgcggctacggcggaggcggcggcgaccgcggctacgggggaggaggtggcttcggaggaggcggcgaccgtggctacggcggcggcggcggaggcggccgcggctccgggtgctacaagtgcggcgaggagggccacatcgcacgggactgctcccacggcggcggcggctacggcggaggcggctacggcggaggccgcggctctgggtgctacaactgcggtgaggacggccacatctcccgcgagtgccccaacaagaggcgctaggcacgacgcctccacgttggacgcggtccggctccaacctcctggctcttgcatcaagtcatggccatctatctatcagtagtagtagtctttcgttctcgttctcgttctcgtcgttcgctcgtgtcgtagtaggaagaagaagaaggcgtgtggagaactggtgatgaggtggatccgcctgtttcggagtagcaatctatgtttctgttttgcatcagctgtgaggctgccatgatcatggatggcactgccgatctaccaaattatctatctatcaatggtatggaatggagtagtaatctatttgcactccgattatagt

SEQ ID NO: 4384 - protein, 197 aa, Panicum virgatum
  misc_feature: Ceres CLONE 1804674
  misc_feature (1)..(68): Pfam Name: CSD Pfam Description: 'Cold-shock' DNA-binding domain
  misc_feature: The sequence is a functional homolog of  SEQ ID NO 1041 in the  10/374,780 US patent application
  misc_feature: The sequence is a functional homolog of  SEQ ID NO 851 in the  10/666,642 US patent application
  misc_feature: Useful for making plants with modulated growth and phenotype characteristics
  misc_feature (85)..(85): Xaa is any aa, unknown, or other
MAAERAQGTVKWFNGTKGFGFISPDDGGQDLFVHHSSVKADGFPNLKDGDADEFTVGADNDGRAKAIDVSAPGGGALAGGERPDXGYGGRGGGGYGGGGDRGYGGGGDRGYGGGGGDRGYGGGGGFGGGGDRGYGGGGGGGRGSGCYKCGEEGHIARDCSHGGGGYGGGGYGGGRGSGCYNCGEDGHISRECPNKRR

SEQ ID NO: 4385 - DNA, 1098 bp, Panicum virgatum
  misc_feature: Ceres CLONE 1804675
  misc_feature: Encodes the peptide sequence at SEQ ID NO. 4386
agcagccaaccagatctagtagaattctctggaccccatcggcggcggcgacgaggaggagagcaccgaccggagatggcggcgagcgggttgaggaggagcgctgcggcgcgggccgcctggcgccctgccagggtgtgcctgtggctcgcgctcgccgccgccgccctgacgctcgcccaggcgaagaaggacccgacggaggtcaccaacaaggtctacttcgatatcgagattgacggcaagcccgcaggtcggattgtcatgggactcttcgggaagactgttcctaaaacagcagaaaacttccgagcgctttgcacaggagagaaaggagttggcaaaagtggcaaacctctccactacaagggaagtacattccacagaatcatccccagcttcatgctccaaggaggtgacttcactcttggtgatggaaggggtggtgaatccatctatggcttgaagtttgctgatgagaacttcaagatcaagcacactgggccaggccttttgtccatggccaatgctgggagagatacaaatggatcccagtttttcatcaccactgtaaccacaagctggttggatgggaagcatgttgtgtttggcaaggtgctgtctggaatggatgtcgtctacaaggttgaagctgaaggccggcagagtgggcaaccaaagagcaaggttgtcatagcagatagcggcgacctgccaatgtgatgagatatactgatattctgatgaaaaataagttgctgtcggtatgtcttttagaactgctatagtggtctgttgtgccgaaattggtctatgccagtttctctttactgcagggatttgcttatttacttagttggaaagttttaatgatgaactaccgaatgctctttcgtttttgcattgttttcagttttatctgtcagaagtctgtggttgtttatttgccgcttcgccatcttcagaagttaaaatagtacattgaatcgaatgagcttgactgaaattcgtcgggtgaagactccatggaatcaagaagactgcaagcattgataatagcttgaacagttttaatttctactcgtgcttcctatcgat

SEQ ID NO: 4386 - protein, 215 aa, Panicum virgatum
  misc_feature: Ceres CLONE 1804675
  misc_feature (1)..(167): Pfam Name: Pro_isomerase Pfam Description: Cyclophilin type peptidyl- prolyl cis-trans isomerase/CLD
  misc_feature (23)..(215): SWISSPROT Homolog: EC 5.2.1.8 Peptidyl-prolyl cis-trans isomerase CYP20-1 precursor
  misc_feature (31)..(215): SWISSPROT Homolog: EC 5.2.1.8 Peptidyl-prolyl cis-trans isomerase CYP19-4 precursor
MAASGLRRSAAARAAWRPARVCLWLALAAAALTLAQAKKDPTEVTNKVYFDIEIDGKPAGRIVMGLFGKTVPKTAENFRALCTGEKGVGKSGKPLHYKGSTFHRIIPSFMLQGGDFTLGDGRGGESIYGLKFADENFKIKHTGPGLLSMANAGRDTNGSQFFITTVTTSWLDGKHVVFGKVLSGMDVVYKVEAEGRQSGQPKSKVVIADSGDLPM

SEQ ID NO: 4387 - DNA, 1073 bp, Panicum virgatum
  misc_feature: Ceres CLONE 1804677
  misc_feature: Encodes the peptide sequence at SEQ ID NO. 4388
agacagccaccgcgatggcgcagatcatcgacggcaaggccatcgccgccaacatccgccgcgaggtcgcggccgatgtcgccacgctctcctccgcccacagcgtcgtgcccgggctggcggtggtgatcgtggggagcaggaaggactcgcagacgtacgtgaacatgaagcgcaaggcctgcgccgaggtcgggatccgctccgtcgacgtcgacctccccgaggacatctccgagctcgcgctcgtcgccgaggtccaccgcctcaacgctgaccccgccgtgcacggcatccttgtgcagcttccattgcctaagcatattaacgaagagaagatattgagtgagatcagcatcgagaaagatgtcgatggtttccatcctctcaatattggcaaacttgcaatgaaaggcagggagccacttttcgtaccatgtacaccaaagggatgcatggagctcttgtcacggagcggagttaccgttaaagggcagcgagctgttgtggttggccgcagcaacatagtcgggctaccagtatccctgctccttctgaaggcagatgcaacggtatcaattgtgcactcacggacccctgatccggaaagtattgtccgtgaagctgacatagtcattgcagcagctgggcaggctatgatgatcaaaggggactggatcaagccaggcgctgcggttatcgatgttgggacaaactcggtcgacgaccctaccaggaagtctgggtaccggcttgtcggtgatgttgatttcgcagaggtgagcaagatcgctggttacctgacgccagtcccaggaggtgttggcccaatgacggtggctatgctgctgaagaacacggtggatggagcaaagcggggaatagtcgagtaggagggatttcatctcattttatgtgctgtacgatctgtactgcaaggatgggaactggctcaaaaagtgtgttgatgtaacggcttgttccccattttggttgtttcaacttgccaagaataacagtagttaccctgtttgacaaatgcaataaaaatgattgctggctttgctgctgtt

SEQ ID NO: 4388 - protein, 292 aa, Panicum virgatum
  misc_feature: Ceres CLONE 1804677
  misc_feature (1)..(168): Pfam Name: THF_DHG_CYH_C Pfam Description: Tetrahydrofolate dehydrogenase/cyclohydrolase, NAD(P)-binding domain
  misc_feature (1)..(288): SWISSPROT Homolog: EC 1.5.1.5 Bifunctional protein folD [ Includes: Methylenetetrahydrofolate dehydrogenase
MAQIIDGKAIAANIRREVAADVATLSSAHSVVPGLAVVIVGSRKDSQTYVNMKRKACAEVGIRSVDVDLPEDISELALVAEVHRLNADPAVHGILVQLPLPKHINEEKILSEISIEKDVDGFHPLNIGKLAMKGREPLFVPCTPKGCMELLSRSGVTVKGQRAVVVGRSNIVGLPVSLLLLKADATVSIVHSRTPDPESIVREADIVIAAAGQAMMIKGDWIKPGAAVIDVGTNSVDDPTRKSGYRLVGDVDFAEVSKIAGYLTPVPGGVGPMTVAMLLKNTVDGAKRGIVE

SEQ ID NO: 4389 - DNA, 1326 bp, Panicum virgatum
  misc_feature: Ceres CLONE 1804680
  misc_feature: Encodes the peptide sequence at SEQ ID NO. 4390
aagtgtaatttcccttccgaattcagaggcgcccccttgaccgccgccgccaagccgagcaagcagccatggacggatccgccgccgcgccactccgcacgcgcgtctgcatcatcgggagcggccccgccgcgcacacggcggccatctacgccgcccgcgcggagctcaagcccgtgctcttcgagggctggatggccaacgacatcgccgcgggcgggcagctcaccaccaccaccgatgtcgagaacttcccgggcttccccgacggcatcatgggcgccgacctcatggaacgctgccgcgcgcagtccctccgcttcggcaccaacatcctctccgagaccgtcaccgccgtcgacttctcggcccgccccttccgcgtcgcctccgactccaccaccgttctcgccgacgcggtcgtcgtcgccacgggggccgtcgcccgacgcctccacttccccggctccgatgcgtactggaaccgcggcatctccgcctgcgccgtctgcgacggcgccgcccccatctttcggaacaagcccatcgccgtcataggcggcggcgactccgccatggaggaggccaatttcctcaccaagtacggctcccatgtctacatcatccaccgccgaaacaccttccgggcttccaagatcatgcaggccagggcgctcgagaacccaaaaatccaggtcatctgggactcggaggttgtcgaggcctatggcggcgaaggcggcggcccattggctagcgtcaaggtcaagaacctggtgagtggtgatatctcggatcttcaggtggccggcctcttctttgccattgggcatgagccggcgaccaagttcctcggtgggcagctcgaactcgattcagatggatatgtggcaaccaagccgggctccactcacaccagtgtgaagggggtattcgctgctggcgacgtgcaggacaagaagtatcgccaggccattactgctgctggatcagggtgcatggccgctctggacgctgagcactatctgcaggagatcggtgcgcaggagggcaagtctgattgactatatttgggtattgcaaccaccagccaatcaaaatgccaattgccggtgctgaaatctaccctctgatgtgtgtcacgccatgggtattcatgatcgagaaactttggatttttgtgctgcttatgagtaacacactattcttctcattagtattcagaagtctgaacgaggcttctcatttagagggagctctccatgtactcgaaattgattcatatttacttatgtcagaacttgtaatattgttttagatatctcc

SEQ ID NO: 4390 - protein, 331 aa, Panicum virgatum
  misc_feature: Ceres CLONE 1804680
  misc_feature (1)..(288): Pfam Name: Pyr_redox_2 Pfam Description: Pyridine nucleotide-disulphide oxidoreductase
  misc_feature (10)..(331): SWISSPROT Homolog: EC 1.8.1.9 Thioredoxin reductase 2
  misc_feature (11)..(331): SWISSPROT Homolog: EC 1.8.1.9 Thioredoxin reductase 1
MDGSAAAPLRTRVCIIGSGPAAHTAAIYAARAELKPVLFEGWMANDIAAGGQLTTTTDVENFPGFPDGIMGADLMERCRAQSLRFGTNILSETVTAVDFSARPFRVASDSTTVLADAVVVATGAVARRLHFPGSDAYWNRGISACAVCDGAAPIFRNKPIAVIGGGDSAMEEANFLTKYGSHVYIIHRRNTFRASKIMQARALENPKIQVIWDSEVVEAYGGEGGGPLASVKVKNLVSGDISDLQVAGLFFAIGHEPATKFLGGQLELDSDGYVATKPGSTHTSVKGVFAAGDVQDKKYRQAITAAGSGCMAALDAEHYLQEIGAQEGKSD

SEQ ID NO: 4391 - DNA, 1468 bp, Panicum virgatum
  misc_feature: Ceres CLONE 1804712
  misc_feature: Encodes the peptide sequence at SEQ ID NO. 4392
accgccacaccagccagctgcccggcagagcgctgaacaagccagagcatcaccgcatcagccgcgggcgaaggggcgagcagctgaaaaaatggcgggggcggccttcctctcgaccgcgcaggctcccgcgctgctcggcgcccgcggcgtcgctgcctcgccgtccgtttcgtctccggcgcggaggcacctgcacattcaagtctactgcaagggcaatgttgagggcattgaggccgctgatcatgaagagggtctgcgattccggagaagggacttcatcggcggctgcgtcgggacggccattggtctggaatttattgagggctccaccaaattcacaggagtggctactgcagctgatctcatcgagcgtaggcaacgctctgagttccaatcaagcatcaaggataccctctatacagctataaacgctaagccagagctcgttccatctttgttgaccttggccctgaatgatgccatcacatatgataaggccacaaaaactggaggtgcaaatggatctatcaggctagaaataagcagacctgaaaacagtgggctctctgctgcgttggatctgctgactgaagccaaaaaggagatagattccaaatccaagggaggtccaatttcatttgcagatctgatccagtttgcagcacaatcagcgctgaagagatcatttcttgatgcggcaattgccaaatgtggtggaaatgaagagaagggaagaaccctatactctgcatatggttcaaacgggcagtggggtctgttcgacaaaacattcgggagaacagatacacaagaagctgacccagagggaagggtacctaattggagcaaagcttctgttcaggagatgaaggataggtttgttgctgttgggttgggtcctcgccagcttgctgtgatgtcagccttccttggacctgaccaggctgctacggaggaacgactgattgctgatccagattgccgtccatgggtcgagaagtaccaacggagtcgtgagacagtctcccggacagactatgaagttgacctgataaccacactcacaaagctgagctcccttggccagaagataaattacgaagcctacacttaccccaagccaaagattgacctgggtaaattgaaactgtgagagatgcttgccgggcatctgcatcggccatgttcaggaaccagaagctcatgaactggtgggctccggctgctcaagagtgatttgattcggtggtgacgttcatgtaacggctgctcatcggctgtcagacttcaatatcagacttttgttttccatggcaattaggatggtacgtctagatagttagatttcattgtctggtttcgttttccgtgaacttgaaagtgccagacatgattgggacaaacgaggtgttctgtaaattctctttgtgcaatctacatgtaaaaaaaaaaaaaaaaaaaa

SEQ ID NO: 4392 - protein, 355 aa, Panicum virgatum
  misc_feature: Ceres CLONE 1804712
  misc_feature (1)..(201): Pfam Name: peroxidase Pfam Description: Peroxidase
MAGAAFLSTAQAPALLGARGVAASPSVSSPARRHLHIQVYCKGNVEGIEAADHEEGLRFRRRDFIGGCVGTAIGLEFIEGSTKFTGVATAADLIERRQRSEFQSSIKDTLYTAINAKPELVPSLLTLALNDAITYDKATKTGGANGSIRLEISRPENSGLSAALDLLTEAKKEIDSKSKGGPISFADLIQFAAQSALKRSFLDAAIAKCGGNEEKGRTLYSAYGSNGQWGLFDKTFGRTDTQEADPEGRVPNWSKASVQEMKDRFVAVGLGPRQLAVMSAFLGPDQAATEERLIADPDCRPWVEKYQRSRETVSRTDYEVDLITTLTKLSSLGQKINYEAYTYPKPKIDLGKLKL

SEQ ID NO: 4393 - DNA, 1607 bp, Panicum virgatum
  misc_feature: Ceres CLONE 1804729
  misc_feature: Encodes the peptide sequence at SEQ ID NO. 4394
aagagctagtgctgcacaaacccgctggattctcccccctcccacaaaacccaatgcaagccatgaggggttttcaactgctggtcctagtggccttgcttattggggagttgcactgcgcaagaacagcaccaccaccagcagatgccccagcaacatcaccacaatctcccgagccaccaccagcagatgagcaaactccaccacaggcgccggggccatcgcctccgccgccacggcgacggggatcgccacatcgacgaccaacagcaccacttatgcaggatccggcaccaccgaagcaggagccggagccggagccagaaccagaaccgccgcggctggttgtgccaccagaggactctcctgcgccggcaccacccggaatgatcaaccgcactatgggttgcaccactcttcttgtacttggggactcaacagtggaccctggaaacaacaaccacctgcccaccacagccagggcaaatttcttgccttacggcttgaacttctacgggcgcaggcccactggccgattcaccaatggccggttagccacagatatgttggccgagaagctaggtatagcgagaactattccaggcttcttcgacccaagcctgaggctggcccagctcaggaggggtgtaagcttcgcatcgggaggttctggatacgacgacagcactgccaacagaataaatgtggtgtcattctctgcacaactgcacaaccttttccgttacaaactactcatccgaacattgcttggaccaagaagagcagagcgacttattaacagggctacctttgtgataagctctggtacaaatgatatgctttctgtctatcttgcatcaaatcgatcgaatgcaattagtatggaaatgtacgagaatcacctgatagcacgtgttgcaaattacacccaggctatgataatgcttggaggaaggagatttgtttttgttggactgcccccaatgggttgcttgccaattgcccgaactttggtcggcacaggatcggacagatgtgtcgagacattaaatcagcttgcaacttcgttcaactcgaagctagttcaactgttgagttttataaattatcagcgccagattagaacctcatacatagatacgtatacagctatacatgacgcaacagtggatcctaagaccttcggcctaacagaagtatcaagagggtgctgtggatcaggggtaattgaagttgggcaaacatgccgagggcgaagaacatgtggagatcccagcaggtacttatactgggatgctgtccatcctacagagaggacaaaccaacattttgcgaatgtgatgatggattctattagagaactctatagctagactgagcaaagagagggccgtgatttggagtcacagcttcatcagactcagacatgaaggggcggctagtttttatcggagtcatgtgtatccaaatgtactagagttaatatatagctgaatttgaatgacccttatggccatttgtaccacaaagtgacaaaccgtattgtgaggttgatgatgggatagataggattagtgatatcttattaaaaaaaaaaaaaaaaaaaa

SEQ ID NO: 4394 - protein, 439 aa, Panicum virgatum
  misc_feature: Ceres CLONE 1804729
  misc_feature (1)..(303): Pfam Name: Lipase_GDSL Pfam Description: GDSL-like Lipase/Acylhydrolase
MQAMRGFQLLVLVALLIGELHCARTAPPPADAPATSPQSPEPPPADEQTPPQAPGPSPPPPRRRGSPHRRPTAPLMQDPAPPKQEPEPEPEPEPPRLVVPPEDSPAPAPPGMINRTMGCTTLLVLGDSTVDPGNNNHLPTTARANFLPYGLNFYGRRPTGRFTNGRLATDMLAEKLGIARTIPGFFDPSLRLAQLRRGVSFASGGSGYDDSTANRINVVSFSAQLHNLFRYKLLIRTLLGPRRAERLINRATFVISSGTNDMLSVYLASNRSNAISMEMYENHLIARVANYTQAMIMLGGRRFVFVGLPPMGCLPIARTLVGTGSDRCVETLNQLATSFNSKLVQLLSFINYQRQIRTSYIDTYTAIHDATVDPKTFGLTEVSRGCCGSGVIEVGQTCRGRRTCGDPSRYLYWDAVHPTERTNQHFANVMMDSIRELYS

SEQ ID NO: 4395 - DNA, 1596 bp, Panicum virgatum
  misc_feature: Ceres CLONE 1804732
  misc_feature: Encodes the peptide sequence at SEQ ID NO. 4396
aaccaaatgcggcgtcctgctggtgtggtctagcgagccgcgtggtgcttgggctccgttcgttccgttgaggctcgcgtcgatctagcgatggagccccggtgctccgtgatggtcctggccctcgccgccgcgctatccgtcgcagtggcttacgacccgctggacccgaacgggaacattaccatcaaatgggacatcatgtcgtggacgcctgacggctatgtcgcggtggtgacgatcaacaacttccagatgtaccggcagatcatggcgccggggtggacggtggggtggacgtgggccaagaaggaggtgatctggtccatggtgggcgcgcaggccacggagcagggcgactgctcccgcttcaagggcaacatcccgcactgctgcaagcgcacccccgccgtcgtggacctgctgcccggcgtgccctacaaccagcagatcgccaactgctgccggggcggcgtcatcagcgcctacggccaggaccccggcgccgccgtcgccgcgttccaggtcagcgtcggccaggccggcaccaccaaccgcaccgtcaaggtgcccaagaacttcacgctgctcggccccggccctgggtacacctgcggccccgccaaggtcgtcccctccaccgtcttcctcacgcccgaccgccgccgcaagacccaggcactcatgacgtggaacgtgacgtgcacctactcgcagtacctggcgtccaagtacccgtcctgctgcgtctctttctcctccttctacaacgacaccatcgtgccctgcgccaagtgcgcctgcggctgcgagcacaagacctgcgtccagggcgactcgaagcggccgctggcggtgacggggaagcacacgcacgcggcggcgacgcgcgggcaccgggacaaggaggcgccgctgctgcagtgcacgacgcacatgtgccccgtgcgcgtgcactggcacgtcaagctcaactacaaggagtactggcgcgccaagatcgccatcaccaacttcaactaccgcatgaactacacgcagtggacgctcgtcgcgcagcaccccaacctcgacaacatcaccgaggtcttcagcttcgactacaagcccgtcgttgcctacggatccatcaatgacacggccatgttctacgggctcaagtacttcaacgaccacctcatgcaggcggggccgtacgggaacgtgcagtcggaggtgctcatgcgcaaggacgccagcaccttcaccttcaggcagggctgggcgttcccgcgcaaggtctacttcaacggcgatgagtgccagatgccgccgccggacgcctacccctacctgcccaacgccgccctgccggcccccgtggcgtcgctgggcgccgcggtggtggccgtcgtggcgttcctggtgctggtcgtggtatgagacatgagaaaaacacaggagagcgatcgacctagcgctagaatcggccggcatggggagaaaaagacgacgatgttttgctctgtagatacagtcgacgttttgacttttgagtttcaggattggtttggatatctaagtttttttttctttcaaaaaaaaaaaaaaaaaaaa

SEQ ID NO: 4396 - protein, 443 aa, Panicum virgatum
  misc_feature: Ceres CLONE 1804732
  misc_feature (1)..(165): Pfam Name: Phytochel_synth Pfam Description: Phytochelatin synthetase-like conserved region
MEPRCSVMVLALAAALSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKVVPSTVFLTPDRRRKTQALMTWNVTCTYSQYLASKYPSCCVSFSSFYNDTIVPCAKCACGCEHKTCVQGDSKRPLAVTGKHTHAAATRGHRDKEAPLLQCTTHMCPVRVHWHVKLNYKEYWRAKIAITNFNYRMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDAYPYLPNAALPAPVASLGAAVVAVVAFLVLVVV

SEQ ID NO: 4397 - DNA, 1892 bp, Panicum virgatum
  misc_feature: Ceres CLONE 1804741
  misc_feature: Encodes the peptide sequence at SEQ ID NO. 4398
attcactgccgcagatctagctagccagctggagagaaacgccggagccatgccggcggcaatggcagcagctgtactgctggtgctgctgctcgccgttgcggcgccgcccctcgccggcgccgacgacccctaccgctacttcacctggaccgtcacctacggccccatcagcccgctcggcaccacccagcagggcatcctgatcaacggccagttcccgggcccgcccatcgactgcgtcaccaacgacaacctcatcgtcaccgtcgtcaaccgcctcgacgagcccttcctcctcacctggaacggcatcaagcagcgcaagaactcgtggcaggacggcgtggcggggaccaactgccccatcccgcccggcgccaactacacctacaagctccaggccaaggaccagatcggctccttcacctacttcccctccctcgcgctccaccgcgccgccggcggcttcggcgcgctcaacgtctaccagcgccccaagatccccgtcccctacccgccgcccgcgggggacttcacgctcctcgtcggggactggtacgccgccggccaccgccagctccgcgggaccctcgacgccggcgccccgctcccgccgcccgacggccttctcatcaatggtgcccggtcgccgccggcgttcgtcggcgcccgcggcgggacgtaccttttccgcgtctccaacgtcgggctccaggcctccgtcaacgtccggatccagggccaccgcctccggctggcggaggtggagggcacccaccccgtgcagaacgtgtacgactccctcgacgtccacgccggccagtcgctcgccttcctcgtcgcgctcgaccagccgccgctcgactacgccgtcgtcgtggccacgcgcttcgccgccgccgacctcacggcggtggccacgctgcactacgccggcgccgccgccagggcgccgggcccgctgccggccgccccgccgccggggcagtacggctggtccgtcaaccaggcgcgctcgttccggtggaacctcacggccagcgcggcgcgccccaacccgcagggctccttccactacggcgccatcccgacgtcgaggacgctggtgctcgcgagctcgtcgccggccatcgccggacggaggcgctgcgccgtcaacggcgtgtccttcgtcgtccccgacacgccgctcaagctcgcggacaactacaacatcgccaacgtcatcgagtgggacagcctcccggcgaggccaggcgccgccggggcgccgccgcgcgccgggacgcccgtcgtcaggctcaacctgcacgagttcgtcgagatcgtgttccagaacaccgagaacgagctgcagtcgtggcacctcgacggatacgacttctgggttgttgggtacggcgatggccagtggactgagatgcagcggcaaacttacaacttggtcgacgcgcaggcaagacatacggttcaggtgtacccgaatgggtggtcggcgatcctggtgtcgctggacaaccaggggatgtggaacctgaggtcggcgatctgggaccggcagtacctcggccagcagctctacctcagggtgtggacgccgcagcagagcttctccaacgagtacagcatcccgaccaacgccattctctgcggcagggccgctggcctcccacactgacgagcaaggtgcagagagcattagcggtcgattcgtcatactacttaattataatgtctcataggataaatctttctacttatatagctgaaatcaagatgagtctgacagtgttttgttgtagccaaaatctcagatgaacttgctattctttgatggtgatgtcagtaatttatttctgcttgtgattaaaaaaaaaaaaaaaaaaaaa

SEQ ID NO: 4398 - protein, 543 aa, Panicum virgatum
  misc_feature: Ceres CLONE 1804741
  misc_feature (1)..(141): Pfam Name: Cu-oxidase_2 Pfam Description: Multicopper oxidase
  misc_feature (1)..(142): Pfam Name: Cu-oxidase Pfam Description: Multicopper oxidase
  misc_feature (2)..(117): Pfam Name: Cu-oxidase_3 Pfam Description: Multicopper oxidase
  misc_feature (13)..(542): SWISSPROT Homolog: EC 1.10.3.3 L-ascorbate oxidase homolog precursor
MPAAMAAAVLLVLLLAVAAPPLAGADDPYRYFTWTVTYGPISPLGTTQQGILINGQFPGPPIDCVTNDNLIVTVVNRLDEPFLLTWNGIKQRKNSWQDGVAGTNCPIPPGANYTYKLQAKDQIGSFTYFPSLALHRAAGGFGALNVYQRPKIPVPYPPPAGDFTLLVGDWYAAGHRQLRGTLDAGAPLPPPDGLLINGARSPPAFVGARGGTYLFRVSNVGLQASVNVRIQGHRLRLAEVEGTHPVQNVYDSLDVHAGQSLAFLVALDQPPLDYAVVVATRFAAADLTAVATLHYAGAAARAPGPLPAAPPPGQYGWSVNQARSFRWNLTASAARPNPQGSFHYGAIPTSRTLVLASSSPAIAGRRRCAVNGVSFVVPDTPLKLADNYNIANVIEWDSLPARPGAAGAPPRAGTPVVRLNLHEFVEIVFQNTENELQSWHLDGYDFWVVGYGDGQWTEMQRQTYNLVDAQARHTVQVYPNGWSAILVSLDNQGMWNLRSAIWDRQYLGQQLYLRVWTPQQSFSNEYSIPTNAILCGRAAGLPH

SEQ ID NO: 4399 - DNA, 1485 bp, Panicum virgatum
  misc_feature: Ceres CLONE 1804745
  misc_feature: Encodes the peptide sequence at SEQ ID NO. 4400
atccagtcacaagactcacaaccaaatcctgcgcgtccgtactcctgcttcccctccgaccacggcggcgctgctctccggtcggaagatgttggatcttccgctacaaatccaggcattgacgataaagtttagtttctctttctgttaggtttcaatatttcattcacagtttggcgagttcttattttccccccaaatttaagcagctgctgttttgaaggtttcttctccgggaaaaattcaaatcccggaaccgactggggttgcagtacccgcagatgctgctaactatcaagttcccggacctataaattactcgacttgtgatttcgtttgttaaatcctagctattgcgttcgacgtgcctgtgatttctgacccgtgatgaattggaaccgcagaaatctctaggagacgaatcgaatcgagcaggttaccaggtagcggaggaaccaggcggccatggctgagcacctggcgtccatctttggcacggagaaggaccgcgtgaactgccccttctacttcaagatcggcgcgtgccggcacggcgaccggtgctcccgcctgcacaacaagccgtccatctcgccgacgctgctgctctgcaacatgtaccagcgcccggacatgatcaccccgggcgtggacgcgcagggcaaccccatcgacccggagcggatccaggaggacttcgaggacttctacgaggacatcttcgaggagctcagcaagcatggcgagatcgagagcctccacgtctgcgacaacctcgccgaccacatgatcggcaacgtctatgtgcagttccgcgaggaggagcaggccgcccgcgcgctgcaggcgctgcagggccgctactactcgggccgccccatcatcgccgagttctcgccggtcaccgacttccgggaggccacctgccgccagttcgaggagcacagctgcaaccgcggcgggtactgcaacttcatgcacgtcaagcaggtcggccgggacctgcggcggaagctgttcggccacctgcaccggacccgccggagccgcagcccgagcccgtaccgctaccgccggagctcgtcgcggtcgagggaccgcgacgacgattacgactactactaccactaccgtagtggcagtggcagccggaggagcagcgagaggcaccgcagccacgacagcaacgggagccgcagccggcgcgggcggtcgaggagccggagcccggtgagggaaggcagcgaggagcggagggcgcggatcgagcagtggaatcgcgagagggaggccgcgcaggtgtgagcagagcagctgctgtgggcatgccaggctgcagtttaccgcagtgatggtgttcgcttggtttgtgaaaatttcatcttgtactagtagttagtcatgtcgtaaattgaactcaaaattcgggggttttaattgttaccaaattgaacctgtggttgttattgaacttgctctggatgc

SEQ ID NO: 4400 - protein, 279 aa, Panicum virgatum
  misc_feature: Ceres CLONE 1804745
  misc_feature (1)..(27): Pfam Name: zf-CCCH Pfam Description: Zinc finger C-x8-C-x5-C-x3-H type (and similar)
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAARALQALQGRYYSGRPIIAEFSPVTDFREATCRQFEEHSCNRGGYCNFMHVKQVGRDLRRKLFGHLHRTRRSRSPSPYRYRRSSSRSRDRDDDYDYYYHYRSGSGSRRSSERHRSHDSNGSRSRRGRSRSRSPVREGSEERRARIEQWNREREAAQV

SEQ ID NO: 4401 - DNA, 1248 bp, Panicum virgatum
  misc_feature: Ceres CLONE 1804764
  misc_feature: Encodes the peptide sequence at SEQ ID NO. 4402
acacagagctagctgatcagcagcagcagcaagcagacacaccgcgtgcttgagctcgctctcgctcttggtctgagcaagcttgctttggtgcgtgaggatggcgaaggacatcgaggccgcggcggcgggcggggagtacacggccaaggactactccgacccgccgcctgcgccgctgatcgacgcggaggagctgaccaagtggtcgctgtaccgcgcggtgatcgccgagttcgtggcgacgctgctcttcctctacatcacggtggccacggtgatcgggtacaagcaccagacggacgcggcggcgtcgggccccgacgcggcgtgcggcggcgtgggcgtcctcggcatcgcctgggccttcggcggcatgatcttcatcctcgtctactgcaccgctggggtgtcggggggccacatcaacccggccgtcacgctgggcctgttcctagcgcgcaaggtgtcgctggtgcgcgcgctgctctacatggtcgcgcagtgcctgggcgccatctgcggtgtcgggctcgtcaagggattccagagcgcctacttcgtgcgctacggcggcggcgccaacgagctcagcgacggctactccaagggcacggggctcgccgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaaggacaaggcctgggatgaccaatggatcttctgggtgggcccattcatcggcgccgccatcgccgccgcgtaccaccagtacgtcctccgggccagcgccgccaagctcggctcctccgcctccttcagccgctagatcggcggcctcgccgtcccggtgggggacaaccggaggcgtgacctgtagatacgtcagcggccggccgcctccgccgcacatcatctcctgaatccctgcgtgcgtcgtcggtggttgcttctccgctagtgatcatgcatgcttttattatgatccgcgtgcgtctgcatctctgcttgatgcgctttttattccaagctagtgtgattgtgctgttctacataactatgtaccagtgtacgagaactttgcaaagtgaaaaaaaaaaaaaaaaaaaa

SEQ ID NO: 4402 - protein, 288 aa, Panicum virgatum
  misc_feature: Ceres CLONE 1804764
  misc_feature: Great-hit functional homolog of the protein sequence given in SEQ ID NO 9410
  misc_feature: Great-hit functional homolog of the protein sequence given in SEQ ID NO 9486
  misc_feature: Useful for making plants with modulated cold sensitivity
  misc_feature: Useful for making plants with modulated drought sensitivity
MAKDIEAAAAGGEYTAKDYSDPPPAPLIDAEELTKWSLYRAVIAEFVATLLFLYITVATVIGYKHQTDAAASGPDAACGGVGVLGIAWAFGGMIFILVYCTAGVSGGHINPAVTLGLFLARKVSLVRALLYMVAQCLGAICGVGLVKGFQSAYFVRYGGGANELSDGYSKGTGLAAEIIGTFVLVYTVFSATDPKRNARDSHVPVLAPLPIGFAVFMVHLATIPITGTGINPARSFGAAVIYNKDKAWDDQWIFWVGPFIGAAIAAAYHQYVLRASAAKLGSSASFSR

SEQ ID NO: 4403 - DNA, 1062 bp, Panicum virgatum
  misc_feature: Ceres CLONE 1804788
  misc_feature: Encodes the peptide sequence at SEQ ID NO. 4404
gtagcccacgcacagattcattccacgcccccctctcccctcgcccgcgctcccagatctcgcacgcctcccgcaagggtaaatttgagctatgggcacagttgtggatgctccagccgttgtgactgaggaggtcgctgagaacactttgggtggcaagaaagttacagttgtatttgttctaggtggccctggaagtggaaaaggcacacagtgtgccaacattgtggaatactttggattcactcatcttagtgctggtgatcttttgcgtgcagagatcaaatctggctccgagaatggaaccatgattgagaacatgataaaggaaggaaagattgttccatcagaggtaactataaaactgttgcaggaggcaatgataaagaatgaaaatgacaaatttctgattgacggatttccaaggaaygaggagaatcgtgcggcatttgagaacgttaccaaaatttctcgtgcattcgtgctattgtttgactgttgtgagaaagagatggaaagacgtcttttggggcgcaaccaggggagagttgatgataacattgagactattaagaaaaggttcaaaacttttgtggaatcaagtctacctgtcatagagtattataacttaaaggacaaggttaaaaagattgatgctgcaaaaccaattcctgaagtgtttgaagatgtcaaaaccatttttgccccatatgctcccaaggatgaatagagcaatacaaggggcaccataaaggtggtacttggtgccataggcaccgctcaaacatatttgtgattatgaaccctttaatatagaaaagttttggctcatatgagctaccagcatatcagtaggcaattcgatttgttaccagcaataagtagatctgattcccagctgtcgtggtagagtcactttttattgttgtcagtgtaccaacccgtcgatgttgtaccagtaccaatgtgtaatttaccgcatggacgatgaaaaccttctgcctacccaccagctatctggtggcactacggaaagtaaaactgttgccatattctttttac

SEQ ID NO: 4404 - protein, 212 aa, Panicum virgatum
  misc_feature: Ceres CLONE 1804788
  misc_feature (1)..(154): Pfam Name: ADK Pfam Description: Adenylate kinase
  misc_feature (24)..(204): SWISSPROT Homolog: EC 2.7.4.14 Cytidylate kinase
  misc_feature (27)..(206): SWISSPROT Homolog: EC 2.7.4.3 Adenylate kinase
MGTVVDAPAVVTEEVAENTLGGKKVTVVFVLGGPGSGKGTQCANIVEYFGFTHLSAGDLLRAEIKSGSENGTMIENMIKEGKIVPSEVTIKLLQEAMIKNENDKFLIDGFPRNEENRAAFENVTKISRAFVLLFDCCEKEMERRLLGRNQGRVDDNIETIKKRFKTFVESSLPVIEYYNLKDKVKKIDAAKPIPEVFEDVKTIFAPYAPKDE

SEQ ID NO: 4405 - DNA, 1061 bp, Panicum virgatum
  misc_feature: Ceres CLONE 1804795
  misc_feature: Encodes the peptide sequence at SEQ ID NO. 4406
tcgaccaaagagccactcgccattgaggcgctcagtgatcgagttcctcttgtgttggtgtccagagaatcgtagtgtagcgtgacagctagcgaggtttcgatatggcttccaggatggcactcctgtgccttcttggcttgctggtagcgtcacctgccattgctgactccggcatctactaccagcttgctcttatgtggcccggagcgtactgccagcagaccaacgccgggtgctgcaagccgacgaccggcgtgtcgccggcgagggacttctacgtctccggcttcaccgtctacaacgcgacgaccgacgctccggtgaccggctgcaacaacgccgctcctttcgaccctaacaagattaccggcgtccagggcctgtaccagtactggagcagcatcaagtgccccagcaacaacggcaggagcaactggaagaacgcctggaagaagtccggcgcctgctccggcctcgaggagaaggactacttcgaggccgccctctccttccgcagccggatcaacccgctggtccgcctcaaggcccagcacatcgagccggacttcgggctgtacggcgtgaaggcgatcaagaatgtgttcaaggcgggcatcgacgcggcgccggtggtccagtgcagcaagggccccttcggcaagttccagctgttccagctctacttctgcgcgtcggcgagcggcaagttcatcgactgcccggcgccggagcagtacacctgctccaaggagatcctcttccaccccttccagaagtggatgctcaagcagcagctcaacgagtccaccgccgccaaccccttcgtgctccccggcgtcgccgtggaaatgtaactgatcgatctgcggcggcggcgctgcgcgcttaccgtttggttcgtgatgatgagtttgcgcgttgcggtgacgcgcgcatggaaattaaataatgttcccctgctttgttggatgcttgctagctcctcgcggagcaatgatgtacttgtgtagtaatgctcgacgaataaactagtgcggctacctttgtggcttcagctt

SEQ ID NO: 4406 - protein, 250 aa, Panicum virgatum
  misc_feature: Ceres CLONE 1804795
  misc_feature (1)..(186): Pfam Name: Ribonuclease_T2 Pfam Description: Ribonuclease T2 family
MASRMALLCLLGLLVASPAIADSGIYYQLALMWPGAYCQQTNAGCCKPTTGVSPARDFYVSGFTVYNATTDAPVTGCNNAAPFDPNKITGVQGLYQYWSSIKCPSNNGRSNWKNAWKKSGACSGLEEKDYFEAALSFRSRINPLVRLKAQHIEPDFGLYGVKAIKNVFKAGIDAAPVVQCSKGPFGKFQLFQLYFCASASGKFIDCPAPEQYTCSKEILFHPFQKWMLKQQLNESTAANPFVLPGVAVEM

SEQ ID NO: 4407 - DNA, 1566 bp, Panicum virgatum
  misc_feature: Ceres CLONE 1804798
  misc_feature: Encodes the peptide sequence at SEQ ID NO. 4408
cctggcccatcagaattcagaacctagctgtccgatccagtgaatcctctgagctgttcttcgtgccccctgtctgttgcctcttcgtttctactccaaggtaacaagcgcaagagcaaccgatggcggtcgtcgaggacatcgtcatcgccggcgccgggctcgccggcctcgcgacggcactcgggttgcacaggaaaggggtgaggagcctggtgctggagtcgtcgccgacgctgcgcgcgtcggggttcgccttcacgacatggacgaacgccttccgcgccctcgatgccctcggcgttggggacaagatccgggagcaccatttgctttacgagaggatggttaccttctctgctgccaccggagaggctgctgcaaaagtaagcctaaagatgcaggggaaaagcgggccacacgaaatccgttgcgtgaagcgggacttcctgctgcagacgctcgagaacgagctgcccaagggcaccatcaggtactcgtccaagatcgtcgccatcgaggaagaaggccacgtcactgtcctgcacttggctgacggttccaccatgaaaaccaaggttctgattgggtgcgacggcgtgaactccgtggtggcgaaatggctggggcttcccaagccgatcctctcggggcgctccgccaccaggggcctcgccgagtaccccgccggccacggcctcggccccgagatcctgcagttcatcggccagggcttccgctccggcgtgctgccctgctccaacacctccgtctactggaactacacctggtacccttcccccgccgacggggacgccgaggagagcgttgccaagatgcggagcttcgtgctggccaagctgcgcgccgccaagatcccggccgcggcgctgggcgtgatcgagcggagcgagatgagcgaggtggtgtcgtcgccgctgcggttccggtcgccgctcgcgctcgtccggggcagcatcagccgcggcggcgtctgcgtggcgggcgacgcgctccacccgatgacgcccgagctcgggcagggcgggtgcgcggcgctcgaggacggcgtcgtcctggcccggtgcctgggcgacgccttcgccgccggggacggcggccacgagggcgtcgcggcggcgctgggaaggtacgccgaggcgaggcggtggcgcagcgtccagctgatcacggccgcctacgtcgtcggcttcatccaacagagcaacaacgtggtggtcaagttcctcagggacaccttcctgtcgccgttgctggccaagacgctagtcgccatggctgactacgactgtggacccctataattctactctccttgacaagggaaaaattggggcaaaaattaatcaacaccgccattacctccctggaaagagcggcccaagctttgctgcaagttttatttagcaggagaaaaaacaaaagtaaagtgttgtagcagccattagagtaggaagcaagcacactacgtcatcagatggaacagtttttctgaaactgtgatatcaaacaaatcaggagcatcaaaaaaaaaaaaaaaaaaaa

SEQ ID NO: 4408 - protein, 400 aa, Panicum virgatum
  misc_feature: Ceres CLONE 1804798
  misc_feature (1)..(48): Pfam Name: Lycopene_cycl Pfam Description: Lycopene cyclase protein
MAVVEDIVIAGAGLAGLATALGLHRKGVRSLVLESSPTLRASGFAFTTWTNAFRALDALGVGDKIREHHLLYERMVTFSAATGEAAAKVSLKMQGKSGPHEIRCVKRDFLLQTLENELPKGTIRYSSKIVAIEEEGHVTVLHLADGSTMKTKVLIGCDGVNSVVAKWLGLPKPILSGRSATRGLAEYPAGHGLGPEILQFIGQGFRSGVLPCSNTSVYWNYTWYPSPADGDAEESVAKMRSFVLAKLRAAKIPAAALGVIERSEMSEVVSSPLRFRSPLALVRGSISRGGVCVAGDALHPMTPELGQGGCAALEDGVVLARCLGDAFAAGDGGHEGVAAALGRYAEARRWRSVQLITAAYVVGFIQQSNNVVVKFLRDTFLSPLLAKTLVAMADYDCGPL

SEQ ID NO: 4409 - DNA, 1080 bp, Panicum virgatum
  misc_feature: Ceres CLONE 1804812
  misc_feature: Encodes the peptide sequence at SEQ ID NO. 4410
gcgggcacaagcacgagcacgcacgcgcgcgatccacccctcacacggcaagcaagcggaggcgtcctccgtcccctcccccggctcgtgctcgccccgcgccttgctcgcaaagatctgctggtggctcggcccgcgggccgcgatgagctgcggggggcaggccggcgggtggctgctggactacgggctggtggaggaggagatccagggctccgagttcatctacatggtcgacgacccggccgtctccagcgtgatactggggttcgatgctcccaggaaggaggacggcgtccaggacaaccccgccgccaagaagagatcccggccggagtccagcgccccacccggcaccaaggcttgccgtgaaaagctccggcgagacaggctcaacgaaaggttcaacgaactctgtgccatcttggagcccgggaagccgcccaaggccgacaaagtcgacattctaagtgacgctgcccgcctcctgaaccagctgcgtgctgaggcccaaaagctcaagcaatcaaatgaatcgctccaggattccatcaagagcctcaaggctgagaagtctgagctgcgcgacgagaagacgaggctgaaggccgagagggagaggctggagcagatgctcaagggcgtcagcgccgcggctgccccggcacccttcctcccgcaccctgccgcatccgcgccgtcattccacccggccgcgtttgcccaggccggcaagttcgtcctgtaccccacctacccgccaccggccgcgttctggcagtggataccgccgacgtccctggacacgtccaaggaccctgcgcactggccgccggtcgcgtagtcggccaactgggctttgcacctggtgtagaatttgaccaaagcacgcctgaagaaaacttcgggggttgctgattgtgtagcagtgtttgtgctttgtgtcgtggataaaggtcagtgagtgacaggatatactaaaattcagctgatcattgccgatggagatgtctatgtaacagtcctaattttaaagcaatgaaggtgatatgattaaaccaaaaaaaaaaaaaaaaaaaa

SEQ ID NO: 4410 - protein, 232 aa, Panicum virgatum
  misc_feature: Ceres CLONE 1804812
  misc_feature (2)..(52): Pfam Name: HLH Pfam Description: Helix-loop-helix DNA-binding domain
MSCGGQAGGWLLDYGLVEEEIQGSEFIYMVDDPAVSSVILGFDAPRKEDGVQDNPAAKKRSRPESSAPPGTKACREKLRRDRLNERFNELCAILEPGKPPKADKVDILSDAARLLNQLRAEAQKLKQSNESLQDSIKSLKAEKSELRDEKTRLKAERERLEQMLKGVSAAAAPAPFLPHPAASAPSFHPAAFAQAGKFVLYPTYPPPAAFWQWIPPTSLDTSKDPAHWPPVA

SEQ ID NO: 4411 - DNA, 1153 bp, Panicum virgatum
  misc_feature: Ceres CLONE 1804816
  misc_feature: Encodes the peptide sequence at SEQ ID NO. 4412
gattgattgattccccatcccccggccctatcccatcccattcccgcctcccattcccaaatatctccccgactccctcgccatgggcagcgccgccgcctcgccgccgccgtccgggaagctgtcgcaggacgagctcaagcgcgtggcagcgcaccgcgcggtggagttcgtggagcccggcatgacgctgggcctcggcacgggttccaccgcggcgcacgcgctggaccacctgggtgacctcctccgcgcgggcgcgctgccgggggtcgccggcgtgcccacctccctcaagacggagctccacgcggcccgcgtcgggatcccgctactcccgctcgacgcggcctcgggcgcccggatccgcctctccatcgacggcgccgacgaggtcgacccggacctcaacctcgtcaagggccgcggcgggtcgctgctgcgggagaagatgatcgagggcgccggggagcggttcgtcgtcatcgtcgacgagtccaagctcgtgcccaggctcgggtgcacgggcgccgtccccgtcgaggtcatccccttcggcgcgccccacacgctgggcctcatctgcaaggtgttcgacggattgccgggcttccacgccaggctcaggacggtcgtggacgccgacctgggttcggcgccgttcgtcaccgacaacggcaactacatcgtcgagatgttcttcgaggatggcatacgcggcgacctgcaagacatcagcgaccgcctcctccggatcaccggcgtcgtcgagcacggcatgttcctcggcatggccaccaccgtcatcgtcgccaacaaggacggcaccgtcaccgccctccacaggaagagtaagcttatttaaccagtctcccggccggcaccggagacgatcatcgtgcggccagccatgatctctcattccagcagccaagaacaaggaaaggaaaaaaaaaaagcagtcaaatttcttggctcgccgtcgccgcgcttttgacctttacgttgcgcgattatcttatcagctgtccctgtctgtgtatctggtgatgcggggaacatggaccagtgctttgtgttcatccatccataatccattgggcaatttgagccgtgcgcagaggacaaagaataaaaaaaaaaaaaaaaaaaa

SEQ ID NO: 4412 - protein, 260 aa, Panicum virgatum
  misc_feature: Ceres CLONE 1804816
  misc_feature (1)..(187): Pfam Name: Rib_5-P_isom_A Pfam Description: Ribose 5- phosphate isomerase A (phosphoriboisomerase A)
MGSAAASPPPSGKLSQDELKRVAAHRAVEFVEPGMTLGLGTGSTAAHALDHLGDLLRAGALPGVAGVPTSLKTELHAARVGIPLLPLDAASGARIRLSIDGADEVDPDLNLVKGRGGSLLREKMIEGAGERFVVIVDESKLVPRLGCTGAVPVEVIPFGAPHTLGLICKVFDGLPGFHARLRTVVDADLGSAPFVTDNGNYIVEMFFEDGIRGDLQDISDRLLRITGVVEHGMFLGMATTVIVANKDGTVTALHRKSKLI

SEQ ID NO: 4413 - DNA, 1050 bp, Panicum virgatum
  misc_feature: Ceres CLONE 1804821
  misc_feature: Encodes the peptide sequence at SEQ ID NO. 4414
acacccaccctctctacgcgcagctcctcgctgaaccggaacacccgcacacacacaccacttggacaccatggcgccccgggcggcggacaagtcgccggtgccgccggccaccggcctcggtctcggcgtcggcggtgccgtcggaggcctgggcatgggcccgcactacaggggcgtgcggaagcgcccgtgggggcggtacgccgcggagatccgcgacccggccaagaagagccgcgtgtggctgggaacgtacgacaccgccgaggaggccgcccgcgcctacgacgctgccgcgcgcgacttccgcggcgccaaggccaagaccaacttccccttcgcgtcccagagccccgtcgccgccggcgccggcgccggcagccccagcagcaactgcaccgtggaatcgcgcggaggcggcagcggmtgcggsgtccasgggcccatgcaggccatgccgctgcccccggccctcgatytcgatytcttccaccgggcggsggcsgtgaccgcggtactccccgggcggcatgcaggtttcccttcaaagggtaccctgtcgggsgcccgacccggaacccctastttttctacsaacagggsgcagckgccgcggccgcggcggccggctaccggatggtcaaggtcgccccgccgccggtgcacggtggcctccgtcgcgaagagggagtccgagtcttcgtcggtgtttgatggcaccctttcgccgcccgcggttgccgcaaaaaaggaggtctccttcgattgggatgggatctggcggcggcgggcggagaactagccaccccccccagagtttttggatggcgagttgggggtttttttttcctttttgccttgaggaatattagttgtgttatttttttttggtcttctaccctgtagttttgttcagttgcctgtgagagaaggggaagcctgtgtaattagtttttccgccagaggaaggaattgatatgttggtttccccccccataaaccataaacgcaaaaaaaaaaaaaaacatcacatttgaatggttatat

SEQ ID NO: 4414 - protein, 244 aa, Panicum virgatum
  misc_feature: Ceres CLONE 1804821
  misc_feature (1)..(65): Pfam Name: AP2 Pfam Description: AP2 domain
  misc_feature: The sequence is a functional homolog of  SEQ ID NO 2220 in the  10/374,780 US patent application
  misc_feature: The sequence is a functional homolog of  SEQ ID NO 500 in the  10/225,066 US patent application
  misc_feature: Useful for making plants with modulated growth and phenotype characteristics
  misc_feature (124)..(124): Xaa is any aa, unknown, or other
  misc_feature (138)..(138): Xaa is any aa, unknown, or other
  misc_feature (140)..(140): Xaa is any aa, unknown, or other
  misc_feature (145)..(145): Xaa is any aa, unknown, or other
  misc_feature (173)..(173): Xaa is any aa, unknown, or other
  misc_feature (179)..(179): Xaa is any aa, unknown, or other
  misc_feature (181)..(181): Xaa is any aa, unknown, or other
MAPRAADKSPVPPATGLGLGVGGAVGGLGMGPHYRGVRKRPWGRYAAEIRDPAKKSRVWLGTYDTAEEAARAYDAAARDFRGAKAKTNFPFASQSPVAAGAGAGSPSSNCTVESRGGGSGCGVXGPMQAMPLPPALDXDXFHRAXAVTAVLPGRHAGFPSKGTLSGARPGTPXFSTNRXQXPRPRRPATGWSRSPRRRCTVASVAKRESESSSVFDGTLSPPAVAAKKEVSFDWDGIWRRRAEN

SEQ ID NO: 4415 - DNA, 1610 bp, Panicum virgatum
  misc_feature: Ceres CLONE 1804874
  misc_feature: Encodes the peptide sequence at SEQ ID NO. 4416
ccctcgcgcctgctttcccattcctctccgccatcccgcgaggccgcgacgcgtcgtcgtcgtcacggaggcgggcgccccactcgcgtgattcgctttcgaaccgcactcacttcctctcctgttccctccctctcctcctctccggcttctcgccaccctctgctagtctgctttccccctccccctttctccaacctcccctccccttcccgctccgctccgctccccatccatggcctcggcggatcgctccccgccggtggcggacgagcggcgcccgcgcccgtccctcttctcgccgtaccagacgccccgcttccgcctcgcccaccgggtggtgctggcgccgatgaccaggtgcagggcgccccgcgcggtcccggggcccgctctcgcggagtactacgcgcagcggtccacggagggcggcctgctcatctccgagggcaccatcatctcgccggccggcccgggcttccctcgtgtccctgggatatacaatcaagagcagatcgatgcatggaaaaaggtagttgatgctgttcatgccaagggagccatctttttctgccaactttggcatgtaggccgggcttctcatcaagtatatcagccaggcagtgctgctccaatatcctcaaccgataagccaatatcatcaaggtggaggatactgatgcctgatggctcctatggcacgtatccaacgcctcggcgccttgccacatctgagatacctgaaatagtcgaccaatatcgtcaggctgcggttaacgccattaaagcaggtttcgatggcattgagatccacggcgcccatggctacctaatcgatcagttcctcaaggatggcatcaacgaccggaccgacgagtacggtggctcactctccaaccgctgccggttcctcctggaagtgacccgtgccgtggtctctgcgatcggggcagaccgtgtcgccgtccgggtgtcaccggccatcgaccacctcgacgcctacgactccaaccccatgcagctcggcctggccgtggtggagcgtctcaacgccctgcagcaggaggtcgggcggctggcctacctccacgtgacgcagccgcggtacacggcgtacgggcagacggagtcgggccagcacgggagcgccgaggaggagagccggatgatgcgcgccctccgcggcgcctaccggggcaccttcatgtgcagcggcgggtacacgcgggagctcggggtggaggccgtggagtccggggacgccgacctcgtgtcgttcgggcggctgttcatcgcgaacccggacctggtggagcggttccggcgcgacgcgccgctgaacaagtacgtgaggaagacgttctacacgccggaccccgtcgtcgggtacacggactacccgttcctcggccagcctaaggcgcgcatgtgataagtagatggaaatggtagttacaagaggtgcattgttgattgtgtaatgtgacgtgagaaaataagatgacgtcttcgtagccgtgattgttggccaatatccagggcaacagactgttaagatatcttaaggacaaattggtgacttaatggcggaaaaaaaaaaaaaaaaaaaa

SEQ ID NO: 4416 - protein, 398 aa, Panicum virgatum
  misc_feature: Ceres CLONE 1804874
  misc_feature (2)..(351): Pfam Name: Oxidored_FMN Pfam Description: NADH:flavin oxidoreductase / NADH oxidase family
  misc_feature (19)..(398): SWISSPROT Homolog: EC 1.3.1.42 12-oxophytodienoate reductase 3
  misc_feature (20)..(391): SWISSPROT Homolog: EC 1.3.1.42 12-oxophytodienoate reductase 3
MASADRSPPVADERRPRPSLFSPYQTPRFRLAHRVVLAPMTRCRAPRAVPGPALAEYYAQRSTEGGLLISEGTIISPAGPGFPRVPGIYNQEQIDAWKKVVDAVHAKGAIFFCQLWHVGRASHQVYQPGSAAPISSTDKPISSRWRILMPDGSYGTYPTPRRLATSEIPEIVDQYRQAAVNAIKAGFDGIEIHGAHGYLIDQFLKDGINDRTDEYGGSLSNRCRFLLEVTRAVVSAIGADRVAVRVSPAIDHLDAYDSNPMQLGLAVVERLNALQQEVGRLAYLHVTQPRYTAYGQTESGQHGSAEEESRMMRALRGAYRGTFMCSGGYTRELGVEAVESGDADLVSFGRLFIANPDLVERFRRDAPLNKYVRKTFYTPDPVVGYTDYPFLGQPKARM

SEQ ID NO: 4417 - DNA, 1115 bp, Panicum virgatum
  misc_feature: Ceres CLONE 1804912
  misc_feature: Encodes the peptide sequence at SEQ ID NO. 4418
cttgtgacctcggcttcttagcatgtcttctccggtgagatgttcgggttagggtttagggctcagttaggcttttaggcttcttagtatcgtgggatagttggctcccttaggtaccaggtgcacacgaggccggacattgcttttgctgtgggctacgtgagcaggttcatggaagtaccaaccaccgagcacttggcagcggtgaagaggatcctccggtacgtggcggggacgatcgactacggctgctgctacaagagggctggagctgaggcaaagctgctcggtttcagcgacgcagacatgggcagcgacatcgacacaagaaagagcaccactggtgttctgttcttcttcggcccatgtgctgtgagttggcagtcacagaagcaaaaggtggtggcgctgtcttcctgtaaagcagagtatatcgcagggacgacggtggcctgtcaaggcacctggctggcacagcttctttcagagctgaagagtgagcagctgaagaaattcactctgaagatggacagtcaatccgcaattgcactcagcaagaatcctgttttccatgaaagaagtaagcacatagatgttcgttatcatttcattcggaattgcattggagatgggaagatggatgttgaacatgtccggactgaggagcaactcgctgacattctgacgaagccgcttggacgcgacaagttctgtgaactgcgcattcagttgggggtcgccaagattgtcagtgaacatcaagtttagggggtgaaatgttaggaataaacttgtgttcgttttaccctgtttcagttagcattcggcttgcttttctgttagcttgtggggctctgcgttccgggtcatctggatcagagccgcgtcttgtaacggccagagacgtgcgagttcacgtcgtggcgttcgtgtccgcgtcgcgcggcatgacccggcgtgcgggatggcgcacgcgtcttacggatcatggcgcgcataaaggagggcagatcgtgtcctgcctctccctttctttcgtaagctttgctatttataagagatagacagaaaaacgtcgctggttaacgcgacaccaaaaaaaaaaaaaaaaaaaa

SEQ ID NO: 4418 - protein, 198 aa, Panicum virgatum
  misc_feature: Ceres CLONE 1804912
  misc_feature (1)..(180): SWISSPROT Homolog: EC 3.4.23.- Retrovirus-related Pol polyprotein from transposon TNT 1-94 [ Includes: Protease
  misc_feature: The sequence is a functional homolog of  SEQ ID NO 1035 in the  10/374,780 US patent application
  misc_feature: The sequence is a functional homolog of  SEQ ID NO 1038 in the  10/374,780 US patent application
  misc_feature: The sequence is a functional homolog of  SEQ ID NO 1040 in the  10/374,780 US patent application
  misc_feature: The sequence is a functional homolog of  SEQ ID NO 1842 in the  10/374,780 US patent application
  misc_feature: The sequence is a functional homolog of  SEQ ID NO 845 in the  10/666,642 US patent application
  misc_feature: The sequence is a functional homolog of  SEQ ID NO 848 in the  10/666,642 US patent application
  misc_feature: The sequence is a functional homolog of  SEQ ID NO 850 in the  10/666,642 US patent application
  misc_feature: Useful for making plants with modulated growth and phenotype characteristics
MEVPTTEHLAAVKRILRYVAGTIDYGCCYKRAGAEAKLLGFSDADMGSDIDTRKSTTGVLFFFGPCAVSWQSQKQKVVALSSCKAEYIAGTTVACQGTWLAQLLSELKSEQLKKFTLKMDSQSAIALSKNPVFHERSKHIDVRYHFIRNCIGDGKMDVEHVRTEEQLADILTKPLGRDKFCELRIQLGVAKIVSEHQV

SEQ ID NO: 4419 - DNA, 1664 bp, Panicum virgatum
  misc_feature: Ceres CLONE 1804916
  misc_feature: Encodes the peptide sequence at SEQ ID NO. 4420
cccatcccaagcgcgcacactgggcgcggcggcggcaccctctcccttcccaaaaccctacgccgcacctgcacgcgcgcctcgggccctcccgccgcgccctcgtctgctccattgtcgccgccgccgccacgtatctacggccggccgagtaaatagctgcgcaggcgtgcccagccggaagccctccttgcgcgtcggcgccccccgggcccggcggtgtcctgcaccgcggcgcggtgagtttcttccatcgggaacaggacattacagcgatacaagagtgaacaaagaggcaaacaaaaaagaagtaagacagtatgccaaagaagggcaccaaatccaagaaggcggtggacgatggtccagatcaacaagaaaataagcttccggattaccttgagctccagcgcacccgtgttgtgtgcaatgcagatgcccctattcatactcaaggttaccaatactcgggtactcttgctgctatgggcgttgacaatagtgtgtcagtggagaaattttgcaagaacttcaaaattgatataaagcgtctcactgaagatgaaatggagtttgatatgattggagttgatgcatctatagctaatgctttccggagaatcctcatcgcagaggttccaactatggccatagagaaaatcttcatggctgacaacacctcagttatagcagatgaggttctttcacatagactaggacttattccacttgatgcagatccaaggctttttgactatatctcagaaaatgatgtcccaaatgaaaggaacacaattgtttttaaactgcatgtttcatgtgaaaagggttctcaacgaattacagtgaaatctggtgaactagagtggttgccagaaggtagccaattaagcatggcatctcctgcgcagtctggggacaaacagaagactttcacttccttcagtcaaagccaaaaggagatcttagaaaagcctatcggtgtgaagtttaaagatataactattgccaggcttgggccaggacaggctattgagcttgaggcacatgctgttaagggagttgggaaagttcatgccaagtggtctccagttgctacggcctggtacagaatgctccctgaggttgctattcttgaacaaattgaaggtgacgaggcagaggagctcgtgaagaagtgcccagttaatgtttttgatattgaagacctgggtaatgatggaaagagggcagttgtggcaaagccaagggcttgcacgctatgtagagaatgcgtcaggggaccatgtggggaaaaaatccaactaaggcgtgttagagaccatttcatatataccatcgagtcgacaggagctctgcccccagaggtgctattcacagaagccgtgaagattttggaagagaaatgcgagagggtcatatctgagctatcctgagaggcaggcaggcacatgcgacaatggagcaaaatagccgagtccgccatatccgttattttgcaggagactagtttgcgattaaacatttttgtagtggttgtttggctcaagaaatgtgagcttattagtactatctgtgctacactcgagcgaaatgttagacttaaaactgtgtccgttgaatcaactggggacacttttgtacaaaaaaaaaaaaaaaaaaaa

SEQ ID NO: 4420 - protein, 371 aa, Panicum virgatum
  misc_feature: Ceres CLONE 1804916
  misc_feature (1)..(293): Pfam Name: RNA_pol_L Pfam Description: RNA polymerase Rpb3/Rpb11 dimerisation domain
MPKKGTKSKKAVDDGPDQQENKLPDYLELQRTRVVCNADAPIHTQGYQYSGTLAAMGVDNSVSVEKFCKNFKIDIKRLTEDEMEFDMIGVDASIANAFRRILIAEVPTMAIEKIFMADNTSVIADEVLSHRLGLIPLDADPRLFDYISENDVPNERNTIVFKLHVSCEKGSQRITVKSGELEWLPEGSQLSMASPAQSGDKQKTFTSFSQSQKEILEKPIGVKFKDITIARLGPGQAIELEAHAVKGVGKVHAKWSPVATAWYRMLPEVAILEQIEGDEAEELVKKCPVNVFDIEDLGNDGKRAVVAKPRACTLCRECVRGPCGEKIQLRRVRDHFIYTIESTGALPPEVLFTEAVKILEEKCERVISELS

SEQ ID NO: 4421 - DNA, 1277 bp, Panicum virgatum
  misc_feature: Ceres CLONE 1804924
  misc_feature: Encodes the peptide sequence at SEQ ID NO. 4422
ttccccgtttccacaagctttctggtgctatatgcaatagagcccctgtctgcccaggtcgtcttctccttgagctaagttcctgctccctttcttttgtttcattaaggtcctcgtagtttcttttcctttagagtcgcctcctcgctctgcagaaactctcgcagacagcccccttaggtttttcgtattctagttggccggtccctcctttgtagatccggggaacctgccgccgcccccatgtttacctaccagtttctctaacgtccgccgtcccccgatgaagctgaacgtgctccgcatccgccgttcccactccttctccgtcgccttcctgtactggttctacgtcttctcatgaacgcatcgccctctctcaagaacgccagcatctcttccggtctctaggttgttagatttcttttagtttcttgaatctttggtttcccccctactttcttccaaaaaagtccctttttgagctgagtctgtcgaagaagaggaacaatcatccgacaatgtcgtcgcgccggagctcgagccctgagagcaacaccgacagcggcagcggcggcggaggattcgccgccgacgagcgcaagcgcaagcggatgctgtccaacagggagtccgcgcgccgctcccgcgcgcggaagcagcagcggctggaggagctggtcgccgaggtggcccgcctccaggccgagaacgtggaggtgcagtctcgcatcgcgacgttcgaccgcgagttcagcaaggtggacggcgagaacgccgtgctacgcgcccgccacggcgagctggccgggcggctggagtcgctgagcagcgtcctggaggtgctccagatggccggcgcccccgtggacatcccggagatccccgacccgctgctccgcccatggcagccaccgttcccgatgcagcccatcgctgccgacgccttccagttttgagccggcggcgtcagtggccgcctcgactaccaagacatggccgtggcgttgccatggtcacctactgctataattactacttcaatactactcatgtattaggtctgtggttgtggtgtttttaatcatggtttgcttggtgttactattaatttagaccattagtaataatcagtttgtgattttgaacttgtgattgcattatataagcaatgtgctcctattgtgcgatgttgtggatccatggatgtgtgggagcacatggtttgtgattgtaatatcttgacatggaacatatattatgaatggtttcatttg

SEQ ID NO: 4422 - protein, 145 aa, Panicum virgatum
  misc_feature: Ceres CLONE 1804924
  misc_feature: Great-hit functional homolog of the protein sequence given in SEQ ID NO 9444
  misc_feature (3)..(55): Pfam Name: bZIP_2 Pfam Description: Basic region leucine zipper
  misc_feature (2)..(65): Pfam Name: bZIP_1 Pfam Description: bZIP transcription factor
  misc_feature: Useful for making plants with altered Lignin content
MSSRRSSSPESNTDSGSGGGGFAADERKRKRMLSNRESARRSRARKQQRLEELVAEVARLQAENVEVQSRIATFDREFSKVDGENAVLRARHGELAGRLESLSSVLEVLQMAGAPVDIPEIPDPLLRPWQPPFPMQPIAADAFQF

SEQ ID NO: 4423 - DNA, 1595 bp, Panicum virgatum
  misc_feature: Ceres CLONE 1804932
  misc_feature: Encodes the peptide sequence at SEQ ID NO. 4424
gacccttccttcccctgttcggctgttccctttccgtttcgcttcctcctcggctcctcccagttctcgcctacatttcccactttcgcaccccaaaaatggccaaaaccttgtgaaacgggggggagcactagtgaaaacccacccgcggctcgcacacccatcccatcgacgccattggcaccgcagcaccctcggccccggtgtgcagaggcgctgaatggccttgcgcctgtagattctggtcccttgccaccgaccaatccggccgaggtttgaccaagatcggcaggcggccgcgtgcgtcgggctcgatccgactcgtctcctaggatggcagcggtggcggacggatcggcttctgcggcggcggccaaggaggtggagtaccaggccggcgtgcagaagctggtggacctgctgtccaagctcaacccggccgccaaggagttcgtcccctcctcggccgccgcggcgtcgccgcccaagaaggcgctgtcggcggacgcgccggtgttcgactaccactcgatcggagccgggaatgggggcgtcaaggactccgccaccgacgcttctttttacattgggagcccacagcgcaggaggtggaatggatacatcaaccaaggaaggaggagggcaaatgatcgggcgaggcgaacagaaagagaagacagcattaggcaaactgtttatgtctctgaacttgaccatacggtgacggaggagagacttgctgatatctttgctacctgcgggcaagttgttgattgcagaatttgtggtgatccccactcagttcttaggtttgcatttattgagttctctgatgaggagggtgcaagaactgcacttaaccttggagggacaatttttggtttctaccctgttagagtcttgccttcaaagacagctatattacctgttaatccaaagtttcttcccagaacggaagatgagaaggaaatggttatgcgaactgtctattgtacaaacatagataaaatggttactcaattagatgtaaagactttctttgaaggactttgcggtgaggtctctcggttgagacttctaggggataatgtacattccacaaggattgcttttgttgagtttgttcacgctgaggctgccatcttggctctgaattgcagtgggatgattttgggaactctgcctgtcagggtgagcccttcaaagactccagtgaagccacgtgtaaatcgagtcggatctaactgacactgcgtaagccgaactggattgttcacgggaagggatcaccataagcttaaggcttccgcgatccagtgcgtcaggatgaattggcttacattcttacaaacattctctttgtacccttttgcaaacctatgggaagggaactggttaaatcagacccttttatagcttgcatttggttctcatgtttcattcgtcctgatggaactgtcattaggcaaccaaccatcacagtaatttctgttcattgttactgctgttaaactaatcggcatttaacgtcttacctatgaactatcactgttgtttgcattatttgcaatcactaaaaaaaaaaaaaaaaaaaa

SEQ ID NO: 4424 - protein, 304 aa, Panicum virgatum
  misc_feature: Ceres CLONE 1804932
  misc_feature: The sequence is a functional homolog of  SEQ ID NO 1301 in the  10/666,642 US patent application
  misc_feature: Useful for making plants with modulated growth and phenotype characteristics
MAAVADGSASAAAAKEVEYQAGVQKLVDLLSKLNPAAKEFVPSSAAAASPPKKALSADAPVFDYHSIGAGNGGVKDSATDASFYIGSPQRRRWNGYINQGRRRANDRARRTEREDSIRQTVYVSELDHTVTEERLADIFATCGQVVDCRICGDPHSVLRFAFIEFSDEEGARTALNLGGTIFGFYPVRVLPSKTAILPVNPKFLPRTEDEKEMVMRTVYCTNIDKMVTQLDVKTFFEGLCGEVSRLRLLGDNVHSTRIAFVEFVHAEAAILALNCSGMILGTLPVRVSPSKTPVKPRVNRVGSN

SEQ ID NO: 4425 - DNA, 1736 bp, Panicum virgatum
  misc_feature: Ceres CLONE 1804976
  misc_feature: Encodes the peptide sequence at SEQ ID NO. 4426
acatcatcaacaggtaattcagctccatctaagtttaggtcctcaggaggaatatcagtttctttctcagcttcaactctagctgcctctgcctctgcctgcttatcctcttcttccaaaccaagataagtatacatttcatcatcattcatcacagctatagcagcacctatcctatcttccggaattggagtaatttccagggtatcccagtggccgcgggggatcaagcagcgccgcggcggcggtgtgaggaagaggaaggaaggggacaagatgaggaagcgggagcgggagaacccgtgcgggatctgcgggcactaccacaagtacgaggagggggaggtctgcggggtgtgcggccaccgctggaagccgtcggacggggagggcaccccggcgaagcacgagtccgccttccccaccgaggtgctcaaggacttcctcttcctcgggagctacaacaacgcctcccgctccgaggtcctcaagacgctcagcgtctcacacatcctcaacactgtgcctgattgccaaaatctatacacgaattcattcacgtatcacaggcttcagcgtgacaggcctttggattttgatgacgcaaaccagtttctagaacaatgtgaaagagataaattacgcgttcttgttcattgcatgactggaaaaaacaggtcagcagctgttgttgccgccttcttgatgaagtctagaggatggagacttgctcagtctttccagtgggtgaaagaccggcggcagcaggttcaactgacagatgcttctcagaacgtgcttctggagtacgagcagaagctttttgggcccagttctcaacctgtgattcccactgaatcatttgtttctcttggatttggttacccaaaaccagcaggtgacacccaagcacctgcgttcaaccaaaatgaccgcgccatccatttttcagcgagtcggcccaaatgttttccccctgaattttgcttttggagccgaggggacagtgggagtcaacccagataacaatgacaatggtggggccaaggccaacccagcttcgactgataacccgatggacaggtcttaagatgatttcaggctatggaatctccatgttgctgaagtaacctactattaggtgtatcgaatacgcatcggggagggtgtttagctttcagatgggtattttgccttttgtgcactcgagaaatggttgtggcaactgacccgtgctgtagagtgactataacattagacgctggaggaggtgctggccttctccctgcagaagctggaggccatggccgtgccctcggtccaggccgaggtggccaacgaggacgctccgttcgaggtggcggcggccgcggtgacgcgagcgtgttcaacacgctggtgccctcggatgagtggtccggcgggtcggacgggagcgtcacgctggtgcctgtggcggccatcaggtacgcgacccgtcgaggcggtgggcgcgccgatggtcaccgactcaccgtcatacagtcggcaaggcagggtgcggcggggcacagcaccgggaggttcaaggtgcagcataaatatgtggatgtacatgtgagatcagtattgtagaattgtcttttttttcgaagaaaaggaataattgtcagtttgtgcggtacgatacaattttagttcgtcatgtcaatctaagacgttcatatttgccgtgccaaaaaaaaaaaaaaaaaaaa

SEQ ID NO: 4426 - protein, 249 aa, Panicum virgatum
  misc_feature: Ceres CLONE 1804976
  misc_feature (1)..(134): Pfam Name: DSPc Pfam Description: Dual specificity phosphatase, catalytic domain
MRKRERENPCGICGHYHKYEEGEVCGVCGHRWKPSDGEGTPAKHESAFPTEVLKDFLFLGSYNNASRSEVLKTLSVSHILNTVPDCQNLYTNSFTYHRLQRDRPLDFDDANQFLEQCERDKLRVLVHCMTGKNRSAAVVAAFLMKSRGWRLAQSFQWVKDRRQQVQLTDASQNVLLEYEQKLFGPSSQPVIPTESFVSLGFGYPKPAGDTQAPAFNQNDRAIHFSASRPKCFPPEFCFWSRGDSGSQPR

SEQ ID NO: 4427 - DNA, 1529 bp, Panicum virgatum
  misc_feature: Ceres CLONE 1805033
  misc_feature: Encodes the peptide sequence at SEQ ID NO. 4428
atgaccgagccgcgcgagcccgtgacctctttttcctcaagcctcgctcgccgactcctggccgcaatctctgtatcttggcatgcattctgcgttcctgctcgtgctcgacctcaatcctatccaacgcagcactgcagcgatcccagttcccatcgccgaatccgcgtcccactcatcctcaacctcaaccactccgaattcaattcggagcctttctcgattcgctacccttatttgatcatcccatgaccacgagactcctgtgattccccccacgcagacctcgctggacaattgccagagcccccttgctcagccccatccaggccagccatgaagtttaccaagaagtacgcgacctacatgagggggatggaggcggagctcccggccgtggggctcaagcgcctcaagaagatgctcaagaaatgccgctccgactccgaccaccgctcgcacctgcaggatgccgctgcctcacccgccgccgcccggtgccccgggcattgttctgtatgtgatgggagtttctttccatctcttctgaatgagatgtggttcaacgaaaaagccaagaagctgctggaactgcacttggcgacaggcttcaagaaatacaccaagtggttcaccaacaagggtgacaatagccatgggagattaatgcagcaaggcaaagacttggttacgtatgcaattataaatgccgtggccatgaggaagatcttaaagaagtatgataagatacattactcaaagcaaggacaagaattcaaagcccaagctcagattttgcacattgagatacttcaatccccatggctctgtgagctgatggcattctacatgaacttaagaaggagcaagaagaataaggctgcaacggagctctttggcgactgttccctcatattcgatgacgagagaccaacgctctcatgcaacctctttgactctatgcgtgtcgacattagcttgacatgttccatttgcttggacacagtgtttgatccagtctctctttcctgtggtcacatattttgctacttgtgctgctgttctactgcatctgtgaccattgttgatgggctgaagtccgcatatcacaaatcaaaatgtcccctgtgtcgacagcaaggggtctttcctgatgctgtgcacctcgaggaactcaacatgctactgagccacagttgtccagagtactgggagaagagaatgcaatcagagcgagttgagcgggttcgcctagctaaggagcattgggagtcacagtgcagagcattcttgggcatctagatagtgagcttctaccagtggaaactggaaatttgattcgatttgttaagattgtttgttggtagatcctgctctatcacaactcttttgataataaagttggatctaccgtctgttgatagaatttacatgtaagaggttagcttggctgcagaaatagaacaactgtagtggctattcaagtgcaattgcatatgtgtttatatgaaaaaaaaaaaaaaaaaaaa

SEQ ID NO: 4428 - protein, 321 aa, Panicum virgatum
  misc_feature: Ceres CLONE 1805033
  misc_feature (1)..(49): Pfam Name: zf-C3HC4 Pfam Description: Zinc finger, C3HC4 type (RING finger)
MKFTKKYATYMRGMEAELPAVGLKRLKKMLKKCRSDSDHRSHLQDAAASPAAARCPGHCSVCDGSFFPSLLNEMWFNEKAKKLLELHLATGFKKYTKWFTNKGDNSHGRLMQQGKDLVTYAIINAVAMRKILKKYDKIHYSKQGQEFKAQAQILHIEILQSPWLCELMAFYMNLRRSKKNKAATELFGDCSLIFDDERPTLSCNLFDSMRVDISLTCSICLDTVFDPVSLSCGHIFCYLCCCSTASVTIVDGLKSAYHKSKCPLCRQQGVFPDAVHLEELNMLLSHSCPEYWEKRMQSERVERVRLAKEHWESQCRAFLGI

SEQ ID NO: 4429 - DNA, 1475 bp, Panicum virgatum
  misc_feature: Ceres CLONE 1805050
  misc_feature: Encodes the peptide sequence at SEQ ID NO. 4430
atcagcagtccagtcggcaatcggcatcgtagcctccaacgaccaggcggcgccgcgcgcgtgctactctttccgtttccatctttttcctcgacctcataaagcctgcgcgatccagctctccaatctccccgtcgttttgccttctcaattcccgaaactccgagtgctaaaaaaaaaaaaattcccgaaactccgacgactcccgcaaaatccgccaaacaccagcgccgccgcaggcatcaaccggcgaggatcccatgacgccggcgcacgactcccgcaagcgcggcccgccggttccacctccacccgcggcccgccccgccccgcccgtcaagctcctgccgccgggcttcgtcgccgaccgcgcggaggccgcggtgcgcgtggagcgcctgctgcgctaccagttccgcgaccgcgccctcctcgaggaggcgctcacgcaccagtccttctccgacgccgtggcctcctaccagcggctcgagttcgtcggggacgccgcgctcgggctcgccgtcaccaactttctctacctaactaatcccaccctcggccccggcgcgctatccacgctccgcgccgctaacgtctcaaccgagaaactcgcgcgcgttgccgtccgccacgatctctacccgctgctccgccgcaagtgcgcccgcctcgatcttctcgtaggccagtttattgagtcagtgaagatagaactaaaagatgaccttgccactgcaccctatggtgggagttttgttaaagctcccaaggtgcttgtggatattgttgagtccattgctgctgctgtctacgttgattgcaaatttgaccttgagaagctttggaaggttacaaggtggctctttgagccaattatcacggcagaaaccgtagatgaacaaccagtgactacattgcatgagttatgccagaaacatggaaaagttgcccagtttgagacatggcagaggggtgggatgacagtggtaaatgtatttgttggtggggagatggttgggcttggctcctcagagcagaaggtaattgctaagctcaatgccgcacgaaatgcgttagcgaagcttgtcggtggtgcaaagcagcaagtgttgatcactggggttggcaatggatcggcggatgagattgggcagctcagagagtgtaaacatcaacttgctgatcagtgcattggaaagaattggccagagcccatctttaagttggaaaaagaaggtggccctgcacatgataggaagtttgtgtgctctgttcaggtagaaactcaaaatggcacttttgttacgataggtgaccctatgtcaagggtaaaagatgcagagaattctgctgcgcagaagatgttggaattattgttgcggttgtgagatcttttcatgtacatgactagatcatttgtaaactcctttggaaagaaacattttattcaagcaaaaaaaaaaaaaaaaaaa

SEQ ID NO: 4430 - protein, 376 aa, Panicum virgatum
  misc_feature: Ceres CLONE 1805050
  misc_feature (1)..(115): Pfam Name: Ribonuclease_3 Pfam Description: RNase3 domain
MTPAHDSRKRGPPVPPPPAARPAPPVKLLPPGFVADRAEAAVRVERLLRYQFRDRALLEEALTHQSFSDAVASYQRLEFVGDAALGLAVTNFLYLTNPTLGPGALSTLRAANVSTEKLARVAVRHDLYPLLRRKCARLDLLVGQFIESVKIELKDDLATAPYGGSFVKAPKVLVDIVESIAAAVYVDCKFDLEKLWKVTRWLFEPIITAETVDEQPVTTLHELCQKHGKVAQFETWQRGGMTVVNVFVGGEMVGLGSSEQKVIAKLNAARNALAKLVGGAKQQVLITGVGNGSADEIGQLRECKHQLADQCIGKNWPEPIFKLEKEGGPAHDRKFVCSVQVETQNGTFVTIGDPMSRVKDAENSAAQKMLELLLRL

SEQ ID NO: 4431 - DNA, 1258 bp, Panicum virgatum
  misc_feature: Ceres CLONE 1805094
  misc_feature: Encodes the peptide sequence at SEQ ID NO. 4432
agcgagctgctggtcctgcacaatatagcagtagttcaatatgcctcagacttgtaatcagctacctgcaaacgccaaacaggcaattcctcacttggtgagcgttataacagcgcgagcattacctcgctccggccgctgccaggtcgcctttcctggccagacggcacatcttggtggacggagggccctgcgtgctgcccccaaactctgtcgtccgcttcatgccatcctagatacagagagaaaattaaggttctcccacttctcttgcattggtaggattcgacccacccctcgaatggagtggggatagtgctcagatatccgctagataagaacgcaaacaaggcctttttcctccgttagcttattcttttaatatgcaatccaagctgaaggtcccaaattcggattctacaatttattaaaacagttattggccactcctatttcatatctaaagtacggggtagcctccatgtgaggtgggtattggtgtataagtgtactctacgtctttcctgatcgattttggattttgaggtcaaccggctattgcatacatttcaatagtaacataccattttcacttacatgttttcttccgaaccaaaccactaattctgcttatttatattttgtttttattgcaatataggttggacaaatatttcgaagtggagatgactgtacgtgattgtgatcttgacaaatatggagttgtcaataatgccatctatgctagttacatcgataaaggttggcacttataagtctcaaacatagggtagtgtatataccgtgctagcccaagttctgtcattttccttccttcatataccgtgattgatcttcataaaacaggccgagaaatgctgcttgcgggcctcggtttcagcacagattcgctagcatccaggggctgtgctttggcaacgtcagagttaaacctcaagtattttgcacctctgaaggataaagacaagtttgtggtaatgatgaggccagtcgaaatcaagggtgtacggatatttgcagagtattttatagaaacgctgccaaatcgtaatgtagttttaaaagcggtgggcagcttcgtttgcctcaacaaagactaccgtccaactcgtgtgttcccggagttgtcaaccaagctgctgcagttcttcgcatcggacgatgacaagctcaattagctttatggttgtctactcgtgggacctcgtgtaataatataataaagatctattcctac

SEQ ID NO: 4432 - protein, 107 aa, Panicum virgatum
  misc_feature: Ceres CLONE 1805094
  misc_feature (20)..(86): Pfam Name: 4HBT Pfam Description: Thioesterase superfamily
MLLAGLGFSTDSLASRGCALATSELNLKYFAPLKDKDKFVVMMRPVEIKGVRIFAEYFIETLPNRNVVLKAVGSFVCLNKDYRPTRVFPELSTKLLQFFASDDDKLN

SEQ ID NO: 4433 - DNA, 1317 bp, Panicum virgatum
  misc_feature: Ceres CLONE 1805110
  misc_feature: Encodes the peptide sequence at SEQ ID NO. 4434
gtgatccttcaggcagtcaaagggagatgaggagtggtacaagctcgcaatttattatgcgagaggggtgcccaccccaactaagcctgttacgacaacaggggcgccccaatgactttaccatctgatcccgaacgcacacacggaaacagccactcctcacctcccctaccctccggttcatgtcctgctgctccccatgtcgcccccactcgagctcgactacataggcctctcgccgccggcggccgccgctgccgcagatgccgccgacgacctgaagggcaccgagctccgcctcggcctgccggggtccgagtcgccggaccgccgcgtcgcggctgccaccgcgaccaccctggacctgctcccagccaaaggcgccaagcgcgggttctccgacgaggtgccgccgccttcgcccgccgccgctgcgggcaagggcaagaaggtggcggacgaggaggacgacgacaagaaggtggcagcgatcccgcagccggccgccaaggctcaggtggtgggatggccaccaatccgcagctaccgcaagaacacgatggctactacccagcagaagggcagcaaggaggatgctgaggccaagcagggccaagggttcctctacgtgaaggtcagcatggatggagccccgtacctcaggaagattgacctcaagacatacaagaactacaaggatctctccactgcacttgagaagatgttcagtggctttagtaatggcaaggacggcttatctgagtaccgcaaggatggtgaatatgttctgacttatgaagacaaggacggagattggatgcttgtcggcgacgtgccatgggagatgtttgctgactcttgccgtaggctcaggatcatgaaaggttcagatgcaattggacttgctccaagggcagctgataagtccaagaaccgcaactagaatggttgctactacagtccagagcaagagggagatccaatggctgtagggccctttatgaaaaccgaaaagtcaaacagttttaagacgaattctgccttatggtctgtactacatgggttgctgttacgcgagtaaagaactccatgtctgttatgttagtttcgcaaaatcatctatggaccaaacctctattcgattgtggttaaggctttgtacgagtgttattcgtatccgtgtaaatggtttggttcattgtgtgctgctactttgattgagcagtcctcctacctagtttgcaaaagggttggtgtccatgaactgtttgttgtttctctatataatgttcaatgaagctcgcgaatgtattgtcc

SEQ ID NO: 4434 - protein, 247 aa, Panicum virgatum
  misc_feature: Ceres CLONE 1805110
  misc_feature (1)..(223): Pfam Name: AUX_IAA Pfam Description: AUX/IAA family
  misc_feature: The sequence is a functional homolog of  SEQ ID NO 890 in the  10/412,699 US patent application
  misc_feature: Useful for making plants with modulated growth and phenotype characteristics
MSPPLELDYIGLSPPAAAAAADAADDLKGTELRLGLPGSESPDRRVAAATATTLDLLPAKGAKRGFSDEVPPPSPAAAAGKGKKVADEEDDDKKVAAIPQPAAKAQVVGWPPIRSYRKNTMATTQQKGSKEDAEAKQGQGFLYVKVSMDGAPYLRKIDLKTYKNYKDLSTALEKMFSGFSNGKDGLSEYRKDGEYVLTYEDKDGDWMLVGDVPWEMFADSCRRLRIMKGSDAIGLAPRAADKSKNRN

SEQ ID NO: 4435 - DNA, 1320 bp, Panicum virgatum
  misc_feature: Ceres CLONE 1805131
  misc_feature: Encodes the peptide sequence at SEQ ID NO. 4436
gcacggcttccacccctccggcacagcgcgcaagtacagcacaccaccagtcgaccagcgacagcgatcgcatcgcgtcgcactcgcacggcgctcgcacgcccctccgcggcatccgcagatcagatccccgcggcgtccatggccgggaacttcgagctccagggccggcacggcaagtccggcgtccgcgtctcccgcgtctggcgccgccccgccgcggcggggggccacgtcatcgtcgagtggagcgtcgccgtcagcgtcgtctccgactgcctcccctcctacacctccagcgacaactccgccatcgtcgccaccgattccatcaagaacaccgtttatgtcaaggcgaaggagtgcacggaagtggtgtccatggaggaattcgccgtgattcttgggaggcatttcacctccttgtaccctcaggtctcagaggctacggtgaccatcgtggagcgcccatgggagcgtgtggttgtcgacggaaagcctcattcgcacgggttcaaagttggcgtcgagaagcacagcacagaagtcattgtgaaaaaatctggaagcctgcttataaattctggaatccaagggtactcgctgctaaagacaactcagtctggttttgaagggtttgtgatggatcgctatagacttctgcctgatacaagagaaaggatagtggcaacagacgtaactgcttggtggaggtatccttttgaacatatttcgcagctcccatcaaagcctttctgctttacacaaagataccaggatgtaaagaaagttctttcagagacgttctttggtccccctgatgttggtgtgtatagcccatctgtacagaatacactatacctcatggccaaagaagttcttacgaggttcccagacatatcatcaattcagcttagaatgccaaatcttcactttctgcctgtcaacttggggagcaaagaaaatccattgatgaagtttgctgatgatgtgtacttgccgacggatgaaccgcacggaactattgaagcaactttgagccgtcccatgtcgaagctgtaatctggtgatccatgctggtgcggaactcctgtttcgtttccccagcactccctggcgaaaatgtatgataagctgtagaagggggggggggggggggggggaactgccataacccctatgcaaaggggtaaataagtgaataatcttgtgttgcatgttttcagctgtagacgtccagttcgtgaagtcccacagttgtaaatttgtacatcgcttccttatatgaaacttgttaggcaaaaaaaaaaaaaaaaaaaa

SEQ ID NO: 4436 - protein, 306 aa, Panicum virgatum
  misc_feature: Ceres CLONE 1805131
  misc_feature (1)..(154): Pfam Name: Uricase Pfam Description: Uricase
  misc_feature (5)..(306): SWISSPROT Homolog: EC 1.7.3.3 Uricase-2
  misc_feature (5)..(306): SWISSPROT Homolog: EC 1.7.3.3 Uricase-2 isozyme 2
MAGNFELQGRHGKSGVRVSRVWRRPAAAGGHVIVEWSVAVSVVSDCLPSYTSSDNSAIVATDSIKNTVYVKAKECTEVVSMEEFAVILGRHFTSLYPQVSEATVTIVERPWERVVVDGKPHSHGFKVGVEKHSTEVIVKKSGSLLINSGIQGYSLLKTTQSGFEGFVMDRYRLLPDTRERIVATDVTAWWRYPFEHISQLPSKPFCFTQRYQDVKKVLSETFFGPPDVGVYSPSVQNTLYLMAKEVLTRFPDISSIQLRMPNLHFLPVNLGSKENPLMKFADDVYLPTDEPHGTIEATLSRPMSKL

SEQ ID NO: 4437 - DNA, 1209 bp, Panicum virgatum
  misc_feature: Ceres CLONE 1805158
  misc_feature: Encodes the peptide sequence at SEQ ID NO. 4438
aacccaaaacccgatcaaatcagacccgatgggcgccacatcgccggactccggcgacctcatcctggtggagccggcgcggccggggtccccggtcgccgtggtgaccatcaaccggccttcggcgctgaacgcgctgacgaagcccatgatgggctccctggcggccgcgttccggcggctgggcgccgacgacgccgtggcggcggtcgtgctcgcgggccgcggccgcgccttctgctccggggtggacctgacggcggcggaggaggtgttcaagggcgacgtcaaggacgtcgccaccgaccccgtcgcgcagatggagctctgccgcaagcccatcgtcggcgccgtcgccgggttcgccgtcaccgccgggttcgagatcgccctcgcctgcgacatcctcgtggccgggcgctccgccaagttcctcgacacccacgccaaatttggtatatttccttcctggggtctttcgcagaagctttctcgcgtcattgggccgaacagagcacgggaagtgtcactaacctgcatgcctgttactgctgaaatggcggagagatgggggcttgtcaaccacgttgtggatgacactgaggtgctgaataaggcaatacaggttgccgaggctattgcaaggaacaaccaaaacttagtcgtgttatacaaatcggttataaatgatgggtttcagctggacttgaagcatgctcaagcacttgagaaggaaagaggtcacaagtattacagtggcatgacgaaggagcaattcgctaatatgcagaaattcattcagggccggagttctaaaccatcatcgaagctgtagcttgcagatatctgtatatcagtaaactgtctgtgtgtatggtattcggctgctaaaagcgtgttcagtagtactgaaaataaacgatgccaggtgcgacatcatatagagactgtcttatggaaagacaaagactgccttcttgcattcaaagctgcggagcagtgatccccaccctgcaaacatgtgttgcaatttacctgaaaacctctggtgccttctcttcccatctgtgatactaaaacaggtcagttcctgttgccgggatatgttgcatcttcctttgctccatgtttaatgttttacatgtggtttgatggagaatgttgtagcaagttggcagatattaataaattgtagagtgatcgttttgc

SEQ ID NO: 4438 - protein, 268 aa, Panicum virgatum
  misc_feature: Ceres CLONE 1805158
  misc_feature (1)..(166): Pfam Name: ECH Pfam Description: Enoyl-CoA hydratase/isomerase family
MGATSPDSGDLILVEPARPGSPVAVVTINRPSALNALTKPMMGSLAAAFRRLGADDAVAAVVLAGRGRAFCSGVDLTAAEEVFKGDVKDVATDPVAQMELCRKPIVGAVAGFAVTAGFEIALACDILVAGRSAKFLDTHAKFGIFPSWGLSQKLSRVIGPNRAREVSLTCMPVTAEMAERWGLVNHVVDDTEVLNKAIQVAEAIARNNQNLVVLYKSVINDGFQLDLKHAQALEKERGHKYYSGMTKEQFANMQKFIQGRSSKPSSKL

SEQ ID NO: 4439 - DNA, 1069 bp, Panicum virgatum
  misc_feature: Ceres CLONE 1805199
  misc_feature: Encodes the peptide sequence at SEQ ID NO. 4440
tctaccagctctcttcccctctctctatcccctcccggccgctcctctgaggaaaaaccaggaaccgtgggggcggagtagggtgcgcgtctggtactctggtgccacatagaggaaggagcgagcaagcaggaagcagcagaaatgccgtacacagctccgaggccgtcgccgcagcagcacatcagccggttcgcgggctgcggcggggtggggaaggcggcgtcgcacgggccgtcgtgcgcggcggtgccggcggaggtggcgcggcaccacgagcacgcggcgcgcgcggggcagtgctgctcggcggtggtgcaggcgatcgcggcgcccgtgggggcggtctggtcggtggtgcggcgcttcgaccggccgcaggcgtacaagcacttcatccggagctgccgcctcgtgaacggcgacggcggcgccgtgggctccgtgcgggaggtgcgcgtcgtgtcgggcctccccgccaccagcagccgcgagcggctcgagatcctcgacgacgagcgccgcgtgctcagcttccgcgtcgtcggcggggagcaccgcctcgccaactaccggtcggtcaccaccgtgcacgaggccgccgccgggcacacgctggtggtggagtcgtacgtcgtggacgtgccgcccgggaacaccgaggacgagacgcgcacgttcgttgacaccatcgtgcgctgcaacctccagtcgctggcgcgcaccgccgagcagctcgccgacgcgctcgcctagtgcccgtgtcgccggccgccggcttttttgcgggacgttgctcttgacttcttcctgttccttagccctattgggggagatcgatccctgtgttcaatggttctagattgatttagcttgtgatttaattttcttttcttttttttgggcgacacatagtaaaaaaatcatttgtgtggctgttgcctgctgatatttgacacccaatattcacatacatgtacaacttttagccgtccagctacttcttggcctagttaaattaagtcactactcctattttacctctatgaaaatatcattacttttgagc

SEQ ID NO: 4440 - protein, 203 aa, Panicum virgatum
  misc_feature: Ceres CLONE 1805199
  misc_feature (2)..(143): Pfam Name: Bet_v_I Pfam Description: Pathogenesis-related protein Bet v I family
  misc_feature (1)..(133): Pfam Name: Polyketide_cyc Pfam Description: Polyketide cyclase / dehydrase and lipid transport
MPYTAPRPSPQQHISRFAGCGGVGKAASHGPSCAAVPAEVARHHEHAARAGQCCSAVVQAIAAPVGAVWSVVRRFDRPQAYKHFIRSCRLVNGDGGAVGSVREVRVVSGLPATSSRERLEILDDERRVLSFRVVGGEHRLANYRSVTTVHEAAAGHTLVVESYVVDVPPGNTEDETRTFVDTIVRCNLQSLARTAEQLADALA

SEQ ID NO: 4441 - DNA, 1074 bp, Panicum virgatum
  misc_feature: Ceres CLONE 1805203
  misc_feature: Encodes the peptide sequence at SEQ ID NO. 4442
ataccccacacacacccccaccctctctgccctgagctcttcgccgaaccggaacgcccgcacacccacgccacttgtacaccatggcgccccgggcggcgcacaagtcgccggtgccgccggccaccggcctcggtctcggcgtcgtcggtggcgtgggcatgggcccgcacttcaggggcgtgcggaagcgcccgtgggggcggtacgccgcggagatccgcgacccggccaagaagagccgcgtctggcttggcacgtacgacacggccgaggaggccgcccgcgcctacgacgccgccgcgcgcgagttccgcggcgccaaggccaagaccaacttcccgttcgcgtccaagtgccccgtcgccgccggcgccggcagccccagcagcaacagcaccgtggagtcgggcggaggcggcggcggctgcggcgtccaggcgcctatgctggccatgccgctgcccccggccctcgatctcgatctcttccgccgggcggcggccgtgaccgcggtctcccccggcggcatgcggtttcccttcaaagggtaccctgtcgcgcgcccgaccccgaacccctacttctacgaacaggtggccgcggccgccgccgcggcgtccggctaccggatgctcaaggtcgccccgccgccggtcaccgcggccgccgtcgcgcagagcgactccgactcctcgtcggtggtcgatcacaccccttcgccgcccgcggttaccgcgaagaaggaggtctccttcgatctggatctgaactggccgccgccggcggagaactagccacaccagagtttttagctgacgacttcgtagtttctctttcctttttgcctcgaggaatattacttctgttgtttttttggtcctctagcctgtagtttttgttcagtagcctgcgagagacggaggagcctgtgtaaatagtttttccgccgagggcggaattgatctgagatctgttcgtctgtctagacagatcaaaccggcgctgatatggagtaaattatgtactactagtatttcattccattagcatcaagcggatattattattcag

SEQ ID NO: 4442 - protein, 237 aa, Panicum virgatum
  misc_feature: Ceres CLONE 1805203
  misc_feature (1)..(64): Pfam Name: AP2 Pfam Description: AP2 domain
MAPRAAHKSPVPPATGLGLGVVGGVGMGPHFRGVRKRPWGRYAAEIRDPAKKSRVWLGTYDTAEEAARAYDAAAREFRGAKAKTNFPFASKCPVAAGAGSPSSNSTVESGGGGGGCGVQAPMLAMPLPPALDLDLFRRAAAVTAVSPGGMRFPFKGYPVARPTPNPYFYEQVAAAAAAASGYRMLKVAPPPVTAAAVAQSDSDSSSVVDHTPSPPAVTAKKEVSFDLDLNWPPPAEN

SEQ ID NO: 4443 - DNA, 1129 bp, Panicum virgatum
  misc_feature: Ceres CLONE 1805378
  misc_feature: Encodes the peptide sequence at SEQ ID NO. 4444
tcccacctccttgtcctctgcctcctccctctcccgactcgcgaactcacgagctcagcagcagcggcggccagcggccagcggccaagacaaacctcgagcccatccctcctcctgacacctcactcccccaagaacccagtattccaggatttggtgatgctcgtaaagtttggctaggcatggcgcctccacaggagcgggactacatcgggctgtcgccggcgacggcggccaccgagctacgtctggggctgccgggcacggaagacgcggagggcggcgacgccgtggcggggacgccgctcaccctcgagctgcttcccaagggcggggccaagcgcggattcgcggacgccatcgtgcggcgggacgcggctgcaaccggcaaggaaccggcggacgacgaggaggacaagaagaaggcgcaggctccggcggcaaaggcacaggtggtaggatggccaccaatccgcagctacagaaagaacaccatggcgatgaaccaggattgcctctatgtcaaggttagcatggatggtgcgccatacctcaggaaggtggaccttaagatgtacagcaactacaaagagctctcactggcgctgaagaaaatgttcagctcctttactgttggtgatattgaatctaatggaaaatcaggaagagaaggattatctaattgccgactaatggatcataaaaatgggaccgaacttgtgctcacatataaggacaaggatggagattggatgcttgttggtgatgtcccgtggagaatgttcacaggcagctgtaggaggctcaggatcatgaagggctcagatgcagtgggccttgcacccagagcaaccgagaagagcaagaacggtaactaggaaaaggatgaatgcactctgctctctacagcctcatcctactctactcttacctgtaaggtcccattctcaaaccctcaaggttaaaggaattaacatgtgagaaggggattacttatatccatatgtacacctatggtttttgttttttccccttattttgcttgtttttttttttttggtttggactcagatatgtcagattgcaaacataagatgtgtgagtatgtccaaaaaaaaaaaaaaaaaaa

SEQ ID NO: 4444 - protein, 231 aa, Panicum virgatum
  misc_feature: Ceres CLONE 1805378
  misc_feature (140)..(294): Pfam Name: AUX_IAA Pfam Description: AUX/IAA family
  misc_feature: The sequence is a functional homolog of  SEQ ID NO 652 in the  11/479,226 US patent application
  misc_feature: Useful for making plants with modulated growth and phenotype characteristics
MAPPQERDYIGLSPATAATELRLGLPGTEDAEGGDAVAGTPLTLELLPKGGAKRGFADAIVRRDAAATGKEPADDEEDKKKAQAPAAKAQVVGWPPIRSYRKNTMAMNQDCLYVKVSMDGAPYLRKVDLKMYSNYKELSLALKKMFSSFTVGDIESNGKSGREGLSNCRLMDHKNGTELVLTYKDKDGDWMLVGDVPWRMFTGSCRRLRIMKGSDAVGLAPRATEKSKNGN

SEQ ID NO: 4445 - DNA, 1249 bp, Panicum virgatum
  misc_feature: Ceres CLONE 1805382
  misc_feature: Encodes the peptide sequence at SEQ ID NO. 4446
aaatccggcttccccccgcaaggccgcaaccaaagcgctccgtttccccacgcctctccaatcccgctcctccggccgtccttccagttccagagcctcctctggcgacgaccctcgccgcggcggcccgaatctagggttcccctttacccaccgcgggccggatcaccctcggggaggccccgcgatgctgccgtgcgcgaggtcggtgctgcgaaggagggggctggcgtcgtccctcctgcggaggtgcggcggggcggtcgagtgcgcccccggcacgggggaggcgctcgccaatgccaggtgcgcgagcacgctttccgcgctcggtgacgggcgcgtgctcgggcgcggcggccggtgggccgatccgcgggccggcgcgatgggcgcggggcgattggcgcgcacgcagaccaggtgcttcctcgggtgtggcgacggggaggaggggagcgtgctctccaaggtctacgaggagaggcgcgtgatggggtactcgccggagcaaatgtttgcggttgtcgccgcagtggacctatacgaggactttgtgccatggtgccagcggtccaggattatcaggcgccatgatgacggctcattcgatgctgagctcgagattggattcaagttccttgtcgaaagctatgtttctcatgtggagatggaaaagcccaagtatatcaagacaacagcatctgaaagtggactttttgatcatttgataaacgtttgggaatttaagcctggtcctgttcctgggacctgtgacctctacttcttagttgattttaaatttcaatcaccactgtatcgtcaggttgcatcaatgttcttcaaggaagtagtttcacggctagtgagctcatttagtgatcgatgttttagaatatatggacctcccgtaccggtgcttgaaaatacttatggacaaggaagataatgaatctgttataaatccaaatttgaaggatttgtctttcgtggatccctggaggatccttgtagtcaacgcataatccttcccctgacaagccgtcatagtgccattttagggtgctatcaggcgagagattgtcttgaggaaatcagccactgttgagttttcattctttggctatttctgagggtttttttccatgtattactcaatcagtttcccatgtgtaacaaggaaatggccatttctcaagattattttcccagtctatcagattatgacgaaaaaaaaaaaaaaaaaaaa

SEQ ID NO: 4446 - protein, 253 aa, Panicum virgatum
  misc_feature: Ceres CLONE 1805382
  misc_feature (1)..(129): Pfam Name: Polyketide_cyc Pfam Description: Polyketide cyclase / dehydrase and lipid transport
MLPCARSVLRRRGLASSLLRRCGGAVECAPGTGEALANARCASTLSALGDGRVLGRGGRWADPRAGAMGAGRLARTQTRCFLGCGDGEEGSVLSKVYEERRVMGYSPEQMFAVVAAVDLYEDFVPWCQRSRIIRRHDDGSFDAELEIGFKFLVESYVSHVEMEKPKYIKTTASESGLFDHLINVWEFKPGPVPGTCDLYFLVDFKFQSPLYRQVASMFFKEVVSRLVSSFSDRCFRIYGPPVPVLENTYGQGR

SEQ ID NO: 4447 - DNA, 1213 bp, Panicum virgatum
  misc_feature: Ceres CLONE 1805389
  misc_feature: Encodes the peptide sequence at SEQ ID NO. 4448
acgcgcccagctcgccggagccacgcattccagctgccagcctggggtgccccgcgccaccagcgcctcgccttgcccccgcgcgcccgccctgggcccccgccggagcacgtcgacgaccggccccgcgcgggcggtcgatcaacaacagtaagcacgccatggcgcgccaccgcggcggtggcgatctcgtccgcctgctcatgacgctcctcctggccgcgacgccgctcctcgcccccgtcgccgccgagctggaggaggcggaggtggtgccgaccgccccgccgcaggtcgcgtcgtcgtctctggcgcggggcgcggacgaggggctggacgacgtgccggcggacgtgcgctgcgcgagctggcggctcgcggcggaggccaacaacctggcgccgtggaaggccgtgccggcggagtgcgcggcgcacgtgcgggcctacctcacgggcgccgcctaccgctccgacctcgagctcgtggcgcgcgagtccgccgcctacgcgcgcgccgcgccgctcgggggcgacggccgcgacgcctggatcttcgacatcgacgagacgttgctgtcgaacctaccctactacgccgaccacggatacgggcttgaattgttcgaccatctcgagtttgacaagtgggtggagaggggggaggcgccggcgatcccctccagcttgaagctgtacatggaggttctcgagctcggattcaaggccatcttgctcacgggcagaagcgaggggcaccgtggcgtcacggtggacaacctcaacaaacacgggttccacgactgggacaagctcatcctcaggacagcggctgaccgcaagaaaactgcgacaatctacaaatcggagaagaggaaggaaattgaagcagaagggtacaggatcttgggcaattcaggggatcagtggagcgatctgctcggttcttccatgagtgctcgctccttcaagctcccaaacccaatgtactatatcccatgacaaacaaaaaaaacaggggtggtgaaaatgtttattcgacacctttttcaccaggcctaatgatagaactgcatactgactagagcaaagaaatttgagaataacttggcaatgaaatttgaactgtacaaaagctttactaacttcctttagtatacattacctcaaatgtaacggatcagtgttaccttatgaatgaatggtgggttcgg

SEQ ID NO: 4448 - protein, 279 aa, Panicum virgatum
  misc_feature: Ceres CLONE 1805389
  misc_feature (2)..(228): Pfam Name: Acid_phosphat_B Pfam Description: HAD superfamily, subfamily IIIB (Acid phosphatase)
  misc_feature (64)..(278): SWISSPROT Homolog: EC 3.1.3.2 Acid phosphatase 1 precursor
MARHRGGGDLVRLLMTLLLAATPLLAPVAAELEEAEVVPTAPPQVASSSLARGADEGLDDVPADVRCASWRLAAEANNLAPWKAVPAECAAHVRAYLTGAAYRSDLELVARESAAYARAAPLGGDGRDAWIFDIDETLLSNLPYYADHGYGLELFDHLEFDKWVERGEAPAIPSSLKLYMEVLELGFKAILLTGRSEGHRGVTVDNLNKHGFHDWDKLILRTAADRKKTATIYKSEKRKEIEAEGYRILGNSGDQWSDLLGSSMSARSFKLPNPMYYIP

SEQ ID NO: 4449 - DNA, 1153 bp, Panicum virgatum
  misc_feature: Ceres CLONE 1805399
  misc_feature: Encodes the peptide sequence at SEQ ID NO. 4450
acacacggatccatccatctctcctttgctctttcccttcaattcaactcgtctcacagaactctttccgagagatcgagacaatccggcggagctaagcaacggcgatggcttttagcccgagggctcgcgtgctggcggcggcgctgctcctgggcctctgctgcggcatcggcgcgccggcggcggcggcggcggggaggatcgacgatggcctggaggtgacgtggggggacgggcgcgggagcgtgtcgccggacggccaggtcctgacgctgtcgctggaccgcacctccggctccgggttccgctccagggacacctacctcttcgcgcgcgccgacgtgcagatcaagctcgtccccaacaactccgccggcaccgtcactaccttctacttcatctcggaggggccgtgggacgtccacgacgaggtggacctcgagttcctgggcaacgtgagcgggcagccctacacgctgcacaccaacgtgttcgccggcggcagcggcggcaaggagcagcagttccacctctggttcgaccccaccgccgacttccacacctactccatcgagtggacgcagcagcacatcctcgtgctggtggacgggacgccgatccgggagttcaagaaccacgcggaccgcggcgtggcgtacccgtcgacgcagcggatgcggctgtacggctcgctgtgggacgccgaggactgggccacgcagggcggccgcgtcaagacggactggtcgcaggcccccttcgcggcgcagtaccgcaacttcacggccgcggacgcctcctcctcctcggcgtcgccggcggcggcgggcgggtacgggcaggagatggacgcggcggcgcagcaggccatgaagtgggcgcgggacaactacatggtgtacgactactgcgccgacggcaagcggttcccgcagggcgtcccgcccgagtgctccatgccgtagccgtagcgtagcgtccagatgggctaagagccggcgcgctttgattgcgaagtcgtcgatcggagggagcaagcattaggggcaggttacacgcatatgctaggttacagaatccattggtctcattcattgtttatatattcatcgacatcgattctttggtgtgaagaatacatattgctatc

SEQ ID NO: 4450 - protein, 286 aa, Panicum virgatum
  misc_feature: Ceres CLONE 1805399
  misc_feature (1)..(184): Pfam Name: Glyco_hydro_16 Pfam Description: Glycosyl hydrolases family 16
  misc_feature (10)..(283): SWISSPROT Homolog: EC 2.4.1.207 Xyloglucan endotransglucosylase/hydrolase protein 22 precursor
  misc_feature (24)..(284): SWISSPROT Homolog: EC 2.4.1.207 Xyloglucan endotransglucosylase/hydrolase protein 24 precursor
MAFSPRARVLAAALLLGLCCGIGAPAAAAAGRIDDGLEVTWGDGRGSVSPDGQVLTLSLDRTSGSGFRSRDTYLFARADVQIKLVPNNSAGTVTTFYFISEGPWDVHDEVDLEFLGNVSGQPYTLHTNVFAGGSGGKEQQFHLWFDPTADFHTYSIEWTQQHILVLVDGTPIREFKNHADRGVAYPSTQRMRLYGSLWDAEDWATQGGRVKTDWSQAPFAAQYRNFTAADASSSSASPAAAGGYGQEMDAAAQQAMKWARDNYMVYDYCADGKRFPQGVPPECSMP

SEQ ID NO: 4451 - DNA, 1090 bp, Panicum virgatum
  misc_feature: Ceres CLONE 1805402
  misc_feature: Encodes the peptide sequence at SEQ ID NO. 4452
accagttcccgctcagttcaaagcagcagcgcctcgccatcatcagagacaaacacacgagctcagagaaggaaacaccacacgcatgaccaacggcatcttctccgccatggcaggggaccaagcgtacatgatccgattcgacggccacttcgacgacacctcgccgagctccgccggcgccgagccgccggaggtgcaggtgcaggtgcagcagccgccgccgttcgcggggcgggtgatctcccccgagcaggagcaccaggtcattgtcaccgccctgctgcacgtcgtctccgggtacacaaccgcgccgccggagatcttcccgcccgccgccgcggcgtgccgggtgtgcgggatggagcggtgcctcggctgcgagggcgccgcggcgatcgcattggacggcgcggagagcaatgcggccgcggcgccgggcgcggcagggcagaggaggcggaggaagaagaagaacaagtaccgcggcgtgcgccagcggccgtgggggaagtgggcggcggagatccgcgacccgcgccgcgcggtgcgcaagtggctcgggacgttcgacaccgccgaggaggccgccaaggcgtacgaccgcgccgccgtcgagttccgcggcccgcgcgccaagctcaacttcccgttccccgagcaggccgcggggcgcgacgaggccaccagcaacggcgacgcgagcgcggccgccaggtcctcggacaacacgctgtcgccgtcgctctgcagcggggacgccgaggagcgggggcagccggcggagtggccgcggggcggggggcaggaaacaggggagcagctctgggaaggcctccaggacctgatgaggctggacgaagccgagctctggttcccgccaacttccaacgcttggaattgaaacgtacgcgcgattagatcctagccgttcaagcggttccaaaatgaacatcctagcctttcgatgtgacttttttttttccagctctgttgtgcttatttgatcatagcagagttttgtaaattacctgtagagtccaaccaactgtattaatcaggcaattttgggagtgtgcctttctaccgc

SEQ ID NO: 4452 - protein, 272 aa, Panicum virgatum
  misc_feature: Ceres CLONE 1805402
  misc_feature: Great-hit functional homolog of the protein sequence given in SEQ ID NO 9438
  misc_feature: Great-hit functional homolog of the protein sequence given in SEQ ID NO 9449
  misc_feature (1)..(63): Pfam Name: AP2 Pfam Description: AP2 domain
  misc_feature: Useful for biocontainment applications
  misc_feature: Useful for making plants with altered terpenoid content
  misc_feature: Useful for making plants with modulated biomass
  misc_feature: Useful for making plants with modulated flowering time
  misc_feature: No seed is being produced by the plant
  misc_feature: The petioles have very varied liminal angles, giving the plant a very bushy appearance.  The rosette leaves of ten do not appear in the normal fashion
  misc_feature: The plant flowers significantly late compared to wild-type.
  misc_feature: The plant is abnormally small.
  misc_feature: The plant produces a reduced number of seeds.
  misc_feature: The rosette leaves do not appear in the normal fashion, i.e., their phyllotaxy may be abnormal or too many leaves may be emerging in comparison to the control.
MTNGIFSAMAGDQAYMIRFDGHFDDTSPSSAGAEPPEVQVQVQQPPPFAGRVISPEQEHQVIVTALLHVVSGYTTAPPEIFPPAAAACRVCGMERCLGCEGAAAIALDGAESNAAAAPGAAGQRRRRKKKNKYRGVRQRPWGKWAAEIRDPRRAVRKWLGTFDTAEEAAKAYDRAAVEFRGPRAKLNFPFPEQAAGRDEATSNGDASAAARSSDNTLSPSLCSGDAEERGQPAEWPRGGGQETGEQLWEGLQDLMRLDEAELWFPPTSNAWN

SEQ ID NO: 4453 - DNA, 1136 bp, Panicum virgatum
  misc_feature: Ceres CLONE 1805404
  misc_feature: Encodes the peptide sequence at SEQ ID NO. 4454
gtgactcgctggtcgtcggctcggcggagtcgtgtgcccggcgtgccccggacatgctctggcgcctcccagcgagcacgcttctgccgccgctgcccgcgccgcccgccccctcgatcgcgtccctcgccgcctccctcccctctccggcctccgccgtcgccgcgtcccccccccccctcccggacccgcgaatttcccgcagatccgccggggatgtcgtcgtccgcttccagcgccgaggggtaccccgccgcaggcggcgacttcacggaggtcgtgatcgtgcggcacggggagacgtcatggaacgcctcgcgcatcatacagggacacatggatgcagagctgaatgatattggaaggcagcaagctgtcgcggtcgcccatcggctttctagagaagtgaaagcagctgctatatgctcatctgatctaaagcgagcagcagagactgcccaaacaattgcaagaatctgcaatctaccaaatgttttgttcgatccagcactaagagaaagacacattggagatctgcagggcatgaagtttcaagatgctgctacagagaggccagaggcttacaaagcttttgtgtcccacaagagaaaccaaccaattcctggtggtggagagagtcttgatcaactgtcagaacgatgtgtgtcctgcttgtacaacattgttgagaaacacaaaggtgagcgagtgatcattgtctcgcacggcggcaccatcagggaactctaccggcacgccagccccacgaggccgctccacggtaagatccacaacacgtcggtgagcgtgatcctcgtgtccggcaccaccggccgctgcatcgtcaagacgtgcggagacgtcagtcaccttcaggaggccggcgccggcgtcctggagaacgccttcggcggcgataagaactccgcctgattgctctccggatccagtcccggaccatctcgtgtgcttgcccgcggcatttatcacgtgcggggacgtcagtcctttcagctgtaccagtcatcctgttcctatcatttggccgggcgctcgatggcgcccgattcgggaacgctagggaatttcgcaggaatagttttggttgctcgccggaaaaaaaaaaaaaaaaaaaa

SEQ ID NO: 4454 - protein, 238 aa, Panicum virgatum
  misc_feature: Ceres CLONE 1805404
  misc_feature (1)..(158): Pfam Name: PGAM Pfam Description: Phosphoglycerate mutase family
MSSSASSAEGYPAAGGDFTEVVIVRHGETSWNASRIIQGHMDAELNDIGRQQAVAVAHRLSREVKAAAICSSDLKRAAETAQTIARICNLPNVLFDPALRERHIGDLQGMKFQDAATERPEAYKAFVSHKRNQPIPGGGESLDQLSERCVSCLYNIVEKHKGERVIIVSHGGTIRELYRHASPTRPLHGKIHNTSVSVILVSGTTGRCIVKTCGDVSHLQEAGAGVLENAFGGDKNSA

SEQ ID NO: 4455 - DNA, 1205 bp, Panicum virgatum
  misc_feature: Ceres CLONE 1805407
  misc_feature: Encodes the peptide sequence at SEQ ID NO. 4456
atcgacagcagagctcgcaaaacctccacaccttcctgaaatagccactagctttagctgctcgccgggttctctgatcactctcgctctcgggctcagccttcctcgcgatccataaaggttgcaagctaccagtcccattaactgatggactttgacctgctgaattacagcccggaagcgcagctggagctgatgaacacgatgctccagctggagcagctcaccaagctcgacggcggccatcagtcgctgatggcggcgcccgtctcgccgccggcatccccagtgcaaacccatgcaacagcccactgcttctcgcctccgccccacgtgtcggcgaccgccgcctaccaggaccagtacacaccgccggccgtgtacgccggcaggaccggcgccctcgagcatctccaggtggactacgcgctgtccccgtgcgccgacggcggccgcgccgcgccgcagccggcggggtcgccgtcgccgacgtcgtcggcggacgcgatgcgggaggcgatcttccacatcgcggcgctgcagccggtggagatcgacccggaggcggtgcggcccccgaagcggcgcaacgtgcgcatctccaaggacccgcagagcgtggcggcgcggctgcggcgggagcgcatcagcgagcgcatccgcacgctgcagcggctcgtcccgggcggcaccaagatggacacggcgtcgatgctggacgaggccatccactacgtcaagttcctcaagtcccaggtgcagtccctcgagcgcgccgccgccgccacccaccaccgcgccgccttccaccccgccgccctccacgcgcagtggcagttcgcgctcccccacggcgacatgtgacacagttaccgtcgagcgcgcgcgtcggttcgccgctggcgtcttcccgatcgggcgacgacgacgacggcctctccatctgccgccgccgattcttctgctgtagtgttgtgtgtgcatcgtcgatctgtacatgatcacatgcgcgtgtatagagatgtaggagagccttcggtacattctagtattattgttgtagccgcatacgacgtggctgctccaattttttgttggagccgtagccgtgcatgcgcgcgcgtacgtgccctaccctacgtagtaggctgtacatttccttgtaccattttttcttcttctatctatccgtcagttcgttgctt

SEQ ID NO: 4456 - protein, 238 aa, Panicum virgatum
  misc_feature: Ceres CLONE 1805407
  misc_feature: Great-hit functional homolog of the protein sequence given in SEQ ID NO 9761
  misc_feature (1)..(48): Pfam Name: HLH Pfam Description: Helix-loop-helix DNA-binding domain
  misc_feature: Useful for biocontainment applications
MDFDLLNYSPEAQLELMNTMLQLEQLTKLDGGHQSLMAAPVSPPASPVQTHATAHCFSPPPHVSATAAYQDQYTPPAVYAGRTGALEHLQVDYALSPCADGGRAAPQPAGSPSPTSSADAMREAIFHIAALQPVEIDPEAVRPPKRRNVRISKDPQSVAARLRRERISERIRTLQRLVPGGTKMDTASMLDEAIHYVKFLKSQVQSLERAAAATHHRAAFHPAALHAQWQFALPHGDM

SEQ ID NO: 4457 - DNA, 1429 bp, Panicum virgatum
  misc_feature: Ceres CLONE 1805432
  misc_feature: Encodes the peptide sequence at SEQ ID NO. 4458
ccgcaccaaccacaggtccacaaccccctgcggcgcacgcgcagcagcgcctcgcttctcctgctcctcctcctcctcctcagctcgctccctctcccacactctccacagaatttccgctccctcctcgtctcctcccgcgccgacgcgaggtgggttagggctccgactccgaagggcggcgcaatggcgacggcgggggtggcggtggccaacggctccggcggcgccgacacgaaggccgcgttcaaggagatatacagcaagctcaaggaggagatgctcgaggaccccgccttcgagttcaccgacgagtcgctccagtggatcgaccgcatggtggattacaatgtgctcggaggaaagtgcaaccgcgggctctcagtcattgatagctacaagatattgaggggtgtcgatgttctgagcaaggaggagacatttctggcctgcacccttggttggtgtattgaatggcttcaagcttattttctggtgctggatgatatcatggacaactcccagacacgacgtgggcagccttgctggtttagggtgcctcaggttggcctcattgctgtaaatgacgggattatccttcgcaatcatatttcacggatccttcaacgccacttcaaaggaaagccctattatgttgatctcattgatttgttcaatgaggttgagttcaagactgcttcagggcagttgttggatcttatcactactcatgagggtgaaaaggacctaagtaaatataacttgacggttcaccgacgcatcgttcagtacaagacagcctactattcattttatctccctgtcgcatgtgcactgctgctggctggtgagaacttggataactttggtgatgtaaagaacattcttgttgaaatgggaacatattttcaagtccaggatgattatctagattgttatggtgatcctgatttcattggcaagatcggaactgatattgaagactacaagtgttcttggttagttgtgcaagctcttgaacgtactgatgaggaccaaaagaaaatcctatttgaaaattatgggaagtccgatccagcatgtgttgcaaaggtgaaagacttgtacaaagagcttaatctggaggaggttttccacgagtacgagagggagagctacaccaagctgaccgccgacatcgaggcccagccgaacaaggcggttcagaccgttctgaagtccttcctgcacaagatctacaagagggacaagtagaactcagctgcgcgtgtggacaagctgctccacctatgctcgcgtcgttttctacgtgctatgctttctgtgtttcgttttcacgctgtaccgtactcccagtttatatatataatgtaataaagcacatgctcccggtttaacaaaaaaaaaaaaaaaaaaaaaaaaaaaaaaa

SEQ ID NO: 4458 - protein, 355 aa, Panicum virgatum
  misc_feature: Ceres CLONE 1805432
  misc_feature: Great-hit functional homolog of the protein sequence given in SEQ ID NO 9592
  misc_feature (1)..(272): Pfam Name: polyprenyl_synt Pfam Description: Polyprenyl synthetase
  misc_feature (7)..(355): SWISSPROT Homolog: FPP synthetase Farnesyl pyrophosphate synthetase
  misc_feature (8)..(355): SWISSPROT Homolog: FPP synthetase 1 Farnesyl pyrophosphate synthetase 1, mitochondrial precursor
  misc_feature: Useful for making plants with modulated salt sensitivity
MATAGVAVANGSGGADTKAAFKEIYSKLKEEMLEDPAFEFTDESLQWIDRMVDYNVLGGKCNRGLSVIDSYKILRGVDVLSKEETFLACTLGWCIEWLQAYFLVLDDIMDNSQTRRGQPCWFRVPQVGLIAVNDGIILRNHISRILQRHFKGKPYYVDLIDLFNEVEFKTASGQLLDLITTHEGEKDLSKYNLTVHRRIVQYKTAYYSFYLPVACALLLAGENLDNFGDVKNILVEMGTYFQVQDDYLDCYGDPDFIGKIGTDIEDYKCSWLVVQALERTDEDQKKILFENYGKSDPACVAKVKDLYKELNLEEVFHEYERESYTKLTADIEAQPNKAVQTVLKSFLHKIYKRDK

SEQ ID NO: 4459 - DNA, 1035 bp, Panicum virgatum
  misc_feature: Ceres CLONE 1805465
  misc_feature: Encodes the peptide sequence at SEQ ID NO. 4460
gataaaagcagccaagccgctggtggccactaatccatcccgcgctgcaacctgcaagctgccatccatccattccattcgcatccaatggcgctctcgctctccctgaagccgccagtagccgcatcagccgccgccggcagcagcagcagcagcagcagcagctgcccgagcttcctgcggccggcggcggtggcgatgaggcgtggtcggagcagtagtgcgcgcggcagcgtggtggcgatggccgacctgctgggcgacttcggcgcgcgcgatcccttcccggaggagatcgagagcaagttcggggagaaggtgctgggcaacgtggacaccctccaccagatcctcatcccgaccctgtcggctctctcgctggctcgcctcccgctgcagcccgacgcggaggcgctctccctggacgatgcgcgcaggctgctcctcaaggtggtcgggtggaggctgctgctctccgacgacgagcagcggcccgcgcggctgcagtgcgtctggaaggtacgcgacgagtcctgcggccaggagctcatcgccaggatcaacgcagcgctcgacggtgccggccacgcgccggcagcactggtctgggaggcccccagccaggtgagggccgagctctcaacgccctccgccgccggtgacagcctcaccgtcaacgactacatcgtcgccgccaggatagacaaagtcaagacgctcgatcttatccccaagaagcgagtatgggcatgaatggcaattgatcttacattttctatcccttcaattaattaattagaattacttgcccacttgaatttattggttgtattaattgtactttcaattcctcctgcgggctgccatgtgtgtattgtacttgcaattactgagtagagaaaaaaaaataatttactcatgaagaaccaagagcggcctgcacatcacacatgacacatattcaatctagtttgctctcaaatcagcgggcgactgctgtaggcagccttccaacaaaaaaaaaaaaaaaaaaaa

SEQ ID NO: 4460 - protein, 221 aa, Panicum virgatum
  misc_feature: Ceres CLONE 1805465
  misc_feature: Great-hit functional homolog of the protein sequence given in SEQ ID NO 9689
  misc_feature (2)..(52): Pfam Name: Pterin_4a Pfam Description: Pterin 4 alpha carbinolamine dehydratase
  misc_feature: Useful for making plants with altered alkaloid content
  misc_feature: Useful for making plants with altered terpenoid content
MALSLSLKPPVAASAAAGSSSSSSSSCPSFLRPAAVAMRRGRSSSARGSVVAMADLLGDFGARDPFPEEIESKFGEKVLGNVDTLHQILIPTLSALSLARLPLQPDAEALSLDDARRLLLKVVGWRLLLSDDEQRPARLQCVWKVRDESCGQELIARINAALDGAGHAPAALVWEAPSQVRAELSTPSAAGDSLTVNDYIVAARIDKVKTLDLIPKKRVWA

SEQ ID NO: 4461 - DNA, 1153 bp, Panicum virgatum
  misc_feature: Ceres CLONE 1805469
  misc_feature: Encodes the peptide sequence at SEQ ID NO. 4462
gactccccggcgtccttaatcaaaaaaaaaaaaagactccccggcgtccccgctcctctcggctcccgaagacatggcgatgggggctagggtttcctagtgccgccccatccatggcctcctccgctcagctctccgctccaccctgccggtagatcgagtcttctagtgcgtcagcgcatttggatctctaggcgtgcgcgaggagacaaggggcctgggcagcggcgagcagattgacaccctcctccccatcggcgacctccctctttgtcgagcatcagcgaataggggccgtccccttccgcagcttcactccccaccagggattcgacaccgtctgcgcctccttcctgttctggtgtcagcgtcactgcaacagcaagatcggtgccccgacgtccccatcgacgacctccctcaaccgcacggtctcagcttcgtttccacaacgcttggcctgagaatgcaagaccctaacagcgacgatttctctgccacaaagctgcacaagaagaaggttgtataccggctgcttccatctggcatgctgaagggtgaacctgaactgctgcgtagagagggtccgcattcatcaggcatggtccataagccacccaaaagaagcttgaagagtgagtgccctgccacacctccatctgacagagggactcctgattccctgctggactccggtcctactgatgaataccgtgctttgcggaggaaatacatgatgctggaggaagagaactttgccctggaccaagaactgagcatggaagatgaggaaatcaaggcacttgaggaggaaaagcttgcgtttcttgatgagcttgttgtattggaaggccttgttgagccgtcgcagctgcagtctcaccgtaggccatgagtgtagtattttggtttctgtgatcgttgtcgttcagtgcaattcagtaaccggtacctgttaatactttctggatgtggaaattgtatttgaaacagcataaacctgttatgaatcgaaaccccttagatgaatgcttgcagggtcagcgacttgtgttttgtgtaacatgatattacaataggatgaaaatttggttgcaagggtaattcatagtgcttatgaagcctgattggctaaaaaaaaaaaaaaaaaaaa

SEQ ID NO: 4462 - protein, 142 aa, Panicum virgatum
  misc_feature: Ceres CLONE 1805469
  misc_feature: Great-hit functional homolog of the protein sequence given in SEQ ID NO 9380
  misc_feature: Useful for making plants with modulated nitrogen use efficiency
MQDPNSDDFSATKLHKKKVVYRLLPSGMLKGEPELLRREGPHSSGMVHKPPKRSLKSECPATPPSDRGTPDSLLDSGPTDEYRALRRKYMMLEEENFALDQELSMEDEEIKALEEEKLAFLDELVVLEGLVEPSQLQSHRRP

SEQ ID NO: 4463 - DNA, 976 bp, Panicum virgatum
  misc_feature: Ceres CLONE 1805470
  misc_feature: Encodes the peptide sequence at SEQ ID NO. 4464
agatccacccatccttccggaggcgagcagaaaaatctccccacccaaaaaaatccccaaaaccctaggcctcggatctcccgatctgcgatggcgaacccccgcgtgttcttcgacatgaccgtcggcggcgccccggccggccgcatcgtcatggagctctacgccaacgaggtcccccgcaccgccgagaacttccgcgccctctgcacgggcgagaagggcgtgggcaagaggggcaagccgctccactacaagggctccaccttccaccgcgtcatccccgacttcatgtgccagggcggcgacttcaccaacggcaacggcaccggcggcgagtccatctacggcgagaagttcgccgacgagaagttcgtccgcaagcacacgggccctggggtgctctccatggcgaacgccgggcccaacaccaacggctcccagttcttcatctgcaccgtgcccaccccgtggctcgacggcaagcacgtcgtcttcggccaggtcgtcgagggcctggacgtcgtcaaggccatcgagaaggtgggctcccgcagcggcgccaccgccaaggtggtccagatcgcagactgcgggcagctcgcctagatccccggtcggatctgtctgcccggcctgccgccctccgtcgtcgtcggttccgccttcgtccgtcccttccattcgctctattacctctgaataagacgatggtgatctgagaggtggtctgagttgagtcgcgtcgtgtcgtgtcgaatcgtttatcgtggtttaattaggggtttgggtgctggatctgcgaatcagcatgtggtggatggtgtctctgcctaatccgtgtttctgctgttatggtatggtctccgaggatgagaactggaacttccctttagtgtttcggaattgttctacttgtgtgatgcgccttcgtgaaattttaatttattttgatcaaaaaaaaaaaaaaaaaaaa

SEQ ID NO: 4464 - protein, 172 aa, Panicum virgatum
  misc_feature: Ceres CLONE 1805470
  misc_feature (1)..(167): Pfam Name: Pro_isomerase Pfam Description: Cyclophilin type peptidyl- prolyl cis-trans isomerase/CLD
  misc_feature (1)..(172): SWISSPROT Homolog: EC 5.2.1.8 Peptidyl-prolyl cis-trans isomerase
MANPRVFFDMTVGGAPAGRIVMELYANEVPRTAENFRALCTGEKGVGKRGKPLHYKGSTFHRVIPDFMCQGGDFTNGNGTGGESIYGEKFADEKFVRKHTGPGVLSMANAGPNTNGSQFFICTVPTPWLDGKHVVFGQVVEGLDVVKAIEKVGSRSGATAKVVQIADCGQLA

SEQ ID NO: 4465 - DNA, 1269 bp, Panicum virgatum
  misc_feature: Ceres CLONE 1805473
  misc_feature: Encodes the peptide sequence at SEQ ID NO. 4466
ggaaccggcactgattgaagaaccacacgcggagaaaggggggagaccaagaacaagcaagccatggagctcaatcaagcagacgaggttctatcttctccgcttgctccaaatgcaaaggacaatctcagcatgatgcactcaaagtttatctgctgcaagctctacatttctgaaagctgcaatcccacagctattgccgcaattgatcttgcagcaaagactgatcctcaggttgcggtgctaagcaagttcgtagatagcctctacaaccgcgtacgctacacacttgtctcctatattatcgatgacagctcaaccggtgaagtgatatatagtccaatcaggaaggtattgttggcgatgatggaggctgcattttcagccataaaccttgaattgcactccggtgctcatcctagaatgggtgtcaatgatgacctgtccttccaccccctgggtcaagccacaatggaggatgcagcttccttggctaagcagctggcttctgacattggcaatgattttcaagtgccagtgttcctctatgcagcagcccatcccacaggcaagtctgtaggtgcaatacggcgtgagctcggctactaccggccaaatcacatgggcaaccagtggtcaggggccacaacagttggcgcgacaccttttcttgagggatacaatgtgccagtgctctcaaaggatgttgcaactgtgaggcggattactcgaagattaagcggacgcggtggagggcttccgactgtgcaagctcttgcgcttctccatggtgatgattgcacagagatcgcatgcttgttggatccagatcatgtcagtgcctatcaagttcagaccgtggttgagcagattgcagcagagcaagggctcgaagttgagaaggggcacgtactcatataaccatgcccagcgaaagggggagacgaagaggaacaaggcacggaaccaaatcactcaagcaagtggtaggcgacgttcccgtcgacagcggatcgtctgtggtgacttcgtcaatctcgaggatttgccggctcagtctctcggagatgctcataggggtatggttgcgtgcgtatattcatagggatgagtgtgcgtgcgtgtttgtgagcgtatgtgtctgtactgtgtttctaaaaaacatattataggacaaaggattttaaacgaaaaaaatccctacatgatgtcaccatgtcacctcatcaatcgaagtggagtattttggaaaaaaaaaaaaaaaaaaaa

SEQ ID NO: 4466 - protein, 285 aa, Panicum virgatum
  misc_feature: Ceres CLONE 1805473
  misc_feature (1)..(166): Pfam Name: FTCD_N Pfam Description: Formiminotransferase domain, N-terminal subdomain
MELNQADEVLSSPLAPNAKDNLSMMHSKFICCKLYISESCNPTAIAAIDLAAKTDPQVAVLSKFVDSLYNRVRYTLVSYIIDDSSTGEVIYSPIRKVLLAMMEAAFSAINLELHSGAHPRMGVNDDLSFHPLGQATMEDAASLAKQLASDIGNDFQVPVFLYAAAHPTGKSVGAIRRELGYYRPNHMGNQWSGATTVGATPFLEGYNVPVLSKDVATVRRITRRLSGRGGGLPTVQALALLHGDDCTEIACLLDPDHVSAYQVQTVVEQIAAEQGLEVEKGHVLI

SEQ ID NO: 4467 - DNA, 1326 bp, Panicum virgatum
  misc_feature: Ceres CLONE 1805477
  misc_feature: Encodes the peptide sequence at SEQ ID NO. 4468
atgccaccaagtcagtcatcactctcctccatcagtgatcacttggtagtcttccttgagctctcgcgaccggcgcctcccaccgtccctcagtagtagtgatcagtccgtcgcaatggcatccgctggcgtcatctccacgctcctggcgcctccccttgtccactcctcccccgtcgcctccgcctctccgctcccggcgcacgcgctcccatccctccgccgccgcccccggtccctgcccacggtccgcgccgtccagacgcagggggcgggtgtccagacgcagcagggcggcgccgcccggaagggcgccatccagcgctggaccagcgcgcccgtcgccgccatcggccccgccaccgacgacgagtccatcttcctcatcaccctcgacctctccggcgccccggcgctcgtggacgcgtacacgaccccagggcagtacctcctggcccgcgtcccctccggggagaagctctccccggcgtacatgtgcatctcctcggcgccgcgctccgggctccagttcgatctgctcgtcaagcccgtgccggggaccacgtcggagcagctgtccaagctccgcgtcggcgaggttgtggagctcggccccgtcatggggcgcgggttcgccatccagcacataaacccgccggcggcggcggagaccctgctcctgttcgccgtcggggtggggatcagtccgattcgttcacttatcgagtttggtattgctgcctctgaaagaaataatgtgatactttattatgctgccaaagatctgcaatctatgccataccaggaccgtttcaagaaatgggagaacactggagttaaagtagtaacgcggacacaacaaattctggaacctttcttggaacagaacctgggtgagatagcagtaaatccactttctatgggagccgtaattgttgcaccgccttcatcgaaagagctaatcaccggagtccttttagacattggcgtgccacatgataaaatcttatcgatcgagtggtctcccgaggatcctttcgcccccaatgtctaggtgttattcatcaggggcacttacgggcttcgacaatggatgcttttacagtggagtgatgagaatcaggaacattgaataacgcttgtcgcactatggaggcgatggctatgtttgtaatcctgataattagtgctttgaataagctaagccagcgttcgtgccatggctgagcatgtttgtagtgcttgacgcatgcacgttcatgcggagcgcgcctaataagtcgttagatcatctccaagtgtgcccaaaaaaaaaaaaaaaaaaaa

SEQ ID NO: 4468 - protein, 312 aa, Panicum virgatum
  misc_feature: Ceres CLONE 1805477
  misc_feature (2)..(102): Pfam Name: FAD_binding_6 Pfam Description: Oxidoreductase FAD-binding domain
  misc_feature (1)..(57): Pfam Name: NAD_binding_1 Pfam Description: Oxidoreductase NAD-binding domain
MASAGVISTLLAPPLVHSSPVASASPLPAHALPSLRRRPRSLPTVRAVQTQGAGVQTQQGGAARKGAIQRWTSAPVAAIGPATDDESIFLITLDLSGAPALVDAYTTPGQYLLARVPSGEKLSPAYMCISSAPRSGLQFDLLVKPVPGTTSEQLSKLRVGEVVELGPVMGRGFAIQHINPPAAAETLLLFAVGVGISPIRSLIEFGIAASERNNVILYYAAKDLQSMPYQDRFKKWENTGVKVVTRTQQILEPFLEQNLGEIAVNPLSMGAVIVAPPSSKELITGVLLDIGVPHDKILSIEWSPEDPFAPNV

SEQ ID NO: 4469 - DNA, 1708 bp, Panicum virgatum
  misc_feature: Ceres CLONE 1805486
  misc_feature: Encodes the peptide sequence at SEQ ID NO. 4470
agcccctgttcctccccccgcaccagcgccaccgccgaatcgaatccgagactccgatctcggattcgccgccgccgtccccgccgcgcccagcgttcgtcgccgtcgccgtcgccgtccccgccgcgcccagcgttcgtcgccgtcgccgtcgccgtcgccgtcgccgtcgcctcgctctcctcctccccgcagctcgtcagccatggcaggactagcaccagagggttcccagtttgatgccaagcagtatgacaacaagatgcaggagctactgactgaagacttctttaccacctatgatgaagtcgttgaaagtttcgataacatggggctccaagagaaccttctgagaggcatctatgcctacggttttgagaagccatcagccattcagcaaaggggaattgttcccttctgcaaggggcttgatgtgattcagcaagctcagtctggaacagggaaaacagctacattctgttctggaattttgcagcagcttgattatggattggttgagtgccaggcattggttcttgctccaacccgtgagcttgcgcagcagattgagaaggtcatgcgtgctcttggggactatttgggtgtcaaagtccatgcctgtgttggtggaacatctgtccgtgaggaccagaggattcttgctagtggtgtacatgttgttgtgggcacaccagggcgtgtgtttgatatgttgcgtaggcagtctctacgcccggacaacattaagatgtttgtgttggatgaagctgatgagatgctctctcgtggtttcaaggatcagatctatgatatcttccagcttcttccatcaaagatccaggttggcgtgttctctgctaccatgccccctgaggcccttgagattacccgcaagttcatgaacaagcctgtcaggatccttgtcaagagagatgagctcacccttgagggtatcaagcagttctatgtcaatgtggagaaggaagattggaagctggacactctctgtgacctgtacgagaccctggccatcactcaaagtgtcatctttgtgaacacccgccgcaaggtggactggctcacagataagatgaggagcagggaccacaccgtctctgccacgcacggtgacatggatcagaacaccagggacatcatcatgagggagttcaggtccgggtcttcccgtgtgctcatcaccaccgacctgcttgcccgtggtattgatgtccagcaggtttccctggtcatcaactacgacctgccgacccagcccgagaactacctccatcgcattggccgtagtggtcggttcgggaggaagggtgttgccatcaactttgtcacccgtgacgacgagcggatgctgtttgacatccagaggttctacaacgtgaccattgaggagctgcctgccaacgttgctgatctcctctagattgtgtcctaggatattgctgctaaggtgctggataaagaagcctgttttagttaaatatcgcaaacttttctctttcctggaggagtggtaatgtcgtgttatcaactatttgcattgtggctaaggatggtttctaagcttttcttctatgcaacgtttgggaaaaattttgtagcgtgtaggtctgtgtgccgcatcctgggctagctgggtgctgagacactactggagtatttaccttgctgttaagctatgcttgtcctgagt

SEQ ID NO: 4470 - protein, 410 aa, Panicum virgatum
  misc_feature: Ceres CLONE 1805486
  misc_feature: Great-hit functional homolog of the protein sequence given in SEQ ID NO 9452
  misc_feature: Great-hit functional homolog of the protein sequence given in SEQ ID NO 9577
  misc_feature (1)..(77): Pfam Name: Helicase_C Pfam Description: Helicase conserved C-terminal domain
  misc_feature (1)..(167): Pfam Name: DEAD Pfam Description: DEAD/DEAH box helicase
  misc_feature: Useful for making plants with altered Lignin content
  misc_feature: Useful for making plants with altered alkaloid content
  misc_feature: Useful for making plants with altered terpenoid content
MAGLAPEGSQFDAKQYDNKMQELLTEDFFTTYDEVVESFDNMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 4471 - DNA, 1248 bp, Panicum virgatum
  misc_feature: Ceres CLONE 1805494
  misc_feature: Encodes the peptide sequence at SEQ ID NO. 4472
atcgacagcagagctcgcaaaacctccacaccttcctgaaatagccactagctttagctgctcgccgggttctctgatcactctcgctctcgggctcatccttcctcgcgatccatataggttgctagctaccagctccattaactgatggactttgacctgctgaattacagcccggaagcgcagctggagctgatgaacacgatgctccagctggagcagctcaccaagctcgacggcggccatcagtcgctgatggcggcgcccgtctcgccgccggtatccccagtgcaaacccatgcaacagcccactgcttctcgcctccgccccacgtgtcggcgaccgccgcctaccaggaccagtacacaccgccggccgtgtacgccggcaggaccggcgccctcgagcatctccaggtggactacgcgctgtccccgtgcgccgacggcggcggcgccgcgccgcagccggcggggtcgccgtcgccgacgtcgtcggcggacgcgatgcgggaggcgatcttccacatcgcggcgctacagccggtggagatcgaccaggaggcggtgcggcccccgaagcggcgcaacgtgcgcatctccaaggacccgcagagcgtggcggcgcggctgcggcgggagcgcatcagcgagcgcatccgcacgctgcagcggctcgtcccgggcggcaccaagatggacacggcgtcgatgctggacgaggccatccactacgtcaagttcctcaagtcccaggtgcagtccctcgagcgcgccgccgccgccgcccaccaccgcgccgccgcgctcggcgccgccttccaccccgccgccctccacgcgcagtggcagttcgcgctcccccacggcgacatgtgacacagttaccgtcgagcgcgcgcgtcggttcgccgctggcgtcttcccgatcgggcgacgacgacgacggcctctccatctgccgccgccgattcttctgctgtagtgttgtgtgtgcatcgtcgatctgtacatgatcacatgcgcgtgtatagagatgtaggagagccttcggtacattctagtattattgttgtagccgcatacgacgtggctgctccaattttttgttggagccgcagcccgtgcatgcgcgcgcgtacgtgcccagtgccctaccctacgtagtaggctgtacatttccttgtaccattttttcttcttctatctatccgtcagttcgttgcttaaaaaaaaaaaaaaaaaaaa

SEQ ID NO: 4472 - protein, 243 aa, Panicum virgatum
  misc_feature: Ceres CLONE 1805494
  misc_feature: Great-hit functional homolog of the protein sequence given in SEQ ID NO 9761
  misc_feature (1)..(48): Pfam Name: HLH Pfam Description: Helix-loop-helix DNA-binding domain
  misc_feature: Useful for biocontainment applications
MDFDLLNYSPEAQLELMNTMLQLEQLTKLDGGHQSLMAAPVSPPVSPVQTHATAHCFSPPPHVSATAAYQDQYTPPAVYAGRTGALEHLQVDYALSPCADGGGAAPQPAGSPSPTSSADAMREAIFHIAALQPVEIDQEAVRPPKRRNVRISKDPQSVAARLRRERISERIRTLQRLVPGGTKMDTASMLDEAIHYVKFLKSQVQSLERAAAAAHHRAAALGAAFHPAALHAQWQFALPHGDM

SEQ ID NO: 4473 - DNA, 1286 bp, Panicum virgatum
  misc_feature: Ceres CLONE 1805496
  misc_feature: Encodes the peptide sequence at SEQ ID NO. 4474
agctgcgaagcaaaccaattcgctcggttccggcgagggcctcctttcctcggaatgccctgcccccgcggccagacggagggggatcactaggcggcggcggcggcggctcgggatgaggcggccggggtacgtgacggtgccgatactcaccgtgatcgccgcaatcgggtacgcctactacaccacggtgttcctcgcgatccccgcgtggctggggctctccacggccgctgggggcgccaacgccgcggccttcaccgcgctcgccgccgcctgcgtcgccacctacgccgtcgccgtgtcgcgggacccgggccgcgtgccggcatccttcgtgcccgacgtcgaggacgccgagagccccatccacgagatcaagcgaaagggtggtgatttgagatactgccaaaaatgttcccattataaacctcctcgagcgcaccattgccgtgtctgcaaaagatgcgttctgagaatggaccaccactgtatatggattaataactgtgttgggcacgagaactacaagatctttctagttttcattttgtatgctgtaattgcatgcttctactctatggttctgattatagggggtgctatgcatttgcctaaagatgaacaaccaggcagtgattctcctaggacatctattattgtttgcggggttcttctgtgtcctttagctttggcactgatggtcctattgggttggcatgtttacctcatcttacacaataaaactactattgagtaccatgaaggagttagagctatgtggttggctgaaaaagcaggaaacctttatcatcatccttataaccttggagtctatgagaaccttgtttcggtactaggtcctaatatgctctgctggctttgcccattatcaaggagcataggaaatggtgttcgtttccgcacatcatatgacattctgccatcaacatcgccaatataatgcaaaccagatcactacaagtggtagatgccctattcttttgcagagtgctgcaatgggaaaatgtgtttaggatacttcaagaaacaagaagaggagcttcgctgtcctttaagcctcgtgggatcaatcgctaattaggatttaggaattctaacttagatttttgttgcatttttgttagataaacttgatcaaagaagtcatcattgcttgtgcagtaatctacagcgggttgtactataataccaaaacaagaacagtctgaactcgaggctggtcttgttgtaaagctatgttaaactgttgttttctgaagttc

SEQ ID NO: 4474 - protein, 282 aa, Panicum virgatum
  misc_feature: Ceres CLONE 1805496
  misc_feature (1)..(65): Pfam Name: zf-DHHC Pfam Description: DHHC zinc finger domain
MRRPGYVTVPILTVIAAIGYAYYTTVFLAIPAWLGLSTAAGGANAAAFTALAAACVATYAVAVSRDPGRVPASFVPDVEDAESPIHEIKRKGGDLRYCQKCSHYKPPRAHHCRVCKRCVLRMDHHCIWINNCVGHENYKIFLVFILYAVIACFYSMVLIIGGAMHLPKDEQPGSDSPRTSIIVCGVLLCPLALALMVLLGWHVYLILHNKTTIEYHEGVRAMWLAEKAGNLYHHPYNLGVYENLVSVLGPNMLCWLCPLSRSIGNGVRFRTSYDILPSTSPI

SEQ ID NO: 4475 - DNA, 1308 bp, Panicum virgatum
  misc_feature: Ceres CLONE 1805523
  misc_feature: Encodes the peptide sequence at SEQ ID NO. 4476
tctcgctttcgctcgccatccgcacacccgccccgccctcgcgagtcgcgatgccttcgctcgccacggccgcggccgcggccgcgtcggcgcctctccaccgccgcgcctgcgcgcgtcagcacctccctccggcctcccgctgcttcctcccctcccgcgcgctcctcaattccgcgcgcctcttcaccgccccggtcccgctgcccgtccacgcgccgagggtgccgcccacggcggcgagggcggccagccccgacgccgcggccgcgagatcgcccacatcaggcggacagatgctggtgttcgtcccgccgcacccgctgataaagcactgggtttctgtcctgcgcaacgagcagacaccctgctccatattcaagcttggtcgtctactcatatatgaagcatccagagattggttgcctacaatcacaggagagattgaaacacctgtagctgtagctagcgttgaatttattgatccaagagagcctgttctggttattccaatactgagagctggtcttgccctagccgaacttgcttcatcagttctgccagccactaagacctatcaccttggccttcgtagggatgaagaaacacttcaaccttcaatatatctgaacaacctgccagacaatattccagaggggtctcgagtgctagttgttgacccaatgctggccaccggtgggacgatcgttgctgctattgacttgttaatcgaatgtggagttaccagcaagcagattaaagtagtatctgctgttgcagcacctcctgcgctgcaaaagctcaataacaagttccccgggctccatgtgtacacaggaacaatagatcctgaagtaaacgagaaaggttttataattccagggttgggagatgctggtgacagaagctttgccacataatctgaccgcacaatttgattcagccagccatctaccatcgagtatatttgcatcagttccataagaacggagcaactgcgagtaaagaggctttcattgctgtagatgccctcatttgagattttgttcattctctgtaatacaattagctgaccaccattttgtaactaaccattatgtattattgtgtagaatataaggctagttcagatctctccagatggaaaaatctttttgaaaggacaacgctcctttcaaaatggcgcatgctggattagtgaattggcgcttcctaatatttctcctgtcgaaggaataaaaccatctcatcatgtttcacttttttataatcaagtttgggtgtgtttaaaaaaaaaaaaaaaaaaaa

SEQ ID NO: 4476 - protein, 289 aa, Panicum virgatum
  misc_feature: Ceres CLONE 1805523
  misc_feature (72)..(289): SWISSPROT Homolog: EC 2.4.2.9 Uracil phosphoribosyltransferase
MPSLATAAAAAASAPLHRRACARQHLPPASRCFLPSRALLNSARLFTAPVPLPVHAPRVPPTAARAASPDAAAARSPTSGGQMLVFVPPHPLIKHWVSVLRNEQTPCSIFKLGRLLIYEASRDWLPTITGEIETPVAVASVEFIDPREPVLVIPILRAGLALAELASSVLPATKTYHLGLRRDEETLQPSIYLNNLPDNIPEGSRVLVVDPMLATGGTIVAAIDLLIECGVTSKQIKVVSAVAAPPALQKLNNKFPGLHVYTGTIDPEVNEKGFIIPGLGDAGDRSFAT

SEQ ID NO: 4477 - DNA, 1520 bp, Panicum virgatum
  misc_feature: Ceres CLONE 1805527
  misc_feature: Encodes the peptide sequence at SEQ ID NO. 4478
acccaaccagacccgccccactgaacgagacgagaaggcgtgtcgccggcggaaggcgacccgcccgacccaacactccccagcctgccagccatgtcggcgcgtgaccgcgagacggccgaggcgctggtgcggctcgctgcctcgctggacggggcggtgctcggcctcggcacggcggccgtcgcagtagcgtcatgggtcaagtacctcgccgtctcggggcagctgcgcctcgtcgcctccgcggcggcgtcctccatctccgacctccactccctgctccctggcagcggcggagagccgcggctcgcggcggtgcgggactacgtgcgccccaaaccggggggcacgatcctccgcaccccgttctccggggagcacggggtcgtcaccaagcacacccagatgtgcttgttcacggaatggagaggcatctttggatggacctttgatctgcatgctcttcttttcagatcatggaaggaacagattgtaacatcttttagaacggttccgtttgttcttgccagttctgagattggaaaccctattgggatggtttatatcaatgtagagaaggcggatcaaccattacctcttacaactgtgtttcataaacttatcccaattgagacaactccttacacattgtttcaaactattattggcaatggctatcccattgcattattggatgaagaaaaaatactaccaattggaaaggagcttacagcaataggactatgtcgagcaaaggatgaaagtgttgagatcagctcatgcccagatctcccctttttcttatctgagctgaccaaggatgagatgcaagctcagctggcttcgcgtgctaggacactcttttggggtagtattgttttgggaaccttgtctgtttgcctaatgggccgtgccatttacaggtgctggaagagaatcaaactgcggagagaggctaggcaagcacaacagttatttgaggatgctgaagatgctattcaagaaggtgactccagtgatgaagaagtaggggacgggcagctatgtgttgtgtgcttaaggaggagaaggaaagcagcttttattccttgtgggcatcttgtctgctgttgcaaatgtgcattaagaatggaacgtgaggctgaaccattgtgcccgatgtgtcggcaggacatcagatacatgatgaggatttatgactcttgaggtccctttgctgataaaatctctgacactggcaggtcctttttactagctgtccctgcaaacatgaggagcacaactggttatcgtcctggacattttcctagtctagactactacctaaccggctgccatggatttgtgaatatataaaaagtttgaacccctcccaagttatgctcttggccgcgtaggactctacctggcttatcctctttttctttgcattgcacatatgtttgcccatcatgtaaacattgagttagctgtaaagataaggctaaaaaattggtcaaaaaaaaaaaaaaaaaaaa

SEQ ID NO: 4478 - protein, 371 aa, Panicum virgatum
  misc_feature: Ceres CLONE 1805527
  misc_feature: Great-hit functional homolog of the protein sequence given in SEQ ID NO 9614
  misc_feature (1)..(40): Pfam Name: zf-C3HC4 Pfam Description: Zinc finger, C3HC4 type (RING finger)
  misc_feature: Useful for making plants with altered alkaloid content
MSARDRETAEALVRLAASLDGAVLGLGTAAVAVASWVKYLAVSGQLRLVASAAASSISDLHSLLPGSGGEPRLAAVRDYVRPKPGGTILRTPFSGEHGVVTKHTQMCLFTEWRGIFGWTFDLHALLFRSWKEQIVTSFRTVPFVLASSEIGNPIGMVYINVEKADQPLPLTTVFHKLIPIETTPYTLFQTIIGNGYPIALLDEEKILPIGKELTAIGLCRAKDESVEISSCPDLPFFLSELTKDEMQAQLASRARTLFWGSIVLGTLSVCLMGRAIYRCWKRIKLRREARQAQQLFEDAEDAIQEGDSSDEEVGDGQLCVVCLRRRRKAAFIPCGHLVCCCKCALRMEREAEPLCPMCRQDIRYMMRIYDS

SEQ ID NO: 4479 - DNA, 1500 bp, Panicum virgatum
  misc_feature: Ceres CLONE 1805537
  misc_feature: Encodes the peptide sequence at SEQ ID NO. 4480
tggaaatttccccatttccatctctcctctccgccgagtgcaaggaagtgaggaaaccaccaccccggagccgcaccgaccatggccaccggcgacatgcgcctctccgtcgcgcatcagacccgcttcgcgctccgcctcgcctctgcactctcctccccttcctcttccagcaacaccgtcttctctccgctctccctccacgtcgcgctcagcctcctcgccgccggcgcgggcggcgccacgcgcgaccagctgctcgccgcactcggcggaggaggtgggatgggcgcggccgatagtctgcacgcgctcgccgagaaggtagcgaagctcgtgcttgccgacgggtccgaggcgggcggcccgcgtgtcgccttcggcaacgccgtctttgttgacgcgtcgttgaagctgaagccggcctttgagaaggccgccgtgggaaaatatagggctgaggcccagtccgtcgacttccagaaaaaggctgcacaagttgctggtcaagtgaactcatgggtagagaaggtcacctcaggtctaatcaaagagcttctgccaccaggctctgttgatggaaccaccaggctggttcttggcaatgcactctatttcaaaggagcttggactgagaagttcgatgcatccaaaacgacagatagtgagttccaccttcttgatgggagctcagttcaagcaccattcatgtccagcacagacgaccaatatattgcatcttacggcgactttaaggtgcttaagcttccataccagcaaggtggggacacgaggcagttctccatgtacataattcttccagaattacaagatggtctctggagcttggctgaaaagttgagctctgaacctgagttcctggagaagcatatcccaatgagagcaattcctgttaggcagttcaaagtccccaagttcaagatatcctttggatttgaagcatccgatttgctaagaggtttgggactccatctgccactgagtgcagaagcagatctgtcagagttggttgatttgccagtgggacagaacttgtgtgtttcatccatttttcacaagtcgtttgtggaagttaacgaggaaggaacagaggctgcagccgcatctgctgtacggattatgttctgttcgtatagaatgcctgtggattttgtcgcagatcacccattcctgttcttgatccgagaagataccgctggtgtcatgctgtttgttggccatgtggtcaatcccctatttgctccgtagtgtgtttgttctgaagtctgaggcgctgccttgcggtgattccttccatcgcctcgtgtgtgatctactatatattttgtatctgaataaataagcggcttgatcgatgtatgtaaggttgtgggatgatatattcgataatttctagtatatatctggtgcttggtcatgagatgtgacatgctgcaccgtgcttctggatgcagagaaaaaaaaaaaaaaaaaaaaaaa

SEQ ID NO: 4480 - protein, 395 aa, Panicum virgatum
  misc_feature: Ceres CLONE 1805537
  misc_feature (3)..(391): Pfam Name: Serpin Pfam Description: Serpin (serine protease inhibitor)
MATGDMRLSVAHQTRFALRLASALSSPSSSSNTVFSPLSLHVALSLLAAGAGGATRDQLLAALGGGGGMGAADSLHALAEKVAKLVLADGSEAGGPRVAFGNAVFVDASLKLKPAFEKAAVGKYRAEAQSVDFQKKAAQVAGQVNSWVEKVTSGLIKELLPPGSVDGTTRLVLGNALYFKGAWTEKFDASKTTDSEFHLLDGSSVQAPFMSSTDDQYIASYGDFKVLKLPYQQGGDTRQFSMYIILPELQDGLWSLAEKLSSEPEFLEKHIPMRAIPVRQFKVPKFKISFGFEASDLLRGLGLHLPLSAEADLSELVDLPVGQNLCVSSIFHKSFVEVNEEGTEAAAASAVRIMFCSYRMPVDFVADHPFLFLIREDTAGVMLFVGHVVNPLFAP

SEQ ID NO: 4481 - DNA, 1081 bp, Panicum virgatum
  misc_feature: Ceres CLONE 1805545
  misc_feature: Encodes the peptide sequence at SEQ ID NO. 4482
cttctatttgagccaagctgcaccgggctcgcacgctcccgtctcgtcacccccgaccggcgaccacgatgaagccgcccactcccacctcctacctcctcctcgccccgctcgcgatcctcctcctcgtcttcgtgctccaccctccgtcccgcgccggctccgacggcctcggcgccctctgcgcccgccgcgccggcttcgccgccttcgccgtcgcggcaccggcgcctgaggcgtcgccgccggagcccgagttcagcctgctggtgggagtgctgacgatgccgggccggcgggagcgccgggacatcgtgcggatggcctacgcgctgcagccgccggccgcgcgcgcgcgcgtggacgtccgcttcgtgttctgccgcgtggccgaccccgtggacgcggcgctgctggcggcggaggcccggcggcacggcgacgtggtggtgctggactgcgccgagaacatgaacgacggcaagacgtacgcgtacctgtcctcggtgccgcggctgttcgcggcggcgccgtacgactacgtgatgaagaccgacgacgacacgtacctgcgggtggcggcgctcgccgacgagctccggggcaagccccgcgaggacgtgtacctgggctacggctacgccatgggcgggcagccgatgccgttcatgcacggcatggggtacgtcgtgtcgtgggacgtcgcgcgctgggtggccggcgccgacgagatcctggcgcgcaacgacaccctgggccccgaggacctcatggtcggcaagtggctcaacctcgccggcagggggaggaaccggtacgacctcaagccccggatgtacgacctcaactgggacatggacaacttccggccggacaccgtcgccgtgcacatgctcaaggacaaccgccgctgggcggcggcgttcagctacttcaacgtcaccggcgggatcaagcagccctccgacctgcaccacctcccgtgacccccatcgaccagcaacaaccacctcgattctttctttttcttgttaattattaataataattcgttcgcgatcaaaaaaaaaaaaaaaaaaaa

SEQ ID NO: 4482 - protein, 305 aa, Panicum virgatum
  misc_feature: Ceres CLONE 1805545
  misc_feature (1)..(178): Pfam Name: Galactosyl_T Pfam Description: Galactosyltransferase
MKPPTPTSYLLLAPLAILLLVFVLHPPSRAGSDGLGALCARRAGFAAFAVAAPAPEASPPEPEFSLLVGVLTMPGRRERRDIVRMAYALQPPAARARVDVRFVFCRVADPVDAALLAAEARRHGDVVVLDCAENMNDGKTYAYLSSVPRLFAAAPYDYVMKTDDDTYLRVAALADELRGKPREDVYLGYGYAMGGQPMPFMHGMGYVVSWDVARWVAGADEILARNDTLGPEDLMVGKWLNLAGRGRNRYDLKPRMYDLNWDMDNFRPDTVAVHMLKDNRRWAAAFSYFNVTGGIKQPSDLHHLP

SEQ ID NO: 4483 - DNA, 1291 bp, Panicum virgatum
  misc_feature: Ceres CLONE 1805562
  misc_feature: Encodes the peptide sequence at SEQ ID NO. 4484
acgaaagcgataaggagacgcactaagctgaccgccgcctgcttgctgcccactctcgccggagaaccatggccacgccggcgtgtgtgcgggtagcttctctgttcatgggcgcacctcttcggcccccttgccagacttgccacgttatctctgcgaggcggggggtcaggagggccgggctggcagtctcggcggcggccgcggccggcggtgggtcgccgcccaccgtgctcgtcaccggcgccggcggccgaacaggccaagttgtgtacaagaagctcaaggagagggcgggccagtttgtgggacgagggctggtcaggacccaggagagcaaagccaaaatcggaggtgctgacgacgtgttcgtcggcgacataagggatcctgagagcattgcttctgcgattgagggcatcgacgcgctcatcatcctcaccagcgcggtgcccaagatgaagccggggtttgatcctagcaaaggagggcgccccgagttttacttcgaagaagggagttatcctgagcaggtggattggattggccaaaaaaatcaaatagatgctgccaagagcactggtgtaaagcacatagttttggttggatccatgggcggaacagacatcaatcacccattaaacaagttaggaagtgggaatatactggtgtggaagcgcaaggcagaacagtacctggcagactctggtctgccatatacaattataagggctggaggtttacaagacaaagatggtggcttgcgagagttgattgttgggaaggatgatgagatcctgaaaacagaaacaagaagtattaccagggcagatgttgcagaagtttgcctacaggctttgctatttgaagaggcaaagtttaaggcatttgatctggcatcaaaacctgaaggcgaagggacgccaactacggactttagggccctttttgcacaagttaatagtcgcttctaagaagataagattgttctcgccaagaaatgagagcaactttttatagcgcaatataaatttgtattgagtaagggacctggatccacttaatgttgaggataatatatattgcttacttggcttgtaaaggcataactttggcaaaggtaagctgctggaaactctggaagagcaccttctgctgagaaaaatgtcgatgtatcctgctgagaaaaatgttgatgtatccatatttaggatatgaattttttggttgcataggaacatgaagttcaaacagaaggtgcccaacgcaattataaaaaacacttttgctt

SEQ ID NO: 4484 - protein, 301 aa, Panicum virgatum
  misc_feature: Ceres CLONE 1805562
  misc_feature (1)..(223): Pfam Name: Epimerase Pfam Description: NAD dependent epimerase/dehydratase family
MATPACVRVASLFMGAPLRPPCQTCHVISARRGVRRAGLAVSAAAAAGGGSPPTVLVTGAGGRTGQVVYKKLKERAGQFVGRGLVRTQESKAKIGGADDVFVGDIRDPESIASAIEGIDALIILTSAVPKMKPGFDPSKGGRPEFYFEEGSYPEQVDWIGQKNQIDAAKSTGVKHIVLVGSMGGTDINHPLNKLGSGNILVWKRKAEQYLADSGLPYTIIRAGGLQDKDGGLRELIVGKDDEILKTETRSITRADVAEVCLQALLFEEAKFKAFDLASKPEGEGTPTTDFRALFAQVNSRF

SEQ ID NO: 4485 - DNA, 1080 bp, Panicum virgatum
  misc_feature: Ceres CLONE 1805582
  misc_feature: Encodes the peptide sequence at SEQ ID NO. 4486
gagttctcaacctctgcgctgctgaatcgaaccagaccagaccgccaccgccccacctcgcctcgccggctagcttttcgccgccgcggatttcgccgcgccgccatggacgccgcgcactcgagcagctccgccgccgccggcgaggccccgaccaccggggagcaccggatggggaccaccatcgtcggggtctgctacgagggcggcgtcgtcctcggcgccgactccaggactagcactggaatgtacgtggccagccgtgcttcagacaagattactcagctgacagacaatgtgtatgtctgccgctctggatctgctgctgacacacaagttatttccgactatgtgcgttatttcctccaccaacacacaattcagcttgggcaaccagctactgttaaagttgcagccaacttgattaggttgcttgcttatcagaacaagaacatgttgcaagctggcatgattattggaggatgggacaagtatgagggaggccaaattttttcagttccccttggcggaacaattctgcggcaaccatttgcaattggaggttcgggttccagttacctgtatgcgcttcttgatcatgaatggagagagggaatgagccaggaagaggcagagaaatttgtggtgaaggtagtttcccttgctatggcccgtgatggtgctagtggaggagttgttcgtacagttactataaatgcggatggtgtcaagaggaacttttaccctggtgacaagcttccgctgtggcacgaagagttggagccccagaactcattgcttgatattctcgctgctgggaaccctgaccctatggtgcagtgatttgctcaagtgtctcacacacacctttgtgaaatttcctactgtatgaattgttcaagattttaagtgaagaatttgaaacaattcctgctggtacaccaaagtgtttacttttattattattattattattattattatcacgccttagtaaattcctattcggcagattgtgataggtgttctgagttgtggttagtaatcagagttaaatgattagctgtttactgtgatgag

SEQ ID NO: 4486 - protein, 245 aa, Panicum virgatum
  misc_feature: Ceres CLONE 1805582
  misc_feature (21)..(243): SWISSPROT Homolog: EC 3.4.25.1 Proteasome subunit beta type 6 precursor
MDAAHSSSSAAAGEAPTTGEHRMGTTIVGVCYEGGVVLGADSRTSTGMYVASRASDKITQLTDNVYVCRSGSAADTQVISDYVRYFLHQHTIQLGQPATVKVAANLIRLLAYQNKNMLQAGMIIGGWDKYEGGQIFSVPLGGTILRQPFAIGGSGSSYLYALLDHEWREGMSQEEAEKFVVKVVSLAMARDGASGGVVRTVTINADGVKRNFYPGDKLPLWHEELEPQNSLLDILAAGNPDPMVQ

SEQ ID NO: 4487 - DNA, 1315 bp, Panicum virgatum
  misc_feature: Ceres CLONE 1805588
  misc_feature: Encodes the peptide sequence at SEQ ID NO. 4488
acaatcagtcctccctcaatacctaccgttgccttctacaactacaatactcccatagttagagacgatggcaaccacagtacgtgagatccggcgtgcgcagcgttctgatggcccagcagctatgctcagtattggcaccgcaaatccagccaactgcgtgtctcaggaggagttccccgattactattttcgtgtcacaaacaaggagcacctcacggacctcaaagatacattcaagaaactatgtcggatcgcggggctggagaaacgcttctttcaccacacggagcaagtgctcaactcccacccgggcttgcttcaggggacgtcctcggctctggactcgcggctcgacgtcgtcgccaaggctgctccagagctcgccgcgtcggccgccgccaaggccatcgcgagatggggccgcccggccaccgacatcacccacctcatcgtaagcaccaactccgaagcccgctcaccgggtgcggacctcgggctggccacgctcctcggcctccgccccgacgtctgccggaccgtgctccagctcaacggctgctcagccggctgcgccgcccttcgcctggccaaggaccatgccgagaacaaccgcggcgcgcgcgtgctcgtggtctgcgtcgagctcaccatcaccacctttcgggccccacacgaaggcgataacttcggcaccctcattccgcaggcgttgttcggcgacggcgcgggcgctgtcatcgtcggcgccgacgccgtgcaacccgccgagcgcccgctcttcgagattgtgtccgcctcgcaggccgtgatacctgggtcggagaagcagctcaacgtgcggctcggggaagtcgggatcgacatcgacatctccttcaacctgccgaagtttgtcgcgcagaatctcgagcgctgcctgcttgatgcgtctggggcgctcgcccttaatggcgtcgagtgtaagtggaacgacctcttctgggcactccatccgggcagccgcgggattctggaccgcgttgagtcggctctcgggctggagcccaagaagctagcggcgagccgaactgtggtgaaagactacgggaacatgctctccgcaacggtgatattcgtgctcgaagagctgcgccggcgaatggatgaggaaggtaatgaggctgcagagtgggggatgatggtgggctttggaccgggattcactgttgagaccatggtgctacacgctacaaagtactagctgttgaagttagaaactgtacaattaatttgcatgttttgattcagaaataaataaagtgaacattttatt

SEQ ID NO: 4488 - protein, 391 aa, Panicum virgatum
  misc_feature: Ceres CLONE 1805588
  misc_feature (5)..(227): Pfam Name: Chal_sti_synt_N Pfam Description: Chalcone and stilbene synthases, N-terminal domain
MATTVREIRRAQRSDGPAAMLSIGTANPANCVSQEEFPDYYFRVTNKEHLTDLKDTFKKLCRIAGLEKRFFHHTEQVLNSHPGLLQGTSSALDSRLDVVAKAAPELAASAAAKAIARWGRPATDITHLIVSTNSEARSPGADLGLATLLGLRPDVCRTVLQLNGCSAGCAALRLAKDHAENNRGARVLVVCVELTITTFRAPHEGDNFGTLIPQALFGDGAGAVIVGADAVQPAERPLFEIVSASQAVIPGSEKQLNVRLGEVGIDIDISFNLPKFVAQNLERCLLDASGALALNGVECKWNDLFWALHPGSRGILDRVESALGLEPKKLAASRTVVKDYGNMLSATVIFVLEELRRRMDEEGNEAAEWGMMVGFGPGFTVETMVLHATKY

SEQ ID NO: 4489 - DNA, 1288 bp, Panicum virgatum
  misc_feature: Ceres CLONE 1805603
  misc_feature: Encodes the peptide sequence at SEQ ID NO. 4490
agcagctagcgagcgctattgctatacccggcgccggcggccggccggatgagcggctgaggcgttgagcaagagcaaccactgcaccgacagaacacatacaccctcggctagctcctggacatttatttaattaattcgccgcgcgccggccggatcttcggccggagatagcagaggcacacatagatgatcccgtacgcgacggcggcggaggcggaggcggcgctggggcgcgccatgacgtgggcggaggcggcgtggttccggtactcggcggcgacgcccgactacttcctctactgccacaacgtggtgatcctgctggtggtgtacacgctggcgccgctccccctggcgctgctggagctccgggcgccgcccaagctcacctcgccgtacaaggtgcagccccgggtgcggctcacggcggccgagttcctccgctgctacaaggacacggcgcgcatgctgctcctcaccgtcggcgcgctccagctcgtctcctacccagccgtcaggatggttggcatccggacgggccttcctctgccgtcggtgggggaggcggcggcgcagctgctggtctacttcctggtggaggactacctggggtactggctgcaccggctgctgcactcggcgtggggctacgacaagatccaccgcgtccaccacgagtacgccgcgcccatcggctacgcggcgccgtacgcgcactgggcggaggtgctcatcctcggcgtgccggccttcgcaggcccggccatggtgccctgccacatgaccaccttctggctctggttcgtcctccgccacgtcgaggccgtcgacacgcacagcggcttcaccttccccttcagcccgaccaagttgatccccttttacggcggcgcagagtaccacgactaccatcactacgtggggaggcagagccagagcaacttcgcctccgttttcaccttctgtgactacatctacggcacggacaaaggttacagataccataagcagagcttagccaagatgaaggacatggagatacacaatgatgagaatggacggcttgatgcattcaacggctggaagcaagattgattagatggcaacttaattcactgccaagttatattagcagtactactgtaggcagcagcgcgctattagctagcgcccatcacggaccacgtggacgccgtatgtatgtccagatccgatcgatccataaatcatcagatgtagcataataacttaatttcccatatataaataataatcttctgatcgg

SEQ ID NO: 4490 - protein, 302 aa, Panicum virgatum
  misc_feature: Ceres CLONE 1805603
  misc_feature (1)..(208): Pfam Name: Sterol_desat Pfam Description: Sterol desaturase
MIPYATAAEAEAALGRAMTWAEAAWFRYSAATPDYFLYCHNVVILLVVYTLAPLPLALLELRAPPKLTSPYKVQPRVRLTAAEFLRCYKDTARMLLLTVGALQLVSYPAVRMVGIRTGLPLPSVGEAAAQLLVYFLVEDYLGYWLHRLLHSAWGYDKIHRVHHEYAAPIGYAAPYAHWAEVLILGVPAFAGPAMVPCHMTTFWLWFVLRHVEAVDTHSGFTFPFSPTKLIPFYGGAEYHDYHHYVGRQSQSNFASVFTFCDYIYGTDKGYRYHKQSLAKMKDMEIHNDENGRLDAFNGWKQD

SEQ ID NO: 4491 - DNA, 1288 bp, Panicum virgatum
  misc_feature: Ceres CLONE 1805614
  misc_feature: Encodes the peptide sequence at SEQ ID NO. 4492
agcaagcaagccactctacttgtagctagctagctagctaagaagagaaggaagaagaagattgctcctctatctaatgagcatgagcatgatgagatgccggtgccagcagcagcaggcgacgactgtcgtcctgctcctcctggccgtgagcgcgagcgcgagcgcgaggcctctgactctgacgactctgggtagtgctagtgccaacgccaacgccaacgctaacgccaacgccaccaacggcctgtccgtctacttccacctcgactcctgcccgcagctggagaccatcgtccgctcccacgtcgacgccgctctccgccagaacgtccgcctcaccgccggcctcctccgcgtcttcttccacgactgcttcccgcagggatgcgacgcctccatcctcctcgacaacggcgagcgcaacctcccgcccaacgtcggcctccagcaggaggtgctgcagctcatcgaggacgcccgggccaaggtgcacgcccagtgcggcgccaccgtctcctgcgccgacatcaccgtcctcgccacgcgcgacgccgtcaacctcgccggcggccccgccttcacggtgcccctcggccgcctcgacagcctggcgcccgcctccgacaacgacgtcttcaagctcccgccgcccaccgccaccgtcgacgacctcctcaccgccttcaccaacgccggcctctccgacccggccgacctcgtctcgctctccggcgcccacaccgtcggcaaggcgcgctgcagctccttcggcgccgtgtccgggcccgcaggcgacgacgtcaccaggtgcatcacggagacctgctcggcggccggcagcgccgaccggctgcgcgacctcgattttctgacgcccaccgtgttcgacaacctctacttcgtcgagctgacgctcaagaagaaccagggggtgatgctgccgtcggaccaggcgctggtcaccgactcgcgcaccagctggctcgtccagggcttcgccgacaaccactggtggttcttcgaccagttcaagacctccatggtgaagatgagccagctcaaggggccccaggggaacgtcggcgaggtccgccgcaactgcttcaggcgcaacgccgccgccggcgacgagggcctgatgctgaccgcatctgcctgatccgatccctgctacttgtactgtttcttgtgtgttttatttatgcatccacgtataacgacgaccacgacgacagtagtacttactccataagacagatgatcgaataaggagtactcctaattc

SEQ ID NO: 4492 - protein, 361 aa, Panicum virgatum
  misc_feature: Ceres CLONE 1805614
  misc_feature (1)..(233): Pfam Name: peroxidase Pfam Description: Peroxidase
MSMSMMRCRCQQQQATTVVLLLLAVSASASARPLTLTTLGSASANANANANANATNGLSVYFHLDSCPQLETIVRSHVDAALRQNVRLTAGLLRVFFHDCFPQGCDASILLDNGERNLPPNVGLQQEVLQLIEDARAKVHAQCGATVSCADITVLATRDAVNLAGGPAFTVPLGRLDSLAPASDNDVFKLPPPTATVDDLLTAFTNAGLSDPADLVSLSGAHTVGKARCSSFGAVSGPAGDDVTRCITETCSAAGSADRLRDLDFLTPTVFDNLYFVELTLKKNQGVMLPSDQALVTDSRTSWLVQGFADNHWWFFDQFKTSMVKMSQLKGPQGNVGEVRRNCFRRNAAAGDEGLMLTASA

SEQ ID NO: 4493 - DNA, 1122 bp, Panicum virgatum
  misc_feature: Ceres CLONE 1805630
  misc_feature: Encodes the peptide sequence at SEQ ID NO. 4494
agctctgacttgtccaccatatcctctcccgagccttgccgttcgttccgccagaattctatccagagaagagaccaccctgctttcgcctccgagcacgtacagctctctgcttcggtctcatcgcgcggaagacctccctgcttcgttctgccggttggcgtttcagctcgggcgatcatcatggggttcccgctggtgagctacgtcctcgccgtgcccaagccggtcgtcgtcttctgcaagatgctcagcgtcatcagggacgccttcctgctgatgctcgccgtcctggggctctgccccttcccgtacgacgacggctcgccccgccgggcggacgggccgaagccagaggaggtgaagggccggctccccgccgtggagtacggcgagctcgtggccgagcggctggtggtggcgtccccgggcggcggcgggcacgcggcgtgccgcggcgaggaggacgcggtggcggcggcggcggtggcctcgccgacgtgcatcgtgtgcctggagaatgtggaggcggggcacgaggtgcggcggctgggcaactgcgcgcacgccttccaccgcggctgcatcgaccggtggatcgacctcgggcgggcgacgtgcccgctgtgccggtccgacctgctgccgcgcccgcggggccgggcccggctgggccggctcgccagcctcctcacgcgcgtttggtgagcggtcctcttggagggcagttttgtcttttcgacggccgggcctcgatcgcagcccatctctaggtggagccgccggaatggcgcggcgcggacaggttagcgacggcgacatggccgccgggcggtacaacggcgcctctgctatcagccaaccattaatcatcaatggggggcttaattggcagctgtttagctcgatccacctgacagtttatatagtactcgacatgtcgacggcttatccggcgactaatcctcattataggatatgtacattacattcatatatagtgctatagtgctatatcatcagctatattcattgtacacgaacttttctctctctaccttctatactagtatgtaatacacgaataaaatttaattagttcaaaaaaaaaaaaaaaaaaaa

SEQ ID NO: 4494 - protein, 174 aa, Panicum virgatum
  misc_feature: Ceres CLONE 1805630
  misc_feature (1)..(43): Pfam Name: zf-C3HC4 Pfam Description: Zinc finger, C3HC4 type (RING finger)
MGFPLVSYVLAVPKPVVVFCKMLSVIRDAFLLMLAVLGLCPFPYDDGSPRRADGPKPEEVKGRLPAVEYGELVAERLVVASPGGGGHAACRGEEDAVAAAAVASPTCIVCLENVEAGHEVRRLGNCAHAFHRGCIDRWIDLGRATCPLCRSDLLPRPRGRARLGRLASLLTRVW

SEQ ID NO: 4495 - DNA, 1623 bp, Panicum virgatum
  misc_feature: Ceres CLONE 1805650
  misc_feature: Encodes the peptide sequence at SEQ ID NO. 4496
accattgggcaatttcaattcaattacagccagacagcaacctcccaattcatccatggagaacatgctccacttagcgccgtgccatgcttcggtcccggactgcttcgtcgtcccgcccgaccagctcccgccggccgcctccgccgccgtgtccctgcccgtcgtcgacatgtccggcagccacgacgaggtccgccgagccattctcgacgccggcaaggagttcggcttcttccaggtggtgaaccatggagtgcctcagcagttgctgcaggacatggaggcggtgtgcgacgagttctacgacttgccggcggcggagaaggcgcacctgtactcggaggacaaacagaagcccaaccggctcttctccggcaccacctacgagaccggcggccacaagtactggatggactgcctccgccttgccttctccttccccgtcggcgacagcacaagcggatggcccgacaagccccaaagacttcgggaggttttcgagaagttcgccgtgctgacaagaggcgtggggatggagctgctgcggctgctgtgcgaagccatggggctccggccggactacttcgacggcgacctcagcggcggcgacgtgatcctcagcgtcaaccgctacccgccgtgcccgaacccgagcgccaccctgggtcttccgccccactgcgaccggaacctcatcaccctcctccacacgggtcccgtacatggcctcgaggttctctacgacggcgactggatcaaggtcgagcccgtgcccgacgccttcgtcgtcaacttcggcctccaactcgaggttgtgaccaatgggatgctgaagagcgtggagcaccgcgtgacgaccaacgcggcggtggcacggacgtcgagggcgatcttcatacaaccaaaggaggactgtctggtgggcccagccgaggaattccttagcgaggacaaccctccgtgctaccgcaccgtcacgttcggcgaattcaggcgcacgcacagcgtcgtgaagctggggtcgtcgctcaacctcaccaccaatctcaaggacatccagaaggatatcagatgatgaattattgaagcagaacaagaataaatctggatcgccatcatgaccaggtcatggatgctgctgagccatggttggtagatgctcatgccaccttggtgtgctctgctgtattgatgaggaatataaaatttgttcagtcattattcggccaatatgaaatctgcagattttgtgttgcttcaccagcaggttgccgttcacaacgccaactttatcgatcactaagagtgcagtgatctagcaggcgtgatcctgcagcaacatgcggctgactgcaggcagaagcggtggcaccaacgcgacatggcgtcgcccataccaatcgcatcacggttcagaaagcagacgtgatcctgcaacgaagataacagaggatgattgaaagcagcggacctgtttcatgattcaattttggcgggcccttgcttgccgtcacctctgaatctctgattgcagcacaacaatcaaattcagaaaccacaaattaatactaactgaaaaaccaggagcacacaaagtcataaaaaaaaaaaaaaaaaaaa

SEQ ID NO: 4496 - protein, 340 aa, Panicum virgatum
  misc_feature: Ceres CLONE 1805650
  misc_feature (1)..(100): Pfam Name: 2OG-FeII_Oxy Pfam Description: 2OG-Fe(II) oxygenase superfamily
MENMLHLAPCHASVPDCFVVPPDQLPPAASAAVSLPVVDMSGSHDEVRRAILDAGKEFGFFQVVNHGVPQQLLQDMEAVCDEFYDLPAAEKAHLYSEDKQKPNRLFSGTTYETGGHKYWMDCLRLAFSFPVGDSTSGWPDKPQRLREVFEKFAVLTRGVGMELLRLLCEAMGLRPDYFDGDLSGGDVILSVNRYPPCPNPSATLGLPPHCDRNLITLLHTGPVHGLEVLYDGDWIKVEPVPDAFVVNFGLQLEVVTNGMLKSVEHRVTTNAAVARTSRAIFIQPKEDCLVGPAEEFLSEDNPPCYRTVTFGEFRRTHSVVKLGSSLNLTTNLKDIQKDIR

SEQ ID NO: 4497 - DNA, 1029 bp, Panicum virgatum
  misc_feature: Ceres CLONE 1805651
  misc_feature: Encodes the peptide sequence at SEQ ID NO. 4498
aaaaaaacggaactgagaaaaaagaggggaagagctccactagagcgtgcggttgcgaggagacgaggagatgtggcggaggcggctgggagctttccttctccgatccccgccgtcttcctcctccgcagccgcctcttcttgccagcatcgccgccaccacctcctccccagcgaggaacctccagccctcaatcgtcttgcaaggctcttcacgtcccaagctggaagtgatggtggcaattcccagaagccgttcattgcttttgtcttagggggtcctggcagtggcaaaggaacacaatgcaccaagattgcttcagatttcggatttgcccatttgagcgctggtgaccttctgcgccatgaaatagcatctggcagtgagaaaggggagttgatcgtggacatcattaaggaagggaggattgtcccatcagagataaccgtggaactcatcaggaaagctatggaagcgagcaatgccaataaggttcttattgatggcttcccaaggtgtgaggaaaacagaatcgcttttgaaagaattgttggaagagaaccagacattgtggttttctttgactgtcctgaggatgagatggttaaacgccttctaggccgtaaccaggggcgggttgatgataacattgagacaatcaagaagcgtcttaaggtgtttgagagtttgaatattcctgttattgactactattcttctaggggaaaggttcgcaagataaatgccacgggcactgcagatgaaatctttgaagcagtctgcaagctcttttcgtccttaaggttctgatgaggatactgacttccaaggaatcccgggagttcgcttaggaattatctggtatttatttttcttaaagccagtgctcactttgcgctgtctaaatctttggtgcagtaattgtacatacacgctatgcctttaccaaataatacccacagaaatacatatgccttgtgacacatctaacctgaagctcgtcctgcagtgcaggaattatttgttcc

SEQ ID NO: 4498 - protein, 246 aa, Panicum virgatum
  misc_feature: Ceres CLONE 1805651
  misc_feature (1)..(151): Pfam Name: ADK Pfam Description: Adenylate kinase
  misc_feature (48)..(244): SWISSPROT Homolog: EC 2.7.4.3 Adenylate kinase
  misc_feature (61)..(246): SWISSPROT Homolog: EC 2.7.4.14 Cytidylate kinase
MWRRRLGAFLLRSPPSSSSAAASSCQHRRHHLLPSEEPPALNRLARLFTSQAGSDGGNSQKPFIAFVLGGPGSGKGTQCTKIASDFGFAHLSAGDLLRHEIASGSEKGELIVDIIKEGRIVPSEITVELIRKAMEASNANKVLIDGFPRCEENRIAFERIVGREPDIVVFFDCPEDEMVKRLLGRNQGRVDDNIETIKKRLKVFESLNIPVIDYYSSRGKVRKINATGTADEIFEAVCKLFSSLRF

SEQ ID NO: 4499 - DNA, 1194 bp, Panicum virgatum
  misc_feature: Ceres CLONE 1805671
  misc_feature: Encodes the peptide sequence at SEQ ID NO. 4500
gtctcacgctccagctcccccttcacccccctcgcctcggcggccgggcccccaaaaccctaaccctagcccgccccccctgcccgagctccggcgccgagcgtccgcgctggggacatggacggcggcggcacgccccgcacgccggaggacgtgttccgggacttccgcgcgcgccgggccggcctgatcaaggcactcaccaccgagaaagagaatctgtgtttgtatggccttcccaatgaaacatgggaagtgaacttgcctgcacaagaggttcctcctgaacttccagagccagctctaggaattaattttgcacgtgatggaatggatgaaaaagattggttgtcacttgttgccgtgcatagtgatgcttggctgctggctgtggcattttactttggagcaagatttgggtttgacaaagaatccaggaagcgtctctttgtcatgattaataacctccctaccatatatgaggttgtcacaggaactgcgaagaagcaaaccaaagaaaaaactccgaaaagcagcagcaagagcaataaatctggcacaaaaccaccacgccagccagaacccaactcaaggggttccaagatgccacctccaaaggatgaggatgacagcggaggcgaggaagatgaggaagaggaagatcatgaaaacacattgtgtggttcatgtggtgacaactacggacaggacgagttctggatatgctgcgatgcctgtgagacatggttccatggcaaatgtgtcaagatcactcctgccaaagccgagcacatcaagcactacaagtgtccgaactgcagcggtagtggcaagagagcccgagcatgatccttggtgggtatatccatcgctcttgcctgtagaaccaggaggttaactcgctgtaaaacatccgcaagggaccaactgccccatggttgcgcattcagtcgttgctttcagtgtaggaccagctgtagggtcttgatgtgctgtttgttgtatgtcgaagacattctagatcttctgttgttagtaactagcaactaactgtagtagcctgtatttcttcaagcttctccgatcccagtgtgcctgtattggatttgggaatagctttagatctcagttgtgcattatgtatcaccatgtactcgtgttaattcgttaaaaggttgtgtgcttctatttctc

SEQ ID NO: 4500 - protein, 243 aa, Panicum virgatum
  misc_feature: Ceres CLONE 1805671
  misc_feature: Great-hit functional homolog of the protein sequence given in SEQ ID NO 9570
  misc_feature: Useful for making plants with altered alkaloid content
MDGGGTPRTPEDVFRDFRARRAGLIKALTTEKENLCLYGLPNETWEVNLPAQEVPPELPEPALGINFARDGMDEKDWLSLVAVHSDAWLLAVAFYFGARFGFDKESRKRLFVMINNLPTIYEVVTGTAKKQTKEKTPKSSSKSNKSGTKPPRQPEPNSRGSKMPPPKDEDDSGGEEDEEEEDHENTLCGSCGDNYGQDEFWICCDACETWFHGKCVKITPAKAEHIKHYKCPNCSGSGKRARA

SEQ ID NO: 4501 - DNA, 1172 bp, Panicum virgatum
  misc_feature: Ceres CLONE 1805688
  misc_feature: Encodes the peptide sequence at SEQ ID NO. 4502
acgctcctccccgatcccgatctccggccgacgccatggcggccgccgcaggcatcgcggcggtagtgggggtgctcatcctcctcgtcgcgggggtctcgggcgcgcgcctcccggcccgcggcgccgccgtccgcggaccggcgttgccgcgcgggggagcgccggccacggcggtgttcgcgctgggcagcttctggaggtcggaggcggcgtttggctgccttcccggcgttatccgcacctcggttggttatgctggcggctccaaggccaaccccgagtaccgcaacctcgccgaccacgccgagtgcgtcaaggttgagtatgatccccggctgattcactacaagcagcttttggacgtgttttgggcaagtcatgatccacgggaggtgtttgggcaagggccagatgttggcaaccagtacagatctgtcatcttcactaatggaaccattgaggccagattggctgctcttagcaaagaaaaagaacaagctaaagatcgcagtagcgttattaccacacagatccaaccattgggggcgttccatcctgctgaaccagaacatcagaaatttgaactgaagcgcaagccattcctcctgcaattgattgggaatttgccagaggaggagctcctgacatcaacactagctgcaaagctgaatgcatatgctgctgagctctgccctgcgaatacccaaaagagaattagctccaagattgatgagattgcaaagaaaggatggcccatcttaagggaaatttagttgatactagatcctggactcaaatcggttgttgcaatgcagacacaagagaggtgcatgattttgcagaaaataattttaggaatatttcttttgtgcaccattgccatgatggcctcagtcatccattcttcactttgctcacaaagatatagttgtgcatagcatgtgcattgaaattgtgactaagctgtgtgtgtgtgttaccccatttgtaacttgaattcattgtccaagcttacttaacggacagtagttgtccgttgtaattttggttgttcatttgtgaaatatagatatttcgtttttattcagcagagcttgtgctggtcgtgattgaggtgcatgtgaatatgacaatgaaatattgttttattgatggggaagattccatgt

SEQ ID NO: 4502 - protein, 246 aa, Panicum virgatum
  misc_feature: Ceres CLONE 1805688
  misc_feature (2)..(154): Pfam Name: PMSR Pfam Description: Peptide methionine sulfoxide reductase
MAAAAGIAAVVGVLILLVAGVSGARLPARGAAVRGPALPRGGAPATAVFALGSFWRSEAAFGCLPGVIRTSVGYAGGSKANPEYRNLADHAECVKVEYDPRLIHYKQLLDVFWASHDPREVFGQGPDVGNQYRSVIFTNGTIEARLAALSKEKEQAKDRSSVITTQIQPLGAFHPAEPEHQKFELKRKPFLLQLIGNLPEEELLTSTLAAKLNAYAAELCPANTQKRISSKIDEIAKKGWPILREI

SEQ ID NO: 4503 - DNA, 1143 bp, Panicum virgatum
  misc_feature: Ceres CLONE 1805721
  misc_feature: Encodes the peptide sequence at SEQ ID NO. 4504
agcaaggacgacagacgtgccagcagcaccgacagcagccatggcgcgccggtctctagctccgctcgcgccgccgccagccctcgctgtcaccgccgtcgtcctcgcgctcgcgctctgcttcaaccaccccgcctcggcgcagtcggcctggctcgacgagttccgcacggacggcgaggtccgctccgacttcgacgcctcgggcaagcaggtggcgtcgctggtccttgacaagagctccggcggcggattcaactccacggagaagtacctcttcggcgagttcagcgtcgagatgaaactggtgcccggcaactccgctggcaccgtcacctccttctacctgacgtccggcgagggcgacgagcacgacgagatcgacatggagttcatgggcaactcgagcggcgcgccgacggtgctcaacaccaacgtgtgggccagcggcgacggcaagaaggagcaccagttctacctctggttcgacccctccgccgacttccacaagtacaccatcatctggaacgccaagaacatcatcttccgcgtcgacgacgtcgccgtgcgcgccttccgccgctacgacgacctcccctacccggacgccaggcccatggcggtgcacgccacgctctgggacggcagctactgggcgacggagaagggcgaggtccccatcgactgggccgccgcgcccttcgtcgtctcctaccggggctacaccgccaacgtctgcgtcgcccgcggcggcggcggccgcacgtcgtgccccgccggccggaaggagtggatggacagggagctggacgacaccgaccggctcaccgtcgcctgggctcgccggaactgcctgcagtacaactattgcgaggacgggtggcgcttcccggaggggttccccggcgagtgcagccgcgaatgacccgtgcctgtcaccacagtcaccactcaccctaccctgtggctggtccgatccgtccgtccatacagacacgcaggcatcaccattgttcttgtagatcatgaagttcctttcttccccttggataattatattcttcttctttcggtacagcaatagctatgtaacttctgagaatcattttttggtcagcgagtaatataaattcaattttcacc

SEQ ID NO: 4504 - protein, 294 aa, Panicum virgatum
  misc_feature: Ceres CLONE 1805721
  misc_feature (3)..(181): Pfam Name: Glyco_hydro_16 Pfam Description: Glycosyl hydrolases family 16
  misc_feature (14)..(294): SWISSPROT Homolog: EC 2.4.1.207 Xyloglucan endotransglycosylase/hydrolase protein 8 precursor
MARRSLAPLAPPPALAVTAVVLALALCFNHPASAQSAWLDEFRTDGEVRSDFDASGKQVASLVLDKSSGGGFNSTEKYLFGEFSVEMKLVPGNSAGTVTSFYLTSGEGDEHDEIDMEFMGNSSGAPTVLNTNVWASGDGKKEHQFYLWFDPSADFHKYTIIWNAKNIIFRVDDVAVRAFRRYDDLPYPDARPMAVHATLWDGSYWATEKGEVPIDWAAAPFVVSYRGYTANVCVARGGGGRTSCPAGRKEWMDRELDDTDRLTVAWARRNCLQYNYCEDGWRFPEGFPGECSRE

SEQ ID NO: 4505 - DNA, 1254 bp, Panicum virgatum
  misc_feature: Ceres CLONE 1805740
  misc_feature: Encodes the peptide sequence at SEQ ID NO. 4506
attcttgtcgtcaagtttaccaatcgagtaactgagcaacacatctcggcatctcctatcctgttgctggaggtcgcggtgcgcaggctcatggcggccgctatctccagtccccccagcgaaagggttgctgtggtcaccggcggcaacaaagggatcgggctggaggtgtgcaggcagcttgctagcaatggcatcaccgtcatcttaacagccagggacgaggagaggggcgcctccgccgtggagaagctcacagcagctgcagggctctccgatgtcatcttccatcagctggaggtcaccgatgctcagagtattgctcgattggctggcttcctgaaggaacgtttcgggaagctagacatcctggtaaataatgctgctatcggcggggttcagacacttcccgtccaagatctgagcgccgaaaagttcagtggcatggatgcgaggcagagggctgaatggatgtggaaaaattgccgggagacgtgcgacgctgcaaaggcagggatccagacgaactactacggcacaaagaacgtaaccgaagcactgctgcctctgctgcaagcctccaccgatggaaggatcgtcaatgtctcctccgacttcgggctgctaagtcatttcagcagcgaggagctgaagcaggagctgaacgatgtcgagagcctcaccgaggggaggctggacgaggtgctggccatgttcctgaacgacttcgtggccggcgaggtggaggcgcgcgggtggccggcggcgttcgcggcgtacaaggtggccaaagcggccatgaacgcctactcgagggtcctggcgaggcggcaccccgagctgcgcgtcaactgcgcgcatcccggctacgtgaagaccgacatgaccaggcactcgggcttgctgacacctgaggagggcgcgcgcaacgtggtgaaggtggcgctgctcccggaaggcgggccgaccggcgcgttcttcgcgttgggccaggagtcaccgttcgtgtgacaaagccggccatagtggtggccgcgcacggcccatgggccatgacctctagtgggccccctcgtcccgtccgccgccctcctcaaccgcctgttatattatctctctatatgcgacttaatttggtgatttgagaatgcgaataaaggattgatgctagcacttactagttggtttttattactaatcttctgtaaaaaaactacaaaatttggcaaaaacagtgatttgaactttgccatg

SEQ ID NO: 4506 - protein, 306 aa, Panicum virgatum
  misc_feature: Ceres CLONE 1805740
  misc_feature (1)..(84): Pfam Name: adh_short Pfam Description: short chain dehydrogenase
MAAAISSPPSERVAVVTGGNKGIGLEVCRQLASNGITVILTARDEERGASAVEKLTAAAGLSDVIFHQLEVTDAQSIARLAGFLKERFGKLDILVNNAAIGGVQTLPVQDLSAEKFSGMDARQRAEWMWKNCRETCDAAKAGIQTNYYGTKNVTEALLPLLQASTDGRIVNVSSDFGLLSHFSSEELKQELNDVESLTEGRLDEVLAMFLNDFVAGEVEARGWPAAFAAYKVAKAAMNAYSRVLARRHPELRVNCAHPGYVKTDMTRHSGLLTPEEGARNVVKVALLPEGGPTGAFFALGQESPFV

SEQ ID NO: 4507 - DNA, 1225 bp, Panicum virgatum
  misc_feature: Ceres CLONE 1805770
  misc_feature: Encodes the peptide sequence at SEQ ID NO. 4508
gcttccagtctaccgcccgcgcccgactccgcctgctcccggcctccccaaccccgccgcggcggagcgctaaaccctaggcgtcggcggctgcagaggaggaggaggaggagggggacgagccgagatgtcgcacttcgggaggacggggccgccggacatccgcgacaccttctcgctcctcgtcctcaacatcagcttccgcaccacggcggacgacctcttcccgctcttcgagcgctacggcaaggtcgtcgacgtcttcatcccgagggaccggaggaccggggactcgaggggtttcgcgttcgtgcggtacaagtacgctgacgaggcgcagaaggctatagatcgccttgatgggaaaaatgtggatggcaggaacatcatggtgcagtttgccaagtacggccccaatgctgagccaatccgtaaaggaagggtcaaagaggttgttgagaaaccacgagacaggtcaagaagccgtagtccaaggccaaggcacagagacagagaacataggaggcgaagtcgcagcaggagcagagaaaggcatgggcgtgatagagacagggactatcgtcgccagagcagaagcagaagcagaagcagaagcagaagtccgagttcaagtccggaccacaaaagtcatcgtagagcaagagatgatgataagcgcaggagcaggagcaagagtaggagcaaaagcagaagcagaagcaggagtagaagccactcataccatagtgcttcacctgctcggcgcagtgctagccctcgcaattgcaaaagctcaccaccaaggaggagccccactcctgaaaagcacaccaatggaaaagattttcctccatcacgcagtgtttctccatcaccaaagcatgcaggctcccgtagcccaggcagtgagagcaaggagtaaagcttgttgatctggtgttgcctaagaacaatctccgtgggattgcagatcgttgattgagcacaatgggagtagcacccaactgctattcaaggttgctagtactatatggtttctagaattgtgttttccagttgttaaagttatgctgttggtttgtatttcgacgatattgtgttttcatgcccatctactgcatctactttatatgcattagacttcttgataccatcatattaacttgttaaaacatttgtgcattttctagttatctggtcgtgagatggcttgctgtttactggc

SEQ ID NO: 4508 - protein, 264 aa, Panicum virgatum
  misc_feature: Ceres CLONE 1805770
  misc_feature: Great-hit functional homolog of the protein sequence given in SEQ ID NO 9287
  misc_feature: Useful for making plants with altered alkaloid content
MSHFGRTGPPDIRDTFSLLVLNISFRTTADDLFPLFERYGKVVDVFIPRDRRTGDSRGFAFVRYKYADEAQKAIDRLDGKNVDGRNIMVQFAKYGPNAEPIRKGRVKEVVEKPRDRSRSRSPRPRHRDREHRRRSRSRSRERHGRDRDRDYRRQSRSRSRSRSRSPSSSPDHKSHRRARDDDKRRSRSKSRSKSRSRSRSRSHSYHSASPARRSASPRNCKSSPPRRSPTPEKHTNGKDFPPSRSVSPSPKHAGSRSPGSESKE

SEQ ID NO: 4509 - DNA, 1090 bp, Panicum virgatum
  misc_feature: Ceres CLONE 1805782
  misc_feature: Encodes the peptide sequence at SEQ ID NO. 4510
agccagcggcgaggctctcgatcccccagcgcagcgtccaccaggcggcggtccgctcgcgaggccagcgccgcgccgcctccagcctccccgcccatctcctcgctcctcgtccaagcgctgccgccgtacgccgcccctgcgcctccccgtcggagacgccccttcgtctccccatctcccgcatcccggggctcaagcacgtccgcagcttctcttccgcctcggcgatccttccaccgcttcacgtctcccacacaccgccggttctctctctccgtctgagcgactgagcctcctttcctcccggcgacgacagggcgagcagccctttgccattctctgcggcaacaagcatctgaaaggggagtgaagctaatatggctgccttgccactgcccactgctgaagtatgtgatgctaatcctcatttgattatgaatggcgagcttcgtgctctccatcccatcttccaaatctacggaaggcgccaagtttttgctggtcctattgtgacgctgaaggtctacgaggacaatgttctgatccgtgagttccttgaggagaaaggccacggcagggtccttgtggttgatggtggtgggagtatgcgctgtgccattctgggtggcaaccctgtccagcaggcacagaacaatgggtgggctggcattgtggtgaacgggtgcatcagggatgttgatgagatcaatggctgcgacattggtgtgcgagctctcaactcccaccctatgaaggcaaacaagaagggcactggtgagaagcatgtccctgtgaccatcgcaggaactaggatttgcgatggcgaatggctctatgccgatacagatggcattcttgtctcgaggatggagttgactgtgtagacccattccctctttgtacttgtgtataagaattgggcgcataaaagcaggtctgctcttgtccttgcctcttggtgttctgtctgaacttgtaataatggattgtcgttgggtcacacgatttaccgggaatcattgatgttacaaattgttgtctatcaatttttggaatcgcaaactcttaaaaaaaaaaaaaaaaaaaa

SEQ ID NO: 4510 - protein, 168 aa, Panicum virgatum
  misc_feature: Ceres CLONE 1805782
  misc_feature (1)..(158): Pfam Name: Methyltransf_6 Pfam Description: Demethylmenaquinone methyltransferase
MAALPLPTAEVCDANPHLIMNGELRALHPIFQIYGRRQVFAGPIVTLKVYEDNVLIREFLEEKGHGRVLVVDGGGSMRCAILGGNPVQQAQNNGWAGIVVNGCIRDVDEINGCDIGVRALNSHPMKANKKGTGEKHVPVTIAGTRICDGEWLYADTDGILVSRMELTV

SEQ ID NO: 4511 - DNA, 964 bp, Panicum virgatum
  misc_feature: Ceres CLONE 1805800
  misc_feature: Encodes the peptide sequence at SEQ ID NO. 4512
gttgaacagtaggttaaaaaatcggtagagacaacaaagcagggcagcagctgggcggaggagtccagggcgaggccgcgagggagggatggctttgccggcgctgagcctgtctcgctccccgtcgtcctccgtctcctcgtcacctgtcgatcgttgtccccgatctacctctacctttcggcgcttcggttcgtccttcgcctacaaacctgccgcaggaatttgctctgctagccaggcaattgaattgctgccttcgttgtgccctgaaattgttgtccgagatgcacagctcgaggattgttgggaagtaactgacactcattgcagctctttctttccggattacaagttcccattggaccttgttctacggattgatcgttacattgctcttctatctggattttcagttccacccgggtgcatgaggacttgccttgtcgcagtcaattctaattctgtaaataatagcttcagcatcgagcgtggagatcctcgagatgccggagccggatttcagaaatacaatctcaataggggctccatagctggcattcttacaattgacacagtggcagactatcttccgagaaggggacccctgaagcagagaaggtaacaagggcaagcaaaagggaacatccgattggatcagtgacatctaacatagtgtgatcaaacacttctcaactgaagtaggattggggcgaagccaggcagaatcaccaccggggtccgcttcattgcttaatggggtcagcatagcttatgaacagtagatatctacatgatctacaaaatttcattggggtcggatgaccccaataacataaggcagccccgctcctgtaggaagcgagtgaacactgtcattgattttgctatatatgcttccatctgtttgggatgtctaaatatgtacaattattgcatttcggaaaaaaaaaaaaaaaaaaaa

SEQ ID NO: 4512 - protein, 178 aa, Panicum virgatum
  misc_feature: Ceres CLONE 1805800
  misc_feature (3)..(35): Pfam Name: Acetyltransf_1 Pfam Description: Acetyltransferase (GNAT) family
MALPALSLSRSPSSSVSSSPVDRCPRSTSTFRRFGSSFAYKPAAGICSASQAIELLPSLCPEIVVRDAQLEDCWEVTDTHCSSFFPDYKFPLDLVLRIDRYIALLSGFSVPPGCMRTCLVAVNSNSVNNSFSIERGDPRDAGAGFQKYNLNRGSIAGILTIDTVADYLPRRGPLKQRR

SEQ ID NO: 4513 - DNA, 1115 bp, Panicum virgatum
  misc_feature: Ceres CLONE 1805811
  misc_feature: Encodes the peptide sequence at SEQ ID NO. 4514
aaaccctaccacacgcaagcacgcccgcgcgcgcgcactagggatcctcgagtcggggaggaggaggagcggggggttgaggaaggagaggagcttcgaggatgttccgcaaccagtacgacaccgacgtgacgacatggagcccgcaggggcggctcttccaggtggagtacgccatggaggccgtcaagcagggctccgcctgcgtggggctccgatcccgcacccacgccgtcctcgccgccgccaacaagcccgcctccgagctctcctcctaccagcgcaaggtcttccgcgtcgccgaccacgccggggtcgcgctggcggggctcaccgccgacggccgcgtcctctcgcggttcctccggaacgagtgcatcaaccactccttcgtctacgaggcgccgctccccgtctccaggctcgcgctcaggctcgccgacaaggcgcaggtttgcacacagcggtcatggaagaggccttatggtgttggtctccttgttgctggactggatgagtctggagctcatttgtattacaattgccccagcgggaactactttgagtaccaggcatttgccattggttctcgctctcaagctgccaagactttcctcgagcgcaggtttgagggctacaacgactacaccccagagcagctcatcaaggatgccctctctgccattaaggagactctgcaaggcgagaagctaaccagctccaactgcaccgtggccatcgtcggcaggaaggacgacggcaccctcgagccatttgagatgattgatgcgaagaggatccaggagataatcgactccatggaggctgttgaggaggcgcctgcagagcccagctccatgcaggaggaggaaaggggctcggacgctgctcccatggacatctagaccggaatacacctcatatgaaccctctacaccgcattccgtgattccaaagactagactgttttagaaagttgtattgtgacttgtgtacgatttgcttccatgcttcggctctgcgacggtctatttgacgaacatttgggtttgaactggttattttatcatgtgacgtgaacaaatcgtttcgtttaaaaaaaaaaaaaaaaaaaa

SEQ ID NO: 4514 - protein, 267 aa, Panicum virgatum
  misc_feature: Ceres CLONE 1805811
  misc_feature (1)..(266): SWISSPROT Homolog: EC 3.4.25.1 Proteasome subunit alpha type 1-A
  misc_feature (1)..(267): SWISSPROT Homolog: EC 3.4.25.1 Proteasome subunit alpha type 1
MFRNQYDTDVTTWSPQGRLFQVEYAMEAVKQGSACVGLRSRTHAVLAAANKPASELSSYQRKVFRVADHAGVALAGLTADGRVLSRFLRNECINHSFVYEAPLPVSRLALRLADKAQVCTQRSWKRPYGVGLLVAGLDESGAHLYYNCPSGNYFEYQAFAIGSRSQAAKTFLERRFEGYNDYTPEQLIKDALSAIKETLQGEKLTSSNCTVAIVGRKDDGTLEPFEMIDAKRIQEIIDSMEAVEEAPAEPSSMQEEERGSDAAPMDI

SEQ ID NO: 4515 - DNA, 1655 bp, Panicum virgatum
  misc_feature: Ceres CLONE 1805868
  misc_feature: Encodes the peptide sequence at SEQ ID NO. 4516
atcacatgatcgtgcatgaatcctcctgcatgctactattagacagggaggcgatctcttccttgtctccactacaacatgggagaaaacagaaagatcatcctgccgaggttagtaacaagcaacctactgcacgaccaacagctgcatgggcatggatctgtctctgaggtttcgagcatagtggatgaaaacttgggaaagagacccttgaatgtccacaaagctacttttgtatacagggtgtttgctagtacctggaatgttggtggcattgcaccatctgatgatttggacttggaggattggttggatacaagggccaacacctgtgacatctatgttctagggttccaggagatagtgccactaaatgcaagaaacgtgcttggtcctacgaagagctgtatatctgcaaagtggaactctctgattggggaggcactcaacaaaaaggaaagaaaagaaggcgcaaagttaaaccaagaatcttcaaatagcagtgcattcgagggttctatacagggagaaggtttcagatgcatcaggagcaagcagatggttggcctctttacctcagtatgggtgagaagcaaccttaggccattcattcaccacctagatgtgtcatgcattggttcaggtatcatgggctgcctagggaacaagggttctgtttcaatccgatttgtgttgcatgagacgagcttttgctttgtctgttgtcacctggcctcaggtggcaaagaaggggatgttctgctgaggaacttggatgtcgcagacatacttgctaggacatggttcccaggtcgtgcaactcaggaattgccagagaagatccttgatcatgatcaagtagttttgctcggtgacttgaattataggatctccttggaaggggctgaaacaaggtcgctggtgaaagccaagaactgggccatcttgttagaaaacgatcagctactatctgagttctctagggggcggcatttcgaggggtggcaagaagggttgatcacgttctcccccacctacaagtaccaccccaactccgatcagtattactggtgcttcgatggtgcccggggcgagaagaagcgtgcaccagcatggtgtgatcgtattctctggcggggcaagggactgaagcaagtccaatacgagacatgcaactacaggttatcggatcaccggccagtgagagcgattttccacgccgaatgtgacgtatcagaggaggtgcagaagtaaacggccagaatccacgctgaactccgcgagcgactgatgtagagaagcctatttcgcacggacgctcagcgtcaaatcaagagttggacgggagatttgatcaatcgagtaaccaagaattttcttctgagatgaatatgaaattgctttttcccggagaggatgagaatttttggaacgctggttgggtgtgtgcaactgccaactagattacatgaatgatacttgggccagtatttaacaggttcagagaagatgacctcaaacaaaaaagaaaaagaaacaaacaaaaacaggttcagagaagaggtgcagattttcgtttgttttattagtggcgctgttcaaatattcattcgtgtgtgcatatctttcctcactaaaaaaaaaaaaaaaaaaaa

SEQ ID NO: 4516 - protein, 391 aa, Panicum virgatum
  misc_feature: Ceres CLONE 1805868
  misc_feature (1)..(323): Pfam Name: Exo_endo_phos Pfam Description: Endonuclease/Exonuclease/phosphatase family
  misc_feature (138)..(384): SWISSPROT Homolog: EC 3.1.3.56 Type I inositol-1,4,5-trisphosphate 5-phosphatase CVP2
  misc_feature (156)..(385): SWISSPROT Homolog: EC 3.1.3.56 Type I inositol-1,4,5-trisphosphate 5-phosphatase 2
MGENRKIILPRLVTSNLLHDQQLHGHGSVSEVSSIVDENLGKRPLNVHKATFVYRVFASTWNVGGIAPSDDLDLEDWLDTRANTCDIYVLGFQEIVPLNARNVLGPTKSCISAKWNSLIGEALNKKERKEGAKLNQESSNSSAFEGSIQGEGFRCIRSKQMVGLFTSVWVRSNLRPFIHHLDVSCIGSGIMGCLGNKGSVSIRFVLHETSFCFVCCHLASGGKEGDVLLRNLDVADILARTWFPGRATQELPEKILDHDQVVLLGDLNYRISLEGAETRSLVKAKNWAILLENDQLLSEFSRGRHFEGWQEGLITFSPTYKYHPNSDQYYWCFDGARGEKKRAPAWCDRILWRGKGLKQVQYETCNYRLSDHRPVRAIFHAECDVSEEVQK

SEQ ID NO: 4517 - DNA, 1052 bp, Panicum virgatum
  misc_feature: Ceres CLONE 1805891
  misc_feature: Encodes the peptide sequence at SEQ ID NO. 4518
aacgtcgatccattcatctgcttgtgccccgccctcggcccagaccaaaaacaagctagctggctatggcggcgagcggcaagagcagggaggagcgctggagcctggccggcaagacggccctcgtcaccggaggaagcaaggggatcgggcgcgcaatcgtggaggagctcgcggggctcggggtgcgcgtgcacacctgcgcccgcggcgacgccgacctgcaggagtgcctgcgccagtggggcgctgacggccgcctcgcgcgcgtcacggggaccgcctgcgacgtcgcagtgcgcgccgaccgggagcggctcgtggccgcggctcgtgaggagctgggcggccggctggacatcctcgtcaacaacgccgggcagaccatgttcgggttcgccgctgacaccacggcggaggactacgcgcgcctcatggccaccaacgtcgagtcctgcttccacctcgcgcagctcgcgcatccactcctcgtcgcggcggcgtcaggcggcggcggcgccagcagcgtggtcaacgtctcctccatcaatgggattctctcctacccggggatgtccatgtacgcgaccaccaaggccgccatgaaccaggtcacccggagcctcgccgtcgagtgggccaaggacaacgtccgcgtcaactccgtcgcgccgggtggcgtcgtcgggaccgacatcgccagcagcagccacctgagtctggccccggagctgctgcagaatttgtgggaggcggagatggcgcgggtccccatgctccgcatggccgagccggaggaggtcgtgtcagtggtcgctttcctctgcatgccggccgcctcctacatcaccggccaggtcatctgcgtcgacggtggccgcaccattaccgcctagctaataggccttgctagctgcttttagctgcatcgcccgcgcttagggatgcaagtggatatccatctatgtttgttttttgtttttgagtatgtcgtttaagtttcatttctcttccaaaataattacgtagcatgttattccagtttatcttat

SEQ ID NO: 4518 - protein, 276 aa, Panicum virgatum
  misc_feature: Ceres CLONE 1805891
  misc_feature (1)..(180): Pfam Name: adh_short Pfam Description: short chain dehydrogenase
MAASGKSREERWSLAGKTALVTGGSKGIGRAIVEELAGLGVRVHTCARGDADLQECLRQWGADGRLARVTGTACDVAVRADRERLVAAAREELGGRLDILVNNAGQTMFGFAADTTAEDYARLMATNVESCFHLAQLAHPLLVAAASGGGGASSVVNVSSINGILSYPGMSMYATTKAAMNQVTRSLAVEWAKDNVRVNSVAPGGVVGTDIASSSHLSLAPELLQNLWEAEMARVPMLRMAEPEEVVSVVAFLCMPAASYITGQVICVDGGRTITA

SEQ ID NO: 4519 - DNA, 1565 bp, Panicum virgatum
  misc_feature: Ceres CLONE 1805911
  misc_feature: Encodes the peptide sequence at SEQ ID NO. 4520
aacccacccctcgctctcaatcaactctagcagaaggaaaacgagaggagaagaagaagccgcggcatttccccccagcttttgcttgctcggcgcgtgctggttgatttgatttgaggagattctcgtgggatcagcttcgtcggtccatggcggagatctgctgcgaggtggcggcggggtcgccggaccggaagggggagtgcgcgggcgacgccggcggccgcgcggcgcggcggcggaggatggagatacggcggctcagggtggtggcggaggagcaggccgcgaagaggcggaggctggagggtgacgaggaggaggaggacgacgcgaggggcccggcgcctaggtacggcgtgacgtcggtgtgcgggcggcggagggacatggaggacgcggtgaccacccgcccggggttcatccaggggcaccacttcttcggggtgttcgacggccacggctgctctcacgtcgcgacgtcgtgcggggtgcggatgcacgagatcgtggccgaggaggccgccgccgccgcaggctcgtcggtggcggacgaggcggcgcggtggagggacgtcatggagaagagctacgcgcgcatggacgccgaggccgtcggctcaagggagaccgccggcccggcgcccacctgccggtgcgagatgcagctgcccaagtgcgaccacgtcggctccaccgccgtcgtcgccgtggtggggccgcgccacctcgtcgtcgctaactgcggcgactcccgcgccgtcctctgcagcggaggcgccgctatcccgctctcagctgaccacaagcctgaccgtcccgacgagctcgaacgaatccacgcggcgggagggcgcgtcatcttctgggacggcgcccgcgtgttcggcatgctcgccatgtcccgggccatcggcgacagctaccttaagccgttcgtgatatcggacccggaggtgagggtggtggagaggaaggacggcgaggacgagttcctgatcctggccagcgacggcctgtgggacgtggtgagcaacgaggtggcgtgcaaggtggtgcgcgcctgcctccggaacagggagccgcgcggcctggagcggtcgagcccgacctccagcctgagccccaggcagagcagcggcagcagcggcagcagcggcgacgaggaggccgcgcccagcgacggcgcggcgtccgacagcgacggcgagggcggcgaggacaaggcctgcgccgaggcggccatcctgctgacgaagctggcgctggcgcggcagagcgcggacaacgtcagcgtcgtcgtcgtcaatctcaggcggcgcccgagatcgtgaccgccggatccaccgtactagccgttcttggctaaattctcggccgccccaaatcaaaattcgcgtcgacaaagcgaaaatcgaacagatccttagcagaactgcagtttacagtaggattggccttgtttgggtatgctaggaaacttgcacgcacgcattccgaaaaaagaatctcgtatgcatgaagcactaaatgaagtttatttgcaaaaaaaaaaaaaaaaaaaa

SEQ ID NO: 4520 - protein, 394 aa, Panicum virgatum
  misc_feature: Ceres CLONE 1805911
  misc_feature (2)..(317): Pfam Name: PP2C Pfam Description: Protein phosphatase 2C
  misc_feature (67)..(304): SWISSPROT Homolog: EC 3.1.3.16 Protein phosphatase 2C ABI1
  misc_feature (67)..(308): SWISSPROT Homolog: EC 3.1.3.16 Protein phosphatase 2C
MAEICCEVAAGSPDRKGECAGDAGGRAARRRRMEIRRLRVVAEEQAAKRRRLEGDEEEEDDARGPAPRYGVTSVCGRRRDMEDAVTTRPGFIQGHHFFGVFDGHGCSHVATSCGVRMHEIVAEEAAAAAGSSVADEAARWRDVMEKSYARMDAEAVGSRETAGPAPTCRCEMQLPKCDHVGSTAVVAVVGPRHLVVANCGDSRAVLCSGGAAIPLSADHKPDRPDELERIHAAGGRVIFWDGARVFGMLAMSRAIGDSYLKPFVISDPEVRVVERKDGEDEFLILASDGLWDVVSNEVACKVVRACLRNREPRGLERSSPTSSLSPRQSSGSSGSSGDEEAAPSDGAASDSDGEGGEDKACAEAAILLTKLALARQSADNVSVVVVNLRRRPRS

SEQ ID NO: 4521 - DNA, 1174 bp, Panicum virgatum
  misc_feature: Ceres CLONE 1805916
  misc_feature: Encodes the peptide sequence at SEQ ID NO. 4522
ctcttcttcccccgacagcgaactcgggagccgagactcccgaccgagaaggggagaactcggcgacggcgagccgaggggagaacaacccgagaggggtccttaatcagcgatcgaagaaggtgggtgcaggagcaagccagcccgccgccaccatgaggcgcgcctcgaagaagtcgtcctcgtcccccgcgaccgccagcgctggccctacgaaagcagtttccaaggaagttgaacggattgatcaatttttctatgcttacgctgataactcatctggcatgattgacccagaaggcattgaaacactctgttctcatctcgaagttccccataccgatgttaggattctgatgttagcatggaaaatgggctgtgagaagcaaggttactttaccttggatgaatggcgaaccggtttgaaagctcttcgagctgacagtatcagtaagctgaagaaagcattcccagaattggttcaagaggttacaaggccaaccaatttccaggatttctacacatatgcatttcgttattgcctcacagaggataagaagaagtgtatagaagtaccggttgcttgtgagttgctgaatctagtattaggcttgcagttccgcccccaggttgacaagcttagtaattacctcaagtaccaaaatgactacaaggtgataaacatggaccaatggatgggatttattcggttctgtaatgagataaatttcccatcactcgacaattatgattcggaccttgcttggcctttgattctagacaattttgttgagtggctacgagaaaataaaagttagatcttctattcctgcaatggtggtgaagatgtcgtccaaaatgtaatattcaagaatcaccctgaaggctccggaggatgcagattcagcttgtttattgctttggtggaggcaggctacagaaatcttcgatcactttcttgtgtcgccttttgattttgggtgtttttgaaactggaaacggtctatgttttttggctatgttgcgttcaatcagttttggtatactccatttttgagagctttgcaagttgcaaatctttttggaatgtgctgtcttagtgtgtgttttggtgaaacagatagggtaagcccgtgtttggttgcaaaataccaaattccaaattttttttccg

SEQ ID NO: 4522 - protein, 220 aa, Panicum virgatum
  misc_feature: Ceres CLONE 1805916
  misc_feature: Great-hit functional homolog of the protein sequence given in SEQ ID NO 9720
  misc_feature: Useful for making plants with altered terpenoid content
MRRASKKSSSSPATASAGPTKAVSKEVERIDQFFYAYADNSSGMIDPEGIETLCSHLEVPHTDVRILMLAWKMGCEKQGYFTLDEWRTGLKALRADSISKLKKAFPELVQEVTRPTNFQDFYTYAFRYCLTEDKKKCIEVPVACELLNLVLGLQFRPQVDKLSNYLKYQNDYKVINMDQWMGFIRFCNEINFPSLDNYDSDLAWPLILDNFVEWLRENKS

SEQ ID NO: 4523 - DNA, 1293 bp, Panicum virgatum
  misc_feature: Ceres CLONE 1805917
  misc_feature: Encodes the peptide sequence at SEQ ID NO. 4524
aatccaagcgggacacgccgcacgcacgacgatttcgttaggctgctcggcctctgttcgactgttccccctccctagctccctctcggcgacggcgcacgggctcgttccgccggaattccagtcgagcggcggtgggtaaccctcctgctcgtccccgcctgccctctgctctcctgcgcccgtcaccggccgcgcagatccggtggcagcagccatggatgagtggattcgccaggccgagttgtgggggcgccaggccgaggcctggatccgtcagcagcccccggagcagatctacgtcgcggccgcggtggtcgccctcaccatcctggtgcttgtcgcagcatcttgtctgaaatcctcgaaaccaaacaccatagtgctatctgggcttagtggcagtggcaaaactacactcttctaccagcttcgggatggatcatcacatcaaggaactgtgacttcaatggaagaaaacaatgatacgtttgtgctgcattcggagcaagaaaggataggcaaagtaaaacctgtgcatattgttgatgttcctggtcatgcaaggctcaaacccaagcttgatgaagtcctgcctaaagcagctggggttgttttcgttgttgatgctcaagatttcttgtctagcatgcaagcttctgcagagtatctgtatgacattctgacaaaagcaactgtagcgaagaaaagggttcctatgcttatattctgcaacaagactgataaagttacagcccattcgaaggaattcatcaagaagcagttggaaaaagaaataaacaagctccgcgaatcaaggaaggccatttcatcagctgacatctctgatgaggtccagcttggtgtccctggagaggcattcaacttcagccagtgccagaacaaggtgacggtcgcagaaggtgctggtttgaccggcaatgtttcggttgttgagcaattcatccgtgaccatgtgaaggcgtagatcctaatcggagctgcgagcggctcacaggaagatggcaagactcaaagacatccattgcgccaatgtggaattcctgcatatacctttatcgggttttctgaccttttttagagaatcttagcattgcattgctaacacctgacaatcattggatatgagtgtacacagcttgttgagaactatacctagccataccatatggttctactttcgctctccaactttgatatttccttggtactgtttcgttgcagttggaattcctcttatggtatgccattggctacaaaaagtttggtggt

SEQ ID NO: 4524 - protein, 256 aa, Panicum virgatum
  misc_feature: Ceres CLONE 1805917
  misc_feature: Great-hit functional homolog of the protein sequence given in SEQ ID NO 9268
  misc_feature: Useful for making plants with modulated cold sensitivity
MDEWIRQAELWGRQAEAWIRQQPPEQIYVAAAVVALTILVLVAASCLKSSKPNTIVLSGLSGSGKTTLFYQLRDGSSHQGTVTSMEENNDTFVLHSEQERIGKVKPVHIVDVPGHARLKPKLDEVLPKAAGVVFVVDAQDFLSSMQASAEYLYDILTKATVAKKRVPMLIFCNKTDKVTAHSKEFIKKQLEKEINKLRESRKAISSADISDEVQLGVPGEAFNFSQCQNKVTVAEGAGLTGNVSVVEQFIRDHVKA

SEQ ID NO: 4525 - DNA, 1489 bp, Panicum virgatum
  misc_feature: Ceres CLONE 1805928
  misc_feature: Encodes the peptide sequence at SEQ ID NO. 4526
acacagccaaggctagagcatcaacacctgaatcggctgcttccagcgcctctctcctccccctccctcttccgatccacgcatctctagcccccgctgctctcgtcgttcgatcggcgctggtcggccactgaccatgacgaagcacggcgtggtgctcggccccgaggacgccgtcgtcccggcggcggcggcggcggcggcggccgcgcggcatttctcgttcccgccgccgaggacggggggcgactcgtgcaggaagctggcggcgcaggtcgacctcggcgccgccgtgatgggatcctggctcgactccatgaaggcctcctcgcccaggcacaggctcagggcgcccctgaccggcgccgccgacgcggagcacgacgactggatggagcggcacccgtcggcattggaccggttcgacgcgctggcggcggcggccaaggggaagcaggtcgctgtgttcctggactacgacggcacgctgtccccgatcgtcgaggaccccgaccgcgccgtcatgaccgacgagatgagggaggcggtgcgcggcgtggcggcgcgcttcccgacggcgatcgtcagcgggcgttgctgtgacaaggtgttcggcttcgtgcggctggcggagctctactacgccgggagccacgggatggacatccgagggcccaccgccggccccaaccaccacggcgaggagggcaagtcggtgctgtgccagccggcgagcgagttcctaccggtgatcgaggaggcgcacggcgcgctggtggagcgggtggaggcgtcgatcccgggcgccaaggtggagaacaacaagttctgcctctccgtgcacttccgctgcgtggaggaggccgcctggggcgcgctgttcgagcaggtccgcgccgtgctcagggattacccggacctccgcctcacccagggccgcaaggtgctcgaggtccgccccatggtcaagtgggacaagggcaaggccctcgagttcctcctcgactcgctcggttacgcggagcgcagcgacgtgttcccgatctacatcggcgacgaccgcaccgacgaggacgcgttcaaggtgctgcgcagccgggggcagggcgcagggatcctcgtgtccaagttccccaaggagaccggcgcgtccttctccctccgcgagccggccgaggtcagggacttcctgcgcaggctcgtcgacgccaacaccacctgatcgattcaggcgtcgacatgaccagcgagcagctctctatctaactcggctaccacctccctccctccagagcggaaagaacggcagaggcagaggagttcctttcttgttgcactactgtatctcagcttaggatcgagaagagcaccaccgttcatagaacctcctgctagcatttcccatgtccatccctttttttttttttgtcttcatttttttgtttctgctgctgctgtttcagtaccagaaaaaaaaaaaaaaaaaaaa

SEQ ID NO: 4526 - protein, 361 aa, Panicum virgatum
  misc_feature: Ceres CLONE 1805928
  misc_feature: Great-hit functional homolog of the protein sequence given in SEQ ID NO 9653
  misc_feature (1)..(235): Pfam Name: Trehalose_PPase Pfam Description: Trehalose-phosphatase
  misc_feature: Useful for making plants with modulated drought sensitivity
MTKHGVVLGPEDAVVPAAAAAAAAARHFSFPPPRTGGDSCRKLAAQVDLGAAVMGSWLDSMKASSPRHRLRAPLTGAADAEHDDWMERHPSALDRFDALAAAAKGKQVAVFLDYDGTLSPIVEDPDRAVMTDEMREAVRGVAARFPTAIVSGRCCDKVFGFVRLAELYYAGSHGMDIRGPTAGPNHHGEEGKSVLCQPASEFLPVIEEAHGALVERVEASIPGAKVENNKFCLSVHFRCVEEAAWGALFEQVRAVLRDYPDLRLTQGRKVLEVRPMVKWDKGKALEFLLDSLGYAERSDVFPIYIGDDRTDEDAFKVLRSRGQGAGILVSKFPKETGASFSLREPAEVRDFLRRLVDANTT

SEQ ID NO: 4527 - DNA, 1910 bp, Panicum virgatum
  misc_feature: Ceres CLONE 1805948
  misc_feature: Encodes the peptide sequence at SEQ ID NO. 4528
acaaagctcagcacgccgcgcagcacagccgtcgcacgatggcgcctctccgccaccgccgcctcctgctcgccgtcgtcctcctcctctccggtctcccccgccccgcccaccccttcaccgagctcgagtccgaccaggtcgcccgcttccaggagtacctccgcatccgcaccgcgcacccgtcccccgactacgccggcgccgccgctttcctcctcccctacgccgcgtccctgggcctccgcaccacaacgctccacttcaccccgtgcaggaccaagcccctgctcctcctcacctggccgggctccgacccgtccctcccctcggtgctcctcaactcccacatcgactccatccccgcggaggccgagcggtggtcgcacccgcccttcgccgcgcaccgcgaccccgccaccggccgcgtctacgcgcgcggcgcgcaggacgacaagtgcctccccgtccagtacctcgaggccatccggggcctccgggccgcggggttcgcgcccgcccgcaccgtccacatctcgctcgtccccgacgaggagatcggcggcgcggacgggttcgagaagttcgcggagtcggaggagttccgcgccctcaacgtcgggttcatgctcgatgaggggcaggcgtcgcccacggatgtattcagggtcttctacgcggacaggctggtgtggaggctcatcgtcaaggcggcgggggcgcccgggcacgggtcgaggatgttcgacggcgccgccgtggacaatttgatggattgcctggagaccatggccgggttcagggaggcgcagttcgggatggtgaaggccggggagaggggtcccggggaggtggtttcagtgaaccctgtgtacatgaaggccggcataccaagccccacgggttttgtgatgaatatgcaaccttcagaagcagaggttggctttgatcttcgccttcccccaactgcagacattgaacagataaaacgaagagtcaaagaggaatgggcaccagctcataaaaacttaacatatgagctgatacggaaaggaccagtaacggatgtggcaggacgtcccatatttacagcaaccgatgagtcaaacccatggtggtctgtatttgagcaggctatcacctctgcaggtggaaagctatccaagcctgagatcttatcttcaaccacagattcacggtttgtgaggcagttgggcattcccgcccttgggttttctccgatgagcaatactccgatactacttcatgacaataatgagtttctggaggataaagtattcctgaggggcatcaaagtttatgaacatgttatcagagcactgagctccttccaaggctgattcagaaaaggatgatgttgtacatagagtatgcatcgttgagttcccatctcattcactgaagacaggagtcagagctctggcttccaggtttctcatgattggttcagtctcgaacataccaaaggaaacactctgaagcaatcaaatccgcctaagatgctgatttgaatgataatctaagcatattggttcatgcatgcatatggtatgaagttatgacatgaatgtaacacgatagcatagaagccatgtctcatgtctggatagatatttctcccatttggaggctccattggttgtacccgtgtgctagaggaaaccgggtgttgtagaataatttctctccacttgaacattttaatgagtagagagacaagccatgcatggatactgtagatggagccctgaaattctgatatttagttgtatcatgtatgggtagagaaggtatgaaataaaggggtagatatccccaaaactgtatcgcatgtccaaacatatattgcaataaaggagatggctgtcaaaaaaaaaaaaaaaaaaaaa

SEQ ID NO: 4528 - protein, 440 aa, Panicum virgatum
  misc_feature: Ceres CLONE 1805948
  misc_feature (1)..(335): Pfam Name: Peptidase_M20 Pfam Description: Peptidase family M20/M25/M40
MAPLRHRRLLLAVVLLLSGLPRPAHPFTELESDQVARFQEYLRIRTAHPSPDYAGAAAFLLPYAASLGLRTTTLHFTPCRTKPLLLLTWPGSDPSLPSVLLNSHIDSIPAEAERWSHPPFAAHRDPATGRVYARGAQDDKCLPVQYLEAIRGLRAAGFAPARTVHISLVPDEEIGGADGFEKFAESEEFRALNVGFMLDEGQASPTDVFRVFYADRLVWRLIVKAAGAPGHGSRMFDGAAVDNLMDCLETMAGFREAQFGMVKAGERGPGEVVSVNPVYMKAGIPSPTGFVMNMQPSEAEVGFDLRLPPTADIEQIKRRVKEEWAPAHKNLTYELIRKGPVTDVAGRPIFTATDESNPWWSVFEQAITSAGGKLSKPEILSSTTDSRFVRQLGIPALGFSPMSNTPILLHDNNEFLEDKVFLRGIKVYEHVIRALSSFQG

SEQ ID NO: 4529 - DNA, 1844 bp, Panicum virgatum
  misc_feature: Ceres CLONE 1805953
  misc_feature: Encodes the peptide sequence at SEQ ID NO. 4530
atcgcagaagcaagaaggcgaacgaaaccgcccccgttcccgtacagttcatcaaagaaatctgaaaaccaatcaacagacccaaccaaaatcccctcgccgcctctcccgtgtcccttctcgtcgcgcggtcgcctcaatctcgaagcctccagcgccgccgcacattcgcgaaggctccagccaaaaatcctagggttctcgcgtcgtccgtcgccatgggctccaagaagcggtcgccccagcatcccgcctccccagccagcggcgaggtcgccggcgatgtcggcgccccaccggcgggtaaggccccgccggcggcggccccggtgggggtggtgccgaagcctccggacgtggcgccgttcctgaccaaggtctacgacatggtctccgacccggcgaccgacgcggtcatctcctggggcgccggcggcggcagcttcgtgatctgggactcgcacgcctttgagcgggacctgctgccgcggcacttcaagcacaaccacttcaccagcttcatacgccagctcaacacctatggatttcataaagttgatcctgataggtgggaacgggccaatgaaggttttgttaaggatcaaaaacatcttctgaagaccatcaagagaaagaagaaatctgctcaggatgcgactagtgatctgcagccggcacctgtcaaaactgcacctggcactgaaaatattgaaatcggaaaatatggaggtcttgaaaaggaggttgaaacccttaagagggacaaagcccttctaatgcagcagctagtagatctcagacagtaccagcaatcatctagccttgaagtgcagaatttaattcaacgcctacatgtgatggaacaaaaccagcagcagatgatggcacttttggcaatagttgtccagaatccaaatttcctcaatcagctggtgcagcaacagcacaggagtaattggtggaatgatgatgggagcaggaaaaggagattccgtgctctggaacaagttcctgtggctgatcaggggacttctgttgctggcgcacaaattattcagtaccatcctcccattcctgaaacctccaatcaagtaatatcagtaaatggagcttttgctccaactattgcacagccagtttcaagcccagaaactgccatgcccatggatgtagaaacaacttctaaccgtgtggatcctctggcttcaactggggacctttttactaacacctttgctctatctggcttggatgatatgtttcttggttgcgaaatagaagacatacttgcatcagagcaggactttgagatgggagaacaacagatctctcaagtggagcctccgttgactgttgaagattacaccgagtatcctgtttttcacactccacaattagagctggagcagcagccgcaggactgtcagatggaagcacaacggggccacaaaaatcctcaatatgctgatgtcataaccaaagcatgaatcgtcaaggagcacatcattcagtgacgattttttatggacggagtctttgaacccagagcgtttcaccaggtggctaccattgtttgaagtgctcactgctcaggatttagtatactagtaataatacattaaaaaaagacagcaacacatgctgactgtaggatattcattttccttgttggcgtgctcaaggtaataggacagggattttgtttttgtcccaactttctttgtcctagctacatggataacgcaaggtagcatcgatcatctgttgtatatactgttgtattggatttatatacatgaagagcaatgttgtattttttttattaaaaaaaaaaaaaaaaaaaa

SEQ ID NO: 4530 - protein, 422 aa, Panicum virgatum
  misc_feature: Ceres CLONE 1805953
  misc_feature: The sequence is a functional homolog of  SEQ ID NO 1805 in the  10/374,780 US patent application
  misc_feature: Useful for making plants with modulated growth and phenotype characteristics
MGSKKRSPQHPASPASGEVAGDVGAPPAGKAPPAAAPVGVVPKPPDVAPFLTKVYDMVSDPATDAVISWGAGGGSFVIWDSHAFERDLLPRHFKHNHFTSFIRQLNTYGFHKVDPDRWERANEGFVKDQKHLLKTIKRKKKSAQDATSDLQPAPVKTAPGTENIEIGKYGGLEKEVETLKRDKALLMQQLVDLRQYQQSSSLEVQNLIQRLHVMEQNQQQMMALLAIVVQNPNFLNQLVQQQHRSNWWNDDGSRKRRFRALEQVPVADQGTSVAGAQIIQYHPPIPETSNQVISVNGAFAPTIAQPVSSPETAMPMDVETTSNRVDPLASTGDLFTNTFALSGLDDMFLGCEIEDILASEQDFEMGEQQISQVEPPLTVEDYTEYPVFHTPQLELEQQPQDCQMEAQRGHKNPQYADVITKA

SEQ ID NO: 4531 - DNA, 1601 bp, Panicum virgatum
  misc_feature: Ceres CLONE 1805960
  misc_feature: Encodes the peptide sequence at SEQ ID NO. 4532
ctgcgcatctcacggccccgcctcccggctccggcaacgaatacgatcccccccgatggcctccgccggcggcggcgccttgacactccggcgggtgctgctcgcgtctgccgcgctccggctagcactggtggtgttcggggagtggcaggatgcccaccttgaggtgcgctacaccgacgtcgactacctcgtcttctccgatgccgccgcctccgtcgccgccggcgggtccccgttcgcccgcgcgacctaccgctactctccgctcctggccttcctgcttcttccgaactcgctcctccatgctgtctggggcaagctcctcttctccgccgcagatttgctagtgggattgttcatagacaccattctgaaactacgtggaatccctgagaaaatgcggatgtggtctgtgatagcttggctgttcaatcccttcacattcaccattggcacaagaggaaactgcgagccaatagtctgcgctgccatgctctggattctcatatgtttgatgaagggtagagtattgcaggcagcattctggtatgggcttatcgtgcacttcagaatatacccaatcatatatgcgattccttttgtaattgttctcgggaagagttatgccggtccttctggtaggcctactcttacaatgtggaactccgaacaacacttgcaaaatgacaaagccagtcaaagagaaggaccaacatcagtactggccattctacgggatttcctttcaaactttttgacaagaaatgcaatcctatttgggctactctcaggatttatgttctttgcctggactggtgttttcttctatctttatgggtgggacttcctaaacgaagcattactttaccatcttactcggactgatccaaggcacaatttctcgatatatttctatcatatatatctacatcatcaacaagggttctcaagtattcagaggcttgcatcgtttctgcctcaactgatcgtgcaactggcactcatcgctcgattctctagggaccttccattttgcatgtttctccaaactgttgcatttgttgcttttaacaaggtgatgacggcacaatactttgtgtggttcttctgcctgttgcccctcatcctcccttggaacagcatgaaccttaagtggaaaggtctggcctgcatgctagtgtggatggggtctcaattgcactggctcatgtgggcttacctgctggaattcaagggcagaaacgtctttgtacagctctgggttgcaggcctcgtgtttctagctgccaacacctttgttatgctcatggtgatcaagcaacacaagtacaccccactcttctcgtcaccagtgaagcctggcagcaaggttgctaccaagaaggaatagcctgcgcgcttgatctttctattttgccaactgatgtgtgattagaacacggatctttttttttccttgtgtttgtgttctgtaccagatcatgttacttacatcctgtagttttgccggtagctaatatggtgacgttacatgagaaatatttttttgttatcagaatctacaattagttctgattcaaaaaaaaaaaaaaaaaaaa

SEQ ID NO: 4532 - protein, 445 aa, Panicum virgatum
  misc_feature: Ceres CLONE 1805960
  misc_feature (6)..(270): Pfam Name: Mannosyl_trans Pfam Description: Mannosyltransferase (PIG-M)
MASAGGGALTLRRVLLASAALRLALVVFGEWQDAHLEVRYTDVDYLVFSDAAASVAAGGSPFARATYRYSPLLAFLLLPNSLLHAVWGKLLFSAADLLVGLFIDTILKLRGIPEKMRMWSVIAWLFNPFTFTIGTRGNCEPIVCAAMLWILICLMKGRVLQAAFWYGLIVHFRIYPIIYAIPFVIVLGKSYAGPSGRPTLTMWNSEQHLQNDKASQREGPTSVLAILRDFLSNFLTRNAILFGLLSGFMFFAWTGVFFYLYGWDFLNEALLYHLTRTDPRHNFSIYFYHIYLHHQQGFSSIQRLASFLPQLIVQLALIARFSRDLPFCMFLQTVAFVAFNKVMTAQYFVWFFCLLPLILPWNSMNLKWKGLACMLVWMGSQLHWLMWAYLLEFKGRNVFVQLWVAGLVFLAANTFVMLMVIKQHKYTPLFSSPVKPGSKVATKKE

SEQ ID NO: 4533 - DNA, 1690 bp, Panicum virgatum
  misc_feature: Ceres CLONE 1805975
  misc_feature: Encodes the peptide sequence at SEQ ID NO. 4534
acaaatcacaaaccccatcctctcctgtctctcaatctctctgacacacactctctctctctaaactgtccttctctctctagaaccatcaccaccagtcctctctctctccggccgagcgcatcgtcgaccatggtcgtcgagatgaaggagaacggcgtggcggcggcgggcgcgggcgagaaggcggcgcagcagctgagcgtgaagcgcggcgagccgacgctggtgccgccggcggagccgacgccgacgggggagcagtactacctctccaacctggaccagaacatcgccgtgatcgtgcagacggtgtactgctacaagcagccctccggcgacggcggcaaggacgacgtggcggcggcgctccgcgacgcgctggcgcgggtgctggtgcactaccaccctctggcggggcggctgggcatcagcccggagatgaagctgacggtggagctcaccggcgagggcgccgtgttcgtggaggccgacgcctgctgcgacctcgccgacgtcggcgacctcaccaagcccgaccccgccgcgctcggccagctcgtctactccgtccccggcgccaagcacattctcgagatgccacccatgaccgcgcaggtgacgaggttcaggtgcggcggcttcgcgctgggcctggccatgaaccactgcatgttcgacggcatcggcgccatggagttcgtcaactcgtgggccgagacggcgcgcggcgccgccgagctcaccgtgccgcccttcctcgaccgcaccgtgctccgggcgcgcgacccgcccgcgcccaccttcccgcaccacgagttcgccgagatccccgacgtctccgacacggcggcgctctacggctcccaggagctcctctaccgctccttctgcttcgacccggaccgcctggagcgcgtccgggcgctggcgctcgccggcggcgacctgggccgctgcaccaccttcgaggcgctctcgggcctcgtgtggcgcgcgcgcaccaaggccctggggctcgcgcccgagcagcgcaccaagctgctcttcgccgtcgacggacggcgccggttcgtgccgccgctgccccgcggctacttcggcaacggcatcgtgctgaccaacgcgatcgccaccgccggcgagctgctggcggcgcccgtgtcgcgcgcggcggggctggtgcaggacgccgtgcggatggtcaccgacgagtacatgcggtcggcggtggactacttcgaggcgacgcgggcgcggccgtcgctggcgtccacgctgctcatcaccacgtggtccaggctcgagttccacggcgccgacttcgggtggggcgagcccgtcatgtccggccccgtcacgctgccggagaaggaggtcatcctcttcctcgcgcacggcaaggagaggaagagcatcaacgtgctgctcggcctgccggccaccgccatggacgccttccaagagctcatggacgagatatgatggatcttgtgcggccggccggtgcccgcgcgccggctgggacagacctgggtgctatacatacatatatataaatgcagggtgctttatgcttaaattgcacggggtttacagtacggttgtgttaattgtggtgcatgcgtgtgttaatattcactctatgttggtgtttaatggatatatatgagaattcgttatcagctgg

SEQ ID NO: 4534 - protein, 450 aa, Panicum virgatum
  misc_feature: Ceres CLONE 1805975
  misc_feature (1)..(422): Pfam Name: Transferase Pfam Description: Transferase family
MVVEMKENGVAAAGAGEKAAQQLSVKRGEPTLVPPAEPTPTGEQYYLSNLDQNIAVIVQTVYCYKQPSGDGGKDDVAAALRDALARVLVHYHPLAGRLGISPEMKLTVELTGEGAVFVEADACCDLADVGDLTKPDPAALGQLVYSVPGAKHILEMPPMTAQVTRFRCGGFALGLAMNHCMFDGIGAMEFVNSWAETARGAAELTVPPFLDRTVLRARDPPAPTFPHHEFAEIPDVSDTAALYGSQELLYRSFCFDPDRLERVRALALAGGDLGRCTTFEALSGLVWRARTKALGLAPEQRTKLLFAVDGRRRFVPPLPRGYFGNGIVLTNAIATAGELLAAPVSRAAGLVQDAVRMVTDEYMRSAVDYFEATRARPSLASTLLITTWSRLEFHGADFGWGEPVMSGPVTLPEKEVILFLAHGKERKSINVLLGLPATAMDAFQELMDEI

SEQ ID NO: 4535 - DNA, 1082 bp, Panicum virgatum
  misc_feature: Ceres CLONE 1805984
  misc_feature: Encodes the peptide sequence at SEQ ID NO. 4536
aaatggagtggaatggaatcactaattccggtttggctctgaatcactaatcacccagccgtctcgcacggtccacacgctcccaagccgacggctcccctccgagaatccatggccgccctccgcgcgtccccgctcttcctcccacagcctctctcgccgtcggcgtcctcccggtcccgtcgttgcgccgcctgccgctgtgtagccgccaccgcggccaggccgggccccgctccctacaggaccggcgtccatggaggccgcggcggcggcaagaagaggcttcttgcgagccggaggaggccgggatgttgcctgcccgcgacggaggaaggcgttgctgcggcggccgctgctagcgaggaggaggaggaggacgggtacctggcgcgggaggccgggtggggcgtgcggcggatggggcgggtcgcggaggagatgcggcgggtggcgcaggtccaggccgaggccttccacgtccccgtcgcgctcttcaacgacttcttcttcgacttcttcaaagctgaggtgctgtcggcgctcatctacagagtgaggaactcgccgccggacagatatgcttgtttggtggctgaagaagctgagccagcctcccagctgtcacaggcaccatatgagaggattatcggtgttgtggattgcaccgtgcaggatgaagatggcatccttaagcacctccaaggagctgatgagtacctctacgtgtcaggaattgcagtgctaccgtcattcaggaggaggaaggtagggacagcactgctgaaggcctgtgaggcactagggctccaatggaggcatagattcatggttctgagagcatatgaggatgacgatggcgcgcgaggcctctacgccaaagaagggtacagggttgtgtcaaggaatcctgactgggtcacctgggttgggaggagaaggcgtgttctgatgataaaagagttgccagttcacgatgacatgatacagcagcaatgaaagaattgggatgcattgcttcttgtgtgtacgagtagcaccatgtacatgtctttttggagtaaaaaaaaaaaaaaaaaaaa

SEQ ID NO: 4536 - protein, 295 aa, Panicum virgatum
  misc_feature: Ceres CLONE 1805984
  misc_feature (1)..(91): Pfam Name: Acetyltransf_1 Pfam Description: Acetyltransferase (GNAT) family
MAALRASPLFLPQPLSPSASSRSRRCAACRCVAATAARPGPAPYRTGVHGGRGGGKKRLLASRRRPGCCLPATEEGVAAAAAASEEEEEDGYLAREAGWGVRRMGRVAEEMRRVAQVQAEAFHVPVALFNDFFFDFFKAEVLSALIYRVRNSPPDRYACLVAEEAEPASQLSQAPYERIIGVVDCTVQDEDGILKHLQGADEYLYVSGIAVLPSFRRRKVGTALLKACEALGLQWRHRFMVLRAYEDDDGARGLYAKEGYRVVSRNPDWVTWVGRRRRVLMIKELPVHDDMIQQQ

SEQ ID NO: 4537 - DNA, 1428 bp, Panicum virgatum
  misc_feature: Ceres CLONE 1805998
  misc_feature: Encodes the peptide sequence at SEQ ID NO. 4538
ctccaccttgtggggtgccgccggacagcttcgaccactcggtctagtgttcgagtactgcaaaggagtccaggacagtgcggaaggtgtcgtcgctgtggcctcgaagcctgcacgtctttgtcactgccgaccagccatggcgtcccccgcggcgtccggcgaggttcagccccccatcctcccggccctcctcctcttccgccgcctggacgcggccttccgcgccgcgctgggccggcgcttccgcctcctcgacttcttcgcatcgggcgagcccgtcccggttttcctcgccggcgccgcggcctcgtcggacccgccccgcgccgcggtcgtcgtgggaggcggcgccgtccgcgtggacgccgcgttcctcgacgccgtcccgtccctcggattcgtcttcagcacgggcgcgggcgtcgaccacatcgacctccacgagtgcgcgcgacgcggcgtcgccgtcgccaactccggcacggtctactccgccgacgtcgctgatcaggccgtcggcatgctcatcgacgtgctaaggcgcgtctcggcggccgagcggttcgtccgccgcggcctctggccagtgcagggggactaccccctcggcaccaagctaggccgcaagcgtgttggtatcatcggcttggggaacatcggttcactgatcgcgaagaggcttcaagcttttggctgtgtcatctattacacctccagaagactgagggattcagtcccgtacaaatacttccctaacgttcacgatcttgcttctgaatcagatgtgcttgttgtcgcatgcgcgttgaacaaggacacacggcacattgtcaacaaggatgttctagaggccctgggaaaggatgggatcatcataaacatcggtcgaggagcaaatgtcgacgagatggagttggttcaggcgctgaaggagggaaggattgcaggagctggtctagatggctttgagaatgagcccaaggtgccaccagagctcttctccatggacaatgtggtaatgacgcctcatgttgcggttttcacatcagagtccaggtcagacctgcgtgacaccatgattggtaaccttgaagccttcttctccgggaagccattgcttacgccggtgcttccctggtaagtcaggctacattgcaggtcaatccatcatcttaatatgatgttggaaggtagtgttattttattttggctgcaagatgcatgcctactggatgcagagcgtgccatttggtatttcagatagtagcatctcttcggaaccgagaaaaaaaaaacagaatgattcctcggggtgaattcttctttcataatcggtatgctttttggttatcaacaattgaagatcctaaatgataatgaaaaatagatctttattttcagttgtaaaaaaaaaaaaaaaaaaaa

SEQ ID NO: 4538 - protein, 334 aa, Panicum virgatum
  misc_feature: Ceres CLONE 1805998
  misc_feature (1)..(271): Pfam Name: 2-Hacid_dh Pfam Description: D-isomer specific 2-hydroxyacid dehydrogenase, catalytic domain
MASPAASGEVQPPILPALLLFRRLDAAFRAALGRRFRLLDFFASGEPVPVFLAGAAASSDPPRAAVVVGGGAVRVDAAFLDAVPSLGFVFSTGAGVDHIDLHECARRGVAVANSGTVYSADVADQAVGMLIDVLRRVSAAERFVRRGLWPVQGDYPLGTKLGRKRVGIIGLGNIGSLIAKRLQAFGCVIYYTSRRLRDSVPYKYFPNVHDLASESDVLVVACALNKDTRHIVNKDVLEALGKDGIIINIGRGANVDEMELVQALKEGRIAGAGLDGFENEPKVPPELFSMDNVVMTPHVAVFTSESRSDLRDTMIGNLEAFFSGKPLLTPVLPW

SEQ ID NO: 4539 - DNA, 1100 bp, Panicum virgatum
  misc_feature: Ceres CLONE 1806005
  misc_feature: Encodes the peptide sequence at SEQ ID NO. 4540
aacgctcacagcaccgcacacacagaaaaccaccagcagcgcctcggttttacggctctgccctcccccgccccgcgcgctcgaagaagccatgaagctggaggtgatgcccaagcagagggtcctggaggcggagcagagggaggaggccatggagatgagcggcctggagctgtggaagcacgagaagccccccaggatctgccccatgccgtcgccgatcccgccgccgccggcgtgcgacgagacggcgctcgtgccgccgctcaacttcgccatggtcgacgacggcatcttccgctccggcttcccggagacctccaacttccggttcctcaagtcgctcaacctccgctccatcgtgtacctgtgcccggagccgtacccggagacgaacacggagttcctcgaggagaacgggatcaagctccaccagttcggaatcgaggggcgcaaggaaccattcgtcgaaatccccgatgacaaaattcgggaggcgctgaaagttgtcctagacccaagaaaccaacccctgcttattcactgcaagagaggcaagcaccgaactggctgcgtggtcgggtgcttgaggaagctgcagaagtggtgcttgtcctccgtcttcgacgagtaccaccgcttcgccgctgcgaaagcgaggatcactgaccagagattcatggagctgttcgacgtctcaaccttgaagcacctgacaccctcgaattgttaaccaaggcgcgcgatcgctgggtcgcccttgatccccccaccccaagtctagtacatctcccagcctatgttcctgcagctactgaaccgaccgattcagcagtgaataattttggaaccccgtagagtcggtgaggtagtgatgagaccattgcaaaatgtttgtgctcgagaggtttagttttcccctgcttagcgcattgcggagcctagtggtagcatcgcgagaggttctctcttttttggtgactcccgcgatcgcgaggaattcgctactgctttcttccgggtactgaagcatgtactcgggcagctttgttgagcgggaatgaactaatctctgaatgcaaaaaaaaaaaaaaaaaaaa

SEQ ID NO: 4540 - protein, 213 aa, Panicum virgatum
  misc_feature: Ceres CLONE 1806005
  misc_feature (1)..(159): Pfam Name: Y_phosphatase2 Pfam Description: Tyrosine phosphatase family
  misc_feature (55)..(212): SWISSPROT Homolog: EC 3.1.3.48 Tyrosine-protein phosphatase SIW14
MKLEVMPKQRVLEAEQREEAMEMSGLELWKHEKPPRICPMPSPIPPPPACDETALVPPLNFAMVDDGIFRSGFPETSNFRFLKSLNLRSIVYLCPEPYPETNTEFLEENGIKLHQFGIEGRKEPFVEIPDDKIREALKVVLDPRNQPLLIHCKRGKHRTGCVVGCLRKLQKWCLSSVFDEYHRFAAAKARITDQRFMELFDVSTLKHLTPSNC

SEQ ID NO: 4541 - DNA, 1176 bp, Panicum virgatum
  misc_feature: Ceres CLONE 1806025
  misc_feature: Encodes the peptide sequence at SEQ ID NO. 4542
gccgctttacggctgcccaccccccaaagaatccaccgcacccacctagtgccgcgggcggccgccggcaatggcggcggtggcggcgcacggcggcgactacctgcggcgcttcgccgcggagacggagtggtacaacgagatcgtcctcagcgcggtggcgcccggcaactggtggcgcggtctgccgcacccggtgcagtcgtggatgcgcaactgcgtcggcggctacctcctctactacctctcgggcttcctctggtacttcgtcatctactactggaagcgccacgcctacatccccaaagattccgtcccttcaaatgaagctatgaggaagcaaataattgtcgcatcgaaggctatgcctttctattgtgctcttccagctttatctgagtacatgattgagagcggatggacacggtgtttctttaatatcagtgaagttggtgtgcccatgtacttaattaatttggctttatatctcatctttgtggagtttggaatttactggatgcacagagagttgcatgacataaagccattatacaaatatctacatgcaacccaccatatttacaacaaggaaaatactctgtctccttttgccgggctcgcgtttcatccagtggatgggattttgcaagcaataccacatgtgtttgccctcttcattttcccaacgcacttcaggacgcacattgctcttatattcttggaggccgtgtggacggcaaacatccatgactgcattcacggcaaggtatggccggtcatgggtgccggttaccataccattcaccacacaacttaccgccacaactatggccactacaccatctggatggattggatgtttggcacgctccgtgagccagtagatatactcaagaacgagtaagatgtgtgttctctgatgctaatctgctcggcctgcttgggcactgtctgtcgcctgaagcattggtatgtttacttcagtatgctaggtgcaatgtcatgttgtgttgccccccgtaattttagctctgttcctcgtgatgcaagggagcccaggacgaataaaagtttgctagatgcattctgggttccagtcgcctgtacaattcggcacctccatgtgtcaatatagaatgtacaatgctttccttgcaaaaaaaaaaaaaaaaaaaa

SEQ ID NO: 4542 - protein, 277 aa, Panicum virgatum
  misc_feature: Ceres CLONE 1806025
  misc_feature (2)..(212): Pfam Name: Sterol_desat Pfam Description: Sterol desaturase
  misc_feature (10)..(272): SWISSPROT Homolog: EC 1.14.21.6 Delta(7)-sterol-C5(6)-desaturase
MAAVAAHGGDYLRRFAAETEWYNEIVLSAVAPGNWWRGLPHPVQSWMRNCVGGYLLYYLSGFLWYFVIYYWKRHAYIPKDSVPSNEAMRKQIIVASKAMPFYCALPALSEYMIESGWTRCFFNISEVGVPMYLINLALYLIFVEFGIYWMHRELHDIKPLYKYLHATHHIYNKENTLSPFAGLAFHPVDGILQAIPHVFALFIFPTHFRTHIALIFLEAVWTANIHDCIHGKVWPVMGAGYHTIHHTTYRHNYGHYTIWMDWMFGTLREPVDILKNE

SEQ ID NO: 4543 - DNA, 1182 bp, Panicum virgatum
  misc_feature: Ceres CLONE 1806050
  misc_feature: Encodes the peptide sequence at SEQ ID NO. 4544
actgccaggcgccacccagccaagcaaggtagatagcggctagctttggacggtaccctccctagctggtggtggcagttagcgatcgatggccgtcgccggcgccctcctcgtcgtcctcagcatcctcgcccgggaggccgcggccggcggctacggcgggtggcagagcgcgcacgccacgttctacggcggcggcgacgcgtccggcacaatgggcggcgcgtgcgggtacggcaacctgtacagcagcgggtatggcacgaacacggcggcgctgagcacggcgctgttcaacgacggcgcggcgtgcgggtcgtgctacgagctgcggtgccagaacgcgggcggatcgtgcctgccgggctccatcaccgtgacggccaccaacttttgcccgcccaactacggcctccccagcgacgacggcggctggtgcaacccgccgcgcccgcacttcgacatggccgagccggccttcctccacatcgcgcagtaccgcgccggcatcgtgcccgtcgccttcaggagggtgtcgtgcgtgaagaagggcgggatccggttcaccatcaacggccactcctacttcaacctggtgctggtgaccaacgtggcgggcgccggcgacgtgcggtccgtctccatccggagcacccgcacggggtggcagcccatgtcccggaactggggccagaactggcagagcaacgccttcctcgacggccaggcgctctccttccaggtcaccgccagcgacggccgcgccgtcaccagcaacaacgccgcgccgcgcggctggcagttcggccagaccttcgagggcgcccagttctgatgcccttccgtcttctcccctccgactcgatccatcgtctccacagaaagcaagcaccgggggcgacgacggggaggggttatattaattaatcaagctgttattgatcattgggtgatcctcgatttgtttggggttttctttttttgccgtttcgcacgtgatgatgggatggggaagacgaggccctcttcgactatattgaacaagagaagagggcctcgcgctatgctgaggctgctaatctagcacccgcctagacgacgtttccttctctggacttctgctagatcggagtgaatgaatgaatgagacattactctccctaaaaaaaaaaaaaaaaaaaa

SEQ ID NO: 4544 - protein, 248 aa, Panicum virgatum
  misc_feature: Ceres CLONE 1806050
  misc_feature: Great-hit functional homolog of the protein sequence encoded by LOCUS At1g69530
  misc_feature: Great-hit functional homolog of the protein sequence encoded by LOCUS At2g03090
  misc_feature: Useful for making plants with altered cell wall content and/or composition
MAVAGALLVVLSILAREAAAGGYGGWQSAHATFYGGGDASGTMGGACGYGNLYSSGYGTNTAALSTALFNDGAACGSCYELRCQNAGGSCLPGSITVTATNFCPPNYGLPSDDGGWCNPPRPHFDMAEPAFLHIAQYRAGIVPVAFRRVSCVKKGGIRFTINGHSYFNLVLVTNVAGAGDVRSVSIRSTRTGWQPMSRNWGQNWQSNAFLDGQALSFQVTASDGRAVTSNNAAPRGWQFGQTFEGAQF

SEQ ID NO: 4545 - DNA, 1230 bp, Panicum virgatum
  misc_feature: Ceres CLONE 1806082
  misc_feature: Encodes the peptide sequence at SEQ ID NO. 4546
gacccgctagatccgctccccgtcttctcgcctcgcacatcggcaaccgcagcacctcacctcccccatgggctctcaccgccgctgacactggggcccaacgctctcgcccgcctccgcctccgccgccgcctcctcccccttcttcccctcctcctcctcttattgcctccactgacccgcgccgcccgcccccgcccaccgacatcggagaccttagtcctagctgcagtcggaaccgccgggccggctcgccgctcccccgcccgaagcctccccgagcacttggatgcgccggctgctccgatggctgcccttccgcccgccgcagagggccccgacgccgtggagatccgcgaggtctgggcggggaacctggaggaggagttcgcggtgatccgcggcgtcatcgacgagtacccgtacgtcggcatggacacggagttcccgggcttcgtggtgcagccgagcggcaagttcgcctgccagagcgacgtcaactacgccagcctcgcgggcaacgtcaacgtgctcaagctcatccagcttggcctcaccctctccaacgaggccggcgagctcccgccgttcggcacggggggccggggctgcatctggcagttcaacttccggggcttcgaccagcgcaccgacccctacagcgccaactccgtcgacatgctccgcctcagcgggatcgacttcgaccgcttcgcggctgagggggtcgactccacccgctttgccgagctgatgatgtcgtccggggtcgtgctcaacgacaacatccagtgggtcacgttccacagcgggcacgacttcggctacgtgctcaggctgctcaccggccgggaaatgcccaacaccttggatgagttcctgaagctcaccaagatcttcttcccggtgctgtacgacatcaagcaactcatgaagtactgtgatggcctatatggcgggctgaacaaacttggggagctgctcaaagtcgagcgcgttgggatcagccaccaggccggttcagattcactgatgactttgcgctgcttcttgaaggtcaagaatttgtacttgaaggaatctgtcaagctgtatgatggtttgttgtatgggcttattcctggggaaggggtgatcaaacatggacctccgcccatttaatctgtaatggatagttaaataaccagattctgaatgagaaaaaatgcagaacaaaagctattgtcggtg

SEQ ID NO: 4546 - protein, 284 aa, Panicum virgatum
  misc_feature: Ceres CLONE 1806082
  misc_feature (1)..(234): Pfam Name: CAF1 Pfam Description: CAF1 family ribonuclease
MAALPPAAEGPDAVEIREVWAGNLEEEFAVIRGVIDEYPYVGMDTEFPGFVVQPSGKFACQSDVNYASLAGNVNVLKLIQLGLTLSNEAGELPPFGTGGRGCIWQFNFRGFDQRTDPYSANSVDMLRLSGIDFDRFAAEGVDSTRFAELMMSSGVVLNDNIQWVTFHSGHDFGYVLRLLTGREMPNTLDEFLKLTKIFFPVLYDIKQLMKYCDGLYGGLNKLGELLKVERVGISHQAGSDSLMTLRCFLKVKNLYLKESVKLYDGLLYGLIPGEGVIKHGPPPI

SEQ ID NO: 4547 - DNA, 1097 bp, Panicum virgatum
  misc_feature: Ceres CLONE 1806089
  misc_feature: Encodes the peptide sequence at SEQ ID NO. 4548
actccaacacaagtaatcatccctcttcaagcgcaagctccccatggccaacccatacaccttccttaggcctcacatagaacacctctggttccaaagaagcttggtctctccaccccctcctgcattcacaaaggaagcactccctcttctcagcctcctacctccaagccatgactacaaccactttcacaagaatgatgggctgcggaagaaggaaaagcgggttacggaggatgtggatatcaaactccgaattggacccccatctccaaaccgtgatctccccctcaatcttgctaaaattagtgctaccgtcgctggtgctggcgataacaaggtggaagaatacgaagatctgggatcagaagggggtgctgctggtgacggccgttgcttggagtacttcgccatcgggaagcttaccaagggaaaatattggatccctaccccagctcagatcctctttggccccacgctcttcgcgtgcccggtgtgctgcaagacattcagcagatacaacaacctgcagatgcacatgtgggggcacgggtcccagtaccggcgcggcccggactccctccgcggcgcgcagccggcggcgatgctccggctgccgtgcttctgctgcgcgccggggtgccggagccacgtggaccacccgcgggcgcggccgctcaaggacttccggaccctgcagacccactaccggcggaggcactgcgcccggcccttcctctgccgccgctgcggcaaggccctcgccgtgcgcggggactggcgcacgcacgagaagaactgcggccgccggtggcgctgcgcctgcggctccgacttcaagcacaagcgctcgctcagggaccatgtccgcgcgttcgggcgcgaccatgtcgaggagcacccaccggcgtcgtcgatcggctgcaaccgcggtgtagcgggcgaggaccggccgggtgctggcgatcagatgtaggcatgtagcaggcttgacagcagcagcagcagcagcctttttttttattagtcgatccggtgtagtggtcaagtcccaagctaagtgtgcatctttgattcaaaaaaaaaaaaaaaaaaaa

SEQ ID NO: 4548 - protein, 310 aa, Panicum virgatum
  misc_feature: Ceres CLONE 1806089
  misc_feature (1)..(23): Pfam Name: zf-C2H2 Pfam Description: Zinc finger, C2H2 type
  misc_feature: The sequence is a functional homolog of  SEQ ID NO 1079 in the  10/666,642 US patent application
  misc_feature: The sequence is a functional homolog of  SEQ ID NO 306 in the  10/666,642 US patent application
  misc_feature: Useful for making plants with modulated growth and phenotype characteristics
MANPYTFLRPHIEHLWFQRSLVSPPPPAFTKEALPLLSLLPPSHDYNHFHKNDGLRKKEKRVTEDVDIKLRIGPPSPNRDLPLNLAKISATVAGAGDNKVEEYEDLGSEGGAAGDGRCLEYFAIGKLTKGKYWIPTPAQILFGPTLFACPVCCKTFSRYNNLQMHMWGHGSQYRRGPDSLRGAQPAAMLRLPCFCCAPGCRSHVDHPRARPLKDFRTLQTHYRRRHCARPFLCRRCGKALAVRGDWRTHEKNCGRRWRCACGSDFKHKRSLRDHVRAFGRDHVEEHPPASSIGCNRGVAGEDRPGAGDQM

SEQ ID NO: 4549 - DNA, 1144 bp, Panicum virgatum
  misc_feature: Ceres CLONE 1806097
  misc_feature: Encodes the peptide sequence at SEQ ID NO. 4550
ctaagctaatcaagctactcaatcaacaagagttaatattgctcgctcgctaatcagctatcaattaaaattattcgactaggctaactaggtcccctccccctctctctgcttttcatggtgctggttggtgcccaaagaataatctcataggctttcatgtttcatccctcctgactcctgagatctcgacgaacagcagcagcatcacagcagctagcaggctggcaacacgcggcatggagcaccagctgttcgatgaccccttctctagcagcatctcgtcgctggaggcggacatcttctccgccggcggccagctgccgtcgccgccgtggccggacctcgacctcgacctcgacgacgacgacatccacgacctctccgcgccggccggcaaccccacctcctcaggaggctatggctcgggcggaggctccggaggctcccacaggaagctcagccacaacgcgtacgagcgcgaccgccggaagcagctcaacgagctctactcctcgctccgctccctcctccccgacgctgaccacactaagaagctgagcatccccaccacggtctcccgagttctcaagtacatccccgagctgcagaagcaggtggacaacctggagaggaggaagaaggagctgacaaacgccaactgcaaaccaggagttctgaacacgagccagattgtaactcccattgtttctgctacttgcctcaacgatacggagatcatggttcaggtcagcctgcacagcaacgtggctgccacaagtcttcctctgtccaagtgcataaaagtgatggagaacgaaggccttcacctaattagttcatcaacttactccaccttcgacaacaggacattctatagcctccatgttcagagaagtcaaagaacgatgaaggagtgcccagcattctgcgatgaactggagaggattatcaagaagaaagcaggggcttagctgcagtgcgccgtagtacatacatatatagcagtatagcaccgtcgcgtgtattattagttggatcctatatgagtatacgctaattaattaagagtgcatgtaaatagtgggttaattaatatgttgtcgtgtgtggatggacggaccaaaaaaaaaaaaaaaaaaaa

SEQ ID NO: 4550 - protein, 244 aa, Panicum virgatum
  misc_feature: Ceres CLONE 1806097
  misc_feature (1)..(53): Pfam Name: HLH Pfam Description: Helix-loop-helix DNA-binding domain
  misc_feature: The sequence is a functional homolog of  SEQ ID NO 1315 in the  10/666,642 US patent application
  misc_feature: The sequence is a functional homolog of  SEQ ID NO 1542 in the  10/666,642 US patent application
  misc_feature: Useful for making plants with modulated growth and phenotype characteristics
MEHQLFDDPFSSSISSLEADIFSAGGQLPSPPWPDLDLDLDDDDIHDLSAPAGNPTSSGGYGSGGGSGGSHRKLSHNAYERDRRKQLNELYSSLRSLLPDADHTKKLSIPTTVSRVLKYIPELQKQVDNLERRKKELTNANCKPGVLNTSQIVTPIVSATCLNDTEIMVQVSLHSNVAATSLPLSKCIKVMENEGLHLISSSTYSTFDNRTFYSLHVQRSQRTMKECPAFCDELERIIKKKAGA

SEQ ID NO: 4551 - DNA, 1394 bp, Panicum virgatum
  misc_feature: Ceres CLONE 1806105
  misc_feature: Encodes the peptide sequence at SEQ ID NO. 4552
gtccccccacttccgcgttgaccccgagcaagcggcagtagcaagcctctccgcccacactgatggctctggtgacctcgggctcgggcgccgggccggtgatcaacgaggtggagatgaacggcggcgctgacccgagcgcgaccaccgtgcgcgccaccgtcgtgcaggcctccaccgtcttctacgacacccccgccactctggataaagcagagagattgatagaagaggctgccgggtatggttcacagttagttgtgtttccggaagctttcattggaggctatcctcgaggatccacttttggttttgggatcagtgttagtatttctaatccaaaagacaagggaaaggaagcattccagaggtatcacgcagctgctatagatgtgcctggtccagaggtgacacgcttggctgctatggctggaaaatataaggttttcttggtgatgggggtgattgaaagggaaggttatacactttattgtttagtgctcttctttgatcctcttggccgttatctgggtaagcaccgcaagctcatgcctacagcattagagagaattatatggggttttggagatggatcgacaattcctgtttatgatactccacttggaaagattggggcccttatttgctgggaaaataaaatgccacttttgaggacagcgctttatgctaaaggtattgagatatattgtgcccccactgctgattccaggcctgtttggcaagcctccatgacgcatattgccttggagggtggatgctttgtcttgtcagcaaaccaattctgccgcagaaaggactatcctcccccagcggagtacgagtttggtggtttaggtgaagagccctctgcagacactgttgtttgccctggaggcagcgttatcatctctccatctggagaagtcttggcaggtcccaactacgacggagaggcgctgattacagccgaccttgatctgggagaaattgttcgagccaagtttgatttcgacgtggtgggccactacgctcgacctgaggtcctgagcttggtcgtgaatgaccagccacagctccctgtgtccttcacttcttcagctgagaaaactccagcaatgaagagtgatagcagtgctaagtcttactgattgactatgacccgaccatgaacctttgattaccgttgaaccaatagcttggtggcaggtagggtctgtcttggatgggagttgtaacttttgaactcgtatctctctttagtgaatgtatataggaaggtggaaaacatggcagacgcacctagtgttccttgttgcttgtaaaggaatgcacagcgtctcaatgataaacaacgtctatgcaggttgtgccctcaaaaaaaaaaaaaaaaaaaa

SEQ ID NO: 4552 - protein, 361 aa, Panicum virgatum
  misc_feature: Ceres CLONE 1806105
  misc_feature (1)..(190): Pfam Name: CN_hydrolase Pfam Description: Carbon-nitrogen hydrolase
  misc_feature (1)..(348): SWISSPROT Homolog: EC 3.5.5.1 Nitrilase 4
  misc_feature (13)..(345): SWISSPROT Homolog: EC 3.5.5.1 Nitrilase 4
MALVTSGSGAGPVINEVEMNGGADPSATTVRATVVQASTVFYDTPATLDKAERLIEEAAGYGSQLVVFPEAFIGGYPRGSTFGFGISVSISNPKDKGKEAFQRYHAAAIDVPGPEVTRLAAMAGKYKVFLVMGVIEREGYTLYCLVLFFDPLGRYLGKHRKLMPTALERIIWGFGDGSTIPVYDTPLGKIGALICWENKMPLLRTALYAKGIEIYCAPTADSRPVWQASMTHIALEGGCFVLSANQFCRRKDYPPPAEYEFGGLGEEPSADTVVCPGGSVIISPSGEVLAGPNYDGEALITADLDLGEIVRAKFDFDVVGHYARPEVLSLVVNDQPQLPVSFTSSAEKTPAMKSDSSAKSY

SEQ ID NO: 4553 - DNA, 1402 bp, Panicum virgatum
  misc_feature: Ceres CLONE 1806132
  misc_feature: Encodes the peptide sequence at SEQ ID NO. 4554
ctctccctccctcggccttccctagcggcgccgactggcgagcggcgccgcccttctgcaggtcttcaccgcccgttcgccggcatcaagcattcgtcagaagcaaggaagggcaatcggggatacaagggcttgttctcgccatgtctcggtcaccgcacctcccgccccgctgcccacccctgggtcctcagatcactcgaagggatgacagcttgttcacccagagctgcaggtttccgtctggggatccgttctttggtgagccgccgtgctggctcgatgatctccttgcagattctgggaaagtccccaaccttcctcctctcagaagggcttgcagcgactccgacgctatcttggacgccctgtcgacgttccagagcccgattcatcccatcgaggaaggggatctaagcccaggtggtgaagccgaggacctgttggatgctgctgaaggtggggaaagtggttctgtggttgaggccagctgcgtttacgggccgaattcaccaagacagaagagtagactgacaacttcagagagttccatggtaaatgctgtgcttgagaatgtccccagcaaccccttgcagtacctgaccattgatgcctccagtggcttgaatggtaatgtggcaaatggaactgctgatgctactgatgcttttggccatcctgatcaagacaagacatttaaaaggcgttcggggcagagatctagggtccggaagcttcaatacattgctgaacttgagagaactgttgattcacttcagaacatgggagctgatttggctgtcagagtggcatcacttttccagcttcacaattctctttcaatggaaaacaagcaactgaggatacagatttctactcttcagcatgcaaaactaattaaggatggtcagacgcaggcactaaagaatgaagctgagaggctgaagcaggtgtccgcctgtcaccgcaggagcagaagcgtcacttcctgttataacctgagcccttatggagacgcgtcagcagtcaattggcagatgcctgacatggcaaagctcagcctgaacggcagctcagtctccccgagaggcggctatggtctgtgacagcacctgagcctgacacctcttagaagagaaatcgaggcattaccctagataactgttcgctaaccttacccaagcatagatttgagatgaggtcctatcgttgactaggagagtagggtgtatcggtcgtttctggagaattacagaggttaccagcttagtttacctcgtagagtgctgcagtctgactcccagatttgaaaactgacggagtgaagcaagcctgtttggcttgctgtttagcggttgcaatctgctcgtttgatgctctttaaaaaaaaaaaaaaaaaaaa

SEQ ID NO: 4554 - protein, 320 aa, Panicum virgatum
  misc_feature: Ceres CLONE 1806132
  misc_feature: Great-hit functional homolog of the protein sequence given in SEQ ID NO 9598
  misc_feature (2)..(48): Pfam Name: bZIP_1 Pfam Description: bZIP transcription factor
  misc_feature: Useful for making plants with altered alkaloid content
MSRSPHLPPRCPPLGPQITRRDDSLFTQSCRFPSGDPFFGEPPCWLDDLLADSGKVPNLPPLRRACSDSDAILDALSTFQSPIHPIEEGDLSPGGEAEDLLDAAEGGESGSVVEASCVYGPNSPRQKSRLTTSESSMVNAVLENVPSNPLQYLTIDASSGLNGNVANGTADATDAFGHPDQDKTFKRRSGQRSRVRKLQYIAELERTVDSLQNMGADLAVRVASLFQLHNSLSMENKQLRIQISTLQHAKLIKDGQTQALKNEAERLKQVSACHRRSRSVTSCYNLSPYGDASAVNWQMPDMAKLSLNGSSVSPRGGYGL

SEQ ID NO: 4555 - DNA, 1214 bp, Panicum virgatum
  misc_feature: Ceres CLONE 1806140
  misc_feature: Encodes the peptide sequence at SEQ ID NO. 4556
agcatcccttgcaactgtcttagaaaatggtgagctcaagtaagggtaaagtgtgcgtgactggggcttcaggcttcattgcctcttggcttatcaaacagcttcttgagtctggatatcatgtggtagggactgtcagagacccaggaaatcgccagaaagtgtcacacctttggaaattgcctggtgctaaagagagactgcagattgtgcaagctgatctgttggaggaagggagctttgatgaagctgtgatggattgtgaaggcgtcttccacactgcatctcctgtcctcgctaaatctgattctagtagcaaggaagcaacgcttattcctgcagtaaacggtactctgaatgtgctaagatcgtgcaaaaagaacccatttctgaaaagggttgttcttacatcttcatcatctgcggtgaggatcagggatgatgctcagccgaatatctcactggatgaaacaatatggagctctgtgccactatgtgaaaagatgcagctatggtatggcctggcgaaggtatttgcagagaaagcagcatgggagttcgccaaagagaatggcattgaccttgtgactgttcttccctcatttgtgattgggcccagtttatcccacgaattatgcgttacagcttcagatgtcctaggcttattccaaggtgacactgccagattcagctgctacggaaggatggggtacgtccacatcgacgatgtcgcgagcagccatatcctcgtgtacgagacgcccgaggccaccgggagatacctgtgcagctcggtggtgctggacaacgacgagctggtctccttccttgcgaaacgatacccggtcttccccatacctcggaggctggacaacccctacggcaagcagacgtaccagctgaacacgtccaagctgcaggcgctgggcttcaagttcaggggattgcaggagatgttcgacgactgtgtccagtcgctcaaagaccagggccacctgctggagtgcccgttgtgatggagggggaagctgtcgtcgtcaagaacaggccatagccaaacagagtcagtcggatcacgtccacaaatcgttggctccgagccaaatacgtttcaataattccatgtcgtgtcagcgtcctttcttaagcagctgctctcagttcatcgctcacggattgtacgactacttaaataaaatctagccattcgcttt

SEQ ID NO: 4556 - protein, 329 aa, Panicum virgatum
  misc_feature: Ceres CLONE 1806140
  misc_feature (1)..(248): Pfam Name: Epimerase Pfam Description: NAD dependent epimerase/dehydratase family
MVSSSKGKVCVTGASGFIASWLIKQLLESGYHVVGTVRDPGNRQKVSHLWKLPGAKERLQIVQADLLEEGSFDEAVMDCEGVFHTASPVLAKSDSSSKEATLIPAVNGTLNVLRSCKKNPFLKRVVLTSSSSAVRIRDDAQPNISLDETIWSSVPLCEKMQLWYGLAKVFAEKAAWEFAKENGIDLVTVLPSFVIGPSLSHELCVTASDVLGLFQGDTARFSCYGRMGYVHIDDVASSHILVYETPEATGRYLCSSVVLDNDELVSFLAKRYPVFPIPRRLDNPYGKQTYQLNTSKLQALGFKFRGLQEMFDDCVQSLKDQGHLLECPL

SEQ ID NO: 4557 - DNA, 2052 bp, Panicum virgatum
  misc_feature: Ceres CLONE 1806199
  misc_feature: Encodes the peptide sequence at SEQ ID NO. 4558
accaccaccgccgcagcacaggcacagcagccgcggcagcagtgccaccgccaccgccaccagcagccatggcctccccggcgtccctgcagcgcttcctcctgccctccgcgcacgcggcgtcgtcgtcctcgtcccgccggcgccccggccgcgccagggcggccgtctccgtgccgtcgcccacgccggcggcgggcgaggtccccgcggagcggctggagcctagggtcgagcagcgggcgggagggtactgggtgctcaaggagaagtaccgcacggggctgaacccgcaggagaaggtgaagctggagaaggagcccatggggctgttcatggaggacggcatcaaggacctcgccaagatccccatggaggagatcgacgccgccaagctcaccaaggacgacgtcgacgtccgcctcaagtggctcggcctcttccaccgccgcaagcaccagtacgggcggttcatgatgcggctgaagctgcccaacggcgtgacgacgagcgagcagacgcggtatctggcgagcgtgatcgaggcgtacggcgcggacgggtgcgcggacgtgacgacgcggcagaactggcagatccgcggggtgacgctcccggacgtgcccgccatcctggagggcctccgcgccgtcggcctcaccagcctgcagagcggcatggacaacgtgcgcaaccccgtcggcaacccgctcgccggcgtcgaccccgacgagatcgtcgacacgcgcccctacaccaacctgctctcctcctacatcaccagcaactcccagggcaaccccaccgtcaccaacctgccgaggaaatggaacgtgtgcgtggtcggcacgcacgacctgtacgagcacccgcacatcaacgacctggcgtacatgccggcgctcaaggacggcaagttcggcttcaacctcctcgtgggcgggttcatcagccccaagaggtggggcgaggcgctgccgctcgacgcctgggtccctggcgacgacgtcatcccggtctgccaggctatcctcgaggcgtacagggacctcggcaacaggggcaaccgccagaagacgcgcatgatgtggctcatcgacgaactcgggatggaggtgttccggtcggaggtggagaagaggatgccgaacggggtgctggagcgcgccgcgccggaggacctcatcgacaagaagtggcagcgccgggactacctcggcgtgcacccgcagaagcaggagggcctctcgtacgtcggcctgcacgtgcccgtcggccggctgcaggcggcggacatgttcgagctcgcgcgcctcgccgacgagtacggctccggcgagctccgcctcacggtggagcagaacgtcgtgctccccaacgtcaggaacgagcgggtcggagcgctgctcgcggagccgctgctgcgggagcgcctctcgccgcggccgtcgctgctgctcaggggcctggtggcgtgcacgggcaaccagttctgcggccaggccatcatcgagaccaaggcgcgggcgctgcaggtgacgcgggaggtggagaagcgggtggccgtgccccggcccgtgcggatgcactggaccggctgccccaacagctgcggccaagtgcaggtggcggacatcggcttcatgggctgcctcaccaaggacggcgacggcaacatctgcgaggcggcggacatcttcgtcggcggccgcgtcggcagcgactcgcacctggcggacgtgtacaggaaggccgtgccgtgcaaggacctggtgcccgtcgtggccgacctcctggtggagcggttcggggccgtgcccagggagagggaggagaacgaggagtaggagcagagcacccgccgggacgtcttcataatcagagccgacttgccgttccttctttcttgtaaagtagacgctgctgccttgttccatggcacgatttgtttttggtggtgttgtagcaaaaaagctaaggttcccttattcacgttacagagaatgccgataaataagaatcacaatgctgcaaaaaaaaaaaaaaaaaaaa

SEQ ID NO: 4558 - protein, 592 aa, Panicum virgatum
  misc_feature: Ceres CLONE 1806199
  misc_feature (1)..(161): Pfam Name: NIR_SIR Pfam Description: Nitrite and sulphite reductase 4Fe-4S domain
  misc_feature (1)..(592): SWISSPROT Homolog: EC 1.7.7.1 Ferredoxin--nitrite reductase, chloroplast precursor
  misc_feature (11)..(591): SWISSPROT Homolog: EC 1.7.7.1 Ferredoxin--nitrite reductase, chloroplast precursor
MASPASLQRFLLPSAHAASSSSSRRRPGRARAAVSVPSPTPAAGEVPAERLEPRVEQRAGGYWVLKEKYRTGLNPQEKVKLEKEPMGLFMEDGIKDLAKIPMEEIDAAKLTKDDVDVRLKWLGLFHRRKHQYGRFMMRLKLPNGVTTSEQTRYLASVIEAYGADGCADVTTRQNWQIRGVTLPDVPAILEGLRAVGLTSLQSGMDNVRNPVGNPLAGVDPDEIVDTRPYTNLLSSYITSNSQGNPTVTNLPRKWNVCVVGTHDLYEHPHINDLAYMPALKDGKFGFNLLVGGFISPKRWGEALPLDAWVPGDDVIPVCQAILEAYRDLGNRGNRQKTRMMWLIDELGMEVFRSEVEKRMPNGVLERAAPEDLIDKKWQRRDYLGVHPQKQEGLSYVGLHVPVGRLQAADMFELARLADEYGSGELRLTVEQNVVLPNVRNERVGALLAEPLLRERLSPRPSLLLRGLVACTGNQFCGQAIIETKARALQVTREVEKRVAVPRPVRMHWTGCPNSCGQVQVADIGFMGCLTKDGDGNICEAADIFVGGRVGSDSHLADVYRKAVPCKDLVPVVADLLVERFGAVPREREENEE

SEQ ID NO: 4559 - DNA, 3192 bp, Panicum virgatum
  misc_feature: Ceres CLONE 1806200
  misc_feature: Encodes the peptide sequence at SEQ ID NO. 4560
acctccgtccccgtccccgtccccctcctccccgaccagagagcgagcgccgtaaccggctaaccgccgccgcgccaccacaccctccgcccgctcccgcgcgcgcacaagcgtttcggacaagctgagcgcggcgggggcgccatgcacagccaccggccgggcgccgacgccggcggcggcggggacatcgtcgagatgtcctcggccgccgcgccgccgccgcaggaggcgcgggaccgggaccgggagcgggtgatcccgcacagcggcccgctgagcaagaagtccgggccgcgcaagagcgcgcgcttcgcggagtccgtctcggcgccgctctccgcgccgccgccccgcgcgtccccctcctccgccgccggcgacgacgacgactacgtcgagatcaccctcgacgtgcgcgacgactcggtggcggtgcacagcgtcaagccggcccaccacggcggcggcggcgccgccgccgacgaccccgacgtgacgctgctggcgcgcacgctcgagagccggcggtcctcgtcctacggccactccgccatccgcagcgcctcgtcgcggatcaagcaggtgtcgcaggagctccgccgcctcgcctccctcaaccgccgcggcggcggcgcgcccgggcgcggcctcgaccgctccaagtccgccgccgcgcacgcgctcaaggggctcaagttcatcagcagggccgacggcgccaagggctgggaggccgtcgaggagcgcttcgacaagctcgaccgggagggaaaactcccgaacgggctcctcccccgctccaagttcggcgaggtcatcgggatgcgggagcccgagttcgccggcgagctgttcgacgccctcgcgcgccgccgcaacatctccggcgacagcatcagcaaggcggagctgctcgagttctgggaccaaatctccgacaccagcttcgacggccgcctccagaccttcttcgacatggtggacaaggacgcggacggcaggatcaccgaggaggaggtgaaggagatcatcacgctgagcgcgtcggcgaacaagctgtccaagatccaggagcagtcggaggagtacgcccggctgatcatggaggagctggacccgggcaacctgggctacatcgacctctacaacctggagatgctgctgctgcaggcgcccagccagtcggtgcgcatcggcaccaccaacagccgcaacctgagccagatgctgagccagagcctccgccccacgccggagcccaacccgctccgccgctggtgccgccgcgccggctacttcctcgaggacaactggcgccgcgtgtgggtgctcctcctctggctcgccgtctgcgcggggctcttcgcctggaagttcgtccagtaccgccgccgctacgtgttcgaggtgatgggctactgcgtgtgcgtcgccaagggcggcgccgagacgctcaagttcaacatggcgctcatcctgctccccgtctgccggaacaccatcacctggatccgcaaccgcaccgccgccgcccgcgccgtgcccttcgacgacaacctcaacttccacaaggtggtcgccgcggggatcaccgccggcgccgcgctccacatcgtctcccacctgacctgcgacttcccgcggctgctccacgccaccgacgccgagtacgcgccgctggccaagaacttcggcgagcggcggccgcccaactactggtggttcgtgaaggggaaagaggggtggacggggctggtgatgctggcgctcatggcggcggcgttcacgctggcgacgccgtggttccggcgcgggcggctgcggctgcccggcccgctccggcggctcacggggttcaacgccttctggtactcgcaccactgcttcgtggtggtgtacgcgctgctcatcgtgcacggccacttcctgtacctgaccaaggagtggtacaagaagacgacgtggatgtacctggcggtgcccatggcgctgtacgccggcgagcggctgacgcgggcgctgcgctccagcgtgcgccccgtgcggatcctcaaggtggccgtgtaccccggcaacgtcctctcgctgcacttctccaagccgccggggttccggtacaggagcggccagtacatcttcgtcaactgcgccgccgtgtcgccgttccagtggcacccgttctccatcacgtcggcgccgcaggacgactacgtgagcgtgcacatcaggacgctgggggactggacgcgcgagctcaagaccgtcttctcgagggtgtgccggccgccgccggagggcaagagcggcctgctccgggccgagtacgaccgcgacggcggcgccatgaccaaccccagcttcccgaaggtgctgatcgacgggccctacggcgcgccggcgcaggactacaagcagtacgacgtggtgctgctcgtcggcctgggcatcggcgccacgcccatgatctccatcatcaaggacatcatcaataacatgaagacgctcgacggcgacctggaggccggctccggcggcggcgccggcgcggacgcctccttccgcacgcgccgggcctacttctactgggtgacccgggagcagggctccttcgagtggttccgcggcgtcatggacgaggtggccgagaccgacaagaagggcgtcatcgagctccacaactactgcaccagcgtctacgaggagggcgacgcccgctccgccctcatcgccatgctccagcagctcaaccacgccaagaacggcgtcgacgtcgtctccggcacccgcgtccggacccacttcgcccggcccaactggcgcagcgtctacaagcgcatcgccctcaaccaccgcgaccagcgcgtcggagtgttctactgcggtgccccgatgctgaccaaggaactgcgtgagctcgcacaggatttctcacggagaaccgacacaaagttcgatttccacaaggagaacttctaattcatttagcctcgacaagttttcgcatgacaagttcggtacataccgtattcgatatgtgtagcgtatatatggatgtagagggagggagtagaacaaagtaggtattgcttgattgtgaccggccagttgggtcaaaatcccatcagttttttgtttgctctagaagaattaataatacaaatgcctttgtaaaaaaaaaaaaaaaaaaaa

SEQ ID NO: 4560 - protein, 944 aa, Panicum virgatum
  misc_feature: Ceres CLONE 1806200
  misc_feature (3)..(97): Pfam Name: NADPH_Ox Pfam Description: Respiratory burst NADPH oxidase
MHSHRPGADAGGGGDIVEMSSAAAPPPQEARDRDRERVIPHSGPLSKKSGPRKSARFAESVSAPLSAPPPRASPSSAAGDDDDYVEITLDVRDDSVAVHSVKPAHHGGGGAAADDPDVTLLARTLESRRSSSYGHSAIRSASSRIKQVSQELRRLASLNRRGGGAPGRGLDRSKSAAAHALKGLKFISRADGAKGWEAVEERFDKLDREGKLPNGLLPRSKFGEVIGMREPEFAGELFDALARRRNISGDSISKAELLEFWDQISDTSFDGRLQTFFDMVDKDADGRITEEEVKEIITLSASANKLSKIQEQSEEYARLIMEELDPGNLGYIDLYNLEMLLLQAPSQSVRIGTTNSRNLSQMLSQSLRPTPEPNPLRRWCRRAGYFLEDNWRRVWVLLLWLAVCAGLFAWKFVQYRRRYVFEVMGYCVCVAKGGAETLKFNMALILLPVCRNTITWIRNRTAAARAVPFDDNLNFHKVVAAGITAGAALHIVSHLTCDFPRLLHATDAEYAPLAKNFGERRPPNYWWFVKGKEGWTGLVMLALMAAAFTLATPWFRRGRLRLPGPLRRLTGFNAFWYSHHCFVVVYALLIVHGHFLYLTKEWYKKTTWMYLAVPMALYAGERLTRALRSSVRPVRILKVAVYPGNVLSLHFSKPPGFRYRSGQYIFVNCAAVSPFQWHPFSITSAPQDDYVSVHIRTLGDWTRELKTVFSRVCRPPPEGKSGLLRAEYDRDGGAMTNPSFPKVLIDGPYGAPAQDYKQYDVVLLVGLGIGATPMISIIKDIINNMKTLDGDLEAGSGGGAGADASFRTRRAYFYWVTREQGSFEWFRGVMDEVAETDKKGVIELHNYCTSVYEEGDARSALIAMLQQLNHAKNGVDVVSGTRVRTHFARPNWRSVYKRIALNHRDQRVGVFYCGAPMLTKELRELAQDFSRRTDTKFDFHKENF

SEQ ID NO: 4561 - DNA, 1702 bp, Panicum virgatum
  misc_feature: Ceres CLONE 1806272
  misc_feature: Encodes the peptide sequence at SEQ ID NO. 4562
gccaatcaatcaaggggagcaaatgcaaatgtacatggacagcagcagctccggccaccgctctccacagcgctccgccgcaactacggcggcgctggtgctcgcgaccgccggcctcctcctcctgccgccgccgctggcacgcgggtcggccaccgagcagcagctgcagcaggaggaggaccgcatcctggggctgccgggacagcccaacggcgtggcgttcgacatgtacggtggctacgtcaccgtcgacgagccggctggccgcgcgctctactactggttccaggaggccgaccccagcacggccgacccgggcacagcgccgctcctcttgtggctgaacggcgggcctggttgctcctccgtcggcggcggcgcgctggaggagctcagcgcgttccgcgtccacaccgacggccagacgctcctgctcaacgagtacgcgtggaacaaagcggcgaacgtgctcttcttggagtcgccggccggcgtggggttctcttacaccaacaccagctccgaccttgtcgtcggcgacgacagaacggctcaagacgcgtacactttcctggtgaaatggttcgagagattcccgcagtacaagtaccgcgatttctayattgcgggagagagctacggaggtcactatgttcctcagctgtcccagcttgtgtacaggaacaacatcggcatcgagaatcctgatatcaacttcaaaggattcatggtcggaaatggtgtgaccgacgaccacatagacacgatcggcatgttcgagtactggtggaaccacggcctcatctccgacgagacccgagagagcgggctgaaggtttgcctggacggcagcaccttgatcaagccatcgccggagtgccagaagatcatggacaaggtcaccgaggagctaggcaacatcgacgtctacagcatctacacgccgccgtgcgagaaggggaccccatacgtgcgcaggcgccgccgcacactgatgctgcctccatacgatccctgcaccaccttctactcgaccaactacctgaacatccccgaggtgcagagggccatgcatgccaacgtcaccggcagcatagagtacccatgggttttatgcagcaatcccttatattataactggaccacagtaacacccatttccatgctacccatctacaaggagctcattgcagctggcctcaaggtctgggtcttcagtggcgacacggacactgcagtgccgctgagctcaaccaggcgctcccttgctgccttgggccttcctgttaagaccagctggtacccctggtacattgtcaaaactgaggttgctggctggagcatggagtatgaaggcctgacctttgtcaccgtccgcggcgccgggcacgaggttcccctgcaccgtccggagcaggcgctcgtcctgttccagcacttcctccagggcgaacccatgccggccgaggcaaaaaatgccagcgtcatcctccttcctagtgagaaggctacctcttactgagcacggaagcacctgtcgttgtgctagcttgatgacgaagactccactacgaataaaagatgttgtcgatcttcatcttgagaataaaagctggagtatcttgtttccttataatgaataatgtatgaaccgttggcttcgcgatggatctattatattgtttttctccggataagc

SEQ ID NO: 4562 - protein, 500 aa, Panicum virgatum
  misc_feature: Ceres CLONE 1806272
  misc_feature (1)..(412): Pfam Name: Peptidase_S10 Pfam Description: Serine carboxypeptidase
  misc_feature (13)..(489): SWISSPROT Homolog: EC 3.4.16.6 Serine carboxypeptidase 2 precursor
  misc_feature (54)..(488): SWISSPROT Homolog: EC 3.4.16.6 Serine carboxypeptidase 2 precursor
MQMYMDSSSSGHRSPQRSAATTAALVLATAGLLLLPPPLARGSATEQQLQQEEDRILGLPGQPNGVAFDMYGGYVTVDEPAGRALYYWFQEADPSTADPGTAPLLLWLNGGPGCSSVGGGALEELSAFRVHTDGQTLLLNEYAWNKAANVLFLESPAGVGFSYTNTSSDLVVGDDRTAQDAYTFLVKWFERFPQYKYRDFYIAGESYGGHYVPQLSQLVYRNNIGIENPDINFKGFMVGNGVTDDHIDTIGMFEYWWNHGLISDETRESGLKVCLDGSTLIKPSPECQKIMDKVTEELGNIDVYSIYTPPCEKGTPYVRRRRRTLMLPPYDPCTTFYSTNYLNIPEVQRAMHANVTGSIEYPWVLCSNPLYYNWTTVTPISMLPIYKELIAAGLKVWVFSGDTDTAVPLSSTRRSLAALGLPVKTSWYPWYIVKTEVAGWSMEYEGLTFVTVRGAGHEVPLHRPEQALVLFQHFLQGEPMPAEAKNASVILLPSEKATSY

SEQ ID NO: 4563 - DNA, 2057 bp, Panicum virgatum
  misc_feature: Ceres CLONE 1806319
  misc_feature: Encodes the peptide sequence at SEQ ID NO. 4564
acgcctctgaccttcccctccgctccgccccctagacacgcgcgcacggcctcctctgctggtgctggggcctggccgcgggccgccccgctcgctcgcgtcggggccaacaaacacagggtgatcgaagtgaagatcgtcaggggccacgcattccgatcgagccgggacgggagcctcgttttcgtttcgtcagggagacgcaaaggagatcatcagagctccatcggatcggaggccgtcgagcaccttcgcgtcgttcaacttcgatcgaggtgcgctcgaccggccacctctccggttcgacgaggaggcgctactctaccgtgctagcagaaagtcaccacacttgtaggccttgtcgcccgaggatgctgcagaaacgatggcagggatgcgtcttcttgctcgccttccttctctgcgacgcgtcaggcataatgaccccctcagaaaattctccgtcagagttcgccaagatccttcagtctaagcagaccaagcatgctcgcgtgtgcagagcggaccccgagctcctgcgatccctagccggcagcgatgcagagctcatgctcgccatccccaacgagcagctggagcacatcgccgagttccaggaggaagccgacctctgggtcatcgcctacgtggcgcgcttcctcccggcggccaggatcacgcacgtcctggcgggcgacgacgtgctgaccacctcccccgggagcgcatacttcctcgtcccggcgatgctcaacctccgctcggccctcgccgccgcggggctcgacggccgggtcaaggtgtcgaccgcggtgtccgcggaggccctggccgccccggcgtggtcgggcgtcgcgggccacgtcctgcggttcctgagctccgccggctcgccgctgttcctcaagtcccgcccgtcggaggccagcgatgccgaggccgacgccgcgtacggcgcgatgcgcgcgctgggcgtcccggccgttcccgtggtcgcggcagacctcggtgccgccgccggcggcgaagcggcggcgtactactactacggctacccgggcggccagccgggtgaacggggcacgcggcggtcgctggcgacggggacgttctgcgtggcgctgcagaacgcggacccggcggcgctgcaggccgggctcaactgggcgtgcgggccgggccacgccgactgctccgccatccagcccggcgggccctgctaccagcagaacaacctgccggcgctcgcctcctacgcctacaacgactactaccagaagatgtccagcaccggcgccacctgctcgttcaacggcaccgccaccaccaccaccaacgatcccagctcaggatcttgcgttttcgcgggaagctccacggcgggaggctccaactcgagcacgccgacgccggtgggcgcgagcccgccgaccagcctctcccctccggcgggcttcacgcccccggtcggctcgagccccccgtcgtccgacctcagcccaccggcggtcggcacgacccctccctccggcttcgccccacctgctggcggcggcttcgagcccccggcgggcggtttcggcaccccgccgtcggggttcggcccgccgggatccttcaacggcagcgggtcgttcggaccgagcggcacgctcaacccttacggcggttgccgtggcgccatgtccggcggcgccggcttgaccgctctgctcgccgtcgccgtcgcgggtcttctcgtgtccatggacgcgatgtgaattatcgatgcagatatatctggattagctctagacactagagacgtcgtatcgccggtagtgattatgcagggatttaatcgcgtcatacgttcttcatcgttgaggtgttagtggtcgtgtcgatgtcagtgtcaactgtcaggtcaggccggacctgtgtacttaggcgtcatgtatatgtcggtatgcgatgagagttgtgacagtcatgatgttcgagtcattggcacagtaatttcgttttctacgacacattaatacagtgaatttttacaaaaaaaaaaaaaaaaaaaa

SEQ ID NO: 4564 - protein, 462 aa, Panicum virgatum
  misc_feature: Ceres CLONE 1806319
  misc_feature (1)..(98): Pfam Name: Glyco_hydro_17 Pfam Description: Glycosyl hydrolases family 17
MLQKRWQGCVFLLAFLLCDASGIMTPSENSPSEFAKILQSKQTKHARVCRADPELLRSLAGSDAELMLAIPNEQLEHIAEFQEEADLWVIAYVARFLPAARITHVLAGDDVLTTSPGSAYFLVPAMLNLRSALAAAGLDGRVKVSTAVSAEALAAPAWSGVAGHVLRFLSSAGSPLFLKSRPSEASDAEADAAYGAMRALGVPAVPVVAADLGAAAGGEAAAYYYYGYPGGQPGERGTRRSLATGTFCVALQNADPAALQAGLNWACGPGHADCSAIQPGGPCYQQNNLPALASYAYNDYYQKMSSTGATCSFNGTATTTTNDPSSGSCVFAGSSTAGGSNSSTPTPVGASPPTSLSPPAGFTPPVGSSPPSSDLSPPAVGTTPPSGFAPPAGGGFEPPAGGFGTPPSGFGPPGSFNGSGSFGPSGTLNPYGGCRGAMSGGAGLTALLAVAVAGLLVSMDAM

SEQ ID NO: 4565 - DNA, 1599 bp, Panicum virgatum
  misc_feature: Ceres CLONE 1806368
  misc_feature: Encodes the peptide sequence at SEQ ID NO. 4566
tcctctgccccattctgccaatgcatcatcgtctcttttgcctgctcagcttcaccggctcccctggccggcctgcgcgtgcgcaaaccctataaaaggcatcctagtcccactccgaatctcccccaacccctcatcacccatcgccctcctctctccgatccttcccccacccactagagatctatcgagcgatcctccgatcggcggtcgcctcccaataataataatggagatggtagtgctgcagcagagggcgggcggcggcggcgggtgccgggccggggcgccgatgatgggcggcgcggcggcggcggcggcgtcggcgaagcaggaggagatgaaggagggcggcggcggcggcggggcggatgaggtccggcgcgggccgtggacggtggacgaggacctgacgctggtcaagtacatcgcggagcacggcgagggccgctggaacgagctcgcgcgcgccgccgggctgaagcgcaccgggaagagctgccgtctccgctggctcaactacctccgccccgacgtgaagcgcggcgacttcaccgccgacgagcagctgctcatcctcgacctccactccagatggggcaaccggtggtccaagatcgcgtcgcatctgccggggcggacggacaacgagatcaagaactactggcggacgcgggtgcagaagcacgccaagcagctcaactgcgacgtcaacagcaagcgcttcaaggacgccatgcgcttcctctggatgcccagactggcagagcgcgccgccgccgcccaccactcatcgccggcgtcgtccctgcagcaggccgccatctccggcggcggctcgtcgtcctccgctctgctgctgcccacggccgccgccggctgcttcggtttcgagatggcgacggccaacgccgccgccgaccgctcccccagcagcgtggtcaccaccaccgccaccaacagctcgccctgcagctcgcggacgacgtcctccggcgcctccaccgccgccaccgccaacgacgacgactgctgggcggcgatccagcaggaccacgacgagttctggtccgccgcgtccaacctgcagcagcagctgctgtacttcccgctggcggcggacctgctgccgatgcagcccgacctcagcggctgggtgcagggcttctccgagggcggctcatcttcgccggacacgacccaccagcagcagctctggagcctcgacgacatctggaggatgcactgatgaacgaatataattattttgtttttcttgcgatcaaattgggacgacgaagcatatgtagtattatggttgtacaaaacggaagctagctagctacgggaaacgatcaagaaagcaacaaaaaaaaatgtgttcgttctttttttttgtttagctctgactttatttatcatagatactagctagcagtagcagtatatactacacctcggttatttagttgggagcttcttcctgtcaaggttttttttcccttttaatttggccctctcaagctaagataggagccggccggcttaaaagagctagggagagatgcatggataattgttaatttgtatggtcatcag

SEQ ID NO: 4566 - protein, 339 aa, Panicum virgatum
  misc_feature: Ceres CLONE 1806368
  misc_feature: Great-hit functional homolog of the protein sequence given in SEQ ID NO 9317
  misc_feature (1)..(48): Pfam Name: Myb_DNA-binding Pfam Description: Myb-like DNA-binding domain
  misc_feature: The sequence is a functional homolog of  SEQ ID NO 1540 in the  10/374,780 US patent application
  misc_feature: The sequence is a functional homolog of  SEQ ID NO 1541 in the  10/374,780 US patent application
  misc_feature: The sequence is a functional homolog of  SEQ ID NO 1563 in the  10/374,780 US patent application
  misc_feature: The sequence is a functional homolog of  SEQ ID NO 1564 in the  10/374,780 US patent application
  misc_feature: The sequence is a functional homolog of  SEQ ID NO 1566 in the  10/374,780 US patent application
  misc_feature: The sequence is a functional homolog of  SEQ ID NO 1634 in the  10/412,699 US patent application
  misc_feature: The sequence is a functional homolog of  SEQ ID NO 1635 in the  10/412,699 US patent application
  misc_feature: The sequence is a functional homolog of  SEQ ID NO 2178 in the  10/374,780 US patent application
  misc_feature: Useful for making plants with modulated drought sensitivity
  misc_feature: Useful for making plants with modulated growth and phenotype characteristics
MEMVVLQQRAGGGGGCRAGAPMMGGAAAAAASAKQEEMKEGGGGGGADEVRRGPWTVDEDLTLVKYIAEHGEGRWNELARAAGLKRTGKSCRLRWLNYLRPDVKRGDFTADEQLLILDLHSRWGNRWSKIASHLPGRTDNEIKNYWRTRVQKHAKQLNCDVNSKRFKDAMRFLWMPRLAERAAAAHHSSPASSLQQAAISGGGSSSSALLLPTAAAGCFGFEMATANAAADRSPSSVVTTTATNSSPCSSRTTSSGASTAATANDDDCWAAIQQDHDEFWSAASNLQQQLLYFPLAADLLPMQPDLSGWVQGFSEGGSSSPDTTHQQQLWSLDDIWRMH

SEQ ID NO: 4567 - DNA, 2146 bp, Panicum virgatum
  misc_feature: Ceres CLONE 1806370
  misc_feature: Encodes the peptide sequence at SEQ ID NO. 4568
agagagcgccagtcacaaagctaaaaaaagcaccgagaaatctagtggtgcagcgagcgaacctccccgtcccctccccttcctccgcctcccaatcccaatttttttttccaccgcaggcctctcccccggctccccgcgacgacgaccccgaagcttcgcgaagcttccagggccttaccccgcgggccgcccctccccagatcgccgcctccggcagcggcgaggcggcatcgcgagggcggaggaggaggaggaggaggaggaggagccgggcgacggggacggtggaggcgggccaaggcgaggctagggtttggggtcggggtcgggctgcgtcggccggcgccccggtgagggaggaggatgcatatgatgcggcggctgaagagcatcgcctccggccgctcgtccgtctccgatccgggtggtgactctggctccaaaaggccaaagtttgagcaggatggagcaggagatattgttatcgaaccacacttaaatgaggacaaacctctgcgaatagaccaagaatcatcgtcatcatccaatagggatgctgaggcaagcacatccactagcatgaagcctgttaaaactgaagaaccaggaacagatcttcttccaaaagaaatgaatgatatgacgatcagtgatgataaagctgatggccacaatgataaggaaatcgaaggggttactcttgatggaaatggaactgagacaggacagatcattgtgacaacaataggaggtcataatgggaagccaaagcagaaggtctcatacatggcagaacgggttgttggtactggttcatttggtgtagttttccaggcaaaatgcttggaaactggtgagacggtggcaataaaaaaggtgttacaagataagcggtacaagaatagagagctccaaactatgcagttacttgaccaccctaatatagttcagctgaagcatcacttcttttcaacaactcaaaggggagaagtttacctcaaccttgtgcttgaatttgtatctgagacggtttatcgtgttgccaaatactacaatcggatgaaccagcgagtgcccataatatatgttaagttatatgcatatcagatgtgccgtgcgcttgcttacattcatcgtgttgttggtgtttgtcatcgtgatattaaacctcaaaatctactggtcaatcctcatacacatcaacttaagatttgtgattttgggagtgctaagaaattggtccccggtgagcctaacatatcatacatttgctcacggtattatagggctcctgaactaatatttggagctatggagtatactactgcaattgatatctggtccgttggctgtgtggtagctgagcttatgattggtcagcctttgtttcctggtgaaagtggtgttgatcaactggtggagataataaagattttgggtactccaacaagagaggaaatcaggtgcatgaaccctaattactctgagttcaagttccctcagataaaggcccatccctggcacaagctttttggtaagcgcatgccacctgaagctgttgacctcgtgtcaaggttacttcagtactcaccaaacctgcgctgcacggctgttgatgcttgtgcccatcctttctttgatgagctgcgagaccccaaagtttgcttgccaaatgggcggtccctgccaccattgttcgacttcacagcagctgaacttgaagggctcccaattgagcttgtccatcgtatcattcctgagcacatgaggaagtgaagaggtgggccagctggaaatccttgtttccttgttagttcttctgagatgcgcagggcatgctatggaccggtttgtagtagtggtatagccagccaacgccttgctagatgtaaagagggctgaaagttcctcaaatcgggcgcgccagcgagcctagaggcaaacctaatgtttgcttgctgcccatggcggaattggctcgtatctttggcatttcatcttgtgtccccagatgtgtatcgataacttaggctgttgtattaccgggttcatgctgaacaagagaattcagagtgcttgcttccctagctgggaatcccagaatgtcggttttgattactgcgaaaaaaaaaaaaaaaaaaaa

SEQ ID NO: 4568 - protein, 470 aa, Panicum virgatum
  misc_feature: Ceres CLONE 1806370
  misc_feature (1)..(467): SWISSPROT Homolog: EC 2.7.11.1 Shaggy-related protein kinase theta
MHMMRRLKSIASGRSSVSDPGGDSGSKRPKFEQDGAGDIVIEPHLNEDKPLRIDQESSSSSNRDAEASTSTSMKPVKTEEPGTDLLPKEMNDMTISDDKADGHNDKEIEGVTLDGNGTETGQIIVTTIGGHNGKPKQKVSYMAERVVGTGSFGVVFQAKCLETGETVAIKKVLQDKRYKNRELQTMQLLDHPNIVQLKHHFFSTTQRGEVYLNLVLEFVSETVYRVAKYYNRMNQRVPIIYVKLYAYQMCRALAYIHRVVGVCHRDIKPQNLLVNPHTHQLKICDFGSAKKLVPGEPNISYICSRYYRAPELIFGAMEYTTAIDIWSVGCVVAELMIGQPLFPGESGVDQLVEIIKILGTPTREEIRCMNPNYSEFKFPQIKAHPWHKLFGKRMPPEAVDLVSRLLQYSPNLRCTAVDACAHPFFDELRDPKVCLPNGRSLPPLFDFTAAELEGLPIELVHRIIPEHMRK

SEQ ID NO: 4569 - DNA, 3071 bp, Panicum virgatum
  misc_feature: Ceres CLONE 1806385
  misc_feature: Encodes the peptide sequence at SEQ ID NO. 4570
aacctccaggctctccaaccgcaaccgctccgcggccgcgcaactgcgcaagcgcaacgatggcgaccgccgcctctccggcgccgccgccgcaggcgcaacacccgccgccgcaggtacccgacccgaagagggcgcttgccgtgaacgcggtccgcctgaaggcgattggcgaccgcctcagggaccacctgaatggcatgttcatcctctccgtcgccgatttcgtccaccacgcctacgccttcgccagagggatcgactacgcggtctcggctggtgatattcctgtgatggccaatgagatacccggcattttgagaaagatatatgagctgaggaatgaaacatttatacaatcttcacttatggtactagttatatcgtgcaagaatgcttgctccaagaaatggtttcaacctacagattccagtgacattctcagaattgctaatgagctctctagtaacttctgcacatcctctggccaggcagctagtgacagcactgcgcttaaaattatatcacaaataatgccaaggtattatccatggttgaagtttgagcgtctaatcacttgtattgaagcaaaggttggctatgatgtattgatgtctgacttctttattgagaggaacctatctcgagatgaaaagattagactaattgttgtacaaaaggaaaatttagattcctcgacatgtgtcacaagcccaccacatgcgagctttttggtcaatggaaagggcgtggacaagaggactaatgtttcaatggacttaggaccccagttcccttctgatatcaccaaaatgctcaaatatggggcaaacattatccaagctgttggatattttaatgctaattatatcatagctgtagcttttataaacaatgtggcatccttcagtgctccaaaactggatgactatacgcaacctatcacagtttgtcctgcagattctgatgtacttgagggaccatcaagagtttccctaaattgccctataagttttaagcgcataaaaactcccattaaagggcgcctttgcaaacactatcagtgttttgattatgataattacatggagatgaactcaaggaaaccaaactggcgctgtccatattgtaataccccttcaaacttcactgacctacgcattgaccaaaagatggcaaagatactagaagagactggagatgatgtcattgatgtacttgtatttgctgatggatcttggaaagctgcaccagctcatgatgagaaatcagataggcatagaggtgatgccattcatcagactggagatgctgtagaaactgattcatcatcttcagatgtcatagatctgataaatggtgatggtgatggtgatctgccgatgatggattgggcatcggctttagaagataagaagcctctgctgaatagtcaagatatatctgtgtcagactatcttccagattttccgatggctgcccagacagaggatctgtatgtaggggatggaaataatgggggtagcaacatggctttcacttctcgtcagaatttgttgccatctactagtgggctgggctcaagttcttttgggaccttggaatctattctaccccaagttgttttgcgccctgttattacagatgctgtctctccttctcttgaaacctccacctcaacatctggcatgcaacatgtttcacaggaaacacattgtgaaactgtacagttgcaatcacaaataggtccagtacatagatcagaagtgagaaggcttcctatacctagaaatcccaggagagagccattaggagtccaggcattgccagtgccaccacagaatcctgggtcatcaacaaggttgcaaccgaatatcctcaattgtccacctcctatcccacaatctactccagcttcttcaacttaccaagcacatcaagtgacgaatccggactgtgtcattgctccaatgaatagcagttgtgggccgttaccaaggactcccggtgctgctacatcattgcatctacagtcaacaacacgggatatgcgcaacacatcgagccatcttcctggtcgggttgttggtctgcctgcgccacacctgattggtgcacggctgccaccaggaaactcaggacaggttggaggagcgaacacctacaaacctatgcctatacagcagactccaactcatgatcagctcatgcacacacgaatgaccatgaaccaaacggcactggctgccgtgggccaaaccactgcagctgcacttgtccgaccgatccaagctaagatccaaagccgtatcctttctaccctgcaaagccaggcgccaagatcgcaatcagtgcctcgtgcagcaactcctccgtctctacagcgagcaccaccgcatctgcagcctccgagtgtaccacctgctgctcctagcacacctcaggctggatcctcagatggtcatccacctgacatccctgaggatgagaactggtgccccacgggtcagatgagagggagtttgacaggcaatgcctacagttctgctatccggcgctatcagccggctcagtctcgtccttccggcacttcgggtgtgcgaaggcctcactaaccgctgggcattgtggtattttgatgatcatcaagcaggacttttggcagcgagatagatatttacttgattctttaggctggtgtttgggaactatgttgatctggagttgatgttgggagaggctaatgaatagtgagtggtggctagtgtttgggcactatgatgatgcggtgttgatgtagggggagaggctagtgaatagtgagtggtgacagtattctgctgacctgccgcacttgtcagagttgtttatatttcgtagcagttttcctagttggctgcgcagcttaggtgctttaaatagcattatgatgttaagcattggcagtagtacatggtaatctatcgcgctagctctcgcatgtgtaaatctgatcatgcttgccttacacaagttgtaccgaagacaaatccagtagtgtggttttcatacaaaaaaaaaaaaaaaaaaaa

SEQ ID NO: 4570 - protein, 851 aa, Panicum virgatum
  misc_feature: Ceres CLONE 1806385
  misc_feature (1)..(50): Pfam Name: zf-MIZ Pfam Description: MIZ/SP-RING zinc finger
MATAASPAPPPQAQHPPPQVPDPKRALAVNAVRLKAIGDRLRDHLNGMFILSVADFVHHAYAFARGIDYAVSAGDIPVMANEIPGILRKIYELRNETFIQSSLMVLVISCKNACSKKWFQPTDSSDILRIANELSSNFCTSSGQAASDSTALKIISQIMPRYYPWLKFERLITCIEAKVGYDVLMSDFFIERNLSRDEKIRLIVVQKENLDSSTCVTSPPHASFLVNGKGVDKRTNVSMDLGPQFPSDITKMLKYGANIIQAVGYFNANYIIAVAFINNVASFSAPKLDDYTQPITVCPADSDVLEGPSRVSLNCPISFKRIKTPIKGRLCKHYQCFDYDNYMEMNSRKPNWRCPYCNTPSNFTDLRIDQKMAKILEETGDDVIDVLVFADGSWKAAPAHDEKSDRHRGDAIHQTGDAVETDSSSSDVIDLINGDGDGDLPMMDWASALEDKKPLLNSQDISVSDYLPDFPMAAQTEDLYVGDGNNGGSNMAFTSRQNLLPSTSGLGSSSFGTLESILPQVVLRPVITDAVSPSLETSTSTSGMQHVSQETHCETVQLQSQIGPVHRSEVRRLPIPRNPRREPLGVQALPVPPQNPGSSTRLQPNILNCPPPIPQSTPASSTYQAHQVTNPDCVIAPMNSSCGPLPRTPGAATSLHLQSTTRDMRNTSSHLPGRVVGLPAPHLIGARLPPGNSGQVGGANTYKPMPIQQTPTHDQLMHTRMTMNQTALAAVGQTTAAALVRPIQAKIQSRILSTLQSQAPRSQSVPRAATPPSLQRAPPHLQPPSVPPAAPSTPQAGSSDGHPPDIPEDENWCPTGQMRGSLTGNAYSSAIRRYQPAQSRPSGTSGVRRPH

SEQ ID NO: 4571 - DNA, 2574 bp, Panicum virgatum
  misc_feature: Ceres CLONE 1806409
  misc_feature: Encodes the peptide sequence at SEQ ID NO. 4572
aaaaccatccgctcccccggacaccgcaccaacgggctcgctcgctccagcctccgccccctcgccgcacacctccgtaaaacccacccgattccgcctaaaccacccaccgcgatcctcgacaattcagcggccgcgatgcagggtctcgccccgcccacctctgtttccatacaccggcgcccgccggccgggtccagggcggcccggggccccagctcggtgaggttcgcgccgcgcgcggtcagctccgtgccgcgcgccgcgcccgccgcgcgcctgccgccggcggcgttcaagcccgccgagctgccggcgcccaggaagcacgccgccgccattgccgcgccggcgccggcctcgccgccgcggacggcggggaggaagaaggagctcaatctcttccagcgcgccgcggcggcggcgctcgacgcgttcgaggaggggttcgtggcgggcgtcctcgagcgcccccacggcctgccccggacggccgacccggccgtgcagatcgccggcaacttcgcgcccgtcggggagaggccccccgcccgcgagctccccgtctccggccgcatcccgcccttcatcaacggcgtgtacgcgcgcaacggcgccaacccctgcttcgaccccgtcgccgggcaccacctcttcgacggcgacggcatggtgcacgcgctgcggatacggaacggcgtcgccgagtcctacgcctgccgcttcaccgagaccgcgcgcctgcgccaggagcgcgcgatcggccgccccgtcttcccaaaggccattggcgagctgcacggccactccgggatcgcgcgccttgctctgttctacgcgcgcgccgcgtgcgggctcgtcgatccctcccacggcaccggcgtcgccaacgccggcctcgtctacttcaacgggcacctcctcgccatgtccgaggacgacctcccgtaccacgtgcgcgtcacggacggcggcgacctcgagaccgtcggcagatacgacttcgacggccagcttgggtgcgccatgatcgcgcacccgaagctcgacccggccaccggcgagctccacgcgctcagctacgacgtcatcaagaagccgtacctcaagtacttctacttcaggcccgacggcaccaagtccgacgacgtcgagatcccgctcgaccagcccaccatgatccacgacttcgccatcaccgagaacttcgtcgtcgtgcccgaccaccaggtggtgttcaagctccaggagatgctgcgcggcggctcgcccgtggtgctggacaaggagaagacgtcgcgcttcggcgtgctccccaagcacgccaaggacgcgtcggagatggcgtgggtggacgtgccggactgcttctgcttccacctgtggaacgcgtgggaggacgaggagaccggcgaggtcgtcgtcatcggctcctgcatgacccccgccgactccatcttcaacgagtccgacgagcacctcgagagcgtgctcacggagatccgcctggacacccgcaccggccggtcctcgcggcgcgccatcctgccgccgtcgcagcaggtgaacctggaggtgggcatggtgaaccgcaacctcctgggccgcaagacccggtacgcgtacctcgccgtggccgagccgtggcccaaggtgtcgggcttcgccaaggtggacctcgccacgggcgagctgaccaagttcgagtacggcgagggccggttcggcggcgagccctgcttcgtgcccatggaccccgccgccgcgcacccgcgcggcgaggacgacgggtacgtgctcaccttcgtgcacgacgagcgcgccggcacgtcggagctcctggtggtcaatgccgtcgacatgcggctggaggccacggtccagctcccgtcccgcgtgcccttcggcttccacggcaccttcatcacggccagcgagctcgaggcccaggcctgatcgcctgagctcccgttcgctccccacctacctccgcgtttcttggagggggcaggagggcgaggaagaacagaggagacacgagccatggatcaggggagaagtcaccagagggagcctcggccatagtaggtccccggagtcttcgccgtccccgacaccacagttacagcagttggtagttaaatttccaatttttttagtttaattaagagtgtattttagttgggatagtggcagattagagaaaggggcccagctcgtagcttttcagctggtgcttgcttctagagagcagccagagctcagctggtgcctactgctagtatagtctacatttttttttggttcccttttttctttggatcagacagggatatgcttccccgctccagctccagttgttgtcactcctcgcagtggactggagtgtccgggatcttggttgccgctgcttgctcgccattgccgcccagttgccgctgaggtgttgctggcatggtttctctatcactgtgtgtacatttgtcgatagtataataaaaactaggaaggtcacccacgcatttgcgcggctagatgttcccatttgtaacacaaaaaaaaaaaaaaaaaaaa

SEQ ID NO: 4572 - protein, 605 aa, Panicum virgatum
  misc_feature: Ceres CLONE 1806409
  misc_feature: Great-hit functional homolog of the protein sequence given in SEQ ID NO 9187
  misc_feature (1)..(605): SWISSPROT Homolog: EC 1.13.11.51 9-cis-epoxycarotenoid dioxygenase 1, chloroplast precursor
  misc_feature: Useful for making plants with modulated drought sensitivity
MQGLAPPTSVSIHRRPPAGSRAARGPSSVRFAPRAVSSVPRAAPAARLPPAAFKPAELPAPRKHAAAIAAPAPASPPRTAGRKKELNLFQRAAAAALDAFEEGFVAGVLERPHGLPRTADPAVQIAGNFAPVGERPPARELPVSGRIPPFINGVYARNGANPCFDPVAGHHLFDGDGMVHALRIRNGVAESYACRFTETARLRQERAIGRPVFPKAIGELHGHSGIARLALFYARAACGLVDPSHGTGVANAGLVYFNGHLLAMSEDDLPYHVRVTDGGDLETVGRYDFDGQLGCAMIAHPKLDPATGELHALSYDVIKKPYLKYFYFRPDGTKSDDVEIPLDQPTMIHDFAITENFVVVPDHQVVFKLQEMLRGGSPVVLDKEKTSRFGVLPKHAKDASEMAWVDVPDCFCFHLWNAWEDEETGEVVVIGSCMTPADSIFNESDEHLESVLTEIRLDTRTGRSSRRAILPPSQQVNLEVGMVNRNLLGRKTRYAYLAVAEPWPKVSGFAKVDLATGELTKFEYGEGRFGGEPCFVPMDPAAAHPRGEDDGYVLTFVHDERAGTSELLVVNAVDMRLEATVQLPSRVPFGFHGTFITASELEAQA

SEQ ID NO: 4573 - DNA, 2697 bp, Panicum virgatum
  misc_feature: Ceres CLONE 1806438
  misc_feature: Encodes the peptide sequence at SEQ ID NO. 4574
agaggctgctccaacccacccagtccagagtcagagtccacacgcgcagccagccaagggcgcgggcgcggcccatcccacctccccttccccaaccctagcctccgcggcggggatagatctagccctccgcccccgccgccaggcccgccgagccctagcttccctcccgaaccgctgcggtcgcgatcgccgccgcgtcgcgcggggcggaggaggatcccgcggcgcccccagcttcgagacgggggccatggaggtggacggcgccgcggaggcggggacggcggcggcgggcggcgcgaagccgctgacgccggaggaggaggcgctgcggcgcagcaccgactgcgtctacttcctcgcctcgcccctcacctgcaagaagggtaatgaatgtgattttcgtcacagcgagggtgcccggatgaaccctcgagactgttggtactggttgaatggcagttgtttgaacccgaaatgttcatttcgccatccgccaattgatggtctctttggtgccccaactcctggaatacctccagtttcttcgcactatggtgcttatagctcgggcaagcagatggtcccatgctattacttccagaaagggaactgcctgaagggtgatagatgccctttttatcatggaccgcaagcggctggtaataataccacagatcaggcggtgaaggtttcgtccttacctttggaactgccccaggctaaaaagaatgaagaaactgcggctcctaataatttaactcagcaaggtgctcgaataattgatgacaggagtatagtccatattactaagagtggtgtaggtgtaacacctactgaactagcttccaacgcagtgaagtctaggcccaactcagagcaggcacccaatagtataccagcagcgaagaaaagtttcacagttgaggaggatcatcctatgcactatcagaaccagcttcctgttgaaggtgattctgtccaagactggaaccaaaatttccaaatacccccaacagatgacctgccacagaatagcagggaggctgatgattttttgggggagtcttctcctggttttgatgttcttgtagacaatgatgcagatggtgctgcttatttacatgacgaggaagattttggaagggatatgtacccggtagaagattatgaatatgctccagctgattttgatactcaggcccatcatgaaagtgaacagttcaatggaatgggcgagaatggacaaattggacaactttatgatggctatgataggaaacggcacagatcctcatctgagaggagcatagacagacctttccattcagatagaaggtttcaccacagaggccttgatcgtgatgagatagatgggtcagatctacgccatcagctccgcaggagacggataaatgggccttcaacagccattagcccagaacgggctaatggggggcggcactggagggatgaacactacagagaaagggcacatggtgttcaccacatgcacaatgatcgccgtcagggcccacgaggaatcactctgagttcccgtctgcaggccagaataaagcttcctggaagatcacctgatagagttgaaactcgcttcgaggatgagcgagacagaaggagactccgggggagattctctccagctagacgggtggattttcatggtggtaggaatcgagagcctggaaaacatcaggaaaggagccaccgaagatcaagtgagctcgtctcaagtgtcaggcatgcagatggcctctttattagaagagatgcagtggattcagctcgccttcctgctcgtagaaacttcggagagccaaggaaggcaaatggaattgtggaaaccgaagtatctcttgattttgagggtccgaaacccctcagtgtcatcttgcagaggaaaagagaggcagcagggggtaataactcatcttccaactatgagaaatctgctgaggttgcagtcatgcggactggttttctggttgaatctgagaagaaaggatgtgccaacactatcatgtccgaagattgcaagagtggattaggtgatgaagagtacaaagaggaagatgatatccctgtggagggtcatgggcagtcttcatcgcatggtgacaaatttgagggtgaagatgctgctgaggtggatccagaaggaaatcaagaggcagataactatgaccagagagagggtgagtcagatgactacgagacaatcgaaggtcatgactacaaatctgaggacgaaaatgcataccaagacgacgaagacctcgacgatgatgatgactttgctcagaaagtaggggttgttttctcttgagctctactgtgtcactgcttctgttgcttgaggcaaagcgttctacgttctgtcgttgctcgaagcaaagctctgaagtgcctgcttagcttagcgcatctcttggatgagttcatcaggcgctttatgtttccattttaattttgatagtgccaacgcctactatttttttgaggctgataactgataagtataggtcagatatgaatcaaggtggcattcataaacgattgtggtctacattgtgctttgttcagcatatctgacctatcctcgaactctgtattgtattagtttccttactaacagcagtatattccttggatcaaaaaaaaaaaaaaaaaaaa

SEQ ID NO: 4574 - protein, 698 aa, Panicum virgatum
  misc_feature: Ceres CLONE 1806438
  misc_feature (1)..(28): Pfam Name: zf-CCCH Pfam Description: Zinc finger C-x8-C-x5-C-x3-H type (and similar)
MEVDGAAEAGTAAAGGAKPLTPEEEALRRSTDCVYFLASPLTCKKGNECDFRHSEGARMNPRDCWYWLNGSCLNPKCSFRHPPIDGLFGAPTPGIPPVSSHYGAYSSGKQMVPCYYFQKGNCLKGDRCPFYHGPQAAGNNTTDQAVKVSSLPLELPQAKKNEETAAPNNLTQQGARIIDDRSIVHITKSGVGVTPTELASNAVKSRPNSEQAPNSIPAAKKSFTVEEDHPMHYQNQLPVEGDSVQDWNQNFQIPPTDDLPQNSREADDFLGESSPGFDVLVDNDADGAAYLHDEEDFGRDMYPVEDYEYAPADFDTQAHHESEQFNGMGENGQIGQLYDGYDRKRHRSSSERSIDRPFHSDRRFHHRGLDRDEIDGSDLRHQLRRRRINGPSTAISPERANGGRHWRDEHYRERAHGVHHMHNDRRQGPRGITLSSRLQARIKLPGRSPDRVETRFEDERDRRRLRGRFSPARRVDFHGGRNREPGKHQERSHRRSSELVSSVRHADGLFIRRDAVDSARLPARRNFGEPRKANGIVETEVSLDFEGPKPLSVILQRKREAAGGNNSSSNYEKSAEVAVMRTGFLVESEKKGCANTIMSEDCKSGLGDEEYKEEDDIPVEGHGQSSSHGDKFEGEDAAEVDPEGNQEADNYDQREGESDDYETIEGHDYKSEDENAYQDDEDLDDDDDFAQKVGVVFS

SEQ ID NO: 4575 - DNA, 2672 bp, Panicum virgatum
  misc_feature: Ceres CLONE 1806486
  misc_feature: Encodes the peptide sequence at SEQ ID NO. 4576
atcgcgcggttcgcatactctttccttccgccttttcctcctcaacctccgacacgctctccccgccgccgtcgaccgctcgaatggaggcggagcagcagaagcagcagccccagcgtccgcgccgcaaggggcagaagcggaagttggaggacgaggcggccgccgccgccatcgccgcggcggcagcggcggcggcgtcctcgctcggcagcgcgggcgccgacgacgacaacgaggaggaggactccggctcggcggtgccccccgagatctgctgccgccactcccacgcggcgcttgcccgcgaggtccgcacgcaggtcgacgtcctcctccgctgcgcctcctcatggcgccgtgccgaccgcgccgccgctaagcgcgctacccacgtcctcaccgagctcgcaaaaaacgaggaggttgtcaacgcgatcgtagagggaggcgctatgccggccttggtgcgccacctagaggagcctcctgctgctgcggcggcggcgcaggaggatcagcagctgcggccgttcgagcatgaggtcgagaagggcgctgccttcgctctgggtctcctagctgtaaagcctgaacatcaacaacttattgttgatgctggtgctctacctccgcttgtgaacctcttgaggcataacaataagacaaactcgagggtagttaaccgtctcatcaagagagcagctgatgcaattaccaatctcgctcatgaaaatagcaacatcaaaactgtcgtcagaatggaaggtggaataccgccacttgttgaattgctagaatcacaggatcttaatgtgcagggagcagctgcaggggccttgcgaactctagcttttaaaaatgatgagaacaaagcccagattgttcaatgcaacgctttgccaactttgatcttaatgctgcgatcagaggatgctgcaattcactatgaagcagttggtgtcattggaaatttggttcattcttcaccaaacatcaagaaggaggttcttaatgccggggcactgcaacctgtgattggattattaagttcttgttgtacagaaagccaacgagaggctgctttgttgctagggcaatttgcttctgccgactctgattgcaaggtccatattgtgcaaaggggtgcagtccgaccattaattgaaatgctacagtcgtctgatgtccaactgagagaaatgtctgcttttgcacttgggaggcttgcccaggacaaacataaccaagcaggtattgcatataatggtggtttgttgcctttgttaaaacttcttgattcaaaaaatggatctctgcaacataatgctgcatttgccctttatggagttgcggacaatgaggactatgtctccgacttcatcaaagttggaggtgtccaaaagttgcaagatggggaatttattgtccaggcaacaaaggactgtgtggcaaaaacattgaagaggttagaggagaagataaatgggcgagtgctgaaacacttgctttacatgatgcgagtaggagagaaatctgtgcagaggcgtgttgctctggctctggcacacctttgtgccccaggagatcaaagaacaattttcattgataataatggtctcgacttgcttcttgatcttctgatttccatgagctcgaaacatcaacaagatggttcggcagcattgtacaaattagccaacaaagctgcagcactttctcccatggatgctgcccccccatctccaacaccacaggtttacctcggtgagcaatacgtgaacagttcaacactttcagacgttactttcttggtggaaggaaaacgcttctatgcacacagaattgctttgcttgcttcttcagatgcatttcgtgcaatgtttgatggtggctacagggaaaaggatgcaagagatattgaaattcccaatatcagatgggatgtttttgaactcatgatgagatttatctatacagggtctgtgcaggtaaccagcgaaattgctcaggatgtacttagagctgctgatcagtatctcttagaaggcctcaaacgcctatgcgaatatactattgcaaaggatgtgaatatagataatgtctacgacatgtatgacttgtccgaagccttccatgctgtgtcactgagacataaatgcatcctgtacattctggagcattttaacaagatctgcaccagagccggttcggctcagctgatccagcgtgttatcccggagctccgcaatttcctaaccaaggcgctgagttcgagtccaagtgacaataatgcgcagatatgatttgagttcgttcgcattcattgacatcgctaccgtcatctgaccgatgcagctggagatcctgtacagctaaagtttctggcgctgagcgttcgatggtatctattgtgggtacatggtggccgggtcgttaaaattaacatcgataatgtaacaaacttctgttcatttaacagagggtatggctaaagagaacctgtgcttctagtcatgtgttaaccagctcttgctggaagatagggttagttggacggtactgagtcgtgaccgaaatttgtgggtcttggcttggtttcctgagtttagggtcgtttccagttcagtgttattcgtgtaatagtcatctatggtgttgtttgtcgtgtt

SEQ ID NO: 4576 - protein, 740 aa, Panicum virgatum
  misc_feature: Ceres CLONE 1806486
  misc_feature: Great-hit functional homolog of the protein sequence given in SEQ ID NO 9319
  misc_feature: Useful for making plants with modulated drought sensitivity
MEAEQQKQQPQRPRRKGQKRKLEDEAAAAAIAAAAAAAASSLGSAGADDDNEEEDSGSAVPPEICCRHSHAALAREVRTQVDVLLRCASSWRRADRAAAKRATHVLTELAKNEEVVNAIVEGGAMPALVRHLEEPPAAAAAAQEDQQLRPFEHEVEKGAAFALGLLAVKPEHQQLIVDAGALPPLVNLLRHNNKTNSRVVNRLIKRAADAITNLAHENSNIKTVVRMEGGIPPLVELLESQDLNVQGAAAGALRTLAFKNDENKAQIVQCNALPTLILMLRSEDAAIHYEAVGVIGNLVHSSPNIKKEVLNAGALQPVIGLLSSCCTESQREAALLLGQFASADSDCKVHIVQRGAVRPLIEMLQSSDVQLREMSAFALGRLAQDKHNQAGIAYNGGLLPLLKLLDSKNGSLQHNAAFALYGVADNEDYVSDFIKVGGVQKLQDGEFIVQATKDCVAKTLKRLEEKINGRVLKHLLYMMRVGEKSVQRRVALALAHLCAPGDQRTIFIDNNGLDLLLDLLISMSSKHQQDGSAALYKLANKAAALSPMDAAPPSPTPQVYLGEQYVNSSTLSDVTFLVEGKRFYAHRIALLASSDAFRAMFDGGYREKDARDIEIPNIRWDVFELMMRFIYTGSVQVTSEIAQDVLRAADQYLLEGLKRLCEYTIAKDVNIDNVYDMYDLSEAFHAVSLRHKCILYILEHFNKICTRAGSAQLIQRVIPELRNFLTKALSSSPSDNNAQI

SEQ ID NO: 4577 - DNA, 2061 bp, Panicum virgatum
  misc_feature: Ceres CLONE 1806525
  misc_feature: Encodes the peptide sequence at SEQ ID NO. 4578
gcagtcggaggcggcaggtacacatccccgcggtgcggcctgctcctcctctttcccataaatagcggcccggcgcccgacgccgggggaacttttccatttccagagctgcaaaggcttccgctttacctggccataccttgccttttttgcttcgcgcgctgcctgcccatggcggcggcgtggttgcgggcggtgttcctggccgccgtggcggcgtccgcggcggaggcgctgggcctggacgtccaccaccggtactcggcgaccgtgcgggagtgggcggggcaccgcgcgccgccgcgcgggacgccggggtactacgccgcgctggccggccacgacggcctccgccgccgctcgcttgcctccgccgcggggggaggggaggtggccttcgccgacggcaacgacacctaccggctcaacgacttcggattcttgcattacgcggtggtggcactggggactccgaacgtgacgttcctggtggcgctcgacaccggcagcgacctcttctgggtgccctgcgactgcatcaagtgcgccccgctcgtctcccccacctacgggaatttgaagttcgacgtgtacagccctcagaagtcgagtaccagccgaaaggtcccttgcagtagcaatttgtgcgatgggcagagtgcgtgccaatcagcaagcaacagctgcccgtacaatattgaatacttgtccgataacacgtcgtcctcaggtgtgctagtcgaggatctattgtacctgataactgagtatggacaaccgaaagttgttacagcctccataacattcggttgtggacaggttcagacaggttcatttctgggcagtgctgcgcccaatggtctgcttgggcttggtatggacagtaaatcagttccaagtttgctagcaagtcaaggagttgctgccaattccttctcaatgtgctttggagaagatggacatggtagaatcaattttggggacaccggaagctcagaccagcaggagaccccattaaatatttataaacaaaacccatattacaacataagcatcactggtgctatggtgggaagtaaatccattaatgctaagtttagtgctattgtcgactctggcacctctttcacagctctgtccgatcctatgtacactgaaatcacaagcagtttcaattcacaagtccaagataagccaacccaacttgactcttctctaccctttgaattttgctacaccataagtccaaagggatctatcaatcctccaaatataagtctgatagcaaaagggggaagcttatttcctgtcaacaatccaataattactataacggacactgcatctaatccacttggctattgcttggccatgacgaagagtgaaggtgttaacttaataggggagaattttatgtctgggttgaagattgtgtttgatcgagagaggaaggtcttgggctggaaaaattttgattgttacagcgtggacaactcgagtaaccttccagtgagcccaaatacttctgctgttcctccgaagccttcaatgggaccgagcagctacactcctgaagctaccaagggtgcttcaccaaatggcacccaagtcaacgtattgcagccttcagagagttcttcactgaagctgcatttcaacacaaacatcttcatcgccaccgctctcatgttctccgcgattctttgatcagctcaaattccacatgtcggtcttctgatacaaaatatgcagatatgatagatttagctaaagtttcattacctcattgatttacgtgtagcggtataggatcacattcttttggcttgggtccagtaggaattacaggatattaggacacgggatgactcatagcctcataggccatttttgttctactttcacacgtttatactgtaccttttgtgatggtttttttcctccccacccagtgtttatgtcgtggtggctgtacatatataggtaacttgaggttgtattgactatagaataagtgaataatgatgctggcatctgcttcaaaaaaaaaaaaaaaaaaaa

SEQ ID NO: 4578 - protein, 511 aa, Panicum virgatum
  misc_feature: Ceres CLONE 1806525
  misc_feature (1)..(341): Pfam Name: Asp Pfam Description: Eukaryotic aspartyl protease
MAAAWLRAVFLAAVAASAAEALGLDVHHRYSATVREWAGHRAPPRGTPGYYAALAGHDGLRRRSLASAAGGGEVAFADGNDTYRLNDFGFLHYAVVALGTPNVTFLVALDTGSDLFWVPCDCIKCAPLVSPTYGNLKFDVYSPQKSSTSRKVPCSSNLCDGQSACQSASNSCPYNIEYLSDNTSSSGVLVEDLLYLITEYGQPKVVTASITFGCGQVQTGSFLGSAAPNGLLGLGMDSKSVPSLLASQGVAANSFSMCFGEDGHGRINFGDTGSSDQQETPLNIYKQNPYYNISITGAMVGSKSINAKFSAIVDSGTSFTALSDPMYTEITSSFNSQVQDKPTQLDSSLPFEFCYTISPKGSINPPNISLIAKGGSLFPVNNPIITITDTASNPLGYCLAMTKSEGVNLIGENFMSGLKIVFDRERKVLGWKNFDCYSVDNSSNLPVSPNTSAVPPKPSMGPSSYTPEATKGASPNGTQVNVLQPSESSSLKLHFNTNIFIATALMFSAIL

SEQ ID NO: 4579 - DNA, 1586 bp, Panicum virgatum
  misc_feature: Ceres CLONE 1806573
  misc_feature: Encodes the peptide sequence at SEQ ID NO. 4580
gacttctgctccagggctcctcctgcctgctctctcctcgtgtgcgccaccgccgagccagcccaccgccccgcgatccttccggaatgctcctccgcggcggccgccgcgccgcgctcctcctcgccgccgccgccggcgtcgcgggcgccggggtcctcacgcgtcgcgaccccgacactgccgtctacgcctcggcctccccgccgctccgccaggccctctccgccgccgccgccgaggggctccgctccggcgcccgcctcttctccccgtggctgcttcctcctcctcctcaccaagggttcccaatactaaattcctttgcttcggcatcggtttcacctgctgacttgaggggccaaggttctgctggaagctcagatgattcaagatgttgcccagggtgtctaggcaggaattcgattgccaaagcagcatctgcagttggtcctgctgttgtaaacatttcttgtatgcaagatgctcatggatggcgcctaggggagagcattgggtcgggaactataatagatcccgatgggacgatattgacatgtgcgcatgttgttgcagattttcagagcacaaaagcagttgtgaggggaaaggttagtgtgactttacaagatggccgtgaatttgaaggtgttgtccttaatgctgaccgccactctgacatcgctgttgtgaagattaaatctaagaccccattaccggctgccaggcttggatcatcatcaagacttcaaccaggtgattgggttgttgctttgggctgtccactttctcttcagaacacagttacagctggtattgtcagctgtgttgaccggaaaagcagtgatctgggtcttggaggattacgaagggagtatctgcaaacagattgcgccattaatcaggggaattctggaggccctcttgtgaacctcgatggtgagattattggagttaatgtgatgaaagtcaggaatgctgatggtttgagcttcgcagtaccaattgactctgtcattaaaatagtagataacttcaagagaaatgggagagttgtgaggccatggcttggtttaaagatgctagacctgaatcccatgatcatttcacagctcaaagaaaaatcaaatacttttccagacataagaaaaggagtgcttgttcctatggttacaccaggatctccagctgagcaggcaggatttcgacctggggatgtggtggttgaatttggtggcagaccagttgaaagcatcaaagagatcattgatatcatgggggacaaggtgggagtgccatttaaagttcttgttaaaagagcaaacaatgtgacagcgactttaactgtgataccagaggaggcagatgccagcagatgaccccaaattgatctgctgggaagcagagataatacctaataggaggattttttccattggacctccaattttcattacatatactttccatccgaattttgtatgtaactaagcatgggtgacaggaccacccaaaaggaaagaacaagagaatacatgggaaatagagatattggcgcaatgttcaaaaaaaaaaaaaaaaaaaaa

SEQ ID NO: 4580 - protein, 430 aa, Panicum virgatum
  misc_feature: Ceres CLONE 1806573
  misc_feature (1)..(173): Pfam Name: Trypsin Pfam Description: Trypsin
MLLRGGRRAALLLAAAAGVAGAGVLTRRDPDTAVYASASPPLRQALSAAAAEGLRSGARLFSPWLLPPPPHQGFPILNSFASASVSPADLRGQGSAGSSDDSRCCPGCLGRNSIAKAASAVGPAVVNISCMQDAHGWRLGESIGSGTIIDPDGTILTCAHVVADFQSTKAVVRGKVSVTLQDGREFEGVVLNADRHSDIAVVKIKSKTPLPAARLGSSSRLQPGDWVVALGCPLSLQNTVTAGIVSCVDRKSSDLGLGGLRREYLQTDCAINQGNSGGPLVNLDGEIIGVNVMKVRNADGLSFAVPIDSVIKIVDNFKRNGRVVRPWLGLKMLDLNPMIISQLKEKSNTFPDIRKGVLVPMVTPGSPAEQAGFRPGDVVVEFGGRPVESIKEIIDIMGDKVGVPFKVLVKRANNVTATLTVIPEEADASR

SEQ ID NO: 4581 - DNA, 2321 bp, Panicum virgatum
  misc_feature: Ceres CLONE 1806574
  misc_feature: Encodes the peptide sequence at SEQ ID NO. 4582
aagtcgactctccgcgcaagcttaatgctccctccattataaccacccaaccctcctcccctccccccaccctcttctcccctccccctcccacccggctccgctcccgtcccgccatgggcaactcgctcgcctgcttctgctgcgccggcggcggcgccggccgccgccgccacgtggcgcccgccgcgctcccctccgacccggcctacgacgagggcctgggccactccttctgctacgtcaggccggataaggtgctcgtgcccttctccgcggacgacctggtcgccgacgccaaggcggccgccgcggccgaggaggccaccacgttccgggccatctcgggggcggcgctcagcgccaacgtctccacgccgctctccacatccgtgctcctcctgctgccgaacgaatccgccgcgtcctcggccgccgccgcctcctccgggttcgagagctccgagtccttcgccgccgtgccgctgcagccggtcccgaggttcccgtcggggccgatctgcgcgcccgccgggggcgggttcctctccgggccaatcgagagggggttcctctccgggccccttgacgccgcgctcatgtccggacccctcccgggcgctgccacctccggccgcatgggaggcgccgtgcccgcgctccgccggagcctctcccacggcggccgccgcctgcggaatttcacgcgcgcgcttctcgcgcgggtggataagtttcaggattcgatggatctcggctcgccggacgccgccgccgccgtggccgcctgcggcgccgattcagccaggctccagtgggcgcaggggaaggccggcgaggaccgcgtgcacatcgtggtgtccgaggagcggggatgggtgttcgtcggtatctacgacggctttaacggccccgacgccacggacttcctggtctcccacctctacgccgccgtgcaccgcgagctccgcggcctgctctgggaccagtgcgagcaagaggagcagaacgaccaacaccccgagcaaccgaccagcaccacggcatcagaccaccaggatcagcctgcccatcgccgccgcgcccgccgatcaagacccccgcgcggcgccgacgatgaccaacggcggtggaagtgcgagtgggagcgtgactgctcaaacctgaagccgccaactcagcggccccctcggagcaacagcgagaacgaccacctcgccgtgctcaaggcgcttgcacgcgcgcttcgcaagactgaagaggcctacctggacgtcgccgacaagatggtcggcgagttcccggagcttgcgcttatgggctcttgcgttctagccatgcttatgaaaggagaggacatgtacctcatgaatgtaggcgacagccgggctgtcttgggaacagtggacagtgttgatctcgagcagatcagtgagggttcattcgacggattggttggggattgctgcccactcttgtcagctgtgcagcttacatccgaacatagcacttcggtgcgagaggaagtttgcagaatacgcaacgagcatcctgatgacccgtccgcaatctcaaaggaccgggtgaagggctcgcttaaggtgactagagcattcggagctggtttcttgaaacagcccaagtggaatgatgcactgttggagatgttcagaatagactacgttgggtcgtctccatacatcacgtgtaatccttccctcttccaccataaacttagcacaagggacagattcatgatactatcttcagacgggctttaccaatatttcaccaatgaggaggcggttgctcaggtagaaatgttcatcgcaacaacccctgaaggcgaccctgctcagcatctggtggaggaagttcttttccgagccgcaaacaaagcaggcatggactttcatgaattaatcgagatacctcagggcgaccgtcggcgataccatgacgatgtgtctgtcattgtaatatctttggagggtagaatctggagatcatgtgtgtaaatagatcagcaatactagattagagaaacaaacgtatagagaaagagaggttcttgcagacctttgagcagttcttgcggctactccgctcctccccagctgcctgtacaatatcaacaaagcactgggttggccttgggcttgggatcttggcgtatccagctgaactacggtgaaatcccctggaccacggcgacggcgtatgagatgttcatgtaaaagaggatttgttcaattattattaatataactaaaatcacgaccgattggtcagctttctttgaaaaaaaaaaaaaaaaaaaa

SEQ ID NO: 4582 - protein, 633 aa, Panicum virgatum
  misc_feature: Ceres CLONE 1806574
  misc_feature (1)..(345): Pfam Name: PP2C Pfam Description: Protein phosphatase 2C
MGNSLACFCCAGGGAGRRRHVAPAALPSDPAYDEGLGHSFCYVRPDKVLVPFSADDLVADAKAAAAAEEATTFRAISGAALSANVSTPLSTSVLLLLPNESAASSAAAASSGFESSESFAAVPLQPVPRFPSGPICAPAGGGFLSGPIERGFLSGPLDAALMSGPLPGAATSGRMGGAVPALRRSLSHGGRRLRNFTRALLARVDKFQDSMDLGSPDAAAAVAACGADSARLQWAQGKAGEDRVHIVVSEERGWVFVGIYDGFNGPDATDFLVSHLYAAVHRELRGLLWDQCEQEEQNDQHPEQPTSTTASDHQDQPAHRRRARRSRPPRGADDDQRRWKCEWERDCSNLKPPTQRPPRSNSENDHLAVLKALARALRKTEEAYLDVADKMVGEFPELALMGSCVLAMLMKGEDMYLMNVGDSRAVLGTVDSVDLEQISEGSFDGLVGDCCPLLSAVQLTSEHSTSVREEVCRIRNEHPDDPSAISKDRVKGSLKVTRAFGAGFLKQPKWNDALLEMFRIDYVGSSPYITCNPSLFHHKLSTRDRFMILSSDGLYQYFTNEEAVAQVEMFIATTPEGDPAQHLVEEVLFRAANKAGMDFHELIEIPQGDRRRYHDDVSVIVISLEGRIWRSCV

SEQ ID NO: 4583 - DNA, 1760 bp, Panicum virgatum
  misc_feature: Ceres CLONE 1806590
  misc_feature: Encodes the peptide sequence at SEQ ID NO. 4584
aggcagcagcaccgtaagggacaaaaaccagagcagaggccagagggaggattcactgtcctgatgaagaattaagagagcacagagaaatcacgcagccactcgtcgaactggagccaagatcttgctgctggtcgtggtggcggcgagagatcgaaggtcggcccggtggtctcttggcatcgtctggtctgatccatggtggccttcgcggcgcacacgagcgccgccacctcgcactgctcgccggcgggcacggccatcctgctccgaagcgggaggcgggacttccccacccgcgtgtcgtgctcggcggcggcggcggcggcgcacaataagacggtggtgatcggggtggcggccgactccgggtgcgggaagagcacgttcgtgcggcgactgacgagcgtgctcggcggcgttgcggagccgccgaggggcgggaacccgaacccggactccaacacgctcgtcggcgacaccgccacggtgctctgcctggacgactaccactcgctggaccgcgcggcgcggaaggcgcggggcttgacggcgctggacccgcgggccaacgacttcgacctcatgtacgagcaggtgagggccctcaaggacggccgcgccgtcgacaagccagtctacaaccacgtcaccggcctcctcgacccgcccgagcgcgtcgcgccgcccaggatcctcctcatccaggggctgcacccgatgtgcgatgagcgcgtcagagatctgctggacttcagcatctacctggacatcagcgacgaagtcaagtttgcatggaaaattcagagagacatagcagagcgtgggcacagcctagagagcatcaaggccagcatcgaggccaggaagcccgacttcgacgcctacattgacccgcagaagcagtacgcggacgccgtgatcgaggtcctgccgacgcagctgatcccgggcgacgacgacggcaaggtgccgcgcgtgaggctgatcatgaaggaaggcgtgaagcacttcgccccggtgtacctcttcgacgaagggtccaccgtcagctggatcccctgcggtcggaagctctcatgctcctaccccggcatcaagttcgcctacggcttcggcacctacttcggccacgaggtgtcggtgctggagatggacgggcggttcgacaagctggacgagctcatctacgtggagagccacctcagcaacctgtccaccaagtactacggggaggtggcgcagcagatgctcacgcacgccgacttgccgggcagcaacaacggcacggggctcttccagaccatcgttgggctcaagatcagggaactctgcgagcagatcgtcgccgagagggccgccatgacggccgacgctgtcaaggtctgatgtctgatgaagccggtgttgatcggaggagggcgaccacacattctggttgctgttcttgtaaccgtagtgccggatagattatcatgctgcattgcagttcgattattatgtttgtaattgtatagggatcttgcagggacagttcagcgagcagtaagttgcatgtccacgagatgttggcgcccttcattgtaggaagaattctgaattttattggtgtacattgtactcctactcttaaggtcgtctggacgcacgatcgctgttggcatagttaaccggataatttgccaagagcagaactagaagcctgatgcaaaatgatcctttcagaagcctggagctggcaaaaaaaaaaaaaaaaaaaa

SEQ ID NO: 4584 - protein, 396 aa, Panicum virgatum
  misc_feature: Ceres CLONE 1806590
  misc_feature (1)..(200): Pfam Name: PRK Pfam Description: Phosphoribulokinase / Uridine kinase family
  misc_feature (2)..(395): SWISSPROT Homolog: EC 2.7.1.19 Phosphoribulokinase, chloroplast precursor
  misc_feature (25)..(396): SWISSPROT Homolog: EC 2.7.1.19 Phosphoribulokinase, chloroplast precursor
MVAFAAHTSAATSHCSPAGTAILLRSGRRDFPTRVSCSAAAAAAHNKTVVIGVAADSGCGKSTFVRRLTSVLGGVAEPPRGGNPNPDSNTLVGDTATVLCLDDYHSLDRAARKARGLTALDPRANDFDLMYEQVRALKDGRAVDKPVYNHVTGLLDPPERVAPPRILLIQGLHPMCDERVRDLLDFSIYLDISDEVKFAWKIQRDIAERGHSLESIKASIEARKPDFDAYIDPQKQYADAVIEVLPTQLIPGDDDGKVPRVRLIMKEGVKHFAPVYLFDEGSTVSWIPCGRKLSCSYPGIKFAYGFGTYFGHEVSVLEMDGRFDKLDELIYVESHLSNLSTKYYGEVAQQMLTHADLPGSNNGTGLFQTIVGLKIRELCEQIVAERAAMTADAVKV

SEQ ID NO: 4585 - DNA, 2108 bp, Panicum virgatum
  misc_feature: Ceres CLONE 1806600
  misc_feature: Encodes the peptide sequence at SEQ ID NO. 4586
gtcgtcagaaattcagcagcccaacgcgtcttccagtctccgcccccggcaagcaagaccgcaaaagccactcctttttctcctccgcccaaaccgccgcctccactcctctcctgtccttctcccctcccctaaaccgagtcacctccgctccctcatcctcctccagcagccccccagcttggctgccgcgctcgctcatcgcaatcctaatctcctcctccctggcatcaccagcttgtcatatgtggatcctttttaagtctctagaagccattttctaaagaacattctggggagaggttgcgactagcatttctgttgattaacatggactactcttctggttcctacttctcaccatggcctgtcaattctgcctctgagaggtacagtttgactgatggttcagtggaatcatttggagatggaagcatgccaccttcaagctatttcatgacagctagttcagaccacagtttaaaattcaatgggcatgaacaggactccactatgcttacaaacgagcggttaacctatgcggatactggacctgctgatatgttacctggtgagattctatccagggataagattcctgaaaatcttctggagcttcaacgactgcagaacaatggcaatctgcagagtaatttagtgaacccacgagtgcttcagcgcacttcaacaccaggaggatttcatcagcaactgaatacatcttgcctttcagaaatgcctcatgccttatccagttcaattgatagtaacagcagtgaagtttccgcttttctcgctgatgtcaatgctgtatcttcagcctcgagcttatgtcccacattccaaaatcatccttcattcatggaaccagtgaatatagaagctttcagtttccaaggggcacaatgtgacgctattttgaacaaaacaagccatccaaacgggaatatctcagtttttgacaatgctaccttggcatcactacatgatagcaaagagtttatcagtagtaggcttcccttgttttctagtgtccaggaaacaaacctagctgccattggtttcaagactcaaaagcaggagcaaaatccaatgtgtaatgtgcctatccctgctttcactgctcgtaaccagatggcggtcacaacaacacaaggagctcagattcttcaacagatgccttcattggtcaatgaaaataaaagtgactgtcctgttagccgtccttctgatgtgcaaaaccaagcaaattcagctggaaatggcgtcggcatgaagccgcgagtaagggctcgtcgtggacaggcaactgatcctcatagtatcgctgaacggcttcgcagagaaaaaatttcagataggatgaaaaatctgcaagacctcgtccctaattccaataaggcagacaaggcatccatgctggatgaaataattgattatgtgaaatttcttcagcttcaggtcaaggtcttgagcatgagtaggctaggatctcccggagcagttcttccccttctcacggaatcccaaactgagggttgccacggtcaacctctgtcagcttcgaccaatgcacaaggactgctggacgcacaagactcagaagatggcttagcctttgaggaagaagtggtcaagctgatggaaacaagcatcaccagcgccatgcagtaccttcagaataaggggctctgcctgatgccagttgctctcgcttccgctatatccacccagaaaggcgtatccgatactgcgatccctcctgaacggtgaagtgaagacacatgctccccccatcagcatgaggaaactactgcaggaaacagaacctgactgctgaagacgcagtttataccccgtggagtacaaagataggataggaagttagtctgaccaaagttcagttcatgtcctaatctactaatctgcttctcggaacctgttgcacatcagttgatgtgtatttttcctcttttctgcttttcctttttttttcctggattgcatcagggactcagggacagggaatagttgcgggttggaaagtttgtatctggatctctatcagggtttctcttttgtgcatataaaatgtgatatctaccggt

SEQ ID NO: 4586 - protein, 480 aa, Panicum virgatum
  misc_feature: Ceres CLONE 1806600
  misc_feature (1)..(50): Pfam Name: HLH Pfam Description: Helix-loop-helix DNA-binding domain
MDYSSGSYFSPWPVNSASERYSLTDGSVESFGDGSMPPSSYFMTASSDHSLKFNGHEQDSTMLTNERLTYADTGPADMLPGEILSRDKIPENLLELQRLQNNGNLQSNLVNPRVLQRTSTPGGFHQQLNTSCLSEMPHALSSSIDSNSSEVSAFLADVNAVSSASSLCPTFQNHPSFMEPVNIEAFSFQGAQCDAILNKTSHPNGNISVFDNATLASLHDSKEFISSRLPLFSSVQETNLAAIGFKTQKQEQNPMCNVPIPAFTARNQMAVTTTQGAQILQQMPSLVNENKSDCPVSRPSDVQNQANSAGNGVGMKPRVRARRGQATDPHSIAERLRREKISDRMKNLQDLVPNSNKADKASMLDEIIDYVKFLQLQVKVLSMSRLGSPGAVLPLLTESQTEGCHGQPLSASTNAQGLLDAQDSEDGLAFEEEVVKLMETSITSAMQYLQNKGLCLMPVALASAISTQKGVSDTAIPPER

SEQ ID NO: 4587 - DNA, 1887 bp, Panicum virgatum
  misc_feature: Ceres CLONE 1806605
  misc_feature: Encodes the peptide sequence at SEQ ID NO. 4588
ggctattattcgaagccgtacgcccggcagatcgccctcgccactccacttcactggggatctcctcctcctccactccacttctcttcctttgcggcgacgactgggctcgccagctcttccccggcgacgagcaccccccctccccccaaggtcggttggttaggcagttcggaccggcggcgcggccatggcttccaacggcatcacccccagagatgtatgtgttgttggggttgcacgcacccctatgggtggtttccttggtgccttgtcttccttgcctgcaaccaaacttgggtctatagcaattcaagctgctctgaaaagagcaaacgtggatccagccgttgtgcaggaggtctactttggaaacgtcttgagtgctaatttgggacaagctcctgcaaggcaagctgctctgggtgcagggataccaaacactgttgtctgtaccactgttaacaaagtctgtgcatctggcatgaaagctactatgtttgcagcacagtcaattcaactgggtatcaatgatattgttgtggcaggtggcatggaaagcatgtccaatgccccaaagtacattgctgaagctaggaaagggtctcgtttcggacatgacacacttgtcgatggcatgcttaaggatggcctttgggacgtatatggtgattgtgccatgggaatgtgtgccgagccttgtgctgacaatcatgccctcacaagagaagatcaggatgcttttgctatccaaagcaacgagcgtggaattgctgctcgtgacagtggtgcttttgcatgggagattgttccgattgaagttcctgttgggaggggaaaaccaccagtacttattgagaaagatgaaagcctgggcaagtttgaccccgtaaaactgaagaaactccgcccaagtttcaaggagaatggtggcactgttacagctggaaacgcttctagtataagtgatggtgctgctgcattagtcttggtgagtgggcagaaggctgaagagcttggcctgcaagtccttgcaaggatcaaaggatatgcagatgcagctcaagctccagagctttttacaaccacccctgcacttgccataccaaaggctattgcaaatgctggactagagtcatctcatgttgatttttatgagattaatgaagccttttcggctgttgcgcttgcaaatcaaaagcttctcgggattccttccgaaaagattaatgttcatggaggagctgtatctttaggtcatcctcttgggtgcagtggtgctcgtattttggtcacccttattggagtccttagggagaagggtggcaagatcggtgttgctggtgtatgcaatggtggaggtggagcgtcagcacttgttcttgagcttgcataagaaatagtgaccttgtgcaatcgttccagtagttagcagcggcttcctgcgtcgaccttgtactattatatggatgtttatttatgttgtagcttgttgaacattcttagattcattaggcaataaattgtgccgtgcttctgttacttgcatagtattctgcaataagagaaacggagcagcatctttgcaccgttcttgtatcaagttcaggcactcaatagctgtagtttttaaatgtttgtgtgaaacttatttacatgaaactgtgaggatgctatgtagcaacggccatgctggtattcagtcaagagtagctgggaactggcgatgagcagcagagcaggtgcaagatacatgtggagcctttggtcgccctcgttttctgctggcttcgtgtgagttgaaactagatacagtgcgtgaatgtaaatgaacaagagaccaaggaatggtttccatgtattgatcaatgatcatttgcctgcttg

SEQ ID NO: 4588 - protein, 401 aa, Panicum virgatum
  misc_feature: Ceres CLONE 1806605
  misc_feature (11)..(399): SWISSPROT Homolog: EC 2.3.1.9 Acetyl-CoA acetyltransferase IA
  misc_feature (3)..(400): SWISSPROT Homolog: EC 2.3.1.9 Acetyl-CoA acetyltransferase, cytosolic 1
MASNGITPRDVCVVGVARTPMGGFLGALSSLPATKLGSIAIQAALKRANVDPAVVQEVYFGNVLSANLGQAPARQAALGAGIPNTVVCTTVNKVCASGMKATMFAAQSIQLGINDIVVAGGMESMSNAPKYIAEARKGSRFGHDTLVDGMLKDGLWDVYGDCAMGMCAEPCADNHALTREDQDAFAIQSNERGIAARDSGAFAWEIVPIEVPVGRGKPPVLIEKDESLGKFDPVKLKKLRPSFKENGGTVTAGNASSISDGAAALVLVSGQKAEELGLQVLARIKGYADAAQAPELFTTTPALAIPKAIANAGLESSHVDFYEINEAFSAVALANQKLLGIPSEKINVHGGAVSLGHPLGCSGARILVTLIGVLREKGGKIGVAGVCNGGGGASALVLELA

SEQ ID NO: 4589 - DNA, 2732 bp, Panicum virgatum
  misc_feature: Ceres CLONE 1806607
  misc_feature: Encodes the peptide sequence at SEQ ID NO. 4590
gtgagctgttcttccgctctctcccccttcccttctctctcttgtgtctgtgcgcgcgacatatgttggctggccggccgcggtggtggtcgtcttccggctattaaggccgttcttgatgagttggtgagggaggaggaggaggagagctcgggtcgtcgctgcgtgcaggggttgtgtgaaggagagccggagagggggggcgtggtggtgcttggccgggccaatggcgccgtcgtggtgggggaaggacgcgagggccaatggcggcggcggcgggacgccggtggtggtgaagatggagaaccccaactggtccatctccgaggtctccgcgtcggaggtggcgccgggctcgccggcgggcggcggcgggggcaaggccgggcggggcaagaacgcgcgccagatcacgtgggtgctgctcctcaaggcgcaccgcgccgcgggccgcctcacgggggcggcctccgccgcgctcgccgtcgcggccgccgcgcgccggagggtggcggcggggcggaccgactccgacgccgcgccgggggagaacacggcgctgcgcatgcgcttctacggctgcatccgggtgttcctcgtgctgtccctgctgctgctcgccgtcgaggtggcggcgtacctccaggggtggcatctcgacgtggaagaggggctcctcgccgtcgacgggctcttcgccgccgcctacgcgggctggatgcgcacccgccttgactacctcgcgccgcccctgcagttcctcaccaacgcctgcgtcgtcctcttcttgatccagagcgtcgaccgccttgtcctttgcctaggctgcttctggatcaggctcaaggggatcaagcccgtgccgctggcggccggcaaggaggacgtcgaggccggcgccgaggacttccccatggtgctcgtgcagatgcccatgtgcaatgagagggaggtgtaccagcagtccatcggtgcagtttgcagcctggactggccaaggtcaaacttccttatccaagtgctagatgattccgatgatgctaccacttcagcccttatcaaggaggaagtggagaaatggcagcgggagggtgtgcgcataatataccggcaccgggtaatccgagatggctataaggctggaaacctgaaatcagccatgaactgcagttatgtgaaagattatgagtttgttgtcatctttgatgctgattttcaaccgcaagcggatttcctgaagcgcaccgttccccatttcaagggaaaggacgatgtcgggttggttcaggcaagatggtcttttgtaaacaaggatgagaacttgctgaccagacttcagaacataaatctttgcttccattttgaggtggagcagcaggtgaatggggcgtttctcaacttcttcgggtttaacggcactgcgggagtgtggagaattaaggcacttgaggactctggaggatggatggagaggacaacagtggaggatatggacatagctgtccgagcacatcttaagggatggaagtttgtctacctaaatgatgttgagtgtcaatgcgagttgccagaatcctatgaagcttacagaaagcagcaacaccggtggcactcaggtcccatgcaattgtttaggctgtgctttgtggacataatcaaatctaagattggattctggaagaagttcaatctcatattccttttcttcctcctccggaagctcatcctaccattctattccttcactcttttctgtgtcatccttcccatgacaatgtttgttcctgaagctgaactccccacatgggtagtatgctacattccagctacaatgtccatcctcaacatccttccagcccccaaatccttcccgttcattgttccgtaccttctgtttgagaacaccatgtcagtaaccaagttcagtgccatgatttctggcctgttccagctcgggagtgcctacgagtgggtcgtcaccaagaaatcaggccgttcttctgagggtgatcttgtttccctcgttgaaaagcactctaagcaacaaagagtaggttctgcgcccaatcttgacgcgctaacaaaggaggagtcaaatcctaaaaaggactcgaagaagaagaagcacaataggatctacaggaaggaactcgcactgtccttccttctgctaacagcagccgcccgcagcttgctgtctgcccagggaatccatttctacttcctcctgttccaaggggtctcattcttggtcgtcggcctcgacctgatcggcgagcaagtggagtgacagaaataaggagtataatgggttctttcctctttttttgtctgaagaaatctttgcaagcatctaagcagctctttgtaaagggaagggtgtcgcactctctgatgcttacacgaggaagctctggtccctattccaggggtcaagattcaccagagatttacttgaaaaaaagattcaccagagatactgaaatgtggagctgtagataggtatagtttggatttagcctgtgagatgcttttattctttcaggtctcgattcttttgtaagaatatttctgtgcctagatgggttctttctttctttctttctttctttctttctttctttctttctttcttgacagactttaccttcaaatgaagataatacttgtggttaccacgtatttgatcaatcaattatcgtgattgttgacaaaaaaaaaaaaaaaaaaaa

SEQ ID NO: 4590 - protein, 687 aa, Panicum virgatum
  misc_feature: Ceres CLONE 1806607
  misc_feature: Great-hit functional homolog of the protein sequence encoded by LOCUS At4g07960
  misc_feature (1)..(176): Pfam Name: Glycos_transf_2 Pfam Description: Glycosyl transferase family 2
  misc_feature: Useful for making plants with altered cell wall content and/or composition
MAPSWWGKDARANGGGGGTPVVVKMENPNWSISEVSASEVAPGSPAGGGGGKAGRGKNARQITWVLLLKAHRAAGRLTGAASAALAVAAAARRRVAAGRTDSDAAPGENTALRMRFYGCIRVFLVLSLLLLAVEVAAYLQGWHLDVEEGLLAVDGLFAAAYAGWMRTRLDYLAPPLQFLTNACVVLFLIQSVDRLVLCLGCFWIRLKGIKPVPLAAGKEDVEAGAEDFPMVLVQMPMCNEREVYQQSIGAVCSLDWPRSNFLIQVLDDSDDATTSALIKEEVEKWQREGVRIIYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEDSGGWMERTTVEDMDIAVRAHLKGWKFVYLNDVECQCELPESYEAYRKQQHRWHSGPMQLFRLCFVDIIKSKIGFWKKFNLIFLFFLLRKLILPFYSFTLFCVILPMTMFVPEAELPTWVVCYIPATMSILNILPAPKSFPFIVPYLLFENTMSVTKFSAMISGLFQLGSAYEWVVTKKSGRSSEGDLVSLVEKHSKQQRVGSAPNLDALTKEESNPKKDSKKKKHNRIYRKELALSFLLLTAAARSLLSAQGIHFYFLLFQGVSFLVVGLDLIGEQVE

SEQ ID NO: 4591 - DNA, 2476 bp, Panicum virgatum
  misc_feature: Ceres CLONE 1806608
  misc_feature: Encodes the peptide sequence at SEQ ID NO. 4592
atccttgccaagcatctcgcaatcctagataggcgaagaggagatgacgatcacatcatccgtcaagctcgccggcggcacgctgtcggtctgcgggaggacggtgctgtccggcgtgccagccgccgtggcggcgtcctctgcgtcagcggccggagcggtcgacggggtcttcattggcgccgacctcgccgagccggcgtcccaccacgtcatttccctcggcaccttaaggggcgtgcgtttcatggcgtgcttccggagcaagctgtggtggatgtcgcagcggatgggggacaagggcggcgatgtcccgcacgagacgcagttcctgctcgtggagtccacgggcgccggtggcaaggacgcggcggcggcggcgtacgtcgtgttcctcccgctcgtggagggcgcgttccgggccagcctccagggcggcgccggcgaggcgctggagctctgcgtcgagagcggggacgacgacacgcgcgcggcgtccatcgagcgcgcgctcttcgtgggcgctgcggagtcggaccccttcgcagccgtcgccggcgccgtcgccgccgccaggtccgcgctcaagacgttccgggtccgcgccgagaagaagctcccgggcatcgtggactactttgggtggtgcacctgggacgccttctaccaggacgtcacgcaggagggcgtcgaggccgggctccgcagcctcgtcaccggcggcgcgccgcccaagttcgtcatcatcgacgacggctggcagtccgtcggcacggaccagcccagccccagccccgacgaacacgccggagaggccacgcagccgcgcctgccccggctcaccggtatcagggagaacagcaagttccagaacgccgacgacccggccgccggcatcaaggcggtggtgcgcgcagcgaaggaggagtacgggctcaagtacgtcttcgtctggcacgccatcatcggctactggggcggcgtccgtccgggcgccgccgggatggagcgctaccgctccagcatgcagttccccaagatctcgccgggcgtcgccgagaacgaccccggcatgaggaccgactggatcaccgcccagggggtcggcctggtgcccccccgcgccgtgtaccggttctacgacgagcagcacgcgtacctcgccgccgccggcgttgacggcgtcaaggtggacgagcagtgcatcctggagacgctcggcgccggccacggcggccgcgcgcagctcaccaggcagtaccaccaggcgctcgacgcgtccgtcgccaagaacttccccgagaacggcatcatcgcgtgcatgagccacaacaccgacgccctatactgctcgaagcagacggcggtggtgagggcgtctgatgatttcttcccgagggaccccgtctcgcacacgatccacatcgccgcggtggcgtacaacagcgtgttcctcggcgagttcatgctcccggactgggacatgttccactccctccacccggccggcgagtaccacggctcggcccgggcgatcagcggcggccccgtctatgtcagtgatgcccccgggaagcacgacttcgagctgctgaagaagatcgtcttgccggacggctcggtgctccgcgcgcgcctgcctggccggccgaccaaggactgcctgttcaccgacccggcacgcgacggcgtcagcttgctcaagatatggaacatgaacaagttcaccggcgtgctgggcgtgtacaactgccagggcgcggcgtggagcttcgtggagaagaagaccacgttccaccgcaccggcgccggcgccctgacctgcggcgtcaaaggcagcgacgtccacctcatctccgacgccgcgacggacccggatcagtggagcggcgactgcgccgtgtaccgccacggcagcggtgacctcgccgtcctccccgacggcgcggcgctgcccgtctccctcaaggtcctcgagcaagacatcctcaccgtgtcgccgatcaaggacctggcacccgggttcaggttcgccccggtcgggctggtcggcatgttcaacggcggcgcggcggtggaaggcctgacctaccacctcctcgacgggggcaagcttgtcggcgacggcggctctgctgcttgcaggtcagaggaggccgtcggattggtgtgcatggaagtgcgggggcgtggcagattcggcgcctactcttctgtcaggccgaggaggtgcatgctgggctcggctgagatcgagttctcctacgtcccttcgtccgggctgctgactctgctgctggaggagatgcccggggagagggttcacaagattgtcgtcgagttgtagacttgcggtgcggtagcatcacaaatccagagcacccgcttttttgtttttttggcccttgccgaaagaatttcacaaatagacccagaaggaaatgttttccgtttccgaaaaaaaaaaaaaaaaaaa

SEQ ID NO: 4592 - protein, 767 aa, Panicum virgatum
  misc_feature: Ceres CLONE 1806608
  misc_feature (1)..(726): Pfam Name: Raffinose_syn Pfam Description: Raffinose synthase or seed imbibition protein Sip1
MTITSSVKLAGGTLSVCGRTVLSGVPAAVAASSASAAGAVDGVFIGADLAEPASHHVISLGTLRGVRFMACFRSKLWWMSQRMGDKGGDVPHETQFLLVESTGAGGKDAAAAAYVVFLPLVEGAFRASLQGGAGEALELCVESGDDDTRAASIERALFVGAAESDPFAAVAGAVAAARSALKTFRVRAEKKLPGIVDYFGWCTWDAFYQDVTQEGVEAGLRSLVTGGAPPKFVIIDDGWQSVGTDQPSPSPDEHAGEATQPRLPRLTGIRENSKFQNADDPAAGIKAVVRAAKEEYGLKYVFVWHAIIGYWGGVRPGAAGMERYRSSMQFPKISPGVAENDPGMRTDWITAQGVGLVPPRAVYRFYDEQHAYLAAAGVDGVKVDEQCILETLGAGHGGRAQLTRQYHQALDASVAKNFPENGIIACMSHNTDALYCSKQTAVVRASDDFFPRDPVSHTIHIAAVAYNSVFLGEFMLPDWDMFHSLHPAGEYHGSARAISGGPVYVSDAPGKHDFELLKKIVLPDGSVLRARLPGRPTKDCLFTDPARDGVSLLKIWNMNKFTGVLGVYNCQGAAWSFVEKKTTFHRTGAGALTCGVKGSDVHLISDAATDPDQWSGDCAVYRHGSGDLAVLPDGAALPVSLKVLEQDILTVSPIKDLAPGFRFAPVGLVGMFNGGAAVEGLTYHLLDGGKLVGDGGSAACRSEEAVGLVCMEVRGRGRFGAYSSVRPRRCMLGSAEIEFSYVPSSGLLTLLLEEMPGERVHKIVVEL

SEQ ID NO: 4593 - DNA, 1081 bp, Panicum virgatum
  misc_feature: Ceres CLONE 1806611
  misc_feature: Encodes the peptide sequence at SEQ ID NO. 4594
agagctggacggccgactaatgcagggtgccaaggccgcacctgggaagggtgcaataatcaagaaccaaaaaagaaccttgtgtttctggcttgccagacttgtcaaaacattgaagaactcccgtgattgcctgtagtctgtcgtcgttgtggtttttgtgtcccaatccagagcgccctcggttgctcgtggtggtggctgttttaatgtagcggtgctgttgacctatcttgctcatgaattaaaaaggatcctggttatgtaaaaaaaaaaaaaaaaaaaaaaaaaaaagagagagcgggctgagcagcggcccgccggagatcgatcaaaccctagctagggtttgaggcgccgggcggcggcgggggagatgtcgacgccggcgaggaagcggttgatgcgggacttcaagcgcctgcagcaggacccgcccgccgggatcagcggcgcgccgcacgacaacaacatcatgctctggaacgccgtcatattcgggccggatgatacgccgtgggacggaggaacgttcaagctttccttgcaatttacagaagattatccgaacaagccaccaactgttcggtttgtctctaggatgtttcacccaaatatatatgcagatggaagcatctgcttggatatcctacagaaccagtggagtcctatatatgacgtagctgccatattgacttctattcagtccctgctctgtgatccaaacccaaactctccagcaaactccgaagctgccagactgttcagtgagaacaagcgggagtacaatcgcaaagtccgcgagatcgtggagcagagctggacggccgactaatgcagggtgccaaggccgcacctgggaagggtgcaataatcaagaaccaaaaaagaaccttgtgtttctggcttgccagacttgtcaaaacattgaagaactcccgtgattgcctgtagtctgtcgtcgttgtggtttttgtgtcccaatccagagcgccctcggttgctcgtggtggtggctgttttaatgtagcggtgctgttgacctatcttgctcatgaattaaaaaggatcctggttatgt

SEQ ID NO: 4594 - protein, 152 aa, Panicum virgatum
  misc_feature: Ceres CLONE 1806611
  misc_feature (1)..(152): SWISSPROT Homolog: EC 6.3.2.19 Ubiquitin-conjugating enzyme E2-17 kDa
  misc_feature (1)..(152): SWISSPROT Homolog: EC 6.3.2.19 Ubiquitin-conjugating enzyme E2-17 kDa 2
MSTPARKRLMRDFKRLQQDPPAGISGAPHDNNIMLWNAVIFGPDDTPWDGGTFKLSLQFTEDYPNKPPTVRFVSRMFHPNIYADGSICLDILQNQWSPIYDVAAILTSIQSLLCDPNPNSPANSEAARLFSENKREYNRKVREIVEQSWTAD

SEQ ID NO: 4595 - DNA, 2026 bp, Panicum virgatum
  misc_feature: Ceres CLONE 1806643
  misc_feature: Encodes the peptide sequence at SEQ ID NO. 4596
gctgacttcgcttcagcaagtcagagaagcaagaggggaagcgaagatccgatctccccccgcccttcccctccccccaaatccacaccatccgggccgcggccgcgccatgccgccctccgccgacgccatgtcggcccccggggacgccgccgccgccgccgccgccgacgtgcgcatgatctcctccaaggagctccgcgcgcacgcgtcccccgacgacctctggatctccatctccggcgacgtctacgacgtcacgccgtggctgccccaccaccccggcggggacctcccgctcgtcaccctcgcggggcaggacgccaccgacgccttcgccgcctaccacccgccctccgcgcgcccgctcctccgccgcttcctcgtcggccgcctctccgactacaccgtctccccggcctccgccgacttccgccgcctcctcgcgcagctctcctccgcgggcctcttcgaccgcgtcggccccacccccaaggtccagctcgccatcatggccacgctcttctgcgccgcgctctacctcgtcctcgcctgcgccgccgcctccgcgcacctcctcgccggcggcctcatcggcttcatctggatccagtccagctatatgggccacgactcgggccaccaccgcatcacaggccacccgctcctcgaccgcgtcctccaggtcctctccggcaactgcctcaccggcctcagcatcgcctggtggaaatacaaccacaacacgcaccacatcgcctgcaacagcctcgaccacgacccggacctccagcacatgccgctcttcgccgtctccccaaagctcttcggcaacatctggtcctacttctaccgccgcactctcgccttcgacgccgcatccaaattcttcatcagctaccagcactggaccttctaccccgtcatgtgcgtcgccaggataaatcttctcacccagtccgccctcttcgtcctcaccgagaagagggtgctgcagcggttcgtcgagattgccggggtagccgcattctgggcctggtacccgttgctggtgtcctgcctgcccaattggtgggagagagtagcgttcgtactttccagcttcgcaatctgcgggattcagcacgtccaattctgcctcaaccatttctcgtcggaggtgtatgtcggaccgccaaaggggaatgactggttcgagaagcagacggcgggcacgctcgacatcctgtgctccccgtggatggattggttccatggcggcctgcaatttcagattgagcaccatctctttccccgcctacctcggtgccaacttcggaaggtcgcgcccgctgtgcgtgatctttgcaagaagcatgggctgccgtattctgcagcctcattctgggacgcaaatgtgcttacatggaagacactgagggctgctgcattgcaggctaggaacaccacaagtggtgccacgccgaagaatttggtctgggaggctgtgaacacccatggataagtgggaggaggattggagtttgaggcaactggtggtgttgactcttgtatgcatgcaagtatttgattatttctcagttgtttagagagattgatcgttacccgctggagtcgggtcggaattttttgtgttggccagtgactgtctgtcaatccagtggaagggtgagttcatccttcaattgtctggttgttcaccagttgttctgttctccctatcatggtaactatattatattccttgcattagattatgaagctccttttaagatcatgcccattcgattttgcttgcactgtcaagattgtgggtagcctacctcaacttgtttgggacaaaaggctatgttgttgttgttgtcgttgtcaagattgtgggtgtttgatgttcatgaatctgtaagcttattgaacggcgggtaacattgtgtggtactcctgtattttctcggttgctatggcagcttgaaactagtatgtatatggcaaaaatcgattcatccaaaaaaaaaaaaaaaaaaaa

SEQ ID NO: 4596 - protein, 464 aa, Panicum virgatum
  misc_feature: Ceres CLONE 1806643
  misc_feature (1)..(254): Pfam Name: FA_desaturase Pfam Description: Fatty acid desaturase
MPPSADAMSAPGDAAAAAAADVRMISSKELRAHASPDDLWISISGDVYDVTPWLPHHPGGDLPLVTLAGQDATDAFAAYHPPSARPLLRRFLVGRLSDYTVSPASADFRRLLAQLSSAGLFDRVGPTPKVQLAIMATLFCAALYLVLACAAASAHLLAGGLIGFIWIQSSYMGHDSGHHRITGHPLLDRVLQVLSGNCLTGLSIAWWKYNHNTHHIACNSLDHDPDLQHMPLFAVSPKLFGNIWSYFYRRTLAFDAASKFFISYQHWTFYPVMCVARINLLTQSALFVLTEKRVLQRFVEIAGVAAFWAWYPLLVSCLPNWWERVAFVLSSFAICGIQHVQFCLNHFSSEVYVGPPKGNDWFEKQTAGTLDILCSPWMDWFHGGLQFQIEHHLFPRLPRCQLRKVAPAVRDLCKKHGLPYSAASFWDANVLTWKTLRAAALQARNTTSGATPKNLVWEAVNTHG

SEQ ID NO: 4597 - DNA, 2419 bp, Panicum virgatum
  misc_feature: Ceres CLONE 1806653
  misc_feature: Encodes the peptide sequence at SEQ ID NO. 4598
atcccgtctaccgccacctccacctgcacctccacccccgccccacgtgctgccgcactgaaccccgcaccccagcggccgccgccgccgtacccaccgacccgccccgttcccttacccgatgtccaccccatcggctccgccgccctgcccgcacctcgccgcgcaccgcctgtcctcgcgcccgctgcgcttcctccgccgctgcctccgcgtgcgcccgctcggccgccccgagatccggcgggacccgcgcgagctcccgcgctgctcgccctgcgccgccgcgtccccctccccctccccgcgcctctacgcctgcctctcctgcgccgccgtcttctgcccctcccacgccgcctcgcacgcctccgcctccgcgggccccggccaccagatcgccgtcgacgtcgaccgcgccgagctcttctgcgccgcctgcggggaccaggtctacgatcccgatttcgaccacgccgtcttcctcgcccaatcctcctccctcctcccctccacctcctccacctcgccctccccggcaccacgcaagcgccggcgcgtggattaccgcgcatgggcgccagatccggccgaattcgcgctcatgagctccgcggaccccaccacctccgcgtccgccgccgcgccggccgggctgcgcgggttcaacaacctcggcaacacctgcttcatgaactccgtgctccaggcgctcctccacgcgcccccgctccggaactacttcctcggcgatcggcacaaccggttcctctgcccgcgccgcacgcccgtcagacaccgtgccacggaggccgacgccgccaaggtcgcgtgcctcgcgtgcgatctcgacgagatctactccgcggcattctccggcgagcgcatgccatacagccccgccaagtttctatatagttggtggcagcatgcatcaaacctcgcaagctacgagcaacaggatgcacatgaattttttatctccatccttgaccatatccatgaaaatataaaggatgatcagcacaagtcacatgcccaaggccatggggactgttgcattgcccacagagtattttctggtatcctgaggtcagatgtcacctgcacaagctgtgggttcacatccacaacttttgagccctgtatggacatttccttggacctggatattggagataacactccttttggtgttgcaaacacaaagccacatgtgcgcaatggggaacggggcttggctggcatgaattccaaggtatcaactctaatgagatgtttggagcggtttacaagggctgagagacttgatgctgagcaaaaattcttctgtgaacgctgcgatgagaggcaagagtccctgaagcaaatgtccattcgcaggcttccattagtttcctgctttcacataaagagatttgagcactcggcggtgaaaaaggtgtcaaggaaagttgatcactgtttgcagttccccttttcccttgacatggcaccttacctatcttcatctattcttagaagtagatatggaaaccgtatatttccagcagaagctagtgatgcagatgcagtttcagaattgtcatcagaattcgagatatttgcagtgatcacacatagtggtaaactagaagctggccattatgtgacatatctgaggttaaacaatcactggtataaatgtgatgatgcctgggtaacgagagttgaggagcatactgtcagaacttctcaggcatacatgctcttttatgtgcagaagacgctatattacaaagcttgtgaaagagcagctgcagtctgatctgaagcaaacactgatggcactactccacaacgtcaggagaagttgccattgaatcagatacacatttagtcggtcaagaggaaaaaagtcatggtattggtaaaaaaatgcatggtattttgacagcacagccatcgagacagatgatggtcaaattttcattctcattgagcaatagttccagtcagagggaaccttttttttttggcgattttctttacagccagttgcccaaagggaagatggtcgaatttatgcattgtattatcatataatcctgattgatggatatcttgtggtggctgccacaaaactgtaagtgcgtcattatttgatatcattgatgatgaggatgctcaaaccaatcatgctggtaggcttgagcaaggagaggagtggaaactgtagaaacataacgaaaaggggaaccgaatttttgatgcgttcctttcagtaattgcattttcgctctactgatggtagagttttcttgctggtgctggccgttctgtgtattgtccctttcttgttttacttggttcatgtgcttaatggatgagctgaaatatgcagctgtcatagttcctacaaaaaaaaaaaaaaaaaaaa

SEQ ID NO: 4598 - protein, 561 aa, Panicum virgatum
  misc_feature: Ceres CLONE 1806653
  misc_feature: Great-hit functional homolog of the protein sequence given in SEQ ID NO 9599
  misc_feature (1)..(354): Pfam Name: UCH Pfam Description: Ubiquitin carboxyl-terminal hydrolase
  misc_feature: Useful for making plants with altered alkaloid content
MSTPSAPPPCPHLAAHRLSSRPLRFLRRCLRVRPLGRPEIRRDPRELPRCSPCAAASPSPSPRLYACLSCAAVFCPSHAASHASASAGPGHQIAVDVDRAELFCAACGDQVYDPDFDHAVFLAQSSSLLPSTSSTSPSPAPRKRRRVDYRAWAPDPAEFALMSSADPTTSASAAAPAGLRGFNNLGNTCFMNSVLQALLHAPPLRNYFLGDRHNRFLCPRRTPVRHRATEADAAKVACLACDLDEIYSAAFSGERMPYSPAKFLYSWWQHASNLASYEQQDAHEFFISILDHIHENIKDDQHKSHAQGHGDCCIAHRVFSGILRSDVTCTSCGFTSTTFEPCMDISLDLDIGDNTPFGVANTKPHVRNGERGLAGMNSKVSTLMRCLERFTRAERLDAEQKFFCERCDERQESLKQMSIRRLPLVSCFHIKRFEHSAVKKVSRKVDHCLQFPFSLDMAPYLSSSILRSRYGNRIFPAEASDADAVSELSSEFEIFAVITHSGKLEAGHYVTYLRLNNHWYKCDDAWVTRVEEHTVRTSQAYMLFYVQKTLYYKACERAAAV

SEQ ID NO: 4599 - DNA, 2285 bp, Panicum virgatum
  misc_feature: Ceres CLONE 1806689
  misc_feature: Encodes the peptide sequence at SEQ ID NO. 4600
cgcaacccaccgccaggaaggctcgcggctccccgtcgaccccgagcgtccggccgcgcggcccctccatgcgccgctgatcgcgcgcgcgagcgatcaagccagctaccccaggggaaggatcggagcgcgggcggcgcagctcacctcagctctgccgccgccggccggccggcagctaggtagctagcagccatgtacgcggcgaaccactggggcgggtcgttcgagatcgccgacggggcggcggaggacgaccacagccgcaacatggacctggaccgcggcgcgctgtcgcggcagcagcaccacgagctggacgagacgcagcagagctggctgctcggcccgccggaggccaagaagaaggacaagtacgtcgacctcggctgcgtcatcgtcaagcgcaagctcctgtggtgggccttctggtgcgtcgtcggcgccttcgtcctcatcggcctccccatcatcatcgccaagtccatcccccacaagaagcacggcccgccgccgcccgaccagtacaccgaggcgctccacaaggcgctccgcttcttcaacgcccagaaatccggccggcttccgaagaacaacggcgtcccgtggcgcgggaactccggcctgtcggacggctccgacgccaaggatgtcaagggcggcctcgtcggcggctactacgacgccggcgacaacatcaagttccacttcccgatggccttctccatgacgatgctcagctggtcggtgatcgagtacagcgccaagtacaaggccgtgggggagtatgaccatgtcagggagctcatcaagtggggcactgactacctgctcctcaccttcaactcttctgcttccaccgtcgacaagatctacgctcaggtgggagctgcaaagatcaacggcagccagccggacgaccactactgctggaaccggccggaggacatgtcgtaccgccgccccaccatcgccgtgagctccgcccccgacctcggcggcgagatcgccgccgccctggccgccgcctccatcgtattccgcgacaacgccgcctactccaagaagctgacccatggcgcggccaccgtgtacaagttcgcgcggcaggcggggcaccgcaccccctactccctccggcagccggacatcgagtactactacaactcgacgagctactgggacgagttcatgtggagcgccgcctggatgtactacgcgacgggcaacacgagctacatcagcttcgccaccgacccgcggctgcccaagaacgccaaggccttcctcaacatcctcgacttctcggtgttcagctgggacaacaagctcccgggcgcccagctgctgctgtcgcggctgcgcatgttcctcaaccccggctacccctacgaggagtcgctcatcggctaccacaacgccaccagcctcaacatgtgcatgtacttcccgcggttcgccgccttcaacttcaccaagggaggcatggcgctcttcaaccacggcaaggggcagccgctgcagtacgtcgtcgccaactccttcctcgcctcgctctacgccgactacatggaggccgccaacgtccccggctggtactgcggccccaacttcatgtccaccaacgacctccgcgccttcgcgaagtcccagctcaactacattctcggcgacaacccgaggaagatgagctacgtggtggggttcggcaagaagtacccgcggcacctgcaccaccggggcgcgtcgacgccgcacaacggcgtcaagtactcgtgcaccggcgggtacaagtggcgcgacagcaagaaggcggacccgaacctgctcacgggcgccatggtcggcgggcccgaccggaacgacaggttcaaggactcgcgcaacacctacggccagaacgagccgacgctcgtgggcaacgccggcctcgtggcggcgctggtggccatcaccgacagcggcaggggggtcggcgtcaccgccgtcgacaagaacaccatgttctccgccgtgccgcccatgttccccaccgcgccgccgccgccgtcctcgtggaagccgtgagggccggagagcgagcagctggtggtggttcgtttgctcatacgatttttggtgatcacgtacgctattcttttgtacaataccaggttaacttgtaagaaaaacgctgtggacggtggcatgcatcatgcgtggcctgtagatgttttatgcataatcgattacggttaatgaatggaaaaaaatatacatcttctcaaaaaaaaaaaaaaaaaaaa

SEQ ID NO: 4600 - protein, 623 aa, Panicum virgatum
  misc_feature: Ceres CLONE 1806689
  misc_feature: Great-hit functional homolog of the protein sequence encoded by LOCUS At5g49720
  misc_feature (2)..(479): Pfam Name: Glyco_hydro_9 Pfam Description: Glycosyl hydrolase family 9
  misc_feature (1)..(623): SWISSPROT Homolog: EC 3.2.1.4 Endoglucanase 10
  misc_feature (1)..(623): SWISSPROT Homolog: EC 3.2.1.4 Endoglucanase 12
  misc_feature: Useful for making plants with altered cell wall content and/or composition
MYAANHWGGSFEIADGAAEDDHSRNMDLDRGALSRQQHHELDETQQSWLLGPPEAKKKDKYVDLGCVIVKRKLLWWAFWCVVGAFVLIGLPIIIAKSIPHKKHGPPPPDQYTEALHKALRFFNAQKSGRLPKNNGVPWRGNSGLSDGSDAKDVKGGLVGGYYDAGDNIKFHFPMAFSMTMLSWSVIEYSAKYKAVGEYDHVRELIKWGTDYLLLTFNSSASTVDKIYAQVGAAKINGSQPDDHYCWNRPEDMSYRRPTIAVSSAPDLGGEIAAALAAASIVFRDNAAYSKKLTHGAATVYKFARQAGHRTPYSLRQPDIEYYYNSTSYWDEFMWSAAWMYYATGNTSYISFATDPRLPKNAKAFLNILDFSVFSWDNKLPGAQLLLSRLRMFLNPGYPYEESLIGYHNATSLNMCMYFPRFAAFNFTKGGMALFNHGKGQPLQYVVANSFLASLYADYMEAANVPGWYCGPNFMSTNDLRAFAKSQLNYILGDNPRKMSYVVGFGKKYPRHLHHRGASTPHNGVKYSCTGGYKWRDSKKADPNLLTGAMVGGPDRNDRFKDSRNTYGQNEPTLVGNAGLVAALVAITDSGRGVGVTAVDKNTMFSAVPPMFPTAPPPPSSWKP

SEQ ID NO: 4601 - DNA, 3723 bp, Panicum virgatum
  misc_feature: Ceres CLONE 1806716
  misc_feature: Encodes the peptide sequence at SEQ ID NO. 4602
cttttcccttgccggtttctttctcctctccctccaacgcgcctcccccctcactccctcgactagcggcgaggcgacgacagggcgagtggcgccctcctcgcgcggttcttcgcggggcgcttcgccggcgacgggcatccggcagggggtccatcatggttaggaagaagagaactggccctggagagagttctggggaggctcctggagcgcctggacagggctcctcacagcgacctgagacaactccacagcatgggggaggacgtggtttactgcctcaacaaggtgcccgtggtggagggcaacaccaggcccgtggtggatatcagggccgtggagggccacctgagtctcaaccgcgcgactaccaggggcgtggtgggtatcagggccgtggaggcccaccttcacaacatcctggtgggccacttgatgctcaactgcgtgattaccagggccgtggtggataccagggccgtggagtcccaccttcacaacatcctggtggtggaccacctgagtatcaatcgcaggagtaccagggacgtggtggtccacgccccagagggggagtgcctcagccacactacggcgggcgtgggggaggtagtgttggaccaagtgttcctccaggtccatcgagatcagttcccgagctgcaccaagccccatatgtccaatatcaaccccctgtggtggtatcaccatccccaccggcagctggctcttcctcgcagcctacggaggctgtggtgagcactggacaagtccagcaacagtttcagcaacttgctattcgtggtgagagttcaaccaaccaagccattcagatggcaccagcatcaagcaaatcagttaaattcccattgcgccctggcaagggtacttatggctccaggtgcatcgtgaaggcaaatcatttctttgctgagctgcctgataaagaccttcaccactacgatgtttctattacgcctgaggttacttcacgtggcgtcaatcgtgctgtcatgggacagcttgtaactctttatagacagtctcatttggatgggcgtctacctgcatatgatggaaggaagagcctttatacagcgggaccattgccatttacatctagggcatttgaaattactctgcaagatgagggggctagtcttggtggaggccaaaggcgcgaaagggtatttaaggtggtgatcaaatttgctgcccgcgctgatctccaccatctggctatgtttctagctgggaggcaaccagatgctcctcaagaggctcttcaagtacttgacattgtactacgtgaattgcctactgccaggtattgtcctgttggtagatcattttattctcccaacttagggagacgccagcaacttggtgagggtttggaaacttggcggggtttctaccaaagcataaggcccacacagatgggtctttctctaaatattgatatgtcctctactgcatttattgagcccctccatgttattgatttcgttgctcagcttcttaacagagatatctcagttagaccgttatctgattctgatcgtgtgaagattaaaaaagctctacgaggtgtaaaagtcgaagtcacacaccgagggaacatgcgaaggaaatatcgtatctctggcctcacttcacaggcaacaagggagttatcattccctattgatgatcgtggtactgtgaagactgtggtgcaatacttcctggagacttatggcttcagtattcagcacacttctttgccttgcttgcaagtgggcaatcaacaaagaccaaattatctgcctatggaggtctgtaagatagttgagggacagcgttactcaaaacgactcaatgagaagcagatcactgctctactgaaagtgacttgccagcgtcctcaagagcgtgagaaagacatcctgcagactgtgcatcacaatgcatactttgaagatccatatgcacaagaatttggcataaggattgatgagcgtcttgcatccgttgaagctcgtgttctgcctcccccaaggctgaaataccatgacagtggcagagagaaggatgttttgccaagagtcggacagtggaacatgatgaataagaaaatggtcaatggcggtagagttagcagctgggcatgcattaacttctcacgcaatgtgcaagataatgctgccaggagtttctgtcatgagctggctcagatgtgccaagtatctggaatggacttcgcacttcaacctgtgctaccaccatcgactgcgaggcctgaacatgttgaaagagcactaaagggatgctatcaagatgccacgaacatactcagacctcagggccgagaacttgacctgctgattgtaatactgcccgacaataatggctcactttatggggatctcaaaaggatctgtgagactgatcttggcttggtctcccaatgttgtctaactaaacatgttttcaaggcgaacaaacagcagtatcttgcaaatgttgcccttaaaataaatgttaaggttgggggaaggaatactgtgcttgtagatgctttggcaaggagaattccccttgtcagtgacagaccaaccattatatttggtgctgatgttacccatccccatcctggagaagattctagtccttccattgcagctgtggttgcttctcaagactggccggaggtcaccaagtatgcaggattagtgagtgcccaagcccatcgccaagagttgatccaggatcttttcaaagtatggcaagatccccaaagagggactgtcactggtggcatggtcagggaacttctcatttctttcaggaggtcaacaggacagaagccccagaggatcatattctacagggatggtgttagcgaggggcagttctatcaagttttgttatatgagcttgatgccattagaaaggcctgcgcatcgttggagcccaactaccagcctccagttacttttgtagtggtccagaagcgtcatcacactagattgtttgctaacaaccacaatgatcagcgttctgttgatagaagtggaaacatactgcctggcactgtggtggattcaaagatttgccatcccactgagtttgatttctacctgtgtagccatgctggcattcagggaacaagccgccccgcacattatcatgttctgtgggatgagaataagtttacggctgatgggttacaatctctcaccaacaatttgtgctacacgtatgctaggtgcacacgctcagtatcagttgtgcctcctgcatactatgctcatttggcagccttccgagctcgcttttacatggagccagatacctctgacagtgggtcgatggtaagcggtgccggagcgagccgtgtccctccacctgggagttctcgcagctccagggctgttgggactgctgctgtgaggcctctacctgccctcaaggaaaacgtgaagcgtgtcatgttttactgctaagatggatgctgagctgctgctttgagcgagcagtatccacctaccttgcctacctggcgttttatttcgagtgcttgcactcttatggtgatgctggggtacttttatgcaccttcaaagttaatttgcgaatttctggtacctttttatactattgtactctgaagattggtttgtactggacttatttagacctggtttgtagtggaattaaaaaaaaaaaaaaaaaaaa

SEQ ID NO: 4602 - protein, 1110 aa, Panicum virgatum
  misc_feature: Ceres CLONE 1806716
  misc_feature: The sequence is a functional homolog of  SEQ ID NO 2086 in the  10/374,780 US patent application
  misc_feature: Useful for making plants with modulated growth and phenotype characteristics
MVRKKRTGPGESSGEAPGAPGQGSSQRPETTPQHGGGRGLLPQQGARGGGQHQARGGYQGRGGPPESQPRDYQGRGGYQGRGGPPSQHPGGPLDAQLRDYQGRGGYQGRGVPPSQHPGGGPPEYQSQEYQGRGGPRPRGGVPQPHYGGRGGGSVGPSVPPGPSRSVPELHQAPYVQYQPPVVVSPSPPAAGSSSQPTEAVVSTGQVQQQFQQLAIRGESSTNQAIQMAPASSKSVKFPLRPGKGTYGSRCIVKANHFFAELPDKDLHHYDVSITPEVTSRGVNRAVMGQLVTLYRQSHLDGRLPAYDGRKSLYTAGPLPFTSRAFEITLQDEGASLGGGQRRERVFKVVIKFAARADLHHLAMFLAGRQPDAPQEALQVLDIVLRELPTARYCPVGRSFYSPNLGRRQQLGEGLETWRGFYQSIRPTQMGLSLNIDMSSTAFIEPLHVIDFVAQLLNRDISVRPLSDSDRVKIKKALRGVKVEVTHRGNMRRKYRISGLTSQATRELSFPIDDRGTVKTVVQYFLETYGFSIQHTSLPCLQVGNQQRPNYLPMEVCKIVEGQRYSKRLNEKQITALLKVTCQRPQEREKDILQTVHHNAYFEDPYAQEFGIRIDERLASVEARVLPPPRLKYHDSGREKDVLPRVGQWNMMNKKMVNGGRVSSWACINFSRNVQDNAARSFCHELAQMCQVSGMDFALQPVLPPSTARPEHVERALKGCYQDATNILRPQGRELDLLIVILPDNNGSLYGDLKRICETDLGLVSQCCLTKHVFKANKQQYLANVALKINVKVGGRNTVLVDALARRIPLVSDRPTIIFGADVTHPHPGEDSSPSIAAVVASQDWPEVTKYAGLVSAQAHRQELIQDLFKVWQDPQRGTVTGGMVRELLISFRRSTGQKPQRIIFYRDGVSEGQFYQVLLYELDAIRKACASLEPNYQPPVTFVVVQKRHHTRLFANNHNDQRSVDRSGNILPGTVVDSKICHPTEFDFYLCSHAGIQGTSRPAHYHVLWDENKFTADGLQSLTNNLCYTYARCTRSVSVVPPAYYAHLAAFRARFYMEPDTSDSGSMVSGAGASRVPPPGSSRSSRAVGTAAVRPLPALKENVKRVMFYC

SEQ ID NO: 4603 - DNA, 2268 bp, Panicum virgatum
  misc_feature: Ceres CLONE 1806748
  misc_feature: Encodes the peptide sequence at SEQ ID NO. 4604
gtggcgctcctcccggtcccggccgcctcctctcctctcttccctcgtctcgcggtcgcgcccagagccgagaggaggaacaggcagggagattccacgcgcccggcagttacgataccgcgccgcagattccctcgtcgctgctcccccaagccctcccgcaccagcagcgccgccgccctccgccgccggctctccagtccagtccaggataggaggcctctgactctctgagctgcacaccatctgagcgacgccatgggagaggtcgcagacatgtacacccaagacgggaccgtcgacatgaagggcaacccggccgtgaagaagggcaccggcaactggcgcgcctgcccttacatcctcgcgaacgagtgctgcgagaggctggcgtactacagcatgagcaccaacctggtgaactacatgaagacccgcctcggccaggggaactccgtcgccgccaacaacgtcaccaactggagcggaacgtgctacatcacgccactcatcggcgcattcttggctgacgcctacatggggagatactggaccatcgccagcttcatgatcatctacatcattggcctgacgctgctgacaatggcgtcgtcggtgaaggggctggtgccgtcgtgcgacggcagcgggacgtgccacccgacggagtcgcagtcggcggcggtgttcgtggcgctgtacctgatcgcgctgggcacgggcggcatcaagccctgcgtgtcgtccttcggcgccgaccagtttgacgagaacgacgagcgggagaacaagagcaagagctccttcttcaactggttctacttctccatcaacatcggcgcgctggtggcgtcgacggtgctggtgtacgtgcagacgcacgtcggctggggctggggctttggcatccccgccgtggtgatggccatcgccgtcgtgagcttcttcgtcggcacgccgctgtaccggcaccagcgccccgggggcagcccggtcacgcgcatcgcgcaggtgctcgtcgcgtccgcgcgcaagtggagcgtggccgtgcccgccgacaaggcgcagctgcacgagacgctggacaaggagtccggcatcgagggcagccgcaagctcgagcacacggaccagttccgctgcctcgacaaggcggccgtcgtgacggcccctgacggcgcggcggcggcggcgccgagcccgtggcggctgtgcacggtgacccaggtggaggagcttaagagcgtggtccggctgctgcccatctgggcgaccgggatcgtgttcgcgacggtgtacgggcagatgagcaccatgttcgtgctgcagggcaacacgctggaccagcgcatggggccccggttcagcatcccctcggcgacgctctccatggtggacaccatcagcgtcatcatctgggtgcccatctacgaccgcctcatcgtgcccgcggcgcgctccgtcacgggccgcccgcgcgggttcacgcagctgcagcgcatgggcatcggcctcgtcatctccatcttctccatggtcgccgcgggcgtgctcgacgtcgtgcggctgcgcgccgtggcgcggcacgggctgtatggcgacaaggacacggtgcccatctccatcttctggcagatcccgcagtacttcatcatcgggtgcgccgaggtgttcaccttcgtggggcagctcgagttcttctacgaccaggctcccgacgccatgaggagcctgtgctcggcgctgtcgctcaccaccgtggcgctgggcaactacctgagcacggtgctggtgaccatcgtgacgcgcatcaccaccaggcacggcaggctcgggtggatcccggacaacctcaaccgcggccacctcgactacttcttctggctgctcgccgtgctcagcctcctcaacttcctcgtctacctgctcatcgccaggtggtacaaatacaagaagacggcggaatacccggacgccaccaaaggggagcgcaaccaggaacactgatcaagcggtggtgcagggctacatacaggctgactggacggagaagaagaagaaaaccaagtgattaaattctctctgttcggttggcttccgatttgttcgtgggagttcgcgtgtttaaacgtactagttcactgtaggtgacaggggtcgaatggattgcttagtatgtcatgtgtcagtaatatgcgcaatgcttgatctcaaatatcagtagtatctataaaataagttcagctccaaaaaaaaaaaaaaaaaaaa

SEQ ID NO: 4604 - protein, 582 aa, Panicum virgatum
  misc_feature: Ceres CLONE 1806748
  misc_feature: Great-hit functional homolog of the protein sequence given in SEQ ID NO 9671
  misc_feature: Useful for making plants with altered carbon content
  misc_feature: Useful for making plants with altered nitrogen content
MGEVADMYTQDGTVDMKGNPAVKKGTGNWRACPYILANECCERLAYYSMSTNLVNYMKTRLGQGNSVAANNVTNWSGTCYITPLIGAFLADAYMGRYWTIASFMIIYIIGLTLLTMASSVKGLVPSCDGSGTCHPTESQSAAVFVALYLIALGTGGIKPCVSSFGADQFDENDERENKSKSSFFNWFYFSINIGALVASTVLVYVQTHVGWGWGFGIPAVVMAIAVVSFFVGTPLYRHQRPGGSPVTRIAQVLVASARKWSVAVPADKAQLHETLDKESGIEGSRKLEHTDQFRCLDKAAVVTAPDGAAAAAPSPWRLCTVTQVEELKSVVRLLPIWATGIVFATVYGQMSTMFVLQGNTLDQRMGPRFSIPSATLSMVDTISVIIWVPIYDRLIVPAARSVTGRPRGFTQLQRMGIGLVISIFSMVAAGVLDVVRLRAVARHGLYGDKDTVPISIFWQIPQYFIIGCAEVFTFVGQLEFFYDQAPDAMRSLCSALSLTTVALGNYLSTVLVTIVTRITTRHGRLGWIPDNLNRGHLDYFFWLLAVLSLLNFLVYLLIARWYKYKKTAEYPDATKGERNQEH

SEQ ID NO: 4605 - DNA, 2582 bp, Panicum virgatum
  misc_feature: Ceres CLONE 1806767
  misc_feature: Encodes the peptide sequence at SEQ ID NO. 4606
agcgggtgcggagttgcaagggagagaggtcaggactccgggggagcaggcgcagatggaatgaggaaccgggctctgctccgccgtcagcctgccgccgcgccgtcccggctccccggccgtcgatctccgcgccacggccgaccccagtggctgtcccccacgcccccttctccacggacaccttaccaccgcatggcgtgatccgatgatagcaacaagagcacgccttcccctctccctgacggcgtcgtccaccccgcacggcgcgcgcaccaagaagaggaggaaaggaagccatgtcccccaacctggacagcgccatcaagagccaggtgccggcgctgctcctgaggcgccttttcggcacgtcccggcgggatgaggcgaagcagctgtcgcgctctccggcgccggcgcctgtggggaggcgccgggtgttcgtgcagacggagaccggatgcgtgctcggcatggacctggaccgcggggacaacgcgcacaccgtcaagcgccggctgcagctcgcactcaacgtgcccaccggcgagacctccctcaccttcggcgaccgcgtcctggagaacgacctatccttcatacggcccgactcgccgctgctgctcacccggaacagcatcaaccggagctgctccaccccgtgtctctgccctgtctccaaggactttgagcaaaaagattgcagtggcctagttgagatgctcgggtgctccagcagctgtgaccgggtgaagcgccttgtcgacgacgtggtgactgccatcaggaacggtatggatcctgtccccattagcagtggccttggtggctcatactacttcaggaatgtctctggcgacagggttgccattgttaagccgacagatgaggagccttttgcaccgaacaatcccaagggctttgtcgggagggcgcttggtcagccaggactgaagaaatctgtgcgagtaggagagacaggattcagggaggttgcagcatacctgttggaccatgagaattttgccaatgtacctgccactgctctggtgaagattacacactccattttcaacataaactgtccagtaaatggtggaagtccggcaccagctcatgaccagaagcagcaagttaacagcaagattgcttcattccagcagttcatcgcccatgactttgacgccagtgaccatggcacatcaagcttccctgttgctgctgttcataggatcggcatactagatatccgaattttcaacaccgacaggcatgccggtaacgtgttggtgaggaagctcaatggtggcacaggtcgcttcggatgccagacagagctgttcccaattgatcatggtatgtgcttgccagagaatctggaggacccttacttcgagtggatacattgggcacatgcatcgattccattttctgaggaagagctcgagtacatcagaaatcttgatccagggaaggatgtgatgatgctgcgcagagaacttccaatgatacgtgaggcctgcttacgtgtcctagtcctatgcacaatcttccttaaggaggctgcagcattaggactttgcttggcagagataggtgagatgatgacacgggagttcagagggatggaggaggaaccaagccagctagaggttgtgtgtatggaggccaggaagagagtagcagagtgggagccattctctgctacagctgcacaagaggatgatgctgatttccagttctcaatggatatgttaggagaatacaatgatgtaattcgttcgccaaggttcaatggctcaggtttcaaagggtctagtttcagaagtcctctgtctaagctcgttgagagtgttgaagagggaaatgatggccatgaagatcaaaatgagtctgatgaagttttttatactggatggaatacacccaatgttcctagcaaagttataggtcagaatggcaatgctacaaaaagtgccatgaacaggagtgcggatgaacaacttccatcaagtatgtgttttgtgaagctgtcagatatgagtgcagatgagtggaatgtcttccttcaaaagttccaggaactgctgaaagaagcactgcacgagcgcgcaagggcagcagcaggtcaaagaatgaagcagcggctgggcacttcatgcaagttttgagtagggcaatagaacatccgaggagaaaaatatgtactactacttgtactgcttgcgtatggagtgagtacagtgtgaagatatcataatatgaagcaccttcaaccttgtacaaagatctaggttacaactgtgttatcgccataaattaacaggttaattaatgggccgcgagtgagttgggcttcatgaagaaattaaaagaggcttacgaatcggctcctgcgtgagcgtttgggtcatgtgggccatgtatctttagatttagttcagtttgagctagagatagagtccgatatggacacgttagtttagattgttgtccaagtctccggactataaatatgtactctatgatatttgtcaaagaagaacgtcatcacgttttgcgaaaaaaaaaaaaaaaaaaaa

SEQ ID NO: 4606 - protein, 623 aa, Panicum virgatum
  misc_feature: Ceres CLONE 1806767
  misc_feature (1)..(264): Pfam Name: PI3_PI4_kinase Pfam Description: Phosphatidylinositol 3- and 4-kinase
MSPNLDSAIKSQVPALLLRRLFGTSRRDEAKQLSRSPAPAPVGRRRVFVQTETGCVLGMDLDRGDNAHTVKRRLQLALNVPTGETSLTFGDRVLENDLSFIRPDSPLLLTRNSINRSCSTPCLCPVSKDFEQKDCSGLVEMLGCSSSCDRVKRLVDDVVTAIRNGMDPVPISSGLGGSYYFRNVSGDRVAIVKPTDEEPFAPNNPKGFVGRALGQPGLKKSVRVGETGFREVAAYLLDHENFANVPATALVKITHSIFNINCPVNGGSPAPAHDQKQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAHASIPFSEEELEYIRNLDPGKDVMMLRRELPMIREACLRVLVLCTIFLKEAAALGLCLAEIGEMMTREFRGMEEEPSQLEVVCMEARKRVAEWEPFSATAAQEDDADFQFSMDMLGEYNDVIRSPRFNGSGFKGSSFRSPLSKLVESVEEGNDGHEDQNESDEVFYTGWNTPNVPSKVIGQNGNATKSAMNRSADEQLPSSMCFVKLSDMSADEWNVFLQKFQELLKEALHERARAAAGQRMKQRLGTSCKF

SEQ ID NO: 4607 - DNA, 2006 bp, Panicum virgatum
  misc_feature: Ceres CLONE 1806773
  misc_feature: Encodes the peptide sequence at SEQ ID NO. 4608
agaggccagagagagagagagagagaagggcgaggaagccttggaagctgcagcagagatccttccctctcccagtctccctcccacgcgccccgcgggctcgaggtagacgaaggcggagccgagctgccgaggtgtaatgcgtggttatggggctgcaaggggataaggcgacgcacgacttcctctcgctctacagcgccgccaaggactccgccctgccgctgctgccggaatccaagccgccgccgccgccgcccgctcatcaaggtttcttcctcaagacgcacgacttcctgcagccgctggagcggccgtcgtcgcagtcgccgccgccgtcgcgccccgccgcggagaagccgctccgccagcacgcgctgcccggcggcatcggcaccttcagcatcggccgcgccgccgcggcggaccagcccggcgccgccgtcaagcaggagcagccgcccttcgccgtctggggccagccggaccctcgaggtcacccgtggtctctccccttcgccgcgcgctgtgtcgccgtcgcctccgccaggccgcagccacagcagcagcagcagaggccgccggagcggaaggcgggaggtggcttcatggacgtcggctccagatccagcggtggggcgggcttcgacgacgacgacggcctcgccgctcgccgcgaggtctcctccacgctcaaagaactctcggtcagggtggagaccaaggggggaagctgcagcggcagcgctgggacggaccaactgcccaacacgccgcgctccaagcactccgccaccgagcagcgcaggcgcagcaagatcaacgacagatttcagatacttagagaaattttgccacaaaatgaccaaaagcgagacaaagcctcatttctcttagaggttatcgaatacataaggtttttgcaagagaaagtacaaaagtacgaggtttcgaacccagaatggaaccaagaaaatgcaaagatcgtgccatggtctaacatctacttccgatcgtcctggaaaaatttacagaacaaggacgaaataaatggagatatggcctctgatccatcgcaagttataaaaaatggtttgtccccacgattcccttttgctgcaaagcctgaggaccataacaatgcaggtgcatttgaaactgcttcgggtgcacaggaactggcagaaccaaagggttgtgtgcccttcaaaccggctgaaactcccagcaaaatcacaaacactgttgcatcccagcaaccaacacaattgacaaatccattgccttcagacgactgtgcagcacccaatggaatgttaagcaacccagaattggcaatagacgaggggacaatcagtttgtcaagccaatattcccaagggctgcttactacgctgaatcttgcccttcaaaactcgggtatagatttgtcacaagctagcatctcggtgcagataaaccttggtaagcgggctaccaagagatctgctcctgggtcaaactccacctccaagaatctcatcaaccaagcgtcccgtgatcaagagatcgggcaccagctgaggtcaggggatggcgcaagagaacattcccaggcgactaagcgccacaagtcagacagataacagctgattcctgctcattgcagaagcccggataatttgatccattttttgaggtccccctatcacaggggtgccttcatgtttcggtgtatattacgctcgcttcccgcgacggctagacagacaagaccatgctgcactgccgctgcattctttcattcgatcccgtcgccatctctagcgttaggctgcttcccgaacgcttccatcgcagattgtgaagctgcttctgtccataggcttccatccatatgacaagttcaggtcgtccccattctgacggacccctattgtaacatactactattctgatgatgctgaaattcatcgccactgtgcagacgcttcagagcgaagcatcaaaaaaaaaaaaaaaaaaaa

SEQ ID NO: 4608 - protein, 491 aa, Panicum virgatum
  misc_feature: Ceres CLONE 1806773
  misc_feature (1)..(51): Pfam Name: HLH Pfam Description: Helix-loop-helix DNA-binding domain
  misc_feature: The sequence is a functional homolog of  SEQ ID NO 532 in the  10/666,642 US patent application
  misc_feature: Useful for making plants with modulated growth and phenotype characteristics
MGLQGDKATHDFLSLYSAAKDSALPLLPESKPPPPPPAHQGFFLKTHDFLQPLERPSSQSPPPSRPAAEKPLRQHALPGGIGTFSIGRAAAADQPGAAVKQEQPPFAVWGQPDPRGHPWSLPFAARCVAVASARPQPQQQQQRPPERKAGGGFMDVGSRSSGGAGFDDDDGLAARREVSSTLKELSVRVETKGGSCSGSAGTDQLPNTPRSKHSATEQRRRSKINDRFQILREILPQNDQKRDKASFLLEVIEYIRFLQEKVQKYEVSNPEWNQENAKIVPWSNIYFRSSWKNLQNKDEINGDMASDPSQVIKNGLSPRFPFAAKPEDHNNAGAFETASGAQELAEPKGCVPFKPAETPSKITNTVASQQPTQLTNPLPSDDCAAPNGMLSNPELAIDEGTISLSSQYSQGLLTTLNLALQNSGIDLSQASISVQINLGKRATKRSAPGSNSTSKNLINQASRDQEIGHQLRSGDGAREHSQATKRHKSDR

SEQ ID NO: 4609 - DNA, 1865 bp, Panicum virgatum
  misc_feature: Ceres CLONE 1806839
  misc_feature: Encodes the peptide sequence at SEQ ID NO. 4610
acgccgaccatccccctcacctcgccgccaccgccgccctactcgggctccaccagcctaccgagtaccgaccttcccccgcgcccggtctcccttccgccctccccccatgtcttcttccgccgtggcgcgcgtgtggcggcgctctctccgcgacgtcctcctgcgcggcggcgcatccgcgcggccggccagcacggcctccgcgtccggcgcggcggcggaggccgcagccgcaccgaagaaggtgcccccgccaccccgcaagggaaggcttttaacaggggctctgataggtttggccattggtggaggtgcttatgtgagtaccgctgatgaagccaagttttgtggctggttattcaagtcgacagaactcgtgaatccactttttgcaatgctagatgcagagtttgctcatcgtttggctgttaaagctgctgcccacggatttgttccaagagaaaagagacctgatccgccagttcttgggctagaggtttggggaaggaagtttgccaatccaattgggcttgctgctggctttgataaaaatgctgaggcagttgaaggcctcttaggcatgggatttggctttgtggaagttggctctgtgacaccgcttcctcaagagggaaatcccaagcctcgaattttcagattaagggagcatggtgccgtaatcaatcgatgtggattcaatagtgaaggaatcgtagttgttgctaagcgtcttggggcacaacatggtaagcggaagatggaagaaacttcaagctccacgtctccctcaaccagcgacataaagcaaggagggaaagcaggacctggaatcttgggagtcaatcttgggaaaaacaagactagtgaagatgctgctgctgattatgtgcaaggggttcatacattgtcacaatatgctgattacttggtcataaatatttcttccccaaatactcctggtcttcgcaaattgcaaggtagaaaacaactgaaagatcttgttaagaaggtgcaagctgctcgggatgagatgcagtgggccgaagatggtcctccaccattgctcgtgaaaattgcaccagacttgtctaagcaggatcttgaggatattgctgcggttgctcttgctcttagactggatggtctgattatatcaaacaccacagtttccaggccaccacccgcagatacacatccattggctcaggagactggtggattaagtgggaagcctttatttgacttatctactaacattctcagggagatgtatatccttacacgcggaaagattcccctcataggctgtggtggtgtaagcagtggtgaggatgcatacaagaagatccgttctggagctactcttgttcaactttacactgctcttgcctatggtggtccagctcttatacctagaataaaggctgagctggcagaacgtttggacagagatggtttcaaatctgttcaggaagcaattggggcagatttcaggtgatcctagcagattactgagaagacctgaataaccattccgtcaagttcatataattcagttgagaagcaagcaacttttctgtaagcatgctcgccaatttcatttggccagtgcttgagaaggaacaccaagttgaaacttttttttgggtgagtggtactcattaacttgagtaatgggttgccattacgtgcttatacatggagctctttccctctgttcgagcaagttgtacaacagattttggttaaaatatgtgtatatttagtggtatcctttaaggtacatgttggtttgatgcatcaggagttcagaacagttttaaagttacacgatttctgaacaaaaaaaaaaaaaaaaaaaa

SEQ ID NO: 4610 - protein, 463 aa, Panicum virgatum
  misc_feature: Ceres CLONE 1806839
  misc_feature (1)..(321): Pfam Name: DHO_dh Pfam Description: Dihydroorotate dehydrogenase
  misc_feature (15)..(463): SWISSPROT Homolog: EC 1.3.3.1 Dihydroorotate dehydrogenase, mitochondrial precursor
MSSSAVARVWRRSLRDVLLRGGASARPASTASASGAAAEAAAAPKKVPPPPRKGRLLTGALIGLAIGGGAYVSTADEAKFCGWLFKSTELVNPLFAMLDAEFAHRLAVKAAAHGFVPREKRPDPPVLGLEVWGRKFANPIGLAAGFDKNAEAVEGLLGMGFGFVEVGSVTPLPQEGNPKPRIFRLREHGAVINRCGFNSEGIVVVAKRLGAQHGKRKMEETSSSTSPSTSDIKQGGKAGPGILGVNLGKNKTSEDAAADYVQGVHTLSQYADYLVINISSPNTPGLRKLQGRKQLKDLVKKVQAARDEMQWAEDGPPPLLVKIAPDLSKQDLEDIAAVALALRLDGLIISNTTVSRPPPADTHPLAQETGGLSGKPLFDLSTNILREMYILTRGKIPLIGCGGVSSGEDAYKKIRSGATLVQLYTALAYGGPALIPRIKAELAERLDRDGFKSVQEAIGADFR

SEQ ID NO: 4611 - DNA, 1211 bp, Panicum virgatum
  misc_feature: Ceres CLONE 1806842
  misc_feature: Encodes the peptide sequence at SEQ ID NO. 4612
aaaaagttgtgagcatccaccagcaccagggcgacgccgagacgcacatcctcttatcctctccgactctgtggtgctcgagctcgcggcgcacgatcatggtgggcgccatctccagtccggcgagcactagggtcgccgtggtcaccggcggcaacaaggggatcgggctggaggtgtgccggcagctcgccgtcgccggcgtcaccgtcgtcttgacggccagggacgaggcgaggggcgcggcggccgccgagaggctcagggagcaggggctccccgacgtccttctccatcaactggacatcaccgatgctccgagcatcgctcgactggctgatttcttgaagacccgtttcgggaagctggacatcctggtaaataatgcagcacttggtgcggttgagtatgttcatgactcggactatggatcagtaacgagcaaggaaaaggaaaagctcagtggcatggatattgatcagaggttgggatggttgtggcagaacagccgggagacttacgacactgcaaggaaaggtctgcagacaaactactacggcacaaagcaagtgatcgaagcctgtctgcctctgctcaaagcctcctccgatggaaggatcgttaatgtctcctcccacttcggtcagctaaggcttttcagaaacgaggagctaaagcgggagctaaacgacattgataatctcacgcaggagaggctggatgagctgctgggcatgttcctagaggacttcgaggccgacgcggtggattcgcgcggctggccgaagtacttctcggcgtacaaggtcgccaaggcggccatgaacgcctactcgaggatcctggcgagggagcaccccgagctgcgcgtcaactgcgagcaccctggctatgtcagaaccgacatgaccatacactcggggttgctgacacccgaggagggcgggagcagggtggtgacggcggcgctgctgccggagggcggcgtgaccggcgcgttctttgaagacttcgaggagtcgtctttcgtctaatgttggcccggcatgggtccttgcagctgcacctcgtctctattcttgccagatgtggtttagcattctgcattattcgctctttaacttcagggccgtatgggtcctttgattttgaaggaattaaaatctacttaataaactgactgtttgattcaaaaaaaaaaaaaaaaaaaa

SEQ ID NO: 4612 - protein, 311 aa, Panicum virgatum
  misc_feature: Ceres CLONE 1806842
  misc_feature (1)..(87): Pfam Name: adh_short Pfam Description: short chain dehydrogenase
  misc_feature (9)..(99): SWISSPROT Homolog: EC 1.1.1.184 Carbonyl reductase [NADPH] 1
MVGAISSPASTRVAVVTGGNKGIGLEVCRQLAVAGVTVVLTARDEARGAAAAERLREQGLPDVLLHQLDITDAPSIARLADFLKTRFGKLDILVNNAALGAVEYVHDSDYGSVTSKEKEKLSGMDIDQRLGWLWQNSRETYDTARKGLQTNYYGTKQVIEACLPLLKASSDGRIVNVSSHFGQLRLFRNEELKRELNDIDNLTQERLDELLGMFLEDFEADAVDSRGWPKYFSAYKVAKAAMNAYSRILAREHPELRVNCEHPGYVRTDMTIHSGLLTPEEGGSRVVTAALLPEGGVTGAFFEDFEESSFV

SEQ ID NO: 4613 - DNA, 1844 bp, Panicum virgatum
  misc_feature: Ceres CLONE 1806851
  misc_feature: Encodes the peptide sequence at SEQ ID NO. 4614
ctcgcacccacaagaatagctcaaacccgcgtgcatgtctgcatccccgggcggacacggcgcgcgccagaagcctcgcatcgccatcgcgcatacaaactggcaggccagacaccacaggacgagagacagagaggaaacctctgcttctccctctgacccactcctcgttcttctgagctcctgttgccttcctccgcacggagagcagacacgccgagagcgatcagggcagggaggggtctgctgcttacttcctgagctctgccgggccgggccatggcgggacggcggacggcgcccctgcgcctgtgcgcctccgtcgcgctgctcgtcgtcgccgtctcctctctgacgccttcgtcagatgcatacgatccactcgatccgaatgggaacataacaatcaagtgggatgtaatgcagtggactccagatggctatgtggctgttgtttccctatacaattaccagcagtaccgccacatccaagcgccgggctggaaactcggatgggtttgggcaaagaaggagataatctgggcaatgaccggtggccaagccactgagcaaggcgattgctccaaattcaaaagcaacattccccattgctgcaagaaggatcctgaggttgtggacctgcttcctggcacaccttataacatgcagatcgccaactgctgcaagggaggagtcctcaccgcatgggcacaggaccctgacaatgctgtggcttcgttccaagtcagtgttggtcaggctgggacgaccaacaagactgtgaaggtgcccaagaatttcactctgaaggctcccgggccagggtatacctgcggccctgccaaactagtgaaacctactaagttcatatcgccggatgggagaagatcaactcaagcacacatgacttggaatgtgacctgtacatactcacagtttgttgcccaaagatctccaacctgctgtgtttcgctttcatcgttttacaacgacaccattgtcaactgcccaacatgctcttgtggatgccagaataacagcactgcaccaggaagctgtgtagagggtaattcaccttatctggcctctgtcgtgaacgatcctaacaagaacagcttggcacctctagtccaatgcacttctcacatgtgcccaataagagtgcattggcatgtcaaagtgaactacaaggagtactggagggtcaagatcaccgtgacaaacttcaactaccggatgaactactcgcagtggaacctcgttgcgcagcaccccaacttcgacaacctgactaccattttcagcttcaactacaaatctctgaacccctatggcgtaataaacgacaccgcgatgttatggggcatcaagtactacaacgatctgctgatgacggctgggccggacgggaatgttcagtctgagcttctgttccggaaggagccctccaccttcaccttccagaaaggctgggctttcccaagacgagtgtacttcaatggcgacaactgcgtgatgccgccgccggacgcgtacccatggctgcccaacgcctctccacggcagtcagcttcggttctcctcacatttgttgctgtttgggcagcattggcgatcctactggccaatccctagtgatgtagtacatgtttcacagaaagttttgacctgattgcattggatgctattgccttctgatcattgagtttcttgcgatggtgttcaaatgtacagttacgtactcaaggatgtacattcccgtacttgtaaattttagcaaagactgactggcgagaaataaagctgtttcctcggcatcatgcaaaaaaaaaaaaaaaaaaaaa

SEQ ID NO: 4614 - protein, 451 aa, Panicum virgatum
  misc_feature: Ceres CLONE 1806851
  misc_feature: Great-hit functional homolog of the protein sequence given in SEQ ID NO 9631
  misc_feature (1)..(165): Pfam Name: Phytochel_synth Pfam Description: Phytochelatin synthetase-like conserved region
  misc_feature: Useful for making plants with altered Lignin content
  misc_feature: Useful for making plants with altered cell wall content and/or composition
MAGRRTAPLRLCASVALLVVAVSSLTPSSDAYDPLDPNGNITIKWDVMQWTPDGYVAVVSLYNYQQYRHIQAPGWKLGWVWAKKEIIWAMTGGQATEQGDCSKFKSNIPHCCKKDPEVVDLLPGTPYNMQIANCCKGGVLTAWAQDPDNAVASFQVSVGQAGTTNKTVKVPKNFTLKAPGPGYTCGPAKLVKPTKFISPDGRRSTQAHMTWNVTCTYSQFVAQRSPTCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKSLNPYGVINDTAMLWGIKYYNDLLMTAGPDGNVQSELLFRKEPSTFTFQKGWAFPRRVYFNGDNCVMPPPDAYPWLPNASPRQSASVLLTFVAVWAALAILLANP

SEQ ID NO: 4615 - DNA, 2085 bp, Panicum virgatum
  misc_feature: Ceres CLONE 1806855
  misc_feature: Encodes the peptide sequence at SEQ ID NO. 4616
tgacccgtgagccaaggagaccagctcacaaaaaactctcgcagatcagccaaggagaccagctcagcgcctgcggctctgcttctgcccccctcgcaaatccacacggtggacccgtgccgtgcgcggccgccggaggaaggagacgcgaagccacgccgcgcgtcgcgtcgcgctcgcttcacaaccgctcgcgaggcggcggccgcggtagcttcgccgctttcccacacctggtctggtctccgccgccgccgttgtcacagctgctcagcctcctgcacaaataccccgaacagcggttgcctcttcttcgtactccttcgacgtttcaacgcgggatcccactagaccgaccggggagccatggggggaagctcgtcgaggagcagcccacgggacgggagcagccacgggcgggggtacggccgctcgcgctcctttggccagccggcggggccgccgccgccgcagtatggaggctactactgccaggacccgagcgcgggctactacgccgcgccgcagcagggaggagggtacgccgccccgtacccggccccggcgtaccagccccccgccgctgccccggcgccgccggccgcgaagccgcggcagctggaccgccggtactcgcggattgccgacgattaccactcggtggatcaggttactgatgccctagctcaagctgggcttgaatcgtcgaatcttattgtcggcattgatttcacaaagagcaatgagtggacagggaaattctccttccatggacgtagtttacatcacattagcagctcaccaaatccttatgaacaagccatctcaattgtagggcagacactgtcaaaatttgatgaagacaatttgatcccatgctttggatttggagatgcatcaacacatgatcaagatgtcttctgtttttatcctgtcgagagaccatgcaatggtttctcagaagctctgcatcgatatagggaaattgtaccacatttgcgcttagctggaccaacatcctttgcaccaattattgagatggctatgaccattgtggagcaaagtggtggccaataccatgttctattgataattgccgatgggcaggttacgcggagtgtagatactgcatctggacagctaagttcgcaagagcagaagactgttgatgccattgtgaaggccagtgaactgcctttgtccatcgtgttagtaggagttggtgatggcccctgggacatgatgaaggaatttgatgacaacattcctgctcgagcttttgacaatttccaatttgtgaatttctcggagataatgtccaagaacatgccacaatcaaggaaagaggctgcatttgctctttctgcattgatggagataccacaacagtataaagcaaccgtggaattaggaattttaggtcgtcgctctttcaagtctcctgacagggttcctctgccgcctcctgctggaatcgatgatgcttattcctattcgtctaaaagctttagtaagccaaccacctacccacagagttcatcatcctcatcaccgtatcctcactacgaaaatccacatagcgccaccccagctgcgcctacgtccacttacgacaaccaggtctgccctatctgccttgtgaaccccaaagacatggcatttggctgtggacaccagacctgctgtgactgtggacagagtctccagtcgtgcccgatctgtcgcattcccatcaccacaaggataaagctatactagcaagtggtggtttggatcattgcaaaatgggtggtatactggagccaccctgcgtcacgccccgagaccgggacagcaccacccatttgcaatccgtccagtgaggcctctccaccatggaccaatttaggccgaggactgcagggccgctgatccagcgctccaagatggagcagggttgtcccagtattgatacccaccaggaatgatccgaacacagtgcaataggcagtgggtttcagaatttatcaagggctatttccaaagcaatggggaaaacacaaaatagaagaaagagggaaaatacaaaaaaaaaaaaaaaaaaaa

SEQ ID NO: 4616 - protein, 463 aa, Panicum virgatum
  misc_feature: Ceres CLONE 1806855
  misc_feature (1)..(33): Pfam Name: zf-C3HC4 Pfam Description: Zinc finger, C3HC4 type (RING finger)
MGGSSSRSSPRDGSSHGRGYGRSRSFGQPAGPPPPQYGGYYCQDPSAGYYAAPQQGGGYAAPYPAPAYQPPAAAPAPPAAKPRQLDRRYSRIADDYHSVDQVTDALAQAGLESSNLIVGIDFTKSNEWTGKFSFHGRSLHHISSSPNPYEQAISIVGQTLSKFDEDNLIPCFGFGDASTHDQDVFCFYPVERPCNGFSEALHRYREIVPHLRLAGPTSFAPIIEMAMTIVEQSGGQYHVLLIIADGQVTRSVDTASGQLSSQEQKTVDAIVKASELPLSIVLVGVGDGPWDMMKEFDDNIPARAFDNFQFVNFSEIMSKNMPQSRKEAAFALSALMEIPQQYKATVELGILGRRSFKSPDRVPLPPPAGIDDAYSYSSKSFSKPTTYPQSSSSSSPYPHYENPHSATPAAPTSTYDNQVCPICLVNPKDMAFGCGHQTCCDCGQSLQSCPICRIPITTRIKLY

SEQ ID NO: 4617 - DNA, 2590 bp, Panicum virgatum
  misc_feature: Ceres CLONE 1806857
  misc_feature: Encodes the peptide sequence at SEQ ID NO. 4618
acttgcaagttgcaacaccccggtcgtctcgggtcggcgtctccccactccgccgccgctccgctcgcccccatttcctccctcccgcctcctgctctcgcctccctcccagtcaaacccgctggcagcaagcgggttccggctcctcggctctgaaacctcgcgggcgcgctccaggactggagggttcagattgggggccgtttctccggcgttctgcggcagattggctattttgcatcatggagagtacagacaaggatgagaaaaatcttgttgtcactgaagagtgtactaatcctggagaaaattttgaagatgaaggggatttagcaaggaaaacagaaatattaaatgtagaagaatcaacaaattcttcaaatgtaggtttaagcaatgagtcagaagcacagatcgacgagggaggtaactcagaaaaggacttaaatggacagatgaatgaatgcgcaatttcagatgccatggaacctttacactcaaaccagatcacaaaagatattcttgcggaagacaaatctgaagagccagtgtttgatggtactgaggttcctgaaatggaagaaatgaggcgttcttccaatcagtctgcagaacttgactcagaagctcagatttctgtaatcaatgagcgggctgttgcaatcaagaattttgttaaagaaaagagtgccattgcagtttcgacatttatgcggcgcctttctggcaaaaaatatgagaatgagtttaaggttgaagttgacaagagtgatggttcagaatgcatcgacagcgagaagactgggtctgatgctgaacctaaacctaaagaggcgcagcagaaaactgatgaaaggactgcttggaatccactaaacttgattaaaattggacgagattttgatacttttataactggggaagcagggcctgaagatgcgccaaatttgtcggagcaatcgaaagcgaagggtaggattataatatacacaaaactggggtgtgaagattgcaaaatggttcgtctattcttgcatcagaaaaggctcaagtatgttgagatcaacattgacatcttccctagcagaaagttggagttggagaagaatactggatcatccactgtaccaaaagtttatttcaatgacctgctgattggaggattagttgagttgaagaagatggaagattctgacatacttgatgagaatatcagtgtacttttcaaagaagaaccctcatcttctgctcccttacctcccttacctggagaagatgatgaatctggaagtgggaagatggatgagctggcaaccattgtcagaaagatgagagagtcagtcattcctaaagatagattttataagatgagaagatttagtaactgctttcttggtagcgaagcggtggatttcttatcagaagatcagtatatggagagagatgaggcagtggaatttggaaggaagcttgcaagcaaatacttctttcgtcatgttctagatgaaaatgtctttgaagatggaaatcacttatatcgtttcctggatcatgaacccatagttatgactcagtgctacaacatccctaggggcattattgatgttgcaccgaagcccattgctgaagtggcatcaaggttgagattgttatcttatgccatttttgaagcttatgtatctgtggatggtagacatgttgactacagaagcatccagggctgtgaggaatttaaaaggtatattagaacaactgaggagctccaaagggtggatattgatgacctatcacgtgaagaaaagctagctttcttcataaatctctacaacatgatggctattcatgcactggtgacatgtggcgttcctgccggaccactggacaggagaaagttttttggagatttcaagtatgtcattggtggatgtgcttattcgctgtcagcaatccaaaacggtattctacgtggcaaccaaaggccaccatacaacattgccaaacctttcggacaaaaagaccaaagatccaaggtggcccttccataccatgaacctcttgttcactttgctttggtatgtggcaccaaatctggacctgcacttaggtgttactcgccaggagatattgataaagaattgatggaagctgcacgtgatttcctaaggaatggtggactgattgttgaccctgatgccaaagtcgcatctgcaagcaaggttttaaaatggtatagcacagattttggcaagaatgagacggaagttctgaagcatgccgcaaactatcttgagcccgcacagtcagagcagctcttggaacttcttgcgagcactcagctgaaagtcttgtaccaaccctacgactggagcataaacatctagatgcagcttgatgtgcatctgcatgttccggttacatttgcacacctgttgtgcaaagttccgtggtccggtgccgctcatgtacccacagttcccattctgaagccgggtgcacctctgacagaaccttcttatattggggcaaaatggatgagtaccaaatgacctgatatatgttgcgttggtgttaaaaaaaaaaaaaaaaaaaa

SEQ ID NO: 4618 - protein, 712 aa, Panicum virgatum
  misc_feature: Ceres CLONE 1806857
  misc_feature (1)..(60): Pfam Name: Glutaredoxin Pfam Description: Glutaredoxin
MESTDKDEKNLVVTEECTNPGENFEDEGDLARKTEILNVEESTNSSNVGLSNESEAQIDEGGNSEKDLNGQMNECAISDAMEPLHSNQITKDILAEDKSEEPVFDGTEVPEMEEMRRSSNQSAELDSEAQISVINERAVAIKNFVKEKSAIAVSTFMRRLSGKKYENEFKVEVDKSDGSECIDSEKTGSDAEPKPKEAQQKTDERTAWNPLNLIKIGRDFDTFITGEAGPEDAPNLSEQSKAKGRIIIYTKLGCEDCKMVRLFLHQKRLKYVEINIDIFPSRKLELEKNTGSSTVPKVYFNDLLIGGLVELKKMEDSDILDENISVLFKEEPSSSAPLPPLPGEDDESGSGKMDELATIVRKMRESVIPKDRFYKMRRFSNCFLGSEAVDFLSEDQYMERDEAVEFGRKLASKYFFRHVLDENVFEDGNHLYRFLDHEPIVMTQCYNIPRGIIDVAPKPIAEVASRLRLLSYAIFEAYVSVDGRHVDYRSIQGCEEFKRYIRTTEELQRVDIDDLSREEKLAFFINLYNMMAIHALVTCGVPAGPLDRRKFFGDFKYVIGGCAYSLSAIQNGILRGNQRPPYNIAKPFGQKDQRSKVALPYHEPLVHFALVCGTKSGPALRCYSPGDIDKELMEAARDFLRNGGLIVDPDAKVASASKVLKWYSTDFGKNETEVLKHAANYLEPAQSEQLLELLASTQLKVLYQPYDWSINI

SEQ ID NO: 4619 - DNA, 3082 bp, Panicum virgatum
  misc_feature: Ceres CLONE 1806868
  misc_feature: Encodes the peptide sequence at SEQ ID NO. 4620
actgcctctgcctgccttgctcttgctggcacatcacgttggcgagcaggcgaatcaatcgccggtgaccccgttccgcctcccctccgacgtggtcctccccgagggggcgaacgaggatgttctggcaaggggtcgcggaccggctgacggggaagaacaaggaggcgtggaacgaggggaagatccgcggcacggtggtgctggtcaagaaggaggtgctggacgccggggacttccacgcctcgctgctcgacggcgtccacaggatcctcggctgggacgagggcgtcgccctgcggctcgtcagcgccaccgccgccgaccccggcaatggaggccgggggaaggcggggaaggcggcgcacctggaggaggcggtgctgtcgctcaagtccaggacggacggggagacggtgttccgggtgaacttcgagtgggacgagtcgcagggcatcccgggcgccgtcctcgtcaggaacctgcagcacgccgagttcttcctcaagagggtcaccctcgagggcgtccccggcaagggcaccgtcgtcttcgtcgccaactcgtgggtctacccgcaccacctctacgcccaggaccgcatcttcttcgccaacgacacctatctgccaagcaaaatgcctgcagcattggtgccttatcggcaagatgaactcaagattctccgaggtgatgataatgctggaccatacaaggagcatgaccgtgtctaccgttatgaccactacaatgaccttggtgagccggacaaaggtgaagaccatgtacggccgatccttggtggcagccaagaacatccatatccccgtcgctgcagaactggcagggaccgagcgaaaacagacccaaattcagagagcaggctttttctgctcaacctgaacatctatgtcccgcgtgatgaacgctttggacatctcaagttctcagacttccttgggtactcactgaaggcagtcattgaggctgttcttccaacaatagggactttcattgatgatacgccgaaggagtttgattcattcgaagacatcctaggactctatgaacttggtccagaagcacccaaccatccagtagtagcagagatcaggaagaaaatccccagtcagttccttagaagtattctgccaaatggtagtcatgaccaccccctaaagatgccacttccaaatatcatcaaatcagatgtattgaaacaggctccagagtttaagtttggatggaggactgatgaggagtttgcaagagaaacacttgcaggcgtgaacccagtaatcatcaaacgccttacggagttccctgctaaaagtgccctggatccaagtcagtatggtgaccataccagcaagatcactgaagctcacattcagcataacctggaaggcttgacagtgcagaatgcactgaagaacaacaagctcttcatcctggaccaccatgatcatttcatgccgtaccttgaccgcatcaacaggttggagagcaacttcatctatgccagcaggacccttctgttcttgaaggacgatggcaccctgaagcccgtggccatcgagctgagcctgccccaccctgatggtcagcagcacggcgccgtcaacaaggtgtacaccccagctcacaccggcgttgagggccacatttggcagcttgccaaggcttacgccaccgtcaatgactctgcctggcatcagttgatcagccactggctgaatacgcacgcggtaatcgagccgtttgtgatcgcgacaaaccggcagctcagcgtggtgcaccccgtgcacaagctgctgagcccacactaccgtgacacgttgaacataaacgccctggcacgccagacactcatcaacgcccgtgggattttcgagctcaccgtgttccctgggaagtacgcgctggagatgtcctccgacgtgtacaagagctggaatttcaatgagcaggctctccccgccgatctcgtcaagagaggtatggccgtgccggaccagtcgagcccgtacggcgtgcgcctgctgatcaaggactacccgtacgccgtggacggtctggtgatctggtgggcgattgagcggtgggtcatggagtacctggacatctactaccctaacgacggcgagctccagcgcgacgtggagctgcaggcgtggtggaaggaggtgcgcgaggaggcgcacggcgacctcagggacagggactggtggcccaagatggacaccgtgcggcagctggccaggacctgcacgaccatcatctgggtggcgtcggcgctgcacgcggccgtcaacttcgggcagtacccgtacgccgggtacctcccaaaccggccgacggtgagccggcggccgatgccggagccgggcagcaaggagtatgcgcagctggaagcggggcaggaggaggccgacaaggtgtacatccgcaccatcaccagccagttccagagcatcctgggcatctcgctcatcgaggtcctctccaagcactcctccgacgaggtgtacctcggccagcgcgacgagccggagcgctggacgtcggacgccaaggcgctggacgcgttcaagaggttcggctcccggctggtggagatcgagaagcggatcaagtcgatgaacgacaacccggcgttcaagaaccggaaggggcctgtggacatgccctacatgctgctgtaccccaacacgtcagacgtcgacggcacgaagggcgagggtctcacggccatgggcatccccaacagtatctccatctgagactgagcagatgcgtctcaactctcgtgggatggtaggttgatgctgtgccgccgctacacgtttggccgtttgggcattgtgcgtagtgtgtttcttcgttggttttgtgatggtgtagtggtctagtgaagattgtaacaatgatttgttgggttgggcagaggagctgcagtgaggaatcagggcttgtttgtttccaagagactttttttagtctctatcacatcgaaaagaattttactattttgaagtatcaaataaaatatatttataaacaaaaaaaaaaaaaaaaaaaa

SEQ ID NO: 4620 - protein, 887 aa, Panicum virgatum
  misc_feature: Ceres CLONE 1806868
  misc_feature (53)..(669): Pfam Name: Lipoxygenase Pfam Description: Lipoxygenase
  misc_feature (19)..(887): SWISSPROT Homolog: EC 1.13.11.12 Lipoxygenase 1
  misc_feature (5)..(887): SWISSPROT Homolog: EC 1.13.11.12 Lipoxygenase 2
MFWQGVADRLTGKNKEAWNEGKIRGTVVLVKKEVLDAGDFHASLLDGVHRILGWDEGVALRLVSATAADPGNGGRGKAGKAAHLEEAVLSLKSRTDGETVFRVNFEWDESQGIPGAVLVRNLQHAEFFLKRVTLEGVPGKGTVVFVANSWVYPHHLYAQDRIFFANDTYLPSKMPAALVPYRQDELKILRGDDNAGPYKEHDRVYRYDHYNDLGEPDKGEDHVRPILGGSQEHPYPRRCRTGRDRAKTDPNSESRLFLLNLNIYVPRDERFGHLKFSDFLGYSLKAVIEAVLPTIGTFIDDTPKEFDSFEDILGLYELGPEAPNHPVVAEIRKKIPSQFLRSILPNGSHDHPLKMPLPNIIKSDVLKQAPEFKFGWRTDEEFARETLAGVNPVIIKRLTEFPAKSALDPSQYGDHTSKITEAHIQHNLEGLTVQNALKNNKLFILDHHDHFMPYLDRINRLESNFIYASRTLLFLKDDGTLKPVAIELSLPHPDGQQHGAVNKVYTPAHTGVEGHIWQLAKAYATVNDSAWHQLISHWLNTHAVIEPFVIATNRQLSVVHPVHKLLSPHYRDTLNINALARQTLINARGIFELTVFPGKYALEMSSDVYKSWNFNEQALPADLVKRGMAVPDQSSPYGVRLLIKDYPYAVDGLVIWWAIERWVMEYLDIYYPNDGELQRDVELQAWWKEVREEAHGDLRDRDWWPKMDTVRQLARTCTTIIWVASALHAAVNFGQYPYAGYLPNRPTVSRRPMPEPGSKEYAQLEAGQEEADKVYIRTITSQFQSILGISLIEVLSKHSSDEVYLGQRDEPERWTSDAKALDAFKRFGSRLVEIEKRIKSMNDNPAFKNRKGPVDMPYMLLYPNTSDVDGTKGEGLTAMGIPNSISI

SEQ ID NO: 4621 - DNA, 2191 bp, Panicum virgatum
  misc_feature: Ceres CLONE 1806942
  misc_feature: Encodes the peptide sequence at SEQ ID NO. 4622
acgcgccggagataattcgggcaaaagcatcgccgactgctacagctccactcctcctgtccgctggtacccaggatcactgacaccaccggcctgagcctccccgggaagaagccgccggcgcggggatggcgtccatctcgcggaatctccggcgatccttcgcccccgaccgcctgcgccgcctcctcctcctctcccagcacccgcgggagtacgtgacggcggagtgccaccgccccgtcgtcctccacaagcgcgggcccgacatcctccacgacccctggttcaaccggggtaccgcgttctcgatgacggagagggaccgcctcggcgtccgcggcctgctcccgcccaacgtcgtctcctcgcagcagcagatcgacagattcatgcttgatctgatacggctgcagacatatgcgagagatgggccatctgatacatatccattagcaaaatggcgcatcctaaacagattacatgacagaaatgaaacaatgtactacaaggtcctaataaataacattgaggagtatgcgccaattgtctacacaccaactgttggacttgtttgccaaaattacagtggtttgtttcgacggcctaggggaatgtattttagttcagaagatcgtggggagatgatgtctatggtgtacaactggccagcggatcaggttgacatgatagtggtgactgatggaagcaggattttgggcctcggtgatctgggggtgcaaggtattggcattgctattggaaaattggatttatatgttgctgctgctggaataaatcctcaaagggttcttcctgttatgatcgatgtcggaacaaacaatgagaagctccttaaggatcctctttatctcgggctacaagagcaccgtctcgagggagatgaatatgtctcagttattgatgaattcatggaagctgtttttactcgctggccaaatgttattgtacagtttgaggacttccaaagtaaatgggcctttaggctgttgcagcgttacagaaagacttatcgcatgtttaatgatgatgttcagggaactgctggtgttgcaatagctggccttttaggagctgtacgggcacaaggaaggccaatgatagatttcccaaagcaaaggattgttgttgctggtgctggcagtgctggtattggagtggtgaatgctgcaagcagaactatggcaagaatgttgggaaacaatgatgttgcttttgagagtgcgaggagccaattctggatagttgatgcccatggtctaataacagaagaccgtgcagacatcgacccagatgcacgaccttttgctaggagaaagggcgagcttggtcaccagggcctaagtgagggggcaagcttagtcgaagtggttaaaaaggtgaagcctgatgtcatacttggattatctgcagttggtggtctgttctcgaaggaggttctagaagcactaaaagattcatcctcttcgagaccagcaatttttgcaatgtcaaacccaactaagaacgctgagtgtacacctggagaagccttttcaattctgggtgaaaaggccatctttgctagtggaagcccattccatgacgtggatcttggtgatgggaagattggtcactccaatcaagggaataatatgtacctctttcctggaatagggctaggaacccttctgtctggtgctcgggttatctctgatggaatgctgcaggctgcagcagaacgtttggcttcgtacatgaaagaagaggaggttctccaagggataatttatcctcccatctccagaatacgtgacatcactaaggaggtggcggcggcagttgtgagggaagcagtagcagaggatctagctgagggataccgtgagatggatgcacgtgagcttgcgcgactcagtgaggaagaaactattgaatatgtcaagacaaacatgtggagccctgtctatccaacaataatatacaagaaagactagaggggtcaaaggcataccttcaggccttcattataggctccatttcctgacgcgttccattgagctggacatttttctatcttaaatgtcagttgtaccatcgctggaactccaattcatttttttctggactgttgatatgctgtgtatgtttgaacacagatcaagtaacaatacgacaggttttctttatt

SEQ ID NO: 4622 - protein, 622 aa, Panicum virgatum
  misc_feature: Ceres CLONE 1806942
  misc_feature (1)..(269): Pfam Name: Malic_M Pfam Description: Malic enzyme, NAD binding domain
  misc_feature (24)..(622): SWISSPROT Homolog: EC 1.1.1.39 NAD-dependent malic enzyme 62 kDa isoform, mitochondrial precursor
  misc_feature (5)..(621): SWISSPROT Homolog: EC 1.1.1.39 NAD-dependent malic enzyme 65 kDa isoform, mitochondrial precursor
MASISRNLRRSFAPDRLRRLLLLSQHPREYVTAECHRPVVLHKRGPDILHDPWFNRGTAFSMTERDRLGVRGLLPPNVVSSQQQIDRFMLDLIRLQTYARDGPSDTYPLAKWRILNRLHDRNETMYYKVLINNIEEYAPIVYTPTVGLVCQNYSGLFRRPRGMYFSSEDRGEMMSMVYNWPADQVDMIVVTDGSRILGLGDLGVQGIGIAIGKLDLYVAAAGINPQRVLPVMIDVGTNNEKLLKDPLYLGLQEHRLEGDEYVSVIDEFMEAVFTRWPNVIVQFEDFQSKWAFRLLQRYRKTYRMFNDDVQGTAGVAIAGLLGAVRAQGRPMIDFPKQRIVVAGAGSAGIGVVNAASRTMARMLGNNDVAFESARSQFWIVDAHGLITEDRADIDPDARPFARRKGELGHQGLSEGASLVEVVKKVKPDVILGLSAVGGLFSKEVLEALKDSSSSRPAIFAMSNPTKNAECTPGEAFSILGEKAIFASGSPFHDVDLGDGKIGHSNQGNNMYLFPGIGLGTLLSGARVISDGMLQAAAERLASYMKEEEVLQGIIYPPISRIRDITKEVAAAVVREAVAEDLAEGYREMDARELARLSEEETIEYVKTNMWSPVYPTIIYKKD

SEQ ID NO: 4623 - DNA, 1670 bp, Panicum virgatum
  misc_feature: Ceres CLONE 1806964
  misc_feature: Encodes the peptide sequence at SEQ ID NO. 4624
gccaacccagcgaaaccaacacacagaaagagagagcaagtagtcgggggcagtgcaactcatccagcgcacgcacagcccgtcgctccgttccaccgccgccgaactccgggcgatcctcctcccccttgtttctcccacccttcccctgccctccccttcctctccggatcgagccgagcccaggaggagagcgagacgatggtgtccgccgtgctgaggaccatcctggtgacgggcggcgccgggtacatcggcagccacaccgtgctgcagctgctccagcagggcttccgcgtcgtcgtcgtcgacaacctcgacaacgcctccgaggttgccctcctccgcgtcgccgagctcgccggccacaacggcagcaacctcgtcttccacaaggttgaccttcgcgacaggcacgcgctcgaggacatcttctcgtcccacaggtttgaggctgtgattcactttgctggcctcaaagctgttggcgagagcgtccagaagcccctgctgtactatgacaacaacctcatcggcaccatcacccttctcgaggtgatggccgcgcatggctgcaagaagctggtattctcgtcatccgcaactgtctatgggtggcccaaggaagtgccatgcaccgaggaattccccctttgcgccaccaacccctatgggcgaaccaagcttgtgattgaagatatctgccgtgacgtccatcgttcagaccctgattggaagatcatacttcttagatacttcaaccctgttggtgctcatcccagcggatacatcggtgaagacccctgcggaatcccaaacaacctgatgccctatgttcagcaagttgctgttgggaggagacctcacctgacagtttacggaacagactacaatacaaaggatggaactggagtgcgtgattacatccatgttgtcgacttggctgacgggcacattgcagcattgaggaagctctatgaggactccgacaaaataggctgtgaagtatacaatctgggcacaggaaaggggacatcagtgctggaaatggtggctgcgttcgagaaagtttctggcaagaaaattcctctggtgtttgctgggcgaagacctggagatgcggagattgtttatgccgcgacggccaaggctgagaaggagctcaaatggaaggcaaagtacgggattgaggagatgtgcagagacctgtggaactgggcaagcaagaatccctacgggtacgccgggtcaagcgaaaacggcaactgaggctgaattggagcagctggtagcaagccgcaattaaaaagaagtcgcggagtaccaccgcatgctactaatccaaggaaggacggatgatcgatggggcctcgtattctcatttgtacatagggagggagtagggggttcccatttgcccatccatccagcttattgttacccagggttaccgttatatatatggttattgttaggtctgtctagtattaatccatgcttatgattggttttttgctagatagacgagaaataagccccgtgccatgcctactgattatagagatatatagatacatatatgtacgtattgtgcctgctgcctccgccctgatcttgggatgacaattgagaatataaatgatttctttcaaaaaaaaaaaaaaaaaaaa

SEQ ID NO: 4624 - protein, 355 aa, Panicum virgatum
  misc_feature: Ceres CLONE 1806964
  misc_feature: Great-hit functional homolog of the protein sequence encoded by LOCUS At4g10960
  misc_feature: Great-hit functional homolog of the protein sequence encoded by LOCUS At4g23920
  misc_feature (1)..(265): Pfam Name: Epimerase Pfam Description: NAD dependent epimerase/dehydratase family
  misc_feature (7)..(355): SWISSPROT Homolog: EC 5.1.3.2 UDP-glucose 4-epimerase GEPI48
  misc_feature (9)..(349): SWISSPROT Homolog: EC 5.1.3.2 UDP-glucose 4-epimerase
  misc_feature: Useful for making plants with altered cell wall content and/or composition
MVSAVLRTILVTGGAGYIGSHTVLQLLQQGFRVVVVDNLDNASEVALLRVAELAGHNGSNLVFHKVDLRDRHALEDIFSSHRFEAVIHFAGLKAVGESVQKPLLYYDNNLIGTITLLEVMAAHGCKKLVFSSSATVYGWPKEVPCTEEFPLCATNPYGRTKLVIEDICRDVHRSDPDWKIILLRYFNPVGAHPSGYIGEDPCGIPNNLMPYVQQVAVGRRPHLTVYGTDYNTKDGTGVRDYIHVVDLADGHIAALRKLYEDSDKIGCEVYNLGTGKGTSVLEMVAAFEKVSGKKIPLVFAGRRPGDAEIVYAATAKAEKELKWKAKYGIEEMCRDLWNWASKNPYGYAGSSENGN

SEQ ID NO: 4625 - DNA, 1983 bp, Panicum virgatum
  misc_feature: Ceres CLONE 1806997
  misc_feature: Encodes the peptide sequence at SEQ ID NO. 4626
gaagcctcacaagtcacaaccaaaaccaacaaggccaaaacgacaagcgcatcactcgggacgctgcttaacgtacatgatagccatggcgaagaagccttccgccctccccaggtccttcctgtccctccgccgcctcctccggcgaagcatctcggggcggcactaccgccgcaccatgtcgtcggcgacggggattaaggcggctccagcacaagacaagctgaaagaccggacggtgctggtcgacgtggagggatggctcctgcgctcgccgctctccacctttccttacttcatgatcatcgccgtcgaggccggcagcttcctccgcggcctcctcctcctgctggtatacccggtcctgtgcctcctggccctcatcggccttgacctgcgcctcgaggccttggtcatggtgtccctcttcgggctgagggagagagaggtggccagggtttccaaggcggtgctacccaagttcttcctggaagacgtgaccatggagggcctcgaagcttttaagaaggcgggcaccgtcgttgcggtgaccacggcgctcccaagggtcatggtggagggcttcctcaaggagtacctcggcgtccatgccatcatcgggcgggaggtcgccgtggcagctggctgttacgttggtttcttggaggaggagcacgcgggcatggagagggttggagccttcctcgaggaaatggaggagacgaggagcaaaggtgatggagctgtgggacttcttggtgcagtcggcaggccggtgcaccacgtggtctcgcgctattgcaaggagacctatgtcataagcgaagccgacaagaaggcgtggcagccattgccgagggacaagtcccccaacaagttggtcttccacgacggccgcctcgccttcaggccgaccttcttcgcggcgctcgccatgtacacctacctccccttgggaatcttcctcgccgccttacgctgcctcgcatttggcgtgctaccctaccgcgtctctgtcccgctggccgcggccaccggcatgcgctcccgccttgtcgccggcccgtccccggacgccagcagagagaaaaacaaggtaggtgggcgcctctacgtctgcaaccaccgcaccctcctcgacccgatcacagtcgctgcaggcctgaacaagcccgtgacggcggtgacgtatagcgtgagcccggtctcagagctgctcgcacccatccgcacggcgcgacttacgcgggaccgggacgaggaccgccggcgcatggaggcgttgctggcgcgcggcgacctcgtggtgtgcccggaaggcacgacgtgccgcgagccctacctgctccggttcagccctctgttcgccgagctcaccggcgaggtgacccccgtcgctctcgacacccgcgtcgacatgttctacggcacgtccaccaagcccggggacaagtggcttgacccgttctacttcatgatgaactcgcagccggagtaccgcgtcgagtttctggagcgcgtggccaccgcccccgccgaaggcgaggctggcggacatggccacagtatccaagcggccaaccaggtgcagctcgtgcttggcgaggcactaggattcgagctcaccgggctcacgaggaaggacaagtacatgatgctggctgggaatgaaggtgtcgtgtcgggtggcgccaagaagtaggtgtgctgtttattacggcgggaacatgcaggttacgttgtgctgttactaatgcgtgattaagagtgtggtatattatttatttatttatttcctcctttcttcttaaacataggtcagtctgtctgtatatgtggacacacacacacacacacacacacacacacacacacacacacacaacacacacacacactttttagtttatgcgtgaaaattcttgtacatgttgaaaataaagaagaaaaaagattgcaaatacaaaaaaaaaaaaaaaaaaa

SEQ ID NO: 4626 - protein, 541 aa, Panicum virgatum
  misc_feature: Ceres CLONE 1806997
  misc_feature (1)..(112): Pfam Name: Acyltransferase Pfam Description: Acyltransferase
MIAMAKKPSALPRSFLSLRRLLRRSISGRHYRRTMSSATGIKAAPAQDKLKDRTVLVDVEGWLLRSPLSTFPYFMIIAVEAGSFLRGLLLLLVYPVLCLLALIGLDLRLEALVMVSLFGLREREVARVSKAVLPKFFLEDVTMEGLEAFKKAGTVVAVTTALPRVMVEGFLKEYLGVHAIIGREVAVAAGCYVGFLEEEHAGMERVGAFLEEMEETRSKGDGAVGLLGAVGRPVHHVVSRYCKETYVISEADKKAWQPLPRDKSPNKLVFHDGRLAFRPTFFAALAMYTYLPLGIFLAALRCLAFGVLPYRVSVPLAAATGMRSRLVAGPSPDASREKNKVGGRLYVCNHRTLLDPITVAAGLNKPVTAVTYSVSPVSELLAPIRTARLTRDRDEDRRRMEALLARGDLVVCPEGTTCREPYLLRFSPLFAELTGEVTPVALDTRVDMFYGTSTKPGDKWLDPFYFMMNSQPEYRVEFLERVATAPAEGEAGGHGHSIQAANQVQLVLGEALGFELTGLTRKDKYMMLAGNEGVVSGGAKK

SEQ ID NO: 4627 - DNA, 2731 bp, Panicum virgatum
  misc_feature: Ceres CLONE 1807042
  misc_feature: Encodes the peptide sequence at SEQ ID NO. 4628
gggggtagaaagcaagaaaagaaaagaaaaaatcggagttctccctcgcctcgtgtcctcttcctctccttccaatctcccctgctcgcgcgtgacctgggccgccgccgcttccctcccctccacacctcgcgctcccgcctcaaccgcgccgccaccgccgccgccgcctaatcctgcctccgcctccgcgcggcccggagccctcgttccccgcgggatcgtccggccgtcctcccacctccgcccgcgtgggctcttcttcgggatctcgtcggtccgggcggcgcgggggctagggattcaggcccatggcgtggcggcgcgtcctcacccagatcgcaaagcaccgacccacaaaagcaatctacaatgagctagttgcttcctcccctttgggcactcttagaagtgaagtcactgcaggtgcaagaattagaaacttacaagagaggaatcagtccagctatattggtagccttgcacgccgtgtgcgagacctagactcaccaagcgaaacttctctgcttaaagaaatttacagaagtgacccagaacgtgtcatacaaatatttgaaagtcaaccttcactccattccaatccagcagcactttcggagtatgtaaaagctctcgttagggttgataggttggatgagagcaccttgcttaaaacattgcagagaggtgttgctgcttctacaaggggggaagaaagctttggtagcattccagcattagttggtgctggccaagcgacaaaagatggagttcttggcactgcaaatgcacctattcatatggttacagcagaaacaggtcaatttaaagatcagctttggcgcaccttccgaagcattgcactaactttccttcttatttcgggcatcggggctctcatcgaggatagaggaatcagcaaaggtcttggtctgaacgaagaggttcaaccaagcatggagtctaatacgaagttcagtgatgtaaagggtgttgatgaagcaaaatctgaacttgaggaaattgttcattacctccgagatcccaagcgcttcacacgtcttggtggaaaacttccaaaaggtgtcttgcttgttggccctcctggcacagggaaaaccatgctagcgagggctattgctggtgaagctggtgtacctttcttttcatgcagtggaagtgagtttgaggagatgtttgtgggagttggagctcgaagagtgcgcgacctttttgctgcagcaaaaaagcgatctccttgtataatattcattgatgaaattgatgcaattggtgggagcaggaatccaaaggatcaacagtatatgaagatgaccttgaaccagttgcttgttgagttggatggctttaagcagaatgaggggataattgtcatcgctgcaaccaacttccctgagtcactagataaagccctagtcagacctgggcgttttgactgtcatattgttgttcccaatccggatgttgagggtcggcggcaaattctggagtcccatatgtcaaaggtcttgaagagtgatgatgtggacttgatgatcattgccaggggaacaccgggattctctggtgctgaccttgctaacttggtaaatgttgctgctcttaaggctgccatggatggtgcaaaggctgtcactatgactgatcttgagtatgcaaaggaccgaatcatgatgggtagtgagcgaaagtcagcggttatttctgatgaaagcagaaagttgacggcataccatgagggagggcatgctcttgttgccatccacacagaaggtgctcaccctgtccacaaagctaccatagtacccagggggatggccctaggaatggtgtcccagctacctgaaaaagacgagactagtgtgtcaaggaagcagatgctggcaaatttggatgtctgcatgggtggacgtgttgcggaggagctgatatttggggatactgaagtgacatctggtgcgtcatctgatttccagcaagcaactgcgacagcaagagcaatggttactaaatatggcatgagcaagcaggttggccttgtctcttacaactacgaagatgatggaaagagcttgagttcagaaacaagacttttaattgagcaggaggttaagaatttcttggagaatgcatacaataatgcaaagactattctcacgaaacacaataaggagctccatgctctagccaacgcacttcttgagcatgagactctcacaggagcccagataaagaacatattagcgcaggtaaataacaagcagcaacaggagcatgccattgaagcaccacagaagacccctgccgctccagcttccccagcatcaccagctgcagcagctgctgctgcagccgctgcagctgcacagcaggcggcagccaaagccaagggggtagctggtatcggatcttagcgcatggagcacccaccagtttgcattgtgtatatttcaccaacctagcaagctgttcctgcaattgacggtcaagaggatcatcaggagtatcctaaactgcagcagcaatagaacatactgattatgtgtaagccactgtttatgtgccttgagcgcaaaacaaaagacgaaaactctacacattgtagtaggcacatttagctggtgcttgaatcagttttgtacccacatcgaaaacaatttctgttgtttagaccccaataattgatagccaaaaaaaaaaaaaaaaaaaa

SEQ ID NO: 4628 - protein, 707 aa, Panicum virgatum
  misc_feature: Ceres CLONE 1807042
  misc_feature (1)..(202): Pfam Name: Peptidase_M41 Pfam Description: Peptidase family M41
MAWRRVLTQIAKHRPTKAIYNELVASSPLGTLRSEVTAGARIRNLQERNQSSYIGSLARRVRDLDSPSETSLLKEIYRSDPERVIQIFESQPSLHSNPAALSEYVKALVRVDRLDESTLLKTLQRGVAASTRGEESFGSIPALVGAGQATKDGVLGTANAPIHMVTAETGQFKDQLWRTFRSIALTFLLISGIGALIEDRGISKGLGLNEEVQPSMESNTKFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDCHIVVPNPDVEGRRQILESHMSKVLKSDDVDLMIIARGTPGFSGADLANLVNVAALKAAMDGAKAVTMTDLEYAKDRIMMGSERKSAVISDESRKLTAYHEGGHALVAIHTEGAHPVHKATIVPRGMALGMVSQLPEKDETSVSRKQMLANLDVCMGGRVAEELIFGDTEVTSGASSDFQQATATARAMVTKYGMSKQVGLVSYNYEDDGKSLSSETRLLIEQEVKNFLENAYNNAKTILTKHNKELHALANALLEHETLTGAQIKNILAQVNNKQQQEHAIEAPQKTPAAPASPASPAAAAAAAAAAAAQQAAAKAKGVAGIGS

SEQ ID NO: 4629 - DNA, 2012 bp, Panicum virgatum
  misc_feature: Ceres CLONE 1807048
  misc_feature: Encodes the peptide sequence at SEQ ID NO. 4630
atccaattgctcttccttccgccatctttttcttccccgaaccaagctctctgtttctcgccgatttcgtcgccctcgcgcgatcttggttcgattcctcgcacacacatcaccagcagccctatctcgaccgattcaaagagtttctagccctgccatcgaccacagccgctagctcgccatcgtcttcttcctctggccaccaacgagcattgaagctaggtcaccgaatcggaagtcgcggacgtcagcgtcgaatacatcgagctgccacccgagagacccgcaggaggagaagaggtgatcgtgatcgagcacgagctcgagctccaagccgaagtcccacctcccgaggctgatcaagcagcgccgtcggaggagcatcaggagtaaagcaccaagaatcggagagtatgttaagtccatacatctctgaatgttttataaactcgttgtaatatataaacttatggcaataatccctaggactgtaggtgtactccttaaaaactctgtagagttggtatgcatctctcaactctcctcagcgttgcggtgttcttccgggaagctctgctgcagcctgcaggtggggggtagccgtggaagctctgaggtggggggtggtggtgctggttgatgtcgatggcgcaggtgtgctgtgactcggcggcagccgcggcggcggcggtggttgtggttgggccggaggcggaggccagggcgagggcgcgcgccgagaggcggcgccgggcgggggaggccgggaggtggaagcacgcgccagcggcggcggcggcggccgggacggccgaggcggccacgaggaagcgacgcgtggaggccggggagctgctcgtggcgcggaagcacggggcggcctcggtggccggccgcaggagggagatggaggacgccgtgtccgtgcgcgaggccttcgccgccggtggcgccgggaggtgcgacttctacggggtgttcgacggccacggctgctcgcacgtcgccgaggcgtgccgggaccggatgcacgagctgctcgccgaggagctggccggcgagggcggccccgcgcagcgggagcccgcggcctggaccgccgcgatggagcggtgcttcgcgcggatggacgccgaggtcgcctccgccggcgggcgcgccgccgccagctgccggtgcgacgcgcacaagtgcgaccacgtgggctccaccgccgtggtggccgtggtggaggagcgccgggtggtggtggcccactgcggcgactcccgcgcggtgctctgccgcgggggcgacggcgcggcgcccgtcgcgctgtcctcggaccacaagcccgaccgggccgacgagcaggcgcgcatcgaggccgcgggcgggcgggtcatcttctgggagggcgcgcgcgtgctgggcgtcctggccatgtcccgcgccatcggggacgggtacctcaagccgtacgtgtgctcggtgcccgaggtgacggtggccgacctcgccgacggcgacgagtgcctgatcctggcgagcgacgggctctgggacgtggtcagcaacgaggccgcctgcgaggtggcgcgcgcctgcctccggaggggcagggagaagtggtgcgccgaggccgccgcgctgctcaccaagctggcgctcgccaggcgcagcgccgacaacgtctccgtcgtggtcgtcgatctccggcggaagaagcagtagctctttctttacctctcaaatggtggtagcactagtacagtgggatggatgatgcacaaagggttctcgctggggtggtagtggtaccgtgtagcagctagctagttagcaagtagtaattctactgattgttttttgttcttcttttcgctgttggaaatcattttttgggctgtatttctccctgaatcaaaaagttcagaggagcgcatgcatagattattattggtgtaaccggaattcgatccggataccatgtggaatgaaaatgaagttctcaaaaaaaaaaaaaaaaaaaa

SEQ ID NO: 4630 - protein, 357 aa, Panicum virgatum
  misc_feature: Ceres CLONE 1807048
  misc_feature (1)..(273): Pfam Name: PP2C Pfam Description: Protein phosphatase 2C
  misc_feature (77)..(356): SWISSPROT Homolog: EC 3.1.3.16 Protein phosphatase 2C
  misc_feature (78)..(314): SWISSPROT Homolog: EC 3.1.3.16 Protein phosphatase 2C ABI1
MSMAQVCCDSAAAAAAAVVVVGPEAEARARARAERRRRAGEAGRWKHAPAAAAAAGTAEAATRKRRVEAGELLVARKHGAASVAGRRREMEDAVSVREAFAAGGAGRCDFYGVFDGHGCSHVAEACRDRMHELLAEELAGEGGPAQREPAAWTAAMERCFARMDAEVASAGGRAAASCRCDAHKCDHVGSTAVVAVVEERRVVVAHCGDSRAVLCRGGDGAAPVALSSDHKPDRADEQARIEAAGGRVIFWEGARVLGVLAMSRAIGDGYLKPYVCSVPEVTVADLADGDECLILASDGLWDVVSNEAACEVARACLRRGREKWCAEAAALLTKLALARRSADNVSVVVVDLRRKKQ

SEQ ID NO: 4631 - DNA, 2100 bp, Panicum virgatum
  misc_feature: Ceres CLONE 1807060
  misc_feature: Encodes the peptide sequence at SEQ ID NO. 4632
aaaccgctctggacaggggacgccccgcacgccgccggcaaggcaaccaacttctttttcccctcgccgcccggaaccttccgctcccctcccgccacgcggcccgccgccatggacacgaccatcggctcggtccccgcggccgcggacgccaccccgcccgccccgtcggcgtcggccccgagggaggcgacgctgggccggcacctcgcgcggcggctcgccgaggtgggcgcccgcgacgtgttcgccgtgccgggggacttcaacctcacgctcctcgacgagctggaggccgagtcgggctccacgggggtgcgcctcgtgggctgctgcaacgagctcaacgcggcgtacgccgccgacgggtacgcccgggcgcgcggcggcggcgtcggcgcctgcgccgtcacgttcaccgtcggcgggctcagcgccatcaacgccgtcgcgggggccttcagcgagaacctccccgtcgtgtgcatcgtcgggggccccaacagcaacgactacgggagcaacaggatcctgcaccacaccatcggcctgccggatttcacgcaggagctcaggtgcttccagaacgtcacgtgctaccaggctgtggtgaacaacttggaagatgcacatgaacagattgacactgccatctctacagcaataaaggagagcaagcctgtttacattagcatcagttgcaacctcccttcaatcccgcatcccaccttcagccgtcatcctgtccctttcttcctctccccaaggctatcgaaccagatgaacctggaggcagcagtggaagccgcagcagcattcttgaacaaagctgtgaagccagtgcttgttggtggaccaaagatgagggtatccaaagcatgcaaagcctttgtagagctggcagatgcctgcggctatcccgttgcggtgatgccttctgcaaaggggcttgtgccagagcaccactcgaggtttatcggcacatactggggcgctgtgagcactccattctgtgctgagatcgttgagtctgccgatgcctatctatttgctggtcccatattcaacgactacagctcggttggatactcgctgctcctgaagaaggaaaaggccatcattgtccaaccagaacgggtggttattggacatggccctgcatttgggtgtgttctgatgaaggatttcctgcatgcacttgcaacccgtctgaagaagaatactgctgcatatgagaactattgtagaatttatgtgcctccaggcgagcctcatccatctgaacctggagagccattgagagtgaacatactcttcaagcatattcaggcaatgctgtctagcaactcggctatcattgcagagactggggattcgtggtttaactgccagaagctgaagctaccagaaggctgtgggtacgaatttcagatgcagtatggatcgattggctggtcagtgggtgcaactctaggatatgcacaggctgctaaggataagcgtgtcattgcatgcattggagatggcagctttcaggtgacggcacaagaagtgtcaacgatgctccgatgggggcataacagcatcatctttctgataaacaatggaggatacacaattgaggtggagatccatgatggtccttacaacattatcaagaattggaactacactggtttggtggaagcattccacaatggcgagggcaagtgctacacagcaaaggttcgaactgaggaggagctgaaggaggcattgaaggaagctctgggacctaagaaggactgcttatgctttatagaggtcatcgtgcacaaggatgacaccagcaaagagcttctcgagtggggatccagggtttctgcggcaaatagccgtccaccaaatcctcagtgagtacatcaggcatccgaaattgcgctggaaaccgatcctcatatgtccatatttagaagtcttggggagaagatgctgttgatctctgaataaactctccctgtaactgtaattcactgatgttgcaagtctcgtggttacttcacatatttcagaaattgatattgtatagttcattgctgccaaaaaaaaaaaaaaaaaaaa

SEQ ID NO: 4632 - protein, 594 aa, Panicum virgatum
  misc_feature: Ceres CLONE 1807060
  misc_feature (1)..(123): Pfam Name: TPP_enzyme_C Pfam Description: Thiamine pyrophosphate enzyme, C-terminal TPP binding domain
  misc_feature (1)..(180): Pfam Name: TPP_enzyme_N Pfam Description: Thiamine pyrophosphate enzyme, N-terminal TPP binding domain
  misc_feature (5)..(594): SWISSPROT Homolog: EC 4.1.1.1 Pyruvate decarboxylase isozyme 1
  misc_feature (9)..(594): SWISSPROT Homolog: EC 4.1.1.1 Pyruvate decarboxylase isozyme 2
MDTTIGSVPAAADATPPAPSASAPREATLGRHLARRLAEVGARDVFAVPGDFNLTLLDELEAESGSTGVRLVGCCNELNAAYAADGYARARGGGVGACAVTFTVGGLSAINAVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKACKAFVELADACGYPVAVMPSAKGLVPEHHSRFIGTYWGAVSTPFCAEIVESADAYLFAGPIFNDYSSVGYSLLLKKEKAIIVQPERVVIGHGPAFGCVLMKDFLHALATRLKKNTAAYENYCRIYVPPGEPHPSEPGEPLRVNILFKHIQAMLSSNSAIIAETGDSWFNCQKLKLPEGCGYEFQMQYGSIGWSVGATLGYAQAAKDKRVIACIGDGSFQVTAQEVSTMLRWGHNSIIFLINNGGYTIEVEIHDGPYNIIKNWNYTGLVEAFHNGEGKCYTAKVRTEEELKEALKEALGPKKDCLCFIEVIVHKDDTSKELLEWGSRVSAANSRPPNPQ

SEQ ID NO: 4633 - DNA, 2632 bp, Panicum virgatum
  misc_feature: Ceres CLONE 1807066
  misc_feature: Encodes the peptide sequence at SEQ ID NO. 4634
aaacgaactcgacgctaaacccccgccgccccacgccgcgcgcgcatgaaaccctagtgacccatccagatctccgcgtcccgggtcgccgcgccgccatggcgaccaccgcgctggacttcctcccggcgccgctccggtcgctgcggctcaagacgaagcagcaggagctcctgcttcgcgtctctgcgctggcgctcatctacgtgctcgccttcgccgtccgcctcttctccgtcctccgctacgagtccatgatccatgagttcgacccctacttcaactaccgcaccacgctcttcctctccgagaatggcttcagcgagttctggaactggttcgacttcgagagctggtacccgctcggacgcgtcgtgggcggaacactcttcccgggcctcatggtcaccgcggcgctgctccaccgcctcctccgcgcgctctccctcgccgtccacatccgcgaggtctgcgtcctcaccgcgcccttcttcgccgccaacaccacgctcgtcgcctacgcctttggccgcgagatctgggactccggggcggggctcgtcgccgccgcgctcatcgccatcgtcccggggtacatctcccgctccgtcgctggttcctacgacaacgaaggcgtcgccatcttcgcgctgctgctcacattctatctcttcgtgcgcgccgtcaacacgggatcgctcgcctgggcactcgcctcggcgttcgggtacttctacatggtgtcagcatggggaggctacgtgttcattatcaatctcgtcccgctttatgtgctcgtgctgcttgtcaccgggaggtactcgcagagactctatgtggcctacaattgcatgtatgtgcttgggatgctgcttgcgatgcagatccgcttcgttgggttccagcatgtgcagtctggggagcacatggccgctatgggagtcttcttcctattgcaggttttcttcttcttggattgggtgaaatacttgctgaatgatgcaagactattcaagtcattccttcgaattactcttacatgtgtgattactgttgggaccttggctcttggaattggtactgcatctggttacatctccccttggacggggcggttttactcccttcttgatcctacctatgcaaaagaccatataccaatcattgcgtctgtctctgagcatcagccaacagcatggtcatcattcatgtttgatttccacatcctccttttcctgtttccagctggcctctatttctgtttcaagcgcctgtcagatgccacaatatttattgttatgtatggcctcacgagtatgtactttgctggagtgatggttcgattaattcttgtggcagcaccagctgtctgccttatcagtgccattgctgcatctgctacaattaaaaatctgaccaccttgatccggacaaagagcaaaagtccccaggctacttctggaaaaacaactggctcaaaggcagctgcaaagggagcggttgatcaatctttgccattccaacataacgcagctattgttcttcttctgggtgctttttacttgctcagtaggtatgccatacactgcacttgggtgacatccgaggcctattcttctccatctatagttttggccgcaaggggtcataatggtggaagagtcatctttgatgattatcgtgaggcatactattggcttcgtcagaacactcctcctgatgccaagattatgtcttggtgggactatgggtaccaaattacagccatgggtaacagaactgttatcgttgacaacaacacatggaataacacacacatagctactgttgggcgtgcaatgtcttcttatgaagatgaagcatatgagattatgcagtcactggacgtgaattatgtgcttgttgtatttggaggtgttactggctattcttcagatgacattaataagttcttatggatggttcgtattggtggaggtgtttttcctgtaatcaaagagcccgattaccttgttaacggggaatatcgtgttgataagggtgcagcaccaaaaatgttgaactgcctaatgtacaagctttgttactatcgatttggagaacttaccacggaatatggaaaacctccaggatatgatcgtgttcgaggagtagagattggcaacaaagatataaagcttgaatacttggaggaggcatttacaacttcaaactggatagtgcgcatatacaaggtcaaaccccctaagaacaggtcctgaggtatcctcgttggtgaagtgtttggaaccttagacaagtacgttattgtcaatatctgagtggctacaggagatggggcagttgttctgatatttgcgacggaagcccctcaaaacatgggcgctgctttggcgagactgactgtagtaaccgtagtgtcagttctgctcaaagtcaagaaccatatttcccctcatttggtctagtgattggtgtcattcagaaggaccaattgtgacaacgagtacttttttattgttaagcttaagcatgtcatgaccgaacttcaaaagtttttgtaggcacaacacaatggcttatttgagtagtaacctggattgtctttgattaaaaaaaaaaaaaaaaaaaa

SEQ ID NO: 4634 - protein, 720 aa, Panicum virgatum
  misc_feature: Ceres CLONE 1807066
  misc_feature (1)..(646): Pfam Name: STT3 Pfam Description: Oligosaccharyl transferase STT3 subunit
  misc_feature (16)..(719): SWISSPROT Homolog: EC 2.4.1.119 Dolichyl- diphosphooligosaccharide-- protein glycosyltransferase subunit STT3A
MATTALDFLPAPLRSLRLKTKQQELLLRVSALALIYVLAFAVRLFSVLRYESMIHEFDPYFNYRTTLFLSENGFSEFWNWFDFESWYPLGRVVGGTLFPGLMVTAALLHRLLRALSLAVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSKSPQATSGKTTGSKAAAKGAVDQSLPFQHNAAIVLLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRVDKGAAPKMLNCLMYKLCYYRFGELTTEYGKPPGYDRVRGVEIGNKDIKLEYLEEAFTTSNWIVRIYKVKPPKNRS

SEQ ID NO: 4635 - DNA, 2095 bp, Panicum virgatum
  misc_feature: Ceres CLONE 1807075
  misc_feature: Encodes the peptide sequence at SEQ ID NO. 4636
attcgatcctcttcctcgcggtcgcggctcgcggctccctctcctcctcaagaccccaacccgtcgctgaggcgggtgcggccaccgatcgacgcgtcctccctgcttcctggttcccacccgttcactgtccccgccgctcgtcacggatccatcagggatttggatcgatttgcttaggttaaaatcaagtaatattttgttgggcggaaaatacaaggcctacaccagaaggaatacccttgtgcagcagacgaagagctgtctctctgtgtggttttgtttggtttatttctttgcagttgcagggggagaatctaaacattatattggagggacaaattcgtcttgttgctttttagtttatctgttgggcattaacctagttgaacggtgtgcagatttatataggttaaaaagtgatcagtttaccaggagcaagagttagccctgatgagtactgaagtagatcacagttattttggtctttctattcactttctcctgatatttaactttttgagtaagtttgcagattaggtcttaaaaagggattgggattaggatttcttggaagggcctgagctgtataattttccagtcatacagtgggctgcacagggttaatttacaggaatattacttgttggtgatcctaaaagaagcatatgttgtgagccctggtttgttttagctgcatgtgtacctttttgtctacttagtcttgcacactgacgacctttattgaggtattcctttatccccatggtttctagataaccaaaccatgaatgtataggcactctagttcatcttatattgaagatggttaatgatatgttttttgcttatgcttgcaggcactctgtcagccgcagagttgaatcatggcggagcacttggcttccatctttggcactgagaaggatagggtcaactgccctttctacttcaagattggggcttgccgtcatggggatcgctgttcccgtctgcacaacaggccaaccatatcaccgactcttgtgcttgctaacatgtatcagcgtcctgatatgataacccctggagtagatgctcaaggccaacctattgatcctgagaagatgcaggagcattttgaggacttctatgaggacatccatgaggagttgggcaagttcggtgagattgagaacctgaatgtctgcgacaaccttgctgaccacatgatagggaatgtctatgtccagttcagggaggaagaacaggcagctgcagcatgcaatgctcttcagggtcgcttttactctggccgcccaataattttggagtattctcctgtgactgacttccgtgaagcaacctgcaggcagtttgaggagaacagctgcaaccgtggtggctactgtaacttcatgcatgtgaaacaaattggcagggatctcaggaggaagctttatgggcattctgcttccaggaggtaccatgggaggagcagaagcagaagccccccacctcaaaggaggggtcatcgtgatcgtgatgactaccatcgtgaccgtgatgattaccgtcgtggcggcggcggcggtggcggcggcggacggggtagaggcagcagacatgacaggtatgatgatggagggggcagaggcggcaggccagacaggtatgatgatggaggaagacgcaggcggggtagcccacccccaaggcgtgggaggagcccagtcagggagagcagcgaggaacgcagggccaagattgagcagtggaaccgtgaacgggaggcaaagcagtgaggtctctgtgacaagtgtcttgagacgagcattgttcactgggttgtttagctcgtcgtttacccctatattctaagttaactggtgtttggtgatattctgcttggctaaacctttttaagtgcaggactcctcagtttatttggttaatcagacatgtaagcttcatttatttccatctgtgtttgcattgtatcatttgctagcttgctgttgaagctagcattggtgtgagtgtgagatcattattggtgttcgtgttatgtcagttgtgactttgtcattcgaaccaaaaaaaaaaaaaaaaaaaa

SEQ ID NO: 4636 - protein, 298 aa, Panicum virgatum
  misc_feature: Ceres CLONE 1807075
  misc_feature (1)..(27): Pfam Name: zf-CCCH Pfam Description: Zinc finger C-x8-C-x5-C-x3-H type (and similar)
MAEHLASIFGTEKDRVNCPFYFKIGACRHGDRCSRLHNRPTISPTLVLANMYQRPDMITPGVDAQGQPIDPEKMQEHFEDFYEDIHEELGKFGEIENLNVCDNLADHMIGNVYVQFREEEQAAAACNALQGRFYSGRPIILEYSPVTDFREATCRQFEENSCNRGGYCNFMHVKQIGRDLRRKLYGHSASRRYHGRSRSRSPPPQRRGHRDRDDYHRDRDDYRRGGGGGGGGGRGRGSRHDRYDDGGGRGGRPDRYDDGGRRRRGSPPPRRGRSPVRESSEERRAKIEQWNREREAKQ

SEQ ID NO: 4637 - DNA, 2112 bp, Panicum virgatum
  misc_feature: Ceres CLONE 1807076
  misc_feature: Encodes the peptide sequence at SEQ ID NO. 4638
acgatttgtttgctcccttctctctctcccgtcctcgtccctcgagccgcgcggcgatcgcatcgagccggagagaggggagaggcgcggccgcaaaaccctagagcagcgagggagggtggtcttcgcggaagcaggaggaccggaagagagagatgcagggcgccagccacatgctcctggaggagccggtgcgcctcgcctccgtgctcgccccagccaagcccaaagtgttcccgtccctcaccaagattgttgggacgctcgggcccaagtcgcactcggtagaggttattcagggatgcctcactgctggaatgtcagttgctcggttcgatttctcatggatggatgctgagtatcaccaggagacccttaacaatctgaggaaagcggcacagaatgtgaagaagttgtgccctgtaatgcttgatactctgggaccagaaattcaggttcacaattccactggtgggccaattgagttgaaagctgggaaccatgttatcataactccagatatatctaaagctctatctgctgagatcttaccaattaaatttggtgatctcgcaaaagacgtgaagaagggtgatactctttttatgggtcaatatctcttcacaggaagcgaaacaacgtctgtctggttagaggttgtggacacttccggtgaaaatgtgaattgtcttgtgaagaatacagctacacttgctggtcccattttcactctgcatgcttcacaagtccacatcagtttgccaacattgagtgaatatgataaacaagtcatttcaacttggtgttcccgtaacaacattgatattatttctctttcccatacccgctctgctgaggatgtaagggagcttaaatcctttttacaatcacatgatcttcctgagacacaaatatatgcgaagattgaaaattctgagggtttggatcatttcgatgaaattctcaaagaggctgatggcatcattctttctcgaggagacctgggaattgatcttccaccagaaaatgttttcatgttccagaagacagctattcataaatgcaatctagagggtaaacctgtgatcgtcactagagttgtggacagcatgattgacaatctacgccctacacgtgcagaggccactgatgttgcgaatgctgtgctagatggaactgatggtattctgctcggtgcggagacacttcgagagctctatcctgttgatgcagtgagtacagtgggcaggatatgtgcagaagctgagactgtgtataaccagccacttcaattcaagaaagtaatgtggcatgttggtgatccgatgccccatgaggaatctgtggcatcagcagcggttggttctgcgattaaagtaaaagctgctgcaattgtcgtattcacattctcagggagagctgctaggttaatttctaagtacaggccgacaatgccagttttagcagttatcttcccgcgtgaaggatccgatccatcaaagtggcgttcatatggaaccactcaggcaaggcaatgttttgcagtgagaggcgtgtaccctttgatggggagtactgatgaggccgaaactggtgggctcacaaaggaagagtatgggataaaactggcactgaactatggtcggtcagttggcatagtgaagcctttcgacagggtgataatctttgaaaagattggtgattcttctgttgtcaagatcattgagtgtgaaggttaaacattagatacccactacccatgctattggttcatgtgacgcatgggagattacctccagtttttctcacttatttgaccaaagataactggagagtacagcatgtgcacctgttgtctttttaggtgattttgcctcttttccaatttcaaatgttttgaaagttttggtccaataaaccaagattgtctcagagacctatatactggaattatggtttgatgaggaaacacaaacacattggattgttgacacaataccatgaattatttgttgctatcttgttctatttgacaaaacaagatgacactgtatataacatctgtaaagacagtctagaggtattatcagtcaaaaaaaaaaaaaaaaaaaa

SEQ ID NO: 4638 - protein, 527 aa, Panicum virgatum
  misc_feature: Ceres CLONE 1807076
  misc_feature (1)..(350): Pfam Name: PK Pfam Description: Pyruvate kinase, barrel domain
MQGASHMLLEEPVRLASVLAPAKPKVFPSLTKIVGTLGPKSHSVEVIQGCLTAGMSVARFDFSWMDAEYHQETLNNLRKAAQNVKKLCPVMLDTLGPEIQVHNSTGGPIELKAGNHVIITPDISKALSAEILPIKFGDLAKDVKKGDTLFMGQYLFTGSETTSVWLEVVDTSGENVNCLVKNTATLAGPIFTLHASQVHISLPTLSEYDKQVISTWCSRNNIDIISLSHTRSAEDVRELKSFLQSHDLPETQIYAKIENSEGLDHFDEILKEADGIILSRGDLGIDLPPENVFMFQKTAIHKCNLEGKPVIVTRVVDSMIDNLRPTRAEATDVANAVLDGTDGILLGAETLRELYPVDAVSTVGRICAEAETVYNQPLQFKKVMWHVGDPMPHEESVASAAVGSAIKVKAAAIVVFTFSGRAARLISKYRPTMPVLAVIFPREGSDPSKWRSYGTTQARQCFAVRGVYPLMGSTDEAETGGLTKEEYGIKLALNYGRSVGIVKPFDRVIIFEKIGDSSVVKIIECEG

SEQ ID NO: 4639 - DNA, 1328 bp, Panicum virgatum
  misc_feature: Ceres CLONE 1807095
  misc_feature: Encodes the peptide sequence at SEQ ID NO. 4640
ccgggattcctcccccactacatagcgccgcgcggccagcctcgcagccgcaccgacgccggggacgagcgatggcggcggcggacccggacacggaggtgcaggctgatttcttccccatggtccgccggtacaggagcggccgcgtggagcggttcatgaacatggccccggtcccggccggcgccgacccggccacgggcgtcgtgtccaaggacgtcgtcgtcgacccggccacgggcgtctgggcgcgcctcttcctcccgcccggcaccccgcgcggcgcgaagctccccgtcgtcgtctactaccacggcggcgccttcgtggtgggctccgccgccgacccgttcacgcacagctacctcaacgcgctcgccgcggaggccggcgtcctcgcggtcgcgcccgagtaccgcctcgcgccggagcacccgctcccggcggcgtacgacgactcgtgggaggcgctcaagtgggtggcctcccacgccgcgggcggcggcgggccggacccggacccgtggctggccgagcacggcgacttgtcccgcctgttcctggccggggccagcgccgggggcaccatcgcgcacgtggtcgccgcgcgcgcgggcgggctcggcgtgcgcgccaggggcctcctgatcgtgcacccctacttcagcggcgcggtggacatcggcgacgagggggcggcggggaaggagcgcaaggcgcgcgccgacgcgttctggcggttcctgtacccgggctcccccgggctcgacgacccgctgtccaacccgttctcggaggccgccggcggcagcgcggcgcgcgtcgccgccgaccgcgtgctcgtctgcgtcgcccagaaggacgacctccgcgacaggggcgtctggtactacgagagcctcagggccagcgggtaccccggcgaggtggagctgctcgagtccatgggcgagggccacgtcttctactgcatcaacccgcggtgcgacagggcgaaggagatgcaggagcgcgtcctcagtttcctgcgcaagtgaagtgagcacctagtagtgctctgcaactgcaagggaagatcagatctcccatggccatgttgttggatcaagaatcctcgtgtaatttgtggttgattgacgatttgatgtttccatcctcccaagctccacatccgtgacatatttttcacggaacgaagggagatcctatatttgttaggcgagtgaaaacatacatacactcggtcccagttatccaaaataaacgcgggttaatcattattcaataaggcacgttgatagtttttttaaaaaaaaaaaaaaaaaaaa

SEQ ID NO: 4640 - protein, 321 aa, Panicum virgatum
  misc_feature: Ceres CLONE 1807095
  misc_feature (1)..(226): Pfam Name: Abhydrolase_3 Pfam Description: alpha/beta hydrolase fold
MAAADPDTEVQADFFPMVRRYRSGRVERFMNMAPVPAGADPATGVVSKDVVVDPATGVWARLFLPPGTPRGAKLPVVVYYHGGAFVVGSAADPFTHSYLNALAAEAGVLAVAPEYRLAPEHPLPAAYDDSWEALKWVASHAAGGGGPDPDPWLAEHGDLSRLFLAGASAGGTIAHVVAARAGGLGVRARGLLIVHPYFSGAVDIGDEGAAGKERKARADAFWRFLYPGSPGLDDPLSNPFSEAAGGSAARVAADRVLVCVAQKDDLRDRGVWYYESLRASGYPGEVELLESMGEGHVFYCINPRCDRAKEMQERVLSFLRK

SEQ ID NO: 4641 - DNA, 1885 bp, Panicum virgatum
  misc_feature: Ceres CLONE 1807108
  misc_feature: Encodes the peptide sequence at SEQ ID NO. 4642
gagcatcggccggttgcggtggcacccataggactctcagattcccacctcgtcttatctccacacatttctccctcctgtttatatatctcagctccatctcccaccaccacggcaccacagctcccctccctctcctctccccactcaccccgcagccattaccgcagcctcgccaagaagccggccgggatggctgcactcaaggcgtcgttcccgggggagctcagcgccgtctccttcctcgactccaacaggggtactttcggccagcacaaagtggattttacatttcaaaggaagggcaaaagagcaatttctctgagaaggacatgctgttctatgcaacaggctccaccaccagcatggcctgggcgagctgttgctgagcctggccagaggtcatgggatggcccgaagcctatctcgattgttggatcaactggttccataggaacacagacattggacattgttgcggagaatcctgataaattccgagttgttgctcttgctgctggctccaatgtgacacttctagctgatcaggtcaaaacattcaaaccaaaactggtttctgtaagaaacgaatcattagttgatgagctgaaagaagccttagctgattgtgaagagaagccagaaattattcctggggagcaaggcatcatagaggtcgctcgacacccagatgcagttacagttgtcacagggatagttgggtgtgcagggctgaagcctacggttgctgcaattgaagctggtaaagacatagcgttggcaaacaaagagacgcttattgcaggtggccctttcgtgcttccccttgcacacaaacacaaagtgaaaattcttcctgctgattctgagcactctgcaatatttcagtgtatacaaggtttgcctgaaggagcacttcgtcgcattattctaactgcatcaggcggtgctttcagagactggccagttgacaaattgcaagatgtaaaagtcgctgacgcattaaagcatccaaactggagtatggggaagaagatcacagtagattctgcaactttattcaacaagggcttagaagttattgaagcacattatttatttggcgctgaatacgatgacattgagattgtgattcacccacagtctatcatacactctatgattgaaacccaggactcatctgtcctagctcaactgggatggccagatatgcggataccaatcttgtacaccttatcttggccagatagaatcttttgctctgaggtcacctggccccgtctggatctttgcaagttgggttcactgacgttcaaagctcctgacaatgtaaaatacccttccatggacctcgcctatgcagctgggcgggctgggggcaccatgacaggtgtcctgagtgctgctaacgagaaggctgtggagttgttcattgatgaaaagatcagctaccttgacatcttcaaggtggtggagcttacatgtgacgcccataggaacgagctggtaacgaggccatcgcttgaggagatcgttcattatgatctgtgggcgaggagatatgcagcgagcctacagccatcatctggccggagccctgtccttgcataagtagataatacatacgcatgcctagtggttgctgtgatcatggtgtaccgtgggagctctaagatatgaagtgtgggctggtaggcgacgtgcccagtgctcctggtttccatggtcattttgtcgttctggagctagatcaagcattagtggccatctagctcccctccggaatgtaaatcatgccttcgcatgaataaattgcatgtgttccttataaattttgatgcctgaagtgtggaaagtctggccggaaaaaaaaaaaaaaaaaaaa

SEQ ID NO: 4642 - protein, 472 aa, Panicum virgatum
  misc_feature: Ceres CLONE 1807108
  misc_feature (1)..(129): Pfam Name: DXP_reductoisom Pfam Description: 1-deoxy-D-xylulose 5-phosphate reductoisomerase
  misc_feature (1)..(472): SWISSPROT Homolog: EC 1.1.1.267 1-deoxy-D-xylulose 5-phosphate reductoisomerase, chloroplast precursor
  misc_feature (3)..(470): SWISSPROT Homolog: EC 1.1.1.267 1-deoxy-D-xylulose 5-phosphate reductoisomerase, chloroplast precursor
MAALKASFPGELSAVSFLDSNRGTFGQHKVDFTFQRKGKRAISLRRTCCSMQQAPPPAWPGRAVAEPGQRSWDGPKPISIVGSTGSIGTQTLDIVAENPDKFRVVALAAGSNVTLLADQVKTFKPKLVSVRNESLVDELKEALADCEEKPEIIPGEQGIIEVARHPDAVTVVTGIVGCAGLKPTVAAIEAGKDIALANKETLIAGGPFVLPLAHKHKVKILPADSEHSAIFQCIQGLPEGALRRIILTASGGAFRDWPVDKLQDVKVADALKHPNWSMGKKITVDSATLFNKGLEVIEAHYLFGAEYDDIEIVIHPQSIIHSMIETQDSSVLAQLGWPDMRIPILYTLSWPDRIFCSEVTWPRLDLCKLGSLTFKAPDNVKYPSMDLAYAAGRAGGTMTGVLSAANEKAVELFIDEKISYLDIFKVVELTCDAHRNELVTRPSLEEIVHYDLWARRYAASLQPSSGRSPVLA

SEQ ID NO: 4643 - DNA, 2440 bp, Panicum virgatum
  misc_feature: Ceres CLONE 1807120
  misc_feature: Encodes the peptide sequence at SEQ ID NO. 4644
aacagaagacggagcagcagtagagtcctccactcttcctcctccgtcttccgcatcgcaatcctcgcctcgcccgcccatctttatttatccgccggccggatttccaaagggaatcaagcgaggcggcgaggacgagcagttgggggatcgctgcacccggaattcagccagaggctttgggacccgggcaggggcggagatggccgtggaccacgccgcggcggaggtggaccacctcgccgccgagagggccgcggcgcgcttcgacgtcgaggcgatgaagatcgcgtgggccggctcgcggcacgccgtcgacgtcgccgaccgcatggcgcggctcgtcgcgtccgatccggtcttccgcaaggataacaggaccatgctctccaggaaggatttgttcaaggacactctaagaaaagcagcccatgcgtggaagcgcattgttgagctacgtcttacagaggaggaagcaagtctgctgaggcaatatgtcgatcagcctggttatgttgatctgcattggggcatgtttgttcctgctataaaagggcaaggaactgaggagcagcagaagaagtggttacctctggcttacaagttccaaataattgggtgctatgctcagactgaacttggtcacggctcaaatgttcagggccttgaaacaactgctacatttgatccaatgactgatgaatttgtcatccacagtccaactctgacctccagcaaatggtggcctggtggcttggggaaagcttccactcatgcagtcgtgtacgctaggttgataaccgaaggaaaggactacggcatacatggtttcattgtgcaattgcgaagcttggaggatcactccccgcttcctggtgttacccttggtgatattggtggaaaatttggtagtggtgcatataacagcatggacaatggtgttctgcgatttgaccatgtgcgcatcccaagggatcaaatgttgatgagactttcacaagttacaagggaggggaaatatgttcaatcagatgttccaaagcagctgctttatgggacaatggtttatgttcgtcaatcaattgtggcagatgcttctaaggcgttgtcccgtgctgtttgcattgctgtacgatacagtgccattcgaaagcagtttggctctcaagatggtggccctgagactcaggttcttaattacaggactcaacaaagcagactctttccattgctggcttcagcatatgcattcagatttgtgggtgattggctcaattggctttacacggatgtcactcagaaactggaagttaaagattattcaacactgcaagaagctcatgcctgtactgctggtttgaaggctgtgactacatctgcaacagctgatgcaattgaagaatgcagaaagctctgtggtggacatggttacttgaacagcagtgggcttcctgaattgtttgccgtctatgttcctgcatgcacttatgaaggagacaatgttgttctgcttttgcaggttgcaaggattctaatgaagactgtttctcaattgacctctggaaaacagccagttggtacaatggcctacatgggcaaagtacaacatctgatgcaatccaaatgtgctgtcaaaacagctgaagattggcttaaccctgctttcatacaagaggcatttgaagctagggctctcaggatggcggtaaactgtgcccagaacataggccaagcgtcaaaccaagaagaaggtttctatgagcggtccccagatttgcttgaggctgcggtagctcacattcaattgatcattgtaaccaagttcatcgagaaggtacatcaggacattcctggacatggagtgaaggaacagctccagaacctctgcaatgtttatgccctctacacacttcacaaacacctgggtgacttcctggcaactgggtccctcacacccaagcaaggagcactggcaaacgagcagctgggcaagctttacgcacaggtgcgtccaaatgctgttgcgctggtggacgcgttcaactacaccgaccactacctgggatcggtgctggggcggtacgacgggaacgtgtacccagcactgtacgaggaggcgtggaaggaccctctgaacgagacggtggtgccagaggggtaccacgagtacctccgccccttgctcaagcagcagctcaagctctcaagactctgatcttaccggcaacctccaggaattcacaatcaccatggtggtggttctcggagaatccagcactccctcctctgaatggattaaataccgggtgaaataagcaactctcttctttatcaaagccacgaaatatacatgtataccttaagtgaggatcatatcagaggtacattcgatcaataaagagaagcgggaggttgagcgtaaaaaaaaaaaaaaaaaaaa

SEQ ID NO: 4644 - protein, 670 aa, Panicum virgatum
  misc_feature: Ceres CLONE 1807120
  misc_feature (1)..(61): Pfam Name: Acyl-CoA_dh_M Pfam Description: Acyl-CoA dehydrogenase, middle domain
  misc_feature (1)..(166): Pfam Name: Acyl-CoA_dh_1 Pfam Description: Acyl-CoA dehydrogenase, C-terminal domain
  misc_feature (1)..(183): Pfam Name: ACOX Pfam Description: Acyl-CoA oxidase
  misc_feature (10)..(670): SWISSPROT Homolog: EC 1.3.3.6 Acyl-coenzyme A oxidase 1, peroxisomal
MAVDHAAAEVDHLAAERAAARFDVEAMKIAWAGSRHAVDVADRMARLVASDPVFRKDNRTMLSRKDLFKDTLRKAAHAWKRIVELRLTEEEASLLRQYVDQPGYVDLHWGMFVPAIKGQGTEEQQKKWLPLAYKFQIIGCYAQTELGHGSNVQGLETTATFDPMTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVQSDVPKQLLYGTMVYVRQSIVADASKALSRAVCIAVRYSAIRKQFGSQDGGPETQVLNYRTQQSRLFPLLASAYAFRFVGDWLNWLYTDVTQKLEVKDYSTLQEAHACTAGLKAVTTSATADAIEECRKLCGGHGYLNSSGLPELFAVYVPACTYEGDNVVLLLQVARILMKTVSQLTSGKQPVGTMAYMGKVQHLMQSKCAVKTAEDWLNPAFIQEAFEARALRMAVNCAQNIGQASNQEEGFYERSPDLLEAAVAHIQLIIVTKFIEKVHQDIPGHGVKEQLQNLCNVYALYTLHKHLGDFLATGSLTPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 4645 - DNA, 1881 bp, Panicum virgatum
  misc_feature: Ceres CLONE 1807158
  misc_feature: Encodes the peptide sequence at SEQ ID NO. 4646
aagaagatcaccagattactcgcataaagatttagatagccgcgccatcggactgcaattgttgatcgcagaccaggcgggcaagaagcttttctttgtattcgcggacacgggcccccctgcgatggaagccgtcggcgtcgctcctgcgcccgtggcggcgccggtgaagaagaagctccttgacctggagaaacctttccccgccgccgcgaacggcgcgaaggcgtccccggcggggaagtgggcgatgaagaagaagctggtgggcggcgacgcggactacgtcctcgaggacgtcccacacctcacggattacctgcccgagctcccgactttcccgaatcccctccaagacaattctgcgtattcggtcgtcaagcagtatttcgtcaacctagacgacacagtctcgcaaaagattgttgttcataagaccagtgcgaggggaactcacttccggcgtgccgggccgcggcagagggtgtatttccagtccgatgaggtgaacgcggccattgtcacctgcggaggcctctgccccgggctgaacacggtcgtccgcgagcttgtttgcgggttatacgatatgtatggtgtcaccagcgttgttggcatagagggtggatacaaggggttttattctaaaaatactattccattgacaccgaaatcggtgaacgacatccacaagagaggcgggactgtccttggaacttcaagaggagggcatgacactgccaaaattgtcgattgtcttcaggaccgtggtattaaccaggtttatattattggaggtgatggtactcagaaaggtgcctctgtaatttatgaggaagtccatagacggggcctcaaatgttctgttgttggtatccccaagaccatcgataatgacatcgcggtgattgacaagtcttttggatttgacactgccgtggaggaggcccaaagagccataaatgctgctcatgtcgaggctgaaagtgcagaaaacggcattggtgttgtgaagctaatgggccgcaacagtgggtttattgcaatgtacgctactctagccagtcgcgatgtggattgttgtttaatcccagagtcacccttctaccttgaagggaagggagggctccttgagttcatcgagagacggctcaaggacaatggtcatatggtcattgtagtggccgagggtgctgggcaggatcttatcgtgaaaagcatgaattttgtggacactcaggatgcttctggaaataagctgcttctggatgttggcctttggctatcccagaagataaaggatcatttcaagaagaagccccacttccccataactctcaaatacatcgacccgacttacatgatccgtgctgtcaaatcaaacgcatccgacaacgtctactgcaccctgctggctcacagcgccctccatggcgccatggcggggtacactggcttcaccgtcgccccggtcaacggcagacatgcctacatcccattctataggatcaccgagaagcagaacaaggtggtgatcacggaccggatgtgggcaagggtgctgtgctcaacgaaccagccctgcttcctgagccacgaggacgtggagaacatgaagcacgacgacgacgagcatcacctgcacaacacgcagctcttggaagatgagagctcgccgatgaagaactcggccaagtgcaatgggtcagcagcaggagtgtgaggggcaaaaagagtatgccgagtattacgcatgtaattatagatgatcatttttaccttcttttctgattttggttttgggtgctggcgttgtagagagaccactacgatagaattgaatctactgtgagcatttcgtaaaaaaaaaaaaaaaaaaaa

SEQ ID NO: 4646 - protein, 532 aa, Panicum virgatum
  misc_feature: Ceres CLONE 1807158
  misc_feature (1)..(252): Pfam Name: PFK Pfam Description: Phosphofructokinase
MEAVGVAPAPVAAPVKKKLLDLEKPFPAAANGAKASPAGKWAMKKKLVGGDADYVLEDVPHLTDYLPELPTFPNPLQDNSAYSVVKQYFVNLDDTVSQKIVVHKTSARGTHFRRAGPRQRVYFQSDEVNAAIVTCGGLCPGLNTVVRELVCGLYDMYGVTSVVGIEGGYKGFYSKNTIPLTPKSVNDIHKRGGTVLGTSRGGHDTAKIVDCLQDRGINQVYIIGGDGTQKGASVIYEEVHRRGLKCSVVGIPKTIDNDIAVIDKSFGFDTAVEEAQRAINAAHVEAESAENGIGVVKLMGRNSGFIAMYATLASRDVDCCLIPESPFYLEGKGGLLEFIERRLKDNGHMVIVVAEGAGQDLIVKSMNFVDTQDASGNKLLLDVGLWLSQKIKDHFKKKPHFPITLKYIDPTYMIRAVKSNASDNVYCTLLAHSALHGAMAGYTGFTVAPVNGRHAYIPFYRITEKQNKVVITDRMWARVLCSTNQPCFLSHEDVENMKHDDDEHHLHNTQLLEDESSPMKNSAKCNGSAAGV

SEQ ID NO: 4647 - DNA, 2455 bp, Panicum virgatum
  misc_feature: Ceres CLONE 1807159
  misc_feature: Encodes the peptide sequence at SEQ ID NO. 4648
gctgacgccgcccgcccccgcccggatctcgctgctgcctccctctcgccccagctcgccgtcgccgtcgccgtcaccagccgcaaccgccaccgccaccgccatgggcacggccaacggcgagcagccggcggcgggcgcgtcctccgacaagctccgccacgtggagtccatgtcgcagctgccctccggcgccggcaagatctccgggatcaacgccgttgtgcttggcgagtcgctcgccgccgaggagaacgacctcatcttccccagcaccgagttctccgccaacgcactcgtctcctccccgaaacagtaccaggagatgtatgagaggtccatcaaggacccgtccgggttctggtccgagatcgccgagaccttttactggaaggagaagtggaaccccagtgaggtgtgctcggagaaccttgatgtcaccaagggacctgtccagatcagctggttcaagggagggaaaaccaatatatgttacaatgctgttgaccgcaacatcgagtctggtaatggggacaagattgcaatgtactgggagggtaatgagcccggtcaggatgcgaagctcacatattctgagctcctggagaaggtttgccagcttgcaaattacttgaagagcgttggcgttggcaagggtgatgctgtgattatctacttaccaatgttgctggagctgcccattgccatgcttgcttgtgcccgcattggtgctgttcactcggttgtttttgctggcttctcagcggattcactagcccaaaggattgttgattgcaagcctaagcttgtcatcacttgcaatgctgtgaagcgtggtgccaagcccatccttctcaaagatatagtggatgcagctttggttgaaagtgagaagaatggagtctctgtaggtctctgtttgacatatgaaaatcagtcggccatgaagagggaagacacaaaatggcaagcagaaagggatgtttggtggcaggatgttgtgacaaaattttcaaccaagtgtgatgtggaatgggtggatgcagaggatccgttgttccttttgtacacaagtggcagcacagggaagccaaagggtgtgttgcatacttctgggggctacatgctgtacactgcaacaacctttaagtatgcatttgattataagccgacagacatatactggtgcactgcagattgtggctggattactggacatagttatgtaacatatggtcctctcctgaatggcgctacagttctcatttttgaagggactccaaactaccctgattccggtcgatgctgggacattgtggacaagtacaatgtgtcaatattttatactgccccaactcttgttcgttcactcatgcgtgatggcactgagtatgttacacgttactctcgaaaatctctccgagtcctgggaagtgttggtgagccaatcaatcctagtgcatggagatggttctacaacattgtgggggactctcggtgccccatatcagacacttggtggcaaactgaaactggtggtttcatgatcacccctttgcctggcgcgtggcctcagaaaccgggttctgcaacctttcctttctttggtgttcagccggtcattgttgatgagaaagggcaagagattgaaggggaatgcagtggatatctttgcataaagaaatcatggcccggagctttccggactctctacggagatcatgagagatatgagaccacatacttcaaacctttcgctgggtactatttcactggtgatggttgcagcagggacaaagacggctaccactggctgaccggtagagtagatgatgttatcaatgtcagtggacaccgaatcggcacagctgaggttgagtcggctttggtgtcacatccacaatgtgcagaggctgctgttgttggtgttgagcatgaggtcaaaggtcaaggaatttatgcatttgtaactttggtggatggtgttccgtatagtgcggaactacgaaaaagcctcataatgaccgtgcgcaaccagattggggcattcgcagcccctgacaagattcattgggcgcccggactccctaaaactcggagtggcaagatcatgcgaaggattttgagaaaaattgctgcacggcagctggatgaacttggggacacaagcaccctagctgatcctggtgtcgttgagcagctaattgcgctcagtgattgctaggttgtagtgaattgggtggtggatgcatcctttgtatacatgttccatttctctttctgtatgattgtgcatttcagtgttgagaactaaagtgggatgtgatcatatgttgttctgatgttgtatcgcatatcgagataggtccatcaaaatgtatcattgattgacataataaaatatgaataaatcgttaaattttagtttggcttctttaaaaaaaaaaaaaaaaaa

SEQ ID NO: 4648 - protein, 706 aa, Panicum virgatum
  misc_feature: Ceres CLONE 1807159
  misc_feature (288)..(702): SWISSPROT Homolog: EC 6.2.1.1 Acetyl-coenzyme A synthetase, cytoplasmic
MGTANGEQPAAGASSDKLRHVESMSQLPSGAGKISGINAVVLGESLAAEENDLIFPSTEFSANALVSSPKQYQEMYERSIKDPSGFWSEIAETFYWKEKWNPSEVCSENLDVTKGPVQISWFKGGKTNICYNAVDRNIESGNGDKIAMYWEGNEPGQDAKLTYSELLEKVCQLANYLKSVGVGKGDAVIIYLPMLLELPIAMLACARIGAVHSVVFAGFSADSLAQRIVDCKPKLVITCNAVKRGAKPILLKDIVDAALVESEKNGVSVGLCLTYENQSAMKREDTKWQAERDVWWQDVVTKFSTKCDVEWVDAEDPLFLLYTSGSTGKPKGVLHTSGGYMLYTATTFKYAFDYKPTDIYWCTADCGWITGHSYVTYGPLLNGATVLIFEGTPNYPDSGRCWDIVDKYNVSIFYTAPTLVRSLMRDGTEYVTRYSRKSLRVLGSVGEPINPSAWRWFYNIVGDSRCPISDTWWQTETGGFMITPLPGAWPQKPGSATFPFFGVQPVIVDEKGQEIEGECSGYLCIKKSWPGAFRTLYGDHERYETTYFKPFAGYYFTGDGCSRDKDGYHWLTGRVDDVINVSGHRIGTAEVESALVSHPQCAEAAVVGVEHEVKGQGIYAFVTLVDGVPYSAELRKSLIMTVRNQIGAFAAPDKIHWAPGLPKTRSGKIMRRILRKIAARQLDELGDTSTLADPGVVEQLIALSDC

SEQ ID NO: 4649 - DNA, 2740 bp, Panicum virgatum
  misc_feature: Ceres CLONE 1807161
  misc_feature: Encodes the peptide sequence at SEQ ID NO. 4650
aatcctgattgcgagggcagctaattactagtgctaagctcgctagcgtaattagccacgactggtagctttgtttgtcgccgcgctaattagtgattagcgtgtgacagaggaggtaatagtaattccggtggcggttctctgatctcggcggagagagagagatgacggtgacgccgaagatcacggtgggggatgggcggctggtggcgcacgggcggaccatcctgaccggcgtgccggagaacatcgtgctgacgcacgcctccggggcggagctcgtcgacggcgccttcgtcggcgccacggccggcgaggccaagagcatgcacgtcttcaccttcggcaccctcagggacctgcggttcatgtgctgcttccggttcaagctgtggtggatgacccagcgcatgggcacctccggccgcgacgtcccgctggagacgcagttcatgctcctggagagccggccgggcgccggcgccggcggcgacgacgacagcggcgagccggtgtacctggtgatgctgccgctgctggagggccagttccgcgccgcgctgcagggcaacgaccgcgacgagctggagatcaccctcgagagcggggacaaggaggttcagacggcgcaggggacctacatggtgtacgtgcacgccgggaccaaccccttcgacaccatcactcaggctgtcaaggttgtggagaggcacctgcagacgttccaccacagggacaagaaaaagctgccgtccttcgtggactggttcgggtggtgcacatgggacgccttctacaccgacgtcaccgccgagggcgtcaagcagggcctgcagagcttggcggagggcggcacgccgccgcggttcctgatcatcgacgacgggtggcagcagatcggcagcgagaacaaggaggaggccaatgccgtcgtgcaggaaggcgcgcagttcgccagcaggctgacggggatcaaggagaacgccaagttccagaacaagaaggaggaggcagagcagcagcagagccagcagcaggccgagcagggccccgggctgaagcttctggtggaggaggcgaagcgcgagcacggcgtcaagtacgtgtacgtgtggcacgccatggcggggtactggggcggcgtgaagccggcggcggaggggatggagcactacgagagcgcgctggcgttccccgtgcagtcgccgggggtgatgggcaaccagccggacatcgtcatggactccctctccgtgctggggctgggcctggtgcacccgcgcaaggccctccgcttctacgacgagctccactcgtacctggccacctgcggcgtggacggcgtcaaggtggacgtgcagaacatcatcgagaccctgggcgccgggcacggcggccgcgtgtcgctcacccgcgcctaccaccacgcgctcgaggcctccgtggcgcgcaacttccccgacaacggctgcatctcctgcatgtgccacaacaccgacatgctctacagcgcccgccagaccgccgtcgtgcgcgcctccgacgacttctacccgcgcgacccggcctcgcacaccatccacatctcctccgtcgcctacaacacgctcttcctcggcgagttcatgcagcccgactgggacatgttccatagcctgcacccggcggcggagtaccacggcgcggcgcgggcgatcggcggctgccctatctacgtcagcgacaagccgggcaaccacaacttcgagctgctcaagaagctcgtgctccccgacggctccgtgctccgcgcgcagctccccggccgccccacccgcgactgcctcttcgccgacccggcgcgcgacggcaccagcctgctcaagatctggaacgtgaacaagtgcacgggcgtggtgggcgtgttcaactgccagggcgccggctggtgccgcgtcaccaagaagacccgcgtccacgacgccgcgccggggacgctcaccgggtccgtccgcgccgaggacgtcgacgccatcgccgacctcgccggcccgggctggggcggcgaggccgtcgtgtacgcctaccggtcgggggagctcatccggctgcccaggggcgccacgctgccggtgacgctcagggtcctcgagttcgagctgttccacgtcgcccccgtcaaggaggtggcgccgggcgtgtcgttcgcgcccatcgggctgctcggcatgttcaacgccggcggcgcggtggagcagtgcgaggccgcggacggcgcggccgccgccgtgcggctcagggtccgcggctgcggccggttcggcgcctactgctcgcggaggccggcgcggtgcacgctggacgcggcggaggcggagttcacctacgacgcagacacgggactcgtcgcgctcgacatccccgtgccggagcaggagttgtacagatggaacctggagatccaggtctaggaggctcttcgatccgaccttctcaggaggctcttcgatcttctccgtcgacgtgtccgtgatggtgctcgcctcattcttcggtggacttgaccattttacgcgtgtgtggttggtgtggccatggagaggtgcgtgtgtgcacgaaatgaagccgtccgccattgatgcgtcctctctctctctctccctagaagaataaactagcgctgctctgtatactgcactacttctgttgcatatgcaataaacgaccactccatgtatgcaaaaaaaaaaaaaaaaaaaaa

SEQ ID NO: 4650 - protein, 761 aa, Panicum virgatum
  misc_feature: Ceres CLONE 1807161
  misc_feature (1)..(734): Pfam Name: Raffinose_syn Pfam Description: Raffinose synthase or seed imbibition protein Sip1
MTVTPKITVGDGRLVAHGRTILTGVPENIVLTHASGAELVDGAFVGATAGEAKSMHVFTFGTLRDLRFMCCFRFKLWWMTQRMGTSGRDVPLETQFMLLESRPGAGAGGDDDSGEPVYLVMLPLLEGQFRAALQGNDRDELEITLESGDKEVQTAQGTYMVYVHAGTNPFDTITQAVKVVERHLQTFHHRDKKKLPSFVDWFGWCTWDAFYTDVTAEGVKQGLQSLAEGGTPPRFLIIDDGWQQIGSENKEEANAVVQEGAQFASRLTGIKENAKFQNKKEEAEQQQSQQQAEQGPGLKLLVEEAKREHGVKYVYVWHAMAGYWGGVKPAAEGMEHYESALAFPVQSPGVMGNQPDIVMDSLSVLGLGLVHPRKALRFYDELHSYLATCGVDGVKVDVQNIIETLGAGHGGRVSLTRAYHHALEASVARNFPDNGCISCMCHNTDMLYSARQTAVVRASDDFYPRDPASHTIHISSVAYNTLFLGEFMQPDWDMFHSLHPAAEYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSVRAEDVDAIADLAGPGWGGEAVVYAYRSGELIRLPRGATLPVTLRVLEFELFHVAPVKEVAPGVSFAPIGLLGMFNAGGAVEQCEAADGAAAAVRLRVRGCGRFGAYCSRRPARCTLDAAEAEFTYDADTGLVALDIPVPEQELYRWNLEIQV

SEQ ID NO: 4651 - DNA, 2273 bp, Panicum virgatum
  misc_feature: Ceres CLONE 1807171
  misc_feature: Encodes the peptide sequence at SEQ ID NO. 4652
agctcagtcgtcattgttcctaaaccctagactagatagccgacacacaccaagagggagaggaggagagaggtcaactcaagtgatctgtgatcccctgctcttgcgcgtgattcaacgactcaagcgatcgcggttgcagcagccagagggaggtagcgactcaaaatggcgtcaccgttcgggacatgtcgcctcaacaagccagcacctgctgcctttgcgaccaacaagaccctcctcctttcgcccccggttgtttccctcccacggcaaatgaaaatgaggccccagaggaagtgccgtttcacagtaaatgcagcaaaggagctccatttcaacaaggatggctcggctatcaggaaacttcagaatggggtcaataagcttgcagatctcgttggggttactcttggaccaaaaggacgaaatgtagtccttgagagcaagtatggctcacccaaaatcgtcaatgatggagtcactgtcgcaaaggaggttgagctggaggaccctgttgaaaacattggagctaaattggtccgccaagctgctgctaaaacaaatgatttggctggtgatgggacaaccacttcggtcgtccttgctcaagggatgattactgagggtgtaaagattgtagctgctggtgctaatccagtgcagatcactcggggtattgagaaaacagccaaagcactagtcaatgaactccaaaagatgtccaaggaggttgaggatagtgagctggctgatgttgctgcagtaagcgctggaaataactatgaaattgggaatattatagctgaggctatgagcaaggttggacggcagggagtggtcacccttgaagaaggaaagagtgctgaaaataacctctatgttgttgagggaatgcagttcgatcgtggttatatttctccctactttgtgactgacagtgaaaaaatgatagtggagtatgagaactgcaagctgctcctagtagacaagaaaattaacaatgcaagagatcttatcactattctggaggatgctattagaggtgggtatccaattctaatagttgcagaggatattgagcaggaagctcttgcaacccttgtggttaataggcttagaggtgcattgaaaattgctgcgatcaaggcccctggctttggagagcgcaagagtcaatacctggatgacattgctactctcactggaggcactgtcatcagagatgaagttgggttgtccctagagaaggcagacaatgaggtcctaggaacggccgccaagattgtagttactaaggattcaacgacaatagttggagatggtactacacaggaggaagtaaacaaaagggtgatgcaaatcaagaaccagattgaggcgactgatcaagaatacgagagagaaaagcttaacgagaggattgctaagctgtctggtggtgttgctgttattcaggtgggagcacagacagaaactgagcttaaggaaaagaaactgagggttgaagatgcccttaatgctacaaaggcagcagttgaggaaggcattgttgtaggtggtggctgtacccttttaaggcttgcatcaaaagttgatgccattgtagaaacccttgagaatgatgaacagagggtcggggctgaaattgtaaggaagtccttgagctatccacttaaattgattgcgaagaatgcgggtgttaatggcagcgtggttatcgagaaggttcttgccaatgagaacttaaggtatggttacaatgcagctacagggaactatgaggatttgatggctgctggtattattgatcccaccaaggttgtgaggtgttgcttggagcatgctgcctcggtggcaaaaactttcatcacttctgatgctgttgtggttgacatcaaggtgcccgagcaagcacctgctgcaaacccaatgggtggtggtggctcaggttttggattctagaaaaatttctggagatgagcttccactccctgcctgcgccatggcatgttacttctgaggaggaatttcattctggtgttattaaagtgttgaagcggcagcaaatctgttatgagtgatctatcaatacttgaacaatgaatcttgcacgcagttggtaggcgtcgcgtgaatgatacttatgtgtaactgttgccagaccagatgaacatcaacttattgatgactggctgttccaatcttcctgagtcttgaaggggaaaaaatccctgttggagggttagttacaaaaaaaaaaaaaaaaaaaa

SEQ ID NO: 4652 - protein, 598 aa, Panicum virgatum
  misc_feature: Ceres CLONE 1807171
  misc_feature (1)..(499): Pfam Name: Cpn60_TCP1 Pfam Description: TCP-1/cpn60 chaperonin family
MASPFGTCRLNKPAPAAFATNKTLLLSPPVVSLPRQMKMRPQRKCRFTVNAAKELHFNKDGSAIRKLQNGVNKLADLVGVTLGPKGRNVVLESKYGSPKIVNDGVTVAKEVELEDPVENIGAKLVRQAAAKTNDLAGDGTTTSVVLAQGMITEGVKIVAAGANPVQITRGIEKTAKALVNELQKMSKEVEDSELADVAAVSAGNNYEIGNIIAEAMSKVGRQGVVTLEEGKSAENNLYVVEGMQFDRGYISPYFVTDSEKMIVEYENCKLLLVDKKINNARDLITILEDAIRGGYPILIVAEDIEQEALATLVVNRLRGALKIAAIKAPGFGERKSQYLDDIATLTGGTVIRDEVGLSLEKADNEVLGTAAKIVVTKDSTTIVGDGTTQEEVNKRVMQIKNQIEATDQEYEREKLNERIAKLSGGVAVIQVGAQTETELKEKKLRVEDALNATKAAVEEGIVVGGGCTLLRLASKVDAIVETLENDEQRVGAEIVRKSLSYPLKLIAKNAGVNGSVVIEKVLANENLRYGYNAATGNYEDLMAAGIIDPTKVVRCCLEHAASVAKTFITSDAVVVDIKVPEQAPAANPMGGGGSGFGF

SEQ ID NO: 4653 - DNA, 1722 bp, Panicum virgatum
  misc_feature: Ceres CLONE 1807178
  misc_feature: Encodes the peptide sequence at SEQ ID NO. 4654
ctcgtcgccccccccctgcgccctcccctctcgctcgctcgccagcggctgcttaataaatcaccagccctctgccccggccaccgaaagcaaccaccccaccacggattaaacaaagcgcgcacccaatcaacgcggcggcgcactcgcatcgcacctcgcaaccgtatctccccgagccgtgttgggggaggaagaggagtggggagccccgatccagtcccatccagccagccgaatcccctcgccgccgccgccgccctctccttcctctaaaaccctagcgtgagcggggatgaagatccagtgcaacgcgtgcggggccgcggaggcgcgggtgctctgctgcgcggacgaggcggcgctctgcgcggcctgcgacgaggaggtgcacgccgccaacaagctcgcggggaagcaccagcgggtgccgctgctctcggacgccgccgccgccgccgcggcggcgcccgccgtgcccaagtgcgacatctgccaggaggcttctggatacttcttctgcctagaggaccgtgcactgctttgtagagattgtgatgttgctatacacacggtaaattcatttgtttcggtgcatcagagattcctgctaactggagttcaggtgggccttgatcctgccgatccagttccacccattgctgaaaaccgtgttaatgccactggtggctcggtatatcaaccagcaaaacatcttccaaggagaaacacaacagttcaattttcaggtgaaggcactgcttctgttcccagcaaaaagttaataaatggagactattcaagacagaattctgttccaacagtcagtacgggagtggttgattggacaacacacaatggtgcaattcaatccggagaatctccacctgagtacatgtcagaggaaaatccaacacatctgcaatctagccagaccacagcggccttttccaatcaaattaacagcgatagtgatcaggcctataacttgccattctcaggtggtaatgggtcagacagcctaccagactggcctgtggatgagttcttcactaactcagaatatggcccaaatttcagctttctggagcatggttcttcaaagagtgacaatgctaagctggggagtgctgggggatctccacaatgctgtttagctgaaggcttcgttgctgaggaactattaggccaggttcctggattggtaaccgataaatatataggccgagtacctgagaactcatgggcagtccctgaggttccctcaccaccaacagcatcggggttcaattggcatgggaatttgcatttcactgcatatgacagcaccatgttcgttcctgaaatctcctccctccagagctctcgagatcaattcgctgtgccttctggtttcaagcgccggaggagacagtattgagcgacaacaagagcactagacaccactctcttttagacaatcttgagagaggcctcttgctgggccaaacgacgggaaaggatcaggactgggtgatcattcccacttcaatgaattatccggtagccaggtttaaagtgtgttgtaatgcctcaaagttgtccatcttccaaatattcgagcttccccagtgaatcgttgtggtgttgagtttgtgtatatagcgaaataaagaggagcaccagtaacatcataattaatggcacatgaagttccttctccaaaaaaaaaaaaaaaaaaaa

SEQ ID NO: 4654 - protein, 374 aa, Panicum virgatum
  misc_feature: Ceres CLONE 1807178
  misc_feature: Great-hit functional homolog of the protein sequence given in SEQ ID NO 9212
  misc_feature (1)..(48): Pfam Name: zf-B_box Pfam Description: B-box zinc finger
  misc_feature: Useful for making plants with altered Lignin content
MKIQCNACGAAEARVLCCADEAALCAACDEEVHAANKLAGKHQRVPLLSDAAAAAAAAPAVPKCDICQEASGYFFCLEDRALLCRDCDVAIHTVNSFVSVHQRFLLTGVQVGLDPADPVPPIAENRVNATGGSVYQPAKHLPRRNTTVQFSGEGTASVPSKKLINGDYSRQNSVPTVSTGVVDWTTHNGAIQSGESPPEYMSEENPTHLQSSQTTAAFSNQINSDSDQAYNLPFSGGNGSDSLPDWPVDEFFTNSEYGPNFSFLEHGSSKSDNAKLGSAGGSPQCCLAEGFVAEELLGQVPGLVTDKYIGRVPENSWAVPEVPSPPTASGFNWHGNLHFTAYDSTMFVPEISSLQSSRDQFAVPSGFKRRRRQY

SEQ ID NO: 4655 - DNA, 1778 bp, Panicum virgatum
  misc_feature: Ceres CLONE 1807241
  misc_feature: Encodes the peptide sequence at SEQ ID NO. 4656
atcgcccccgactcaggccatctatctaatcctccttcctctcccgcgctcacacagcacacacctctctctgcgaagtccggcccagcggcgggcgggcggcgccatggcggttgcgaacgggagcggcggcaaggggttcgaggtgcccaaggtggaggtcaggttcaccaagctcttcatcaacggccagttcgtcgacgccgtctctggtaagacgttcgagacccgggacccgcgaaccggcgaggtcatcgccaacatcgccgagggcgataaggccgacgtcgacctcgccgtcaaggccgcccgggaggccttcgacaatggcccctggcccaggatgacgggctatgagcggggccggatcctgaacaagttcgcggacctgatcgaccagcacatcgaggagctggcgatgctggacacggtggacgccggcaagctcttcctcgtcggcaaggtccgggacatccccggcgccgcgcacctgctgcgctactacgccggcgccgccgacaagatccacggcgagacgctcaagatggcgcagcggatgcacgggtacacgctcaaggagcccgtcggcgtgatcggccacatcgtgccctggaactaccccagcaccatgttcttcttcaaggtcagcccggcgctcgccgccgggtgcgccgtcgtcgtcaagcccgccgaacagacgccgctctccgcgctcttctacgcgcacctctccagggaggccggcgtccccgacggcgtgctcaacgtcgtgccagggttcggccccacggccggcgccgccgtcgccgcgcacatggacgtcgacaagctcagcttcaccgggtccacggaggtcggccggctcgtcatgaaggcggccgccgagagcaacctcaaatccgtctcgcttgagctcggcggcaagtccccggtcatcgtgttcgatgacgccgacctcgacatggccgtgaacctggtcaacttcgccacatacaccaacaagggcgagatctgcgtcgccggcacgcgcatctacgtgcaggaagggatctacgacgcgttcgtcaagaaggcggccgagctcgccaagaaatcggtggtcggggacccgttcaacccgcgtgtcaaccaaggcccacaggttgacaaagaccagtacgagaaggttctcaagtacatcaatatcggaaagcgcgaaggcgccacgctggtcaccggagggaagccctgcggtgacaaggggtactacattgagcccaccatcttcacggacgtaaaggatgacatgtcgatcgcgcaagatgaaatttttggaccggtgatggcgctcatgaaattcaagactgttgaagaggtcattcagaaagcaaacaacacccggtatggcctagccgctggcatcgtgactaagaatattgacatcgcaaacacggtgtcgcggtcgatccgcgcaggcgccatctggatcaattgctactttgccttcgaccctgatgcgccatttggtggttacaagatgagtgggttcggcaaggacatgggcatggacggccttgagaagtatctgcagacgaagaccgtggtcacacccctatataacacaccctggctctgatctcatcctaagacaaytgaacaacacaagggaggaaatgaagaaacgtgtcttatacagataaaagaatgggttgtttgtagctskgcatctgcatggattgatgatgtacaatgtagcatggtgacttgtttcagaacaataaagacatgtttcagacttt

SEQ ID NO: 4656 - protein, 502 aa, Panicum virgatum
  misc_feature: Ceres CLONE 1807241
  misc_feature (3)..(464): Pfam Name: Aldedh Pfam Description: Aldehyde dehydrogenase family
  misc_feature (15)..(502): SWISSPROT Homolog: EC 1.2.1.3 Aldehyde dehydrogenase 2B4, mitochondrial precursor
  misc_feature (5)..(502): SWISSPROT Homolog: EC 1.2.1.3 Aldehyde dehydrogenase 2C4, cytosolic
MAVANGSGGKGFEVPKVEVRFTKLFINGQFVDAVSGKTFETRDPRTGEVIANIAEGDKADVDLAVKAAREAFDNGPWPRMTGYERGRILNKFADLIDQHIEELAMLDTVDAGKLFLVGKVRDIPGAAHLLRYYAGAADKIHGETLKMAQRMHGYTLKEPVGVIGHIVPWNYPSTMFFFKVSPALAAGCAVVVKPAEQTPLSALFYAHLSREAGVPDGVLNVVPGFGPTAGAAVAAHMDVDKLSFTGSTEVGRLVMKAAAESNLKSVSLELGGKSPVIVFDDADLDMAVNLVNFATYTNKGEICVAGTRIYVQEGIYDAFVKKAAELAKKSVVGDPFNPRVNQGPQVDKDQYEKVLKYINIGKREGATLVTGGKPCGDKGYYIEPTIFTDVKDDMSIAQDEIFGPVMALMKFKTVEEVIQKANNTRYGLAAGIVTKNIDIANTVSRSIRAGAIWINCYFAFDPDAPFGGYKMSGFGKDMGMDGLEKYLQTKTVVTPLYNTPWL

SEQ ID NO: 4657 - DNA, 1853 bp, Panicum virgatum
  misc_feature: Ceres CLONE 1807257
  misc_feature: Encodes the peptide sequence at SEQ ID NO. 4658
atccatgccgtctgcaaccacacgcctactgttctgtcgtgttccccggccatcatccttccttgcactgccagctgctgctgatgcctcctctcccatgtctacttaaacctagctagctagcagtacgtagcttgcaccaagcaccggcgtagtaagctctacctgataattaatttagtttttggccaccgcgccggggccatggaaagaacaatattgataatgaaggccgccgccgccgccgtcgcggtgctcctcgccgtcgcggtgctcgccgccgaggcggcggcgccgcaccaccagtacccgcgcggggtgacgagcacgtaccgtcggaagctggaggcctccgaggacatgccgctggacgcggacgtgttcgccgtgccgccgggccgcaacgcgccgcagcaggtgcacatcacgctgggagaccaggccggcacggccatgaccgtgtcctgggtcaccatggaggccgagggcaacagcaccgtcctctacggccgcgccgcgggccgcctcgacctcgccgccgagggcaccaccacgcgctacaccttctacaactacacctccggcttcatccaccactgcacgctcaccggcctggaccacgccacccggtactactacgccgtggggcacggcgacacggtgcgcaccttctggttcaccacgccgccccgcccgggtcccgacgcgccgctccgcctggggctcatcggcgacctgggccagacggccgactccaacgccacgctggcgcactacgagcagcaccccggcgccgccgtgctcttcgtcggcgacctctcctacgccgacaagcacccgctccacgacagcaggcgctgggacacctggggccgcttctccgagcgcagcgtcgcgtaccagccctggatctggacggccggcaaccacgaggtggagtacgcgccggagctgggggagacgacggcgttcaagcccttcgcccaccgctacccgacgccgtaccgcgcgagcgggtcgtcggagccgtactggtactcggtgaagctggggccggcgcacatcatcgttctctcctcctactcggccttcggcaagtacacgccgcagttcaagtggctggaggcggagctcgcccgcgtcgaccgcgagctcacgccgtggctcttcatcagcacgcacgtgccctggtacaacagcaacaacttccacttcatggagggcgagccgatgcgcgtgcagttcgagaagatggccgtcgacgcccgcgttgacgccgtcttcgccggccacgtccacgcctacgagcgcagccaccgcttctccaacatccagtacaacatcaccgacggcaggtgcacgcccgtcgccgaccgccgcgcgcccgtctacgtcgtcatcggcgacggcggcaacatcgaggggctcgccgacgagctcacgtggccgcagccggcctactcggcgttccgggagtacagcttcgggcacgccgtgctggacatcaagaaccgcacgcacgcctactacgcctggtaccgcaaccacgacggcaacaaggtcacggcggacgccacctggttcaccaatcgctaccacatgcccaaccacgacgactcctccatctcctcaaaaaccgcctactacgcgtaatacaattatatatatatatatatatatatataaatttcccgagctgcaggaaaattaattaattaattaattgtgctgcatatatatttatctagtacccaataataaccatggacatgagatgtgcacttgaatatttatctatgttgaaaataagatggctggacgtccagtttgttcaaaaaaaaaaaaaaaaaaaa

SEQ ID NO: 4658 - protein, 482 aa, Panicum virgatum
  misc_feature: Ceres CLONE 1807257
  misc_feature (2)..(198): Pfam Name: Metallophos Pfam Description: Calcineurin-like phosphoesterase
  misc_feature (38)..(464): SWISSPROT Homolog: EC 3.1.3.2 Iron(III)-zinc(II) purple acid phosphatase precursor
  misc_feature (38)..(473): SWISSPROT Homolog: EC 3.1.3.2 Purple acid phosphatase precursor
MERTILIMKAAAAAVAVLLAVAVLAAEAAAPHHQYPRGVTSTYRRKLEASEDMPLDADVFAVPPGRNAPQQVHITLGDQAGTAMTVSWVTMEAEGNSTVLYGRAAGRLDLAAEGTTTRYTFYNYTSGFIHHCTLTGLDHATRYYYAVGHGDTVRTFWFTTPPRPGPDAPLRLGLIGDLGQTADSNATLAHYEQHPGAAVLFVGDLSYADKHPLHDSRRWDTWGRFSERSVAYQPWIWTAGNHEVEYAPELGETTAFKPFAHRYPTPYRASGSSEPYWYSVKLGPAHIIVLSSYSAFGKYTPQFKWLEAELARVDRELTPWLFISTHVPWYNSNNFHFMEGEPMRVQFEKMAVDARVDAVFAGHVHAYERSHRFSNIQYNITDGRCTPVADRRAPVYVVIGDGGNIEGLADELTWPQPAYSAFREYSFGHAVLDIKNRTHAYYAWYRNHDGNKVTADATWFTNRYHMPNHDDSSISSKTAYYA

SEQ ID NO: 4659 - DNA, 2727 bp, Panicum virgatum
  misc_feature: Ceres CLONE 1807344
  misc_feature: Encodes the peptide sequence at SEQ ID NO. 4660
ataaataaggctctcccaaaccccttccctttcccgtgctcctcccctcctctgcttccctcccccaaccgccgcgcctcccctccgccgctcccgtccctccggaaagatggcgtcccacattgttggataccctcgcatgggccccaagagggagctcaagttcgcccttgagtctttctgggatgggaaaagcactgctgaggatctggagaaggttgccaccgacctcagggccagcatctggaagcagatggctgatgctgggatcaagtacatccccagcaacaccttctcgtactatgaccaggtccttgacaccaccgccatgcttggcgctgtcccggaacgctactcatggactggtggggagattgggttcgatacctacttctcgatggccaggggcaatgccactgtccctgctatggaaatgaccaagtggtttgacaccaactaccacttcattgtccctgaattgggccctaacaccaagttctcctactcttctcacaaggctgttaatgaatacaaggaggctaaggcgcttggcgttgataccgtgccagttttcattggaccagtctcatacttgttgctctcgaagcctgccaagggagtagaaaagggtttccctcttctttcccttcttagcagcatccttcctgtctacaaggaggtcattgctgagttgaaggcagctggggcttcatggattcagttcgatgagcccacccttgtccttgaccttgatgctcacaaattggctgcattctctgctgcatacacagagcttgagtctgcactttctggactgaatgtgctcgttgagacttactttgctgatgttcctgcagaatcattcaagaccctaacatctttgagcagtgtgactgcttatggttttgaccttgttcgtggaacccagactgttgagcttatcaagagtggtttccccgctggaaagtacctttttgccggtgttgtggatggacgcaacatctgggctgacgatcttgctgcttccctcagcactctccaggctctcgaggctgttgttggaaaggacaagcttgttgtgtcaacttcctgctcactcatgcacactgctgtggatcttgtaaacgagactaagcttgacagtgagattaagtcttggcttgcttttgctgcccagaaggttgttgaggttgatgctcttgccaaagcactggctggtcaaaaggatgaggcttactttgcagcaaatgctgctgctcaggcctcaaggagatcatcaccccgtgtgacaaatgaagaagtccagaaggctgctgctgctctcaagggctctgaccaccgccgtgctaccaacgttagtgctagattggatgctcagcagaagaagctaaaccttccagtccttcccacgaccacaattggttcattcccgcagactgtggagctcaggagggtacgccgtgagtacaaggcgaagaagatctctgaggaggagtacgtcagtgccatcaaggaggaaatcagcaaggttgttaagctccaagaagagcttgacatcgatgtgcttgtgcatggcgagcctgagagaaacgatatggttgagtactttggtgagcaactctctggttttgcattcactgccaatggttgggtgcaatcttatggatcaaggtgtgtcaagccaccgatcatctacggtgatgtgagccgccccaaccccatgaccgttttctggtcgaagaccgcacagagcatgacatctcgcccaatgaagggaatgttgactggtccagtcacaatccttaactggtcctttgtcaggaatgaccagccaaggtttgagacctgctaccagattgctcttgcaatcaagaaggaggttgaggatcttgaggctgctggtattcaggtcatccaaattgacgaggctgctttaagagaaggcctgccactccgcaaggctgagcacactttctacttggactgggccgttcactctttcagaattaccaactgcgagatcaaggacaccacccagatccacacccacatgtgctactccaacttcaacgacatcatccactccatcatcaacatggatgctgatgtgatcaccattgagaactcacggtctgacgagaagctactttccgtcttccgtgagggtgtgaagtacggtgcaggcattggccctggtgtctacgacatccactcccccaggatcccatccaccgaggagattgctgaccgcatcaacaagatgctcgcagtgctcgataccaacatcctctgggtgaaccctgactgcggtctcaagacccgcaagtacaccgaggtcaagcctgccctgaccaacatggtctccgccgccaagctcatccgcacccagcttgccagcgccaagtgagaactgtctctgtggtggctttttcgttcaattacaaggagggtgttcatcaaagccattaaatgtcttgaataatctggggtctcatgaatccgctctttctgtggttagcttagttcgtttttcttggcacgatgatggcaccctgcttatacctctgctactcttacgaatttggtggttttgacttttgaggcaagttgcacgtgtacttgtattgtaaaaccggttggatatctgcagtgtttcatctgcaactctgaggtgtgttagggctcgtattaatcatctttgttccggaaaaaaaaaaaaaaaaaaaa

SEQ ID NO: 4660 - protein, 765 aa, Panicum virgatum
  misc_feature: Ceres CLONE 1807344
  misc_feature: Great-hit functional homolog of the protein sequence encoded by LOCUS At5g17920
  misc_feature (1)..(317): Pfam Name: Meth_synt_1 Pfam Description: Cobalamin-independent synthase, N-terminal domain
  misc_feature (1)..(324): Pfam Name: Meth_synt_2 Pfam Description: Cobalamin-independent synthase, Catalytic domain
  misc_feature (1)..(765): SWISSPROT Homolog: EC 2.1.1.14 5- methyltetrahydropteroyltriglutamate-- homocysteine methyltransferase
  misc_feature: Useful for making plants with altered cell wall content and/or composition
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYSSHKAVNEYKEAKALGVDTVPVFIGPVSYLLLSKPAKGVEKGFPLLSLLSSILPVYKEVIAELKAAGASWIQFDEPTLVLDLDAHKLAAFSAAYTELESALSGLNVLVETYFADVPAESFKTLTSLSSVTAYGFDLVRGTQTVELIKSGFPAGKYLFAGVVDGRNIWADDLAASLSTLQALEAVVGKDKLVVSTSCSLMHTAVDLVNETKLDSEIKSWLAFAAQKVVEVDALAKALAGQKDEAYFAANAAAQASRRSSPRVTNEEVQKAAAALKGSDHRRATNVSARLDAQQKKLNLPVLPTTTIGSFPQTVELRRVRREYKAKKISEEEYVSAIKEEISKVVKLQEELDIDVLVHGEPERNDMVEYFGEQLSGFAFTANGWVQSYGSRCVKPPIIYGDVSRPNPMTVFWSKTAQSMTSRPMKGMLTGPVTILNWSFVRNDQPRFETCYQIALAIKKEVEDLEAAGIQVIQIDEAALREGLPLRKAEHTFYLDWAVHSFRITNCEIKDTTQIHTHMCYSNFNDIIHSIINMDADVITIENSRSDEKLLSVFREGVKYGAGIGPGVYDIHSPRIPSTEEIADRINKMLAVLDTNILWVNPDCGLKTRKYTEVKPALTNMVSAAKLIRTQLASAK

SEQ ID NO: 4661 - DNA, 1695 bp, Panicum virgatum
  misc_feature: Ceres CLONE 1807347
  misc_feature: Encodes the peptide sequence at SEQ ID NO. 4662
atcgccacgggaaccaagaatctgacacggaaacctcccgcttccatggcgacggcatccaccacgctgctcctctccctcgccctcctcgcctccgccgcggccgctgcgcagtcgtcggacgcggatgccatctcccggttccaggagtacctccgcatcgacacggcgcagccggcgccggactacgccgcggccgtggccttcctccggggccaggccgccgaggccggcctcgaggcgcgcacgctggagctcgccgctgggaagccccttctgctgctgcgatggcccgggcggcggccgtcgctgccctcgatactcctcaactcccacaccgacgtcgtgccgtcggagcggcagaagtgggaccacccgcccttctccgccgccctcgacgaggcatccggtcgcatctacgcccgaggctcccaggacatgaagtgtgtggggatgcaataccttgaagccatccgccgtctccgttctgcaggatttgttccagatcgaaacatctatataacatttgttcctgatgagaagattggtgggcatgagggtgttgagctgtttgtttcatcaaaggaattcaaagaaatgaacgtgggtttggtccttgatgaggggcttgcatctcctggggaggagtatcgtgtgttctatgcagagcgtagcccttggtggcttactataaaagcaaagggtgcaccagggcatggtgcaaagttgtatgacggtagtgcaatggagaatctgatgaagagcgtggaagctattaggagattcaggacatcacagtttgatttagtgaagtccggagagaaggctgaaggagatgttgtgtcggtgaatttcgcatacctgaaggctggcacacctacaccgacgggttttgtcatgaatctccaaccatctgaagcagatgtaggtcttgacatccggatccctcctagtgctcatgtggaagcactggagaggcgccttgttgaagaatgggcgccatcttcacgcaacttgacctttgagtttaaacagaagatgtctgtcctggacaactttgggaagccagccatgacacctgctgacagcacaaacccatggtggctgttgcttgaagaagctgtgaagagtgctggtggcaaacttggtaagccggagatattcccagcctctactgatgcccgttatttccggcagattgggttgccagcatttggcttttcacctatggcgaacacactgatattgcttcatgaccataatgagtttctgcacaaagacgagtacctcaaaggaatcgggatatacgagtatatcatcaaggcactggccacccacaaagatagcgttaaagacgatgaatccagggcagaactatgagggcctcgatcttacctagccatgttgccattcttgccgcccaactggagcacagaaatcatgtgtaggcaaagcagctgcttacatttctgctcctgcggcgaaatgatagaactgcaaacaccatccctgtacattcaataagcgtgcttatgcgctgaacaattggcgtgattccctctatgcaattcatggttcagcctattgcaacttgatgcatcagttgtgacttgtgacttgtgactgttgtatcaaacctacattggttgtatcagtatcctgttcggctgttcccaaaaaaaaaaaaaaaaaaaa

SEQ ID NO: 4662 - protein, 444 aa, Panicum virgatum
  misc_feature: Ceres CLONE 1807347
  misc_feature (1)..(334): Pfam Name: Peptidase_M20 Pfam Description: Peptidase family M20/M25/M40
MATASTTLLLSLALLASAAAAAQSSDADAISRFQEYLRIDTAQPAPDYAAAVAFLRGQAAEAGLEARTLELAAGKPLLLLRWPGRRPSLPSILLNSHTDVVPSERQKWDHPPFSAALDEASGRIYARGSQDMKCVGMQYLEAIRRLRSAGFVPDRNIYITFVPDEKIGGHEGVELFVSSKEFKEMNVGLVLDEGLASPGEEYRVFYAERSPWWLTIKAKGAPGHGAKLYDGSAMENLMKSVEAIRRFRTSQFDLVKSGEKAEGDVVSVNFAYLKAGTPTPTGFVMNLQPSEADVGLDIRIPPSAHVEALERRLVEEWAPSSRNLTFEFKQKMSVLDNFGKPAMTPADSTNPWWLLLEEAVKSAGGKLGKPEIFPASTDARYFRQIGLPAFGFSPMANTLILLHDHNEFLHKDEYLKGIGIYEYIIKALATHKDSVKDDESRAEL

SEQ ID NO: 4663 - DNA, 2249 bp, Panicum virgatum
  misc_feature: Ceres CLONE 1807355
  misc_feature: Encodes the peptide sequence at SEQ ID NO. 4664
atccccagcacgagcagctcgttctcgttcatcaccgaccctcaccgtctcgtctccctgctccgctccccacacgcgctcgcccctccctccctccctctctcccctcctcaccgccgctcgcgccccgtgccgtttccgccatgtgtggcatcttcgccgtgctcgggtgcgccgactgctcccaggcccagagggcgcgcgtcctcgcctgctcccgcaggctgaggcaccggggacccgactggtcgggggtgtaccagcacgagggcaacttcctcgcccagcagcggctcgccgtcgtctccccgctgtccggcgaccagccgctcttcaacgaggaccgcaccgtcgtcgtcgtggccaatggggagatctacaaccacaagaagatccggaagcagttcaccggcaagcacaccttcaccaccggcagtgactgcgaggtcatcatccctctgtacgaggagtacggcgagaacttcgtcgacatgctggacggcgtgttcgccttcgtgctctacgacacccgcaacaagacctacatggcggcgcgcgacgccatcggcgtcaaccccctctacatcggctggggcggcgacggtcccgtctggttcgcctccgagatgaaggcgctgaacgaggactgcgtccggttcgagcacttcccgccggggcacctctactccagcgccgccgcggggttccgccgctggtacaacccggcctggttcctcgagcaggtgccagcggcgccgtacgacccgctcgtgctcagggcggccttcgagaaggcggtcgtcaagaggctcatgaccgacgtgcccttcggcgtcctcctctcgggcggcctcgactcctccctcgtcgcctccgtgaccaagcgccacctcgtcgagaccgaggcggccaagaagttcggcaccgagctccactccttcgtcgtcggactcgagggatcccctgacctgaaggccgccagagaggtcgctgactacctcggaaccgtccaccacgagttccatttcaccgtacaggacgggatcgacgcgatcgaggaggtgatctatcacgacgagacctacgacgtgacgacgatccgggccagcacgcccatgttcctgatggcgcgcaagatcaagtcgctgggcgtcaagatggtgctctcgggggagggctccgacgagctcctgggcggctacctctacttccacttcgcgcccaacaaggaggagttccacaaggagacctgccgcaaggtcaaagctctgcaccagtacgactgcctgcgcgccaacaaggcgacctcggcctggggcctcgaggtccgcgtgcagttcctcgacaaggagttcatcgacgtcgccatgggcatggaccccgaatggaaaatgtacgacaagagtctcgggcggatcgagaagtgggtcatgaggaaggcgttcgacgacgaggagcgcccgtacctgccgaagcatattctctacaggcagaaagagcagttcagcgacggtgtcggctacagctggatcgatggcctcaaggccttcaccgagcagcaggtcacggacgaaatgatgaacaacgctgccaaattgtacccctacaacacgccggtcaacaaggaggcctactactacaggatgatcttcgagaggctcttccctcaggactcggcgagggagacggtgccgtggggcccgagcatcgcgtgcagcacgcccgcggccatcgagtgggtggagcagtggaaggcctccaacgacccttccggccgcttcatctcctcccacgacgccgccaccggccacggcgccggaggcgcgcacgctaacggcaacggcgtggcggccgtggcgaacgggcacggcccggccaacggcgcggtcaacggcggcgaggtcgccgtggcgaacggtcacggcgcggcgaacgggaacgaggtcgccgtcgcgatcgcggtgtgactttgttggctcatcagggataaggacgacgagtaggttgcggcgtggcgtgtcagccggtcgccatgacatggtgcggtggcacacgtgctactagcctactattgtttttacgcggtgttgtactgtcactagcgtaagtgcgcgtgtgtgagcgagcgagcgagccatggaggcatgtgtgtgttgtgccgggttgatgtcctcgaactcgatctttctaaagacttgagctacggatcaatctaaagatgttttgtttaaaaaaaaaaaaaaaaaaaa

SEQ ID NO: 4664 - protein, 607 aa, Panicum virgatum
  misc_feature: Ceres CLONE 1807355
  misc_feature (1)..(573): SWISSPROT Homolog: EC 6.3.5.4 Asparagine synthetase [glutamine-hydrolyzing]
  misc_feature (1)..(589): SWISSPROT Homolog: EC 6.3.5.4 Asparagine synthetase [glutamine-hydrolyzing]
MCGIFAVLGCADCSQAQRARVLACSRRLRHRGPDWSGVYQHEGNFLAQQRLAVVSPLSGDQPLFNEDRTVVVVANGEIYNHKKIRKQFTGKHTFTTGSDCEVIIPLYEEYGENFVDMLDGVFAFVLYDTRNKTYMAARDAIGVNPLYIGWGGDGPVWFASEMKALNEDCVRFEHFPPGHLYSSAAAGFRRWYNPAWFLEQVPAAPYDPLVLRAAFEKAVVKRLMTDVPFGVLLSGGLDSSLVASVTKRHLVETEAAKKFGTELHSFVVGLEGSPDLKAAREVADYLGTVHHEFHFTVQDGIDAIEEVIYHDETYDVTTIRASTPMFLMARKIKSLGVKMVLSGEGSDELLGGYLYFHFAPNKEEFHKETCRKVKALHQYDCLRANKATSAWGLEVRVQFLDKEFIDVAMGMDPEWKMYDKSLGRIEKWVMRKAFDDEERPYLPKHILYRQKEQFSDGVGYSWIDGLKAFTEQQVTDEMMNNAAKLYPYNTPVNKEAYYYRMIFERLFPQDSARETVPWGPSIACSTPAAIEWVEQWKASNDPSGRFISSHDAATGHGAGGAHANGNGVAAVANGHGPANGAVNGGEVAVANGHGAANGNEVAVAIAV

SEQ ID NO: 4665 - DNA, 2122 bp, Panicum virgatum
  misc_feature: Ceres CLONE 1807387
  misc_feature: Encodes the peptide sequence at SEQ ID NO. 4666
ctagaaaggaacggcgggcaagaggctcggggcccccgcgcgccgctgtggtagcgggcggcaccagtgcaagagcgagccaagcgcatctcgcaatcctcaccttggcttccactcgggcatttcgcagctgggctctggagcgagctctcggccggcctgcaaggttggttgcatcatgcgcctcttctccatctcatctcctggcgacttctctgctgatgatggcggagggagaagtgtttttgttcccggccttttgctggtttaagaagctgaggattgggagcttttgacatgactcggtttcatccgtgattgaccgccttttatgctttttgctgagatgaaaaggctgtatgctatccatcagcacttgtctttctcctaatgcagtttgccacttgccaagcgaaggttccgtttcgtgtttcgcttccagttggaacaaggattttaatagcaattgtcttgttgctaaaataagcaagttgcatgtgttccgttttccttgccttgatgagtgagctcatctgatctcaagctccgccttctttgtcccgtgctttgtcttttggatgttcactttgacctcaccacacgcttccctgtttctgtggcgtactctcactttctctggcataagttgagtgtacagctaaactttctgggagctgcacacctctcattgcctgtaataatatatcattctaggagggttgttgtttggactcttgaagcctctgaactagctcaacaagaaaccagtccaatgggagactccaaaggaagaaaaactcttccacggctgctagatcttatccctgatgggaaagaacgggaggccagggaagcacgaggtgaaggaagatcaagaaacactggctttgggagcgaggaggacaggaagctagagcttaaactcggacttcctggtctcgtagaagaagagacggcaacggtgtcaaggcatgaagggatacagcgagagaggccagctctctctctttgttgcttccgagaaccctcaaagccgaccacaaacactactacaactggtacaaagagggtgttcttagacaccattgaggccaaaacaggaggttgtgatgagcagaaacagcaggccagagctggatgtggtaacgaactaacactggagcaaaagattgcagtggtggtgagtgagagaaaaaaaggatgctgtgccccaccatcacatgctcctccagcagcatatgtgcgcaacagaccacaggcccagggaagaggtgcttcagctccggcggtgggttggcctccaatcggatccttcaggagaaaccttgcatttggtagttcatccaaacaatcaactgggcaacaaaagggtgaagctagcacgaaggagaagctcccctgcattaagaatcctcttgtaaaaatcaacatggacgggatccccatcggaaggaaagtaaaccttgcagcctatgacagctacgagaggctgtcattggctgtcaaagagcttttccaaggttttcttgaagctcaaaaggatctatcttgtgctcagagtgggcagctaggagcagatgaaaaaatattttctcaattattgaacggaaatggtgaatatactctggtttacgaagacaatgaaggagacaggatgctggtgggagacgtgccgtggaatgtatttgtctcaactgctaaaaggctgagggttttgaggagctcggagctttcccatggtttggttggagtggcccctagaagagtaccaaattgctgaaagcctgaaacagtgacagaattctatcattcggaatgtgaggaaccaaagctggtccattccaatatcgggatggcacctattttttccccctgtagagactaatctaatgagatgaactagcatatgtcagatgcatgggaaggcactggctaccatgtaatttattgttgtaggatgtaggtaatgtcctaaagtaattctacatggttttggcattggatttttaggacagtttgcagatgaaaggcttacccatgtaaaattccttctctgttacagatttgtaatcagttctttttgtaactctacatgcaaatctaaaaaaaaaaaaaaaaaaaa

SEQ ID NO: 4666 - protein, 335 aa, Panicum virgatum
  misc_feature: Ceres CLONE 1807387
  misc_feature (1)..(286): Pfam Name: AUX_IAA Pfam Description: AUX/IAA family
MGDSKGRKTLPRLLDLIPDGKEREAREARGEGRSRNTGFGSEEDRKLELKLGLPGLVEEETATVSRHEGIQRERPALSLCCFREPSKPTTNTTTTGTKRVFLDTIEAKTGGCDEQKQQARAGCGNELTLEQKIAVVVSERKKGCCAPPSHAPPAAYVRNRPQAQGRGASAPAVGWPPIGSFRRNLAFGSSSKQSTGQQKGEASTKEKLPCIKNPLVKINMDGIPIGRKVNLAAYDSYERLSLAVKELFQGFLEAQKDLSCAQSGQLGADEKIFSQLLNGNGEYTLVYEDNEGDRMLVGDVPWNVFVSTAKRLRVLRSSELSHGLVGVAPRRVPNC

SEQ ID NO: 4667 - DNA, 2109 bp, Panicum virgatum
  misc_feature: Ceres CLONE 1807400
  misc_feature: Encodes the peptide sequence at SEQ ID NO. 4668
gcaccggcaccaccaccgcatctccaccgagagccgtgacaggcagccaaccgagaccgagcacctagctaccaggcgtcacctccctcctcctcctctctctctctctctctctctctctctctctctctctctccaccgctcggctcgcggcggggcaggcggcgtggctccgagggcggcgagcgccggtttggggacgtcggcggcggcggggggcctcgccggcggcgagctggtttgggtatgagaggggtggttacccatgcggcgccgaccaccagcgccccctgcggattcatggacggcctcctcatcttcgtcttctacctctcgcttcctatacgtggcggccgcgcccaagcgctaagcgcctcgaattgttaaccgccgccgccggccccgatcggtcggtcggcccgcatcgatcccgctcgcagctcggatcgggtcagggtcagcttcgtctcgtcgcctcgcagcatggaccagccaccgaatggcttcgccgccggaggttttttcaagcacattgatgggcaaaactcgtctcccccttctgtaattgtaatagggggagggatttcaggcattgcggctgctcgtgctttgtcgaatgcttcatttaaggtcacacttttagagtcgagggaccgacttggtggccgggtgcacactgactattcttttggatgtccaattgacatgggtgcatcttggttgcacggtgtatgcaatgagaattctttggcgccattgattaggatgcttgggcttagattgtatcgcacaagtggtgataactctgtgttgtatgaccatgatttagagagttatgccctatttgataaaaatggtcagcaagttccccaggagatagttaccaaagttggggaaacatttgagaaaattcttaaggagacagtcaaagtaagagatgaacatgcaaacgacatggctcttattcaagctatggcaatagtgtttgacaggaatccacatctgaagctggagggcctagaatatgaagtgctgcagtggtgtatatgtagactggaggcatggtttgccacagacacggataatatatctctgaagaactgggatcaggaacatgtgcttactggtggccatggtcttatggtgaatggctatgatcctgttatcaaagctctcgctcgagatcttgatattcacctcaaccacagggtcacaaagatcatacagcggtataataaggttattgtttgtgtggaagatggggcaagttttgttgcagatgctgccataataactgtccctctcggggtacttaaggcaaatattatcaagtttgaacctgagctaccaaatgagaaactttcagcaattgcggatcttggcgttggcattgagaacaagatagctctcaagttcaacactgtattttggcccaatgtagaagtactaggtagggttgccccaacatctaatgcctgtggctactttctcaaccttcacaaagccacaggaaatccagttctggtttgcatggtagctggaagatttgcatacaaaatcgagaagctatcagatgaggaatctgtaaactttgttatgtcccagctcaggaaaatgctaccagaggcaactgaaccggttcagtatctggtttcacggtggggcagtgacccaaactcactcggttcctactcgtgcgacctagtagggaaaccatctgacttgtatgaaagattctgcgctccggtgggcaacctgttttttgctggggaggccgcctgcatcgaccactctgggtcggtgcatggagcttattcttcaggcattgttgctgcagaggactgccgaaggcgtctctcgacgcagctaggcatctctgacctgttccaggtcgggaagattgttatgagggaggagatgactgaagtcatggtccccttccagatatccaggctgtaagagaagggtgttatctatttacttgtattatcctgaagcagcagaggggatgaacacttaacaatgtagctgcttcgccgaatgtgtaacattccaaactgttgtgttatcgcagcttgttgtttgatgtaaaaaaaaaaaaaaaaaaaa

SEQ ID NO: 4668 - protein, 491 aa, Panicum virgatum
  misc_feature: Ceres CLONE 1807400
  misc_feature (1)..(422): Pfam Name: Amino_oxidase Pfam Description: Flavin containing amine oxidoreductase
MDQPPNGFAAGGFFKHIDGQNSSPPSVIVIGGGISGIAAARALSNASFKVTLLESRDRLGGRVHTDYSFGCPIDMGASWLHGVCNENSLAPLIRMLGLRLYRTSGDNSVLYDHDLESYALFDKNGQQVPQEIVTKVGETFEKILKETVKVRDEHANDMALIQAMAIVFDRNPHLKLEGLEYEVLQWCICRLEAWFATDTDNISLKNWDQEHVLTGGHGLMVNGYDPVIKALARDLDIHLNHRVTKIIQRYNKVIVCVEDGASFVADAAIITVPLGVLKANIIKFEPELPNEKLSAIADLGVGIENKIALKFNTVFWPNVEVLGRVAPTSNACGYFLNLHKATGNPVLVCMVAGRFAYKIEKLSDEESVNFVMSQLRKMLPEATEPVQYLVSRWGSDPNSLGSYSCDLVGKPSDLYERFCAPVGNLFFAGEAACIDHSGSVHGAYSSGIVAAEDCRRRLSTQLGISDLFQVGKIVMREEMTEVMVPFQISRL

SEQ ID NO: 4669 - DNA, 2120 bp, Panicum virgatum
  misc_feature: Ceres CLONE 1807403
  misc_feature: Encodes the peptide sequence at SEQ ID NO. 4670
gccaattgccaaattccagggcgggggccatcgtccatccccacctcaccatccgccaccagccgctgctgctcggctgctcttccctttcccccctgccccctcccaggtcccggccgctgccgcgctcctaataattagcctagcatcagcgtcagcagcgctcgcgacgagtgaacagagccacgcttatatcaccagctgtccggctcgctccccgcaccaccccacctccccgccgactcctgccaccgcccgctggcatagcgcgtaggccgcgagaggagctccggcgggcggcaggcagcgagggatctcggcgcgcgcgcgtttgcagcgcaggcggcatgaagctcccgctgtggccggggctggcgcccgcggcggggccgcccgacgcggcgccggagccggccaagccgtcgctgccggccgcgtggctgctgctgcacgcgctcttctgcgccacctccatggccgtcgggttccgcttctcgcgcctcatcgtctacctcctcttcctcccgacgccgcccatcaacccggccgcgcagctcgtctcgctcgtgtccccgcccgtcatgctcaccgccggcaacgccacggccacgatcaccaccaccacgaccaccaccaccaccgtcaccactaccaccacggtcgccaccgagatcgggccccaccagcatcagcaccaccaccacggccccgtcttcgtggggcgccacccgatccgcgtccgctcctggccgcacccggaccccaacgagctgctcaaggcccaccgcatcctcgccgccgtccagaacgcgcagcgcagcagcaagcgccgcggcgcggggccgcccaggcccgtcattgccgtcaccccgaccaccacctccgtgctccaggtaccgtccctgacgtccctggcgcacacgctccgactcgtcgacgcccagctcatgtggatcgtcgtcgagccggggcaccgcaccgacgccgtcgccgccgtgctctcccgctccaacctcgacttcctccacatcaccggccccggcgactccaccgcgtccctgcgattgcacgccctcagggagattcgggcgaagcgaatggatgggatcgtggtgttcgccgacgagaacagcatcctccggacggagctgttcgacgaggcgcagaaggtgagcaccgtaggcgccgtgcccgtcggcatcctgggcgacgacgacggcaccagcgagtcgttcctccaggcgccgtcgtgcgacgccgcggggaagctggtgggctaccacgtgtcggaggagaccgtgctgccggcgaaccggggcgacatgctgatgtccagcaggctggagtgggccggattcgtggtgaacgcgcgcgcgctgtgggacgacgccaaggagcggcccgagtgggtgcgcgatctcggcgccatcgacgacgccgacgcccgcgccgccagcccgctcgcgctcgtcaccgaccccggccgcgtcgagccgctcgccagctgcgcccaggcggcgctcgcgtggtcgctccggtcagacagcctccacgaggtcaaattcccacacgaatggaaattcgatcctcctcagctgagtacaggttccaatgagcagagtgtcaaaccagagacgaagcaaacaactctagcgagcactgaagatcagcactagaggtcaattttttgtggacagaagtcagagcaaatcaggcagctgttgctcccaggatttgtcaaaagtctccagttccccactgatgcatccgtctatgcaccgtcgatgccaaccgctgccaaagtaacagaagccagctcagatcagcgcagctcatttctttggactctacagataaagtcaccatcagtacatgtaacttggacccttgttcatctaaatcactctgtatgaatgtatacaaatagataaatgtttaattatctgtatcttcaatcctcttcatgtagaatagcattttaggcatattgttttcgtgtaaaatagatcagagcagggacttgcggaaagtcttgtggtttgggcatgaaagcattggttgtacactcgtatgaaataatgatgatccagttttcactccaaaaaaaaaaaaaaaaaaaa

SEQ ID NO: 4670 - protein, 442 aa, Panicum virgatum
  misc_feature: Ceres CLONE 1807403
  misc_feature (1)..(241): Pfam Name: Glyco_transf_43 Pfam Description: Glycosyltransferase family 43
MKLPLWPGLAPAAGPPDAAPEPAKPSLPAAWLLLHALFCATSMAVGFRFSRLIVYLLFLPTPPINPAAQLVSLVSPPVMLTAGNATATITTTTTTTTTVTTTTTVATEIGPHQHQHHHHGPVFVGRHPIRVRSWPHPDPNELLKAHRILAAVQNAQRSSKRRGAGPPRPVIAVTPTTTSVLQVPSLTSLAHTLRLVDAQLMWIVVEPGHRTDAVAAVLSRSNLDFLHITGPGDSTASLRLHALREIRAKRMDGIVVFADENSILRTELFDEAQKVSTVGAVPVGILGDDDGTSESFLQAPSCDAAGKLVGYHVSEETVLPANRGDMLMSSRLEWAGFVVNARALWDDAKERPEWVRDLGAIDDADARAASPLALVTDPGRVEPLASCAQAALAWSLRSDSLHEVKFPHEWKFDPPQLSTGSNEQSVKPETKQTTLASTEDQH

SEQ ID NO: 4671 - DNA, 3160 bp, Panicum virgatum
  misc_feature: Ceres CLONE 1807434
  misc_feature: Encodes the peptide sequence at SEQ ID NO. 4672
tcctcgagatcgttctcccctcctccgctcccccttcctccgcgtgctgctccagccactccgcactccagatctccgaaccctaacccctcccacatgccattgcactgagcagtagccggcagcggtagccacacgccatggcgcagccccacacctgggggatcctcctcgccgtcctcgtcgccgcggccgtcgccgtcccaccggcgaccgcggcggtggcgagcatcgacctgggctccgagtggctcaaggtcgcggccgtgcacctcgccccgggccgcgtgccgatcgccgtcgccatcaacgagatgtccaagcgcaagtccccggccctcgcggcgctcgccgacggcaaccgcctcgccggcgaggaggcggccggaatcacggcgcggcacccgtccaaggtgttcgcccgcgcgcgggacctcctcgccaagcccttcccctacgtgcagtccttcgcggagtcgcacttcctcccctacgacctcgtccccgacgcgcgcggcgccgccgcggtccgcggcgacgacgggcaggtgtactccgtcgaggagatcgtcgcgatggtgctccactacgccgcgggtctcgccgatgcgcacgccggggcgcccgtacgggacgcggtggtgaccgtcccaccctacttcgggcaggccgagcgccgggcgctgacgcaggccgcacagctggctggaatcaatgtgctcgctctcatcaacgagcacgctggggcagcgcttcagtacgggattgataaggacttctccaacgcgtcgcggcatgtcatcttttacgatatgggcgccggtagcacctacgccgcgctggtgtactactcggcctacaacgccaaggagtacgggaagacagtgtctgttaaccagttccaggttaaggatgttagatggaactccaaacttggaggtgtcgaaatggaaatgcgtctggtcaactattttgccgatcaattcaataagcagctcggtaacggagttgatatccgtcagtcccccaaggcaatggctaagttgaagaagcaagttaagcgcactaaagaaattctgagtgcaaacacagctgctccgatttcagttgaatctttgtataacgatgtcgatttcaggagcaccataacacgtgagaaatttgaagagctttgtgaagatttatgggaactagctctaactccagttaaagaagtgctcgcacattctgacatgaagattgatgatatctatgctgtagaactcataggaggtgccacacgggttccgaaattgcaggccaagctgcaagagtttctgggtcggcgtgaactggataagcatcttgacgctgatgaagccattgttctgggtgcctcactgcatgctgctaacctgagtgacgggattaagttaaaccgtaaattgggtatgattgacggctctacatatgctttcatgcttgaaatagatggccccgattatgtcaaggatgaaagcattgatcaaattctggtgccacggatgaagaaaatgccaataaagatgtttaggtccatcagacataccaaggactttgatgtatctctcaactatgacaaagcctacgaactgcctccaggcattcaatcacataagtttgcagagtattcagtatcaggcctgacagatgccactgaaaagtattcaagccgcaatttatcggcacccataaaagcaaatatacatttttctttgagtagaagcggaattgtttctcttgatagagcagaagcagtgattgagataactgaatgggtagatgttccaaagaagattttgacactagagagtaacaacaccaatcagaattccccttctgaagcaggggcagctaatagtacgccagacagtaaggataatctgaattctgatagtgataataattccagcactcccattgatgagggtaatgctcaagaaactattacagagaaggtgctcaggaaaagaacatttagggtcccactgaaggttgtggaaaaaacgactggtgctggaacaattctgtcaaaggagttgtattctgaagcaaaaaataggttggaggcacttgataagaaggatgctgaacggagaaagactgctgaacttaaaaataacctagaatcgtacatatactctatgaaggaaaagctggaagaaagctcagatattttgactgtctcaactgaacaagagaggcaatcctttgcggagaaacttaatgaggtgcaggattggttatatatggacggcgaagatgctcaagcaaacgaattcaaagaacgccttgatcaacttaaggccattggcgacccgattcttttcagattgagtgaattaaaagcccgaccagcagcctgcgaaaatgcccgattgtatctttctgagctgcaaaagattgtgaagaactgggagacaaacaaaccatggcttccaaaaaagagagtagatgatgttgtaagtgaagcggagaaagtaaaaagctggttggaggagaaggaaaccctgcagaaaagtacccctgctcacagtcaacctgctttcacatctgaagaagttgttgacaaaattctggacctacaggataaggttgcgagtattaatagaattcctaaaccaaaacccaagattgaaaagaaacctacaaaagaggaagagcctgctaataaggagaaaactgcctcttcagaatctgcatccagtgagactgaatccactggaacatctcaagaatctaacgccacagaaggtgatcagtcagcatcacccgagactagtgattcagaaccacaatctcatgacgagttgtgagtacctgaatcaaccatggagagctgtagagcaggttggaaatatgcatatactccaagaaggcagtctgaggataaattttggttgctcaaatttttcccaagtttcctttggtgaccaagagacgaggctatgtaggattttaatgaacactagatgttgatctatagtttctgatcgctgtatagcagctcaggtgatgtacgttaacgcttcaaaggtgtagttcaggatcaaaaaaatgcgttgctgtactgaactcatttgattttttttatatgatgaatgctatacaaattttacgccaaaaaaaaaaaaaaaaaaaa

SEQ ID NO: 4672 - protein, 897 aa, Panicum virgatum
  misc_feature: Ceres CLONE 1807434
  misc_feature (1)..(306): Pfam Name: HSP70 Pfam Description: Hsp70 protein
MAQPHTWGILLAVLVAAAVAVPPATAAVASIDLGSEWLKVAAVHLAPGRVPIAVAINEMSKRKSPALAALADGNRLAGEEAAGITARHPSKVFARARDLLAKPFPYVQSFAESHFLPYDLVPDARGAAAVRGDDGQVYSVEEIVAMVLHYAAGLADAHAGAPVRDAVVTVPPYFGQAERRALTQAAQLAGINVLALINEHAGAALQYGIDKDFSNASRHVIFYDMGAGSTYAALVYYSAYNAKEYGKTVSVNQFQVKDVRWNSKLGGVEMEMRLVNYFADQFNKQLGNGVDIRQSPKAMAKLKKQVKRTKEILSANTAAPISVESLYNDVDFRSTITREKFEELCEDLWELALTPVKEVLAHSDMKIDDIYAVELIGGATRVPKLQAKLQEFLGRRELDKHLDADEAIVLGASLHAANLSDGIKLNRKLGMIDGSTYAFMLEIDGPDYVKDESIDQILVPRMKKMPIKMFRSIRHTKDFDVSLNYDKAYELPPGIQSHKFAEYSVSGLTDATEKYSSRNLSAPIKANIHFSLSRSGIVSLDRAEAVIEITEWVDVPKKILTLESNNTNQNSPSEAGAANSTPDSKDNLNSDSDNNSSTPIDEGNAQETITEKVLRKRTFRVPLKVVEKTTGAGTILSKELYSEAKNRLEALDKKDAERRKTAELKNNLESYIYSMKEKLEESSDILTVSTEQERQSFAEKLNEVQDWLYMDGEDAQANEFKERLDQLKAIGDPILFRLSELKARPAACENARLYLSELQKIVKNWETNKPWLPKKRVDDVVSEAEKVKSWLEEKETLQKSTPAHSQPAFTSEEVVDKILDLQDKVASINRIPKPKPKIEKKPTKEEEPANKEKTASSESASSETESTGTSQESNATEGDQSASPETSDSEPQSHDEL

SEQ ID NO: 4673 - DNA, 2058 bp, Panicum virgatum
  misc_feature: Ceres CLONE 1807461
  misc_feature: Encodes the peptide sequence at SEQ ID NO. 4674
aacacacggcggcgcggcgggaggagaggaggggagggcgcagtcgcacgacaccaccaccaccgtctctctctctctcctcgtccggctctccggccaccgccgtcgatcgaataatgcatcagcagacgacgacgccgacgcagctgcaaacaacaacgccgccgtacccgcaaaataaaattatgaggcatcagcagcggcggcggcggcaggaggaggaggcggccgccaaggccaccgaggacagccgcttcgtcttcgacgccggcaagccgcctcccttccgcatcggcgacgtccgcgccgccgtgccggcccactgctggcgcaagagctccctgcggtcgctgtcgtacgtggcaagggacgtggccgtggtggcggggctggccgtggcggcggcggcgctcgacacctgggcgctctggcccatctactgggcggcgcagggcacaatgttctgggcgctcttcgtcctcggacacgactgtgggcacgggagcttctctgacagcggcactctcaacagcgcggtggggcatctcctccactccttcatcctcgtcccctaccatggatggaggatcagccacagaacgcaccatcagaaccacggccacattgaaagggacgagtcatggcacccgatcacggagaagctttaccggcagcttgaaccacgcaccaagaagctacgcttcaccgtcccgttcccgctcctcgcattccccgtctacctatggtacaggagccccggcaagaatggatctcactttcttcccagcagcgacctgttcagccccaaggagcgggccgatgtcatgctctcaaccacctgctgctgcgtcatgctcgcatcgctgctcgccatggcgtgcgccttcggaccactccacctgctcaagctctacgccgtcccataccttgtatttgtgatgtggcttgacctggtgacgtacctgcaccaccacggcagccccgagcagcagctcccctggtaccgcggcgacgagtggagctacctgcgtggggggctcaccaccgtggaccgggactacggctggatcaacaagatccaccacgacatcggaacccatgtcatacaccacctcttcccgcagatcccgcactaccatctcgtagaagcaaccaaggctgcgaggccggtgctgggcagatactaccgggagccccagaagtccgcagggccgctgccacttcacctctttggcgtgctcctcaggagtctcagagtggatcactttgtcagcgaccacggggacgtcgtctactaccaaactgaccacaccttgcttgatcagcacccaaaacgaccataagcaaaactagtgattcgttccatctgcatgcagctggaaattaatattatattacgacgacctcaagtttaagcatgcacaaggcaaggatttatacgtacggaattaataattacatcctggtagatcgatttaggtagcatagaaaagttagtcaaataatttcagcagcaaagcaagcaaccaagcaagcgcacacacacatatatatgcatgtattgttcgttgattattgttggggtgtggacccacgcacaggcctactctggaatctgtatcattgttggggtctggactggacccaggcggaggcagcgacagcatcatgttctccatcctccatttcctgtttccggcagccggtgccgcccgcgctgagatgtgaaccatgcccaggtccgcgccgctcttctatggccgatggtggtggcggtgttgcaggggctcgtccacggcaagatacacagcaagaaagttgtctgtttctttctctttggcatttccaggtcctgactagcttttccatttgcattttgagcacattttctgatgaggtccatttcattcatatacatccttcttgttcgtcgccccagcagcaagcccgccggcctactaaatagcaagtccactgtaacaatccaaaaatttggattcaaataaagaaattttcttacacgtggcccccacgtgtcaaaaaaaaaaaaaaaaaaaa

SEQ ID NO: 4674 - protein, 408 aa, Panicum virgatum
  misc_feature: Ceres CLONE 1807461
  misc_feature (1)..(244): Pfam Name: FA_desaturase Pfam Description: Fatty acid desaturase
MHQQTTTPTQLQTTTPPYPQNKIMRHQQRRRRQEEEAAAKATEDSRFVFDAGKPPPFRIGDVRAAVPAHCWRKSSLRSLSYVARDVAVVAGLAVAAAALDTWALWPIYWAAQGTMFWALFVLGHDCGHGSFSDSGTLNSAVGHLLHSFILVPYHGWRISHRTHHQNHGHIERDESWHPITEKLYRQLEPRTKKLRFTVPFPLLAFPVYLWYRSPGKNGSHFLPSSDLFSPKERADVMLSTTCCCVMLASLLAMACAFGPLHLLKLYAVPYLVFVMWLDLVTYLHHHGSPEQQLPWYRGDEWSYLRGGLTTVDRDYGWINKIHHDIGTHVIHHLFPQIPHYHLVEATKAARPVLGRYYREPQKSAGPLPLHLFGVLLRSLRVDHFVSDHGDVVYYQTDHTLLDQHPKRP

SEQ ID NO: 4675 - DNA, 2215 bp, Panicum virgatum
  misc_feature: Ceres CLONE 1807468
  misc_feature: Encodes the peptide sequence at SEQ ID NO. 4676
agtcgccaccccccaatccgtgaattaaactagtgccgcaaaagcagagcggagaggcaggccccccaagccgccaccaccagtccaccgcttcttctcggttctgctgctggctctccctccttttccttcccttcgccagttcgcctcccgccgccgtacaaaagctgtggatagggagaggcagagagagataggggggagcaacttggggaggctggtggagagatcgagcgcaaaaagcgatttggcgctgtgttcgtcggctggaaagttctggggtttttttttcttcgtctcggggttcgttggaggattgcttggggttgattcgctgggggtttgtgttgctggctcctgtgcgtgcgggtgcggcggccatggcggggaggcggtggtagtggtggccgtgtgtttcttgatcccgtcgtgggttgtcggggagaattggtggtgctcgggagcggggtggggagagaggggattggggaaggggagagagaagagacagcctgaggtgatgtatggctcgccggtgtccaaggatctgaacctgccggtgcagccgccgatgacttcgtccgggctgcagcgctacagatcggctccgagcacgctgctcggcgaggtctgcgaggacttcctccagcccgggccgcgcgccggcagccccgaccccgtcgccgacaacgtcttctccaggttcctggccgaccaccagatcagggacaagccgccggcgccggcgccgcatgcccccgccgcggcgcacttcccggacacggccgccatggcctcccagcatcagaatcagcagcagcagcagcagcagcagatgatgttccactcccagcagcagcagatggccaccgtggagtccgggctctaccgcaccgtcagctccggcatggaggcccccacagccgccgtcgccggcgccagcagcctgatccggcagagcagctcccccgccggattcctcaatcatttgaacatggacaacgggtacgggggcatgctgcgggccggcggcatgggcgtcggcttcagaaacggcgcggccagcgcggccgccgcggccgactccccctccggcggcggcggcgggggcaggctcaagggccagctcagcttctcgtcgcggcagggctccctgatgtcgcagatctcggagatgggcagcgaggagctcggcgggagcagccccgagggcgccggcggcggccgcggctacatccccgggtacccgatgagctccgggtgggaggactcgtcgtcgctcatgtcggagagcctgtccgggatgaagcgcccgcgggattcgtcggagcccggccagagcggcctgacgcagcagttcagcctgcccaagacgtcgtcggagatggcggccatcgagaagttcctccagttccaggacgccgtgccctgcaagatccgcgccaagcgcgggtgcgccacgcacccgcgcagcatcgccgagcgggtgcggaggacaaagatcagcgagcgaatcaggaagctccaggagctcgtgcccaacatggacaagcaaaccaacacctcagacatgctggatttggccgtcgactacatcaaggatctccagaagcaggtcaaggtgctgaacgagagccgcgccagctgcacctgctcggcgagcaagcagcagcatttttccggctgaaagccccagggagacatcatcgccgtcgtcatcatttggattttggaattgttgatggggggttgcacaacgaaaccggagctctcgtttctctggactgctggagttgaggctgcagaacagtgtgagcttctgagctcctggccgggggactagctggagcgcaggagcagtggcatcatcaagtattcaagcgggtgtgggattgggggagaggcatgggaggaggggtgggggagaattgtatagtgattagttttcgctgtaacttatgctatatacaaccatcctgcacgcccatgtccaatcgcattgcatctcgccatttctgtagaaagttactgttgtgcttctgcatttgtgctgttagctgcagctgtaggatggagtagcaccatttttagaccattgtcaccccaacatcctctcgttcttgtcataagagagagagaaaactgtcgtccccaataataagagagagaaaaaactctcgtccccaataatcccgcaaccgcgagagactatttt

SEQ ID NO: 4676 - protein, 388 aa, Panicum virgatum
  misc_feature: Ceres CLONE 1807468
  misc_feature (1)..(49): Pfam Name: HLH Pfam Description: Helix-loop-helix DNA-binding domain
  misc_feature: The sequence is a functional homolog of  SEQ ID NO 174 in the  10/714,887 US patent application
  misc_feature: The sequence is a functional homolog of  SEQ ID NO 174 in the  11/435,388 US patent application
  misc_feature: The sequence is a functional homolog of  SEQ ID NO 178 in the  10/714,887 US patent application
  misc_feature: The sequence is a functional homolog of  SEQ ID NO 178 in the  11/435,388 US patent application
  misc_feature: The sequence is a functional homolog of  SEQ ID NO 180 in the  10/714,887 US patent application
  misc_feature: The sequence is a functional homolog of  SEQ ID NO 180 in the  11/435,388 US patent application
  misc_feature: The sequence is a functional homolog of  SEQ ID NO 184 in the  10/714,887 US patent application
  misc_feature: The sequence is a functional homolog of  SEQ ID NO 184 in the  11/435,388 US patent application
  misc_feature: The sequence is a functional homolog of  SEQ ID NO 186 in the  10/714,887 US patent application
  misc_feature: The sequence is a functional homolog of  SEQ ID NO 186 in the  11/435,388 US patent application
  misc_feature: The sequence is a functional homolog of  SEQ ID NO 188 in the  10/714,887 US patent application
  misc_feature: The sequence is a functional homolog of  SEQ ID NO 188 in the  11/435,388 US patent application
  misc_feature: The sequence is a functional homolog of  SEQ ID NO 190 in the  10/714,887 US patent application
  misc_feature: The sequence is a functional homolog of  SEQ ID NO 190 in the  11/435,388 US patent application
  misc_feature: The sequence is a functional homolog of  SEQ ID NO 26 in the  10/714,887 US patent application
  misc_feature: The sequence is a functional homolog of  SEQ ID NO 26 in the  11/435,388 US patent application
  misc_feature: The sequence is a functional homolog of  SEQ ID NO 392 in the  10/412,699 US patent application
  misc_feature: The sequence is a functional homolog of  SEQ ID NO 913 in the  11/479,226 US patent application
  misc_feature: The sequence is a functional homolog of  SEQ ID NO 974 in the  11/435,388 US patent application
  misc_feature: Useful for making plants with modulated growth and phenotype characteristics
MYGSPVSKDLNLPVQPPMTSSGLQRYRSAPSTLLGEVCEDFLQPGPRAGSPDPVADNVFSRFLADHQIRDKPPAPAPHAPAAAHFPDTAAMASQHQNQQQQQQQQMMFHSQQQQMATVESGLYRTVSSGMEAPTAAVAGASSLIRQSSSPAGFLNHLNMDNGYGGMLRAGGMGVGFRNGAASAAAAADSPSGGGGGGRLKGQLSFSSRQGSLMSQISEMGSEELGGSSPEGAGGGRGYIPGYPMSSGWEDSSSLMSESLSGMKRPRDSSEPGQSGLTQQFSLPKTSSEMAAIEKFLQFQDAVPCKIRAKRGCATHPRSIAERVRRTKISERIRKLQELVPNMDKQTNTSDMLDLAVDYIKDLQKQVKVLNESRASCTCSASKQQHFSG

SEQ ID NO: 4677 - DNA, 1756 bp, Panicum virgatum
  misc_feature: Ceres CLONE 1807476
  misc_feature: Encodes the peptide sequence at SEQ ID NO. 4678
gactgctaagctccgccgagcgccgccgcccgcctccgaataatgctctccgggatgctgctgccgcggctgcgctcctccacgcgcgtcctccgcaagctgtgcggattggaacccgcggcggcgcgactgctctcctccgccgacgcacccgcgcgtgataactcactcctgcaccctctccccggcctcgacctgcctccgcccctcccagacaacctgggccgcagccccacccgggtcaccacgctccccaacggcatccgcgtcgccaccgaagacgtcccgggtccttccgcgtgcatcggtttctttgttaactccggctcggtttacgagtccgccgagaccaccggcgtgtcctacttgctggagaagatggccttcaaggacaccaaccaccgcacgcaccgcaatctcgtgcatcagctcgagcttgctggaggcaacgttggtgcctcctgttccagggagcagatggtctacagctatgacacgctcaagggctacatgcccgaggccatcgagatactcgtcgactgcatgcgcaacccgctcttcctccaggaagaagtccaacgacagttggtccttgctcaagaagaactccaggacctgcacaagaaccctgagaggtttcttcatgaacagcttaaccttgtcggatattcaggtgctcttgcaaatccgctaatagctcctgaggatgctcttgccagaatcaatcacaagattattcaaaagttttatcatgaaaactataccgctgatcgtgtggttctagcagcatctggtgttgatcatgaaagcttgctaaaccatgctgaatttttgttaaatgattggcacaaggggtcccctgtggaaaaaccaaagtctacatacgtgggtggtgattccagacacagagcagattcagatatgacacatgttgcattagcttttgaagtgccagggggctggcttcaagaaagagatgctacaactatgaccgtcatacagactttaatgggtggtggtggttcattctcctctggcggtcctgggaaaggaatgcattcacggctttatctacgggtcctaaataaatatcactctgtccaatctttttcagcatttagtaatgtatatgacaatactggtctctttggcatctacttgaccacgccaccagattttgttgcaaaggctgttgatgttgcaataagtgaattgattgctgttgcaacacctggagaagtgacggaggttgaactgcaacgagctaaaaactcaacaatttcgtctgtattgatgaatcttgaatccagggtaattgttgcagaagatattggaaggcagttgttgacttatggttgcaggaagcctattgattacttccttcgatgtatggaagaaattactgtagatgatatcacaacatttgccaggaagatgttatcttcgcaacccacaatggttagctggggagatgttgacaaagttcctccatatgaatttgtttacaagcggttccagtagtgccctacacagtgatccctgatggacttgaagaatggtccattggggttttattttgaccttgtactcggccactggctcagaaactactttctttcagaagtgcaaatcattgttaggatttctgcagctacgatcatttgtaattgttcaaacagcacacagatgaaatgaatgaagttgtcagaaatgaaaattttgaagagtttgtttgtaaaaaaaaaaaaaaaaaaaa

SEQ ID NO: 4678 - protein, 492 aa, Panicum virgatum
  misc_feature: Ceres CLONE 1807476
  misc_feature (1)..(187): Pfam Name: Peptidase_M16_C Pfam Description: Peptidase M16 inactive domain
  misc_feature (1)..(147): Pfam Name: Peptidase_M16 Pfam Description: Insulinase (Peptidase family M16)
  misc_feature (9)..(492): SWISSPROT Homolog: EC 3.4.24.64 Mitochondrial-processing peptidase alpha subunit, mitochondrial precursor
MLSGMLLPRLRSSTRVLRKLCGLEPAAARLLSSADAPARDNSLLHPLPGLDLPPPLPDNLGRSPTRVTTLPNGIRVATEDVPGPSACIGFFVNSGSVYESAETTGVSYLLEKMAFKDTNHRTHRNLVHQLELAGGNVGASCSREQMVYSYDTLKGYMPEAIEILVDCMRNPLFLQEEVQRQLVLAQEELQDLHKNPERFLHEQLNLVGYSGALANPLIAPEDALARINHKIIQKFYHENYTADRVVLAASGVDHESLLNHAEFLLNDWHKGSPVEKPKSTYVGGDSRHRADSDMTHVALAFEVPGGWLQERDATTMTVIQTLMGGGGSFSSGGPGKGMHSRLYLRVLNKYHSVQSFSAFSNVYDNTGLFGIYLTTPPDFVAKAVDVAISELIAVATPGEVTEVELQRAKNSTISSVLMNLESRVIVAEDIGRQLLTYGCRKPIDYFLRCMEEITVDDITTFARKMLSSQPTMVSWGDVDKVPPYEFVYKRFQ

SEQ ID NO: 4679 - DNA, 1806 bp, Panicum virgatum
  misc_feature: Ceres CLONE 1807519
  misc_feature: Encodes the peptide sequence at SEQ ID NO. 4680
ggcgggcattgactattgagggaggggaacttgccacccaccacctcctctgctccgccgacagcgagagcccgcgagcaagcggcggctaccaccaccgcctcccaggttcccacgtccctgccatcctttttgactccgggatccccctcctccccgcctgccgaggatcccacaaccttcctactacttcccccgtaccttccgatctcgccacattcctagccgagcgtgaagtggtagggaggggagggaggcggcggcgcgggtgaggaccgatggggaaggggagcgggcgggggctggccctggcgctcgccgtgctcctcgcctgctccggcgtcgttgtcgtcacggcgcaggacaccgagcggatcgaaggaagtgctggcgatgtgctggaagataaccctgttgggaggctcaaggtctttgtctatgatctccctagcaaatacaacaagaaactgctgaagaaggaccctaggtgcctgaaccacatgtttgctgctgagatcttcatgcaccggttcctgttgtcaagcgctgttcgaacttttaatcccgaggaagcagattggttctacacacctgtatacacaacatgcgatctgactccttcgggtcttcccttgcctttcaagtctcctcgaatgatgcgtagtgcaatccagctgattgccacaaactggccttactggaatagatcagaaggcgcagatcatttctttgtcacaccacatgactttggtgcttgctttcattatcaggaagagaaagcaattgcccggggaatcctccccttgcttcagcgtgctacgctggttcaaacctttggacagaagaaccatgtctgcctgaaggatggatccattaccatacctccatttgcgcctccccagaaaatgcaaactcaccttatacccccagatacccctcgatccatcttcgtgtacttccgcggtctgttctatgacaatggcaatgatcccgaaggcggctactatgctagaggagctcgcgcgtcagtctgggagaacttcaagaacaatccgctctttgacatctcgaccgatcacccaccaacatactatgaagacatgcagcgttcagtgttctgcctgtgcccattgggctgggcaccatggagtcccaggctagtggaagcagtggtcttcggctgcatcccggtgatcatcgcagatgacatcgtcctgccctttgcggatgccatcccatgggaggagatcggtgtgttcgttgctgaggaggatgtaccgaggctggacagcatcctgacatccattcccacagatgttatactgaggaagcaacggctccttgcgaacccgtcgatgaagcaggccatgctgttcccccagcctgctcagccaggagatgcattccaccagattctaaacggacttgcacgcaagctcccacatggtgataatgtcttcttgaagcctggggagaggatcctgaactggaccgctggaccaccaggcgacctaaagccttggtagcatcttgcggatctgagatggataaaaactttctggaaaggaaatactgaggacatgatgatatagtgcaccttcgaattaccatggatgcatagtgctgaccacaagccaaatgtacattttttatatgctctttcttctatagctgttatatacacctcatatcttcttctcttcttttttttgtccctctttatccaattcattagatgatgagaatgccaggccttgtcaatcatatgtggatatatcatcataataaagtttaaagattttactc

SEQ ID NO: 4680 - protein, 415 aa, Panicum virgatum
  misc_feature: Ceres CLONE 1807519
  misc_feature: Great-hit functional homolog of the protein sequence encoded by LOCUS At1g27440
  misc_feature: Great-hit functional homolog of the protein sequence encoded by LOCUS At5g61840
  misc_feature: Useful for making plants with altered cell wall content and/or composition
MGKGSGRGLALALAVLLACSGVVVVTAQDTERIEGSAGDVLEDNPVGRLKVFVYDLPSKYNKKLLKKDPRCLNHMFAAEIFMHRFLLSSAVRTFNPEEADWFYTPVYTTCDLTPSGLPLPFKSPRMMRSAIQLIATNWPYWNRSEGADHFFVTPHDFGACFHYQEEKAIARGILPLLQRATLVQTFGQKNHVCLKDGSITIPPFAPPQKMQTHLIPPDTPRSIFVYFRGLFYDNGNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPRLDSILTSIPTDVILRKQRLLANPSMKQAMLFPQPAQPGDAFHQILNGLARKLPHGDNVFLKPGERILNWTAGPPGDLKPW

SEQ ID NO: 4681 - DNA, 2537 bp, Panicum virgatum
  misc_feature: Ceres CLONE 1807531
  misc_feature: Encodes the peptide sequence at SEQ ID NO. 4682
caggaagagcttcgcagtcctccacacaacctcccgagctcttcttcttaccaccaccaccaccgcagctcctcctcctctcttctcggtagtcgaaatggcgagcaacacggccatctgcgagagcgacccgctcaactggggcaaggcggcggcggaaatggcggggagccacctcgacgaggtgaagcgcatggtggcgcagttccgcgagcccctcgtcaagatcgagggctccagcctccgcgtcggccaggtggcggccgtggctgtggccaaggacgcgtccggcgtggccgtcgagctcgacgaggcggcgcgcccccgcgtcaaggccagcagcgagtggatcctcgactgcatcgcccacggcggcgatatctacggcgtcaccaccggcttcggcggcacgtcgcaccgccgcaccaaggacgggccggcgctccaggtcgagctgctcaggcatctcaacgccggtatcttcggcaatggttccgacggccacacgctcccgtccgaggtgtcacgcgcggccatgctcgtccgcatcaacaccctgctccagggctactccggcatccgcttcgagatcctcgaggccctcgccaagctcatcaacaccggcgtcagcccgtgcctgccgctccggggcaccatcaccgcgtccggcgacctcgtcccgctgtcctacattgccggcctcatcaccggccgccccaacgcgcaggccgtcaccgtcgacggcaggaaggtggacgccgccgaggcgttcaaagtcgccggcatcgagggcggcttcttcaagctcaaccccaaggagggcctcgccatcgtcaacggcacgtccgtcggctcggcgctcgccgccgtggtgtgcttcgacgccaacgtcctcgccgtcctgtccgaggtgctgtccgccgtcttctgcgaggtgatgaacggcaagcccgagtacacggaccacctcacccacaagctcaagcaccacccgggctccatcgaggccgccgccatcatggagcacatcctggacggcagctccttcatgaagcacgccaaggaggtgaacgccatggacccgctcctcaagcccaagcaggacaggtacgcgctccgcacgtcgccgcagtggctgggcccccagatcgaggtcatccgcgccgccaccaagtccatcgagcgcgaggtcaactcggtcaacgacaaccccgtcatcgacgtccaccgcggcaaggcgctccacggcggcaacttccagggcacccccatcggcgtgtccatggacaacgcccgcctcgccatcgccaacatcggcaagctcatgttcgcccagttctccgagctggtgaacgagttctacaacaacgggctgacctccaacctggccggcagccgcaaccccagcctggactacggcttcaagggcaccgagatcgccatggcgtcctactgctccgagctccagtacctggccaaccccatcaccaaccacgtgcagagcgcggagcagcacaaccaggacgtcaactccctcggcctcgtctccgccaggaagaccgccgaggccgttgacatcctcaagctcatgtcgtccacctacatggtcgcgctgtgccaggccgtggaccttcgccacctcgaggagaacctcaagagcgccgtcaagagctgtgtgacggcggtggcccggagggtgctgaccaccagacccgacggcgaactccacagcgcccgcttcagcgagaagtccctgctcacggccatcgaccgcgaggcggtgtacggctactacgacgacccctgcggcgccaactcgccgctgatgaagaagatccgcgccgtgctggtggaccacgccctggccaacggcgaggccgagaaggacgccagcgcgtccgtcttgtccaagatcaacaagctggaggaggagctccgcgaggcgctgcccagggagatggaggccgcccgcgtggccttcgagaccggcgcggcgccgatcgccaacaggatcgaggagagccggtcgtacccgctgtaccgcttcatccgccaggacctcggcgccgtctacctgaccggcgagaagctcaagtcccccggcgaggagtgcaacaaggtgttcctggccctcagcgagggcaagctcatcgaccccatgctcgagtgcctcaaggagtgggacggcaagcccctgcccatctgctaagctgatgctgatcaggaggaggaggaggaggagatcatcacaccgtgcgcacgcgaggaataaacaagggagggtttcagtattctgaatgcttcttattattgtttgcaactttgcagattattatatatgttgcttgtctgttcatcctttttgagcttgttactgtaatcgtgtattccgtcgtctcttgtttcttaccctcgatcgctgcaatgccattgtggcccatggctcggcactcagctttctgatctgtactctaattaatttggaagtaaaatgtaccactgtatctgagtcctctcaaaaaaaaaaaaaaaaaaaa

SEQ ID NO: 4682 - protein, 703 aa, Panicum virgatum
  misc_feature: Ceres CLONE 1807531
  misc_feature (1)..(491): Pfam Name: PAL Pfam Description: Phenylalanine and histidine ammonia-lyase
  misc_feature (1)..(702): SWISSPROT Homolog: EC 4.3.1.5 Phenylalanine ammonia-lyase
  misc_feature (10)..(703): SWISSPROT Homolog: EC 4.3.1.5 Phenylalanine ammonia-lyase
MASNTAICESDPLNWGKAAAEMAGSHLDEVKRMVAQFREPLVKIEGSSLRVGQVAAVAVAKDASGVAVELDEAARPRVKASSEWILDCIAHGGDIYGVTTGFGGTSHRRTKDGPALQVELLRHLNAGIFGNGSDGHTLPSEVSRAAMLVRINTLLQGYSGIRFEILEALAKLINTGVSPCLPLRGTITASGDLVPLSYIAGLITGRPNAQAVTVDGRKVDAAEAFKVAGIEGGFFKLNPKEGLAIVNGTSVGSALAAVVCFDANVLAVLSEVLSAVFCEVMNGKPEYTDHLTHKLKHHPGSIEAAAIMEHILDGSSFMKHAKEVNAMDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLANPITNHVQSAEQHNQDVNSLGLVSARKTAEAVDILKLMSSTYMVALCQAVDLRHLEENLKSAVKSCVTAVARRVLTTRPDGELHSARFSEKSLLTAIDREAVYGYYDDPCGANSPLMKKIRAVLVDHALANGEAEKDASASVLSKINKLEEELREALPREMEAARVAFETGAAPIANRIEESRSYPLYRFIRQDLGAVYLTGEKLKSPGEECNKVFLALSEGKLIDPMLECLKEWDGKPLPIC

SEQ ID NO: 4683 - DNA, 2335 bp, Panicum virgatum
  misc_feature: Ceres CLONE 1807556
  misc_feature: Encodes the peptide sequence at SEQ ID NO. 4684
ggacggcccccagagaggcagaggctggcagagaagtaccctggcgcctgccgcctggccaccggcacggcagtccgccccgcgacaccgccaccgggctcgctgcccaacccctctttcttcccgccggaaatcaatctctctccaccggccaccaccgcgatccccgagccgaccgtccgcatccaatgctcgaaaccctagcggccgccccacgccctcaccggccaccgcaaccataagccccccgatccccacctcgcatgctcgtcaccccctgctccttcctatccatcgcgcggaacaccgcccgcctccgctttctcctcgccgcttccgctgctcgcgccgcccgcctcgccatgtcgaccgcgccgcaggcggcggcggcggctgtctccgtcgagtacgccaagtcgggccgctccacctgcaaggggtgcagcggggccatcgcctccggggcgctccgcctcggcgcctccacgcccgacccccgcggcttcgacgccaccaagtggtaccacgtcgcctgcttcccctccgacgcgtcccacccgctcggccccgtcgagagcatcaatgggttcgactccattaaggaagccgatcgagaggaattgcatgagctagtgaagaatcgcgagagggaccagactgcagaaccaagtccaaagaaagcaaagactcagatgtcgtccccttcagagggggtgtcagataaggcaagtgtctctgttgagtatgcgaagtctggccgctctacatgtaaaggctgcagtaagaatattgccaaaggcgccctccgccttggtgcctcttttcatgatccccgcggctttgaaaataccaagtggtaccatgttgcatgcttccctacagcatcataccctgtatttcctgtggagaatctgaaggggtttgattcaattgaggatcatgatcgtgagaaactgcaggagttagtggagaatcacaagagcataggggactctaatgaagttactgaaaagaatccagaagaattaaagaatcgtgataataaggtagacaagacagtcaatccattggatgagcctagtccaaagaaagtaaagactcacatgtcttcatccatgaaggcggtgtctgaaaaggcaagtgtcttggttgagtacgcaaagtctggtcgctccacctgcaagggatgcagtgagaatattgccaaaggcgccctccgcctcggtgcttctgctcatgatccgcgcggttatgacagcaccaaatggtaccatgttgcatgcttccctacctcatcatacccaatatttcctgtggagaatcttaaggggtttgattctgtcaagaataatgaccgtgagaagttgctggagttgggtgagaattacaagagagatggcaatgcagctgatcagtcgagtgagccaagcctgaaggaagaaatggttgacagcacgaggatctctaaagaaggttctgaaaataatctggaagaagtaaagttgtctgcagggaacaatagaatgcgcccagtgatatccttttcagtttctgataccaataaagattacaagggtgctacacttcccgctcattggaaggcttttgagacagttatcttccgtgaacaggaagatggccttcatgcttcagctaagattgctgcatttgactttgatgggtgccttgccaaaacttctgtgaggatcattggtgcagacaagtggtctttacagtataaatcaattccaaaaatattgcaaagtctgtacaatgatggttacaaactggtcatattcaccaatgagtcgaacattgatcgctggaagaataagcggcaggaagctgttgactccaaagttggacgactcgataactttattgagtgtgttaaagtccctatgcaggttttcattgcttgtggtttagggcaaggaaaaggtactccagatgatccataccgcaaaccaaatcctggaatgtggtggttgatggctcagcatttcaattccggaattgaaatcgacatggacaaatctttttatgttggtgatgctgccgggagagaaaaagatcatagcgatgctgatataaaatttgctgaggccatcggtttgaagtttcacgttcctgaggaatacttcggtccctaggagttctgaggtgaggtcgattagggcaaggtggttatgctatgattgtatgtagtttttgggtgttgagaatactaaagctaacctgatgtggaaatctgtatttggctgtttaaacagtctaataatatcgcagctaatctgatgtcgagatgtagtgcggaaaaaaaaaaaaaaaaaaa

SEQ ID NO: 4684 - protein, 629 aa, Panicum virgatum
  misc_feature: Ceres CLONE 1807556
  misc_feature (1)..(163): Pfam Name: PNK3P Pfam Description: Polynucleotide kinase 3 phosphatase
MLVTPCSFLSIARNTARLRFLLAASAARAARLAMSTAPQAAAAAVSVEYAKSGRSTCKGCSGAIASGALRLGASTPDPRGFDATKWYHVACFPSDASHPLGPVESINGFDSIKEADREELHELVKNRERDQTAEPSPKKAKTQMSSPSEGVSDKASVSVEYAKSGRSTCKGCSKNIAKGALRLGASFHDPRGFENTKWYHVACFPTASYPVFPVENLKGFDSIEDHDREKLQELVENHKSIGDSNEVTEKNPEELKNRDNKVDKTVNPLDEPSPKKVKTHMSSSMKAVSEKASVLVEYAKSGRSTCKGCSENIAKGALRLGASAHDPRGYDSTKWYHVACFPTSSYPIFPVENLKGFDSVKNNDREKLLELGENYKRDGNAADQSSEPSLKEEMVDSTRISKEGSENNLEEVKLSAGNNRMRPVISFSVSDTNKDYKGATLPAHWKAFETVIFREQEDGLHASAKIAAFDFDGCLAKTSVRIIGADKWSLQYKSIPKILQSLYNDGYKLVIFTNESNIDRWKNKRQEAVDSKVGRLDNFIECVKVPMQVFIACGLGQGKGTPDDPYRKPNPGMWWLMAQHFNSGIEIDMDKSFYVGDAAGREKDHSDADIKFAEAIGLKFHVPEEYFGP

SEQ ID NO: 4685 - DNA, 2396 bp, Panicum virgatum
  misc_feature: Ceres CLONE 1807557
  misc_feature: Encodes the peptide sequence at SEQ ID NO. 4686
gtcctccccctccccattcggtttcgcttcggggtgaggcgccggtttctgccgcccacggaattccctgcggcttcccgcctggttccttccttcccacggatccgagctcgccatcctcttcgtcctcctctccgctcggttgaccgacgcggagtgggggggtccaaccaggccttttcgttgatttgagactcacaccggatacttccttatggcatctgacatgcaaccacttagtggccatgagataccctcccatgttgtggagaactgtggagtttctgatcatgcatgtcatggcaaatgccaaagctgtgatagcgatgtaaaaccatcttgtgctgaagtgaatggaatttccttgttgattggtagtcatactgatgggaaggcttcaaaagagaaatgtggagcatgcacttttacttatgattgcgctggtcctgatggctgtttgattgccacaaatggaagttgcatggctgttgatgagctaacacagcagtttgagagagaacaagctggggctgcactagaggatctggttttctctaacgatgaagaggaagatgacagtgactgggaccctgctagtggccttgttatgaataggtggttttgcttgaattgcacagtgccaaatgtggacgaggttatgtattgcctgaattgccatgagcttaagggattaggagtagatggatatgatgctttcaaaactcaaattgcagaggcagctttggtatctcctgacacagaattgccggaggtgtctacagcgattggttttgatgaaagaatgctgctccacagtgagctagaagttaaaccaaatccacatccagaaagaccggaccgccttcgtgcaattgctgccagtctttctgctgcaggaatctttccctcaaaatgtgctttggtaccccctagggaaattaccaaggaggaactcctaatggttcatactccagaccacattgaaagtgttgagcagacaaagaacatgctttacagttacttcacttcggatacttatgcaaatggacactcagcatgtgccgccaaacttgcagcaggactctgtgctgatcttgctagtttgatagtatctgggcgtgttcaaaatggctttgcaatggtgagacctcctggacatcatgcaggggtgaagcaagcaatgggtttttgtcttcacaacaatgcagcagtggctgcgttagctgcaaaaagaacaggtgccaagaaagtcctcatagttgactgggatgtgcaccatggaaatggcacacaagagatattcgaaggggacaaatctgtcttgtacgtatcgttgcatcgtcatgagtatggaaacttctaccctggaactggagcagcacatgaggttggaattcatgatggtcaaggtttctcagttaatataccttggagctgtagcggtgttggagacaatgactacatctttgcttttaagactgtggtgcttccaatagaatttgctccagacatcacaataatatctgcaggattcgatgcagctagaggtgaccctctgggttgttgtgatgtcactccgacgggatactctataatgacatccttgttaactgcttgctcagggggaagattgttggttatacttgagggaggatacaatcttcggtcgatatcctcatcagctactgaagttgttaaggtcttagttggggacggttcaagttttgatgttgcaactgcaccatcaaaagagggcttggagactattttacaagtcctgaagattcagcaacaattttggccaattttaggttcaacctatgcatcactgcaggcacatgaggggtcggttttttccaaatctactaacaagaaaaggaagcattcaggagggccagggcccttctggtggaagtttggaagcaaaaggctactgtacaaagcactctatgagggcccccttctgaggaagatcaagggcttcggacaaggaaaagcaattgattcggcagatccttagatgatgccggacatgaacagcatagttgtctgactggggttcctaaagcagtagtttgcatttacctagagccgaattttgactggtttcttgaatggtggtcgaccattttagatgaagtttgacagcaaccctgttttgttgacgtgtggtgtttcagccgatgtatcatcttaccctgttttttggctggttcgtaccatactagattttagcctccaggcttcagcgttagcagcattgcctgattggagtttgcattcccgttgggttattagaatgccattgatgtatgtagcagatcctctattggaataccttgaagattttgaatgcgcatctcagtatttagctccaaaaaaaaaaaaaaaaaaaa

SEQ ID NO: 4686 - protein, 601 aa, Panicum virgatum
  misc_feature: Ceres CLONE 1807557
  misc_feature (1)..(267): Pfam Name: Hist_deacetyl Pfam Description: Histone deacetylase domain
MASDMQPLSGHEIPSHVVENCGVSDHACHGKCQSCDSDVKPSCAEVNGISLLIGSHTDGKASKEKCGACTFTYDCAGPDGCLIATNGSCMAVDELTQQFEREQAGAALEDLVFSNDEEEDDSDWDPASGLVMNRWFCLNCTVPNVDEVMYCLNCHELKGLGVDGYDAFKTQIAEAALVSPDTELPEVSTAIGFDERMLLHSELEVKPNPHPERPDRLRAIAASLSAAGIFPSKCALVPPREITKEELLMVHTPDHIESVEQTKNMLYSYFTSDTYANGHSACAAKLAAGLCADLASLIVSGRVQNGFAMVRPPGHHAGVKQAMGFCLHNNAAVAALAAKRTGAKKVLIVDWDVHHGNGTQEIFEGDKSVLYVSLHRHEYGNFYPGTGAAHEVGIHDGQGFSVNIPWSCSGVGDNDYIFAFKTVVLPIEFAPDITIISAGFDAARGDPLGCCDVTPTGYSIMTSLLTACSGGRLLVILEGGYNLRSISSSATEVVKVLVGDGSSFDVATAPSKEGLETILQVLKIQQQFWPILGSTYASLQAHEGSVFSKSTNKKRKHSGGPGPFWWKFGSKRLLYKALYEGPLLRKIKGFGQGKAIDSADP

SEQ ID NO: 4687 - DNA, 1822 bp, Panicum virgatum
  misc_feature: Ceres CLONE 1807574
  misc_feature: Encodes the peptide sequence at SEQ ID NO. 4688
ataccacacaagcgccgaagcgcgcgtgccaacaacaagcgaagcctgccgacgagtgccggcagcccggcacctccaatactctccctgagcgccataaggatagacatggctgccgccgtcgccgccgtctccctcctgctgttcctctccgcccagggcgcggctcccgttcttggcttcacgaggggggacttccccgaggatttcgtcttcggatccgctacctctgcttatcagtatgagggtgctgttgcagaggatggcaggagcccaagcatctgggataccttcactcacgcagggagaatgccggacaaaagcaatggcgatatagccaccgacgggtatcacaagtacaaggatgatgtcaagctcgtaactgacactaacctggaggcttatagattctccatctcctggtccaggcttataccaaaaggaaggggaactgtcaatccaaaagggttagagtactacaacaatcttatagatgaactagtgagacatggtgttcaagtccacgttatgatgtaccagctggatctccctcaggttttggaagacgagtatggtggatggttaaaccccagaattgtggaggatttcacagcatatgcagacgtgtgcttcaaggagttcggtgatagggtttcgtactggactactctggatgaagtcaatgtcgcagcagtcgggtcgtatgatattggacaaatcccacctgcgcgatgttctgatccattcggagtaacaaaatgtacagtggggaactcaagtgtggaaccatatatagcagctcataacatgttattggcacatgcatcagctaccagactgtacagagcaaaatatcaagctgtgcaaaaaggagttgttggcataaatatatacacaatgtggccatacccattaacaaactccactgccgatttagaagcaactcaaagatttcgggacttctattttggctggatagtagaacccttggtgtttggagattatccacaggcagtgaagaagaatgttggttctcgccttccatcgttcacaaaagtacaatctgaagccatcaggggtactctagacttcattggaataaatcactattattctttctatgtgaacgaccgcccgttagaaataggcatccgcgacttcgcactggacatctctgctgagtatagaggttcgagaacagatccacccattggtcagcacgccccaacatccattccggctgatcccaaaggattgcaacttttggtggagtacctgaataaagcctacgggaatcttcccgtttatatccaagagacaggctatgcgaccaaaaatggtagtctccatgatactgacagggtcgattacatgaagaaccacataaggagcacattgactgcactaaggaacggagccaatgtgaaaggctacttcgcgtggtgcttcatggacgtcttcgagtaccttacaggattcaagtcgcagtacggcctgtaccgcgtcgacttcaaggaccaggcgcttccaaggcaagctaggctctctgctcgctggtactccgaattcctcaggaacaaggagatccagatccgtgaagagaatgagctagacgatgcaggatcgcacgctcagcaatgactcgtgtagttcactgcggtgatttatcatttctcaacatactatggcagccttcggaagaagaaccatattttatttaagtaaaataaaaactggcactctggcaggagttttaccagatttgcgttaataaagaagcaggggacttaccagattgcgttaaaaaaaaaaaaaaaaaaaa

SEQ ID NO: 4688 - protein, 510 aa, Panicum virgatum
  misc_feature: Ceres CLONE 1807574
  misc_feature: Great-hit functional homolog of the protein sequence encoded by LOCUS At1g02850
  misc_feature (1)..(227): Pfam Name: Glyco_hydro_1 Pfam Description: Glycosyl hydrolase family 1
  misc_feature: Useful for making plants with altered cell wall content and/or composition
MAAAVAAVSLLLFLSAQGAAPVLGFTRGDFPEDFVFGSATSAYQYEGAVAEDGRSPSIWDTFTHAGRMPDKSNGDIATDGYHKYKDDVKLVTDTNLEAYRFSISWSRLIPKGRGTVNPKGLEYYNNLIDELVRHGVQVHVMMYQLDLPQVLEDEYGGWLNPRIVEDFTAYADVCFKEFGDRVSYWTTLDEVNVAAVGSYDIGQIPPARCSDPFGVTKCTVGNSSVEPYIAAHNMLLAHASATRLYRAKYQAVQKGVVGINIYTMWPYPLTNSTADLEATQRFRDFYFGWIVEPLVFGDYPQAVKKNVGSRLPSFTKVQSEAIRGTLDFIGINHYYSFYVNDRPLEIGIRDFALDISAEYRGSRTDPPIGQHAPTSIPADPKGLQLLVEYLNKAYGNLPVYIQETGYATKNGSLHDTDRVDYMKNHIRSTLTALRNGANVKGYFAWCFMDVFEYLTGFKSQYGLYRVDFKDQALPRQARLSARWYSEFLRNKEIQIREENELDDAGSHAQQ

SEQ ID NO: 4689 - DNA, 3156 bp, Panicum virgatum
  misc_feature: Ceres CLONE 1807595
  misc_feature: Encodes the peptide sequence at SEQ ID NO. 4690
gttaaactgccaaggggtgacagtgtgtatcctaggagcaactggcctaaattcagctgaggaaaaaagaagtactggttcaaggattgggcagcggctttgagccggatacagttgcctgtgaggctaacgaaatggattctcacaacggggaggctgatgacttgcctcctccacctcctctaaatgcgtgcattgaacctcttaaatctgaggaaacaaagaagctgttgaaacctaagagggctctgatccctaggaaaggttttggcaaaaaggggcagcaaataaggcttgtaacaaaccacttcaaagtttctctgaagaacactgacgaatttttctatcactactacgtgaatttgaaatacgaagatgatacacctgttggcaagggagccggcaggagtgtgattgagaaacttcagcaaacctatgccactgaacttgcaaacaaagattttgcgtatgatggtgagaagagcctgttcacaattggtgctcttcctcaaaatattaacgagttcactgttgtggtggaagatgtttcaactggaaagactcctgcaaatggcagccctggcaatgacagtccacctggaagtgacaggaaaagggtcagaaggccttacaatacaaagacgtacaaagttgagctgtctttcgcagcaaaaattcctatgaatgcaatcgcacatgctttgaaaggtcaggaatcagagcatactcaggaagcgattcgagtgattgatattattctgaggcagcactcggcaaaccagggttgcctcttggttcgtcaatcattcttccataacaatccttccaactttgttgagcttggaggtggtgtaatgggctgtagaggattccattccagtttccgtgccacacagagtggactttcactaaacattgatgtgtcaacaacaatgatagtacaacctggtcctgtcattaattttctacttgccaaccagaaggttgacaatccaaacaagattgactggcaaaaggcaaagcgctcattgaagaacttgaggataaaaataaccccaacgaatgctgtgaacaagattgttggtctgagtgacaggccttgcagagaaacaatgtttacactaaagcgtagaaatgatgacaatggtgactctgaagagatcagtgtttatgatcacttcgtaaagaaccgtggcatagagctcaaatactctgctgactttccttgtatcaacgtgggaaaacaaaagcggccatcttattttccaatagagctctgtacgcttgtgtctttacaaagatacaccaagtcattgactacacttcagaggtcttcacttgttgagaagtctaggcagaaaccccaagaaaggatgtctgtgctatctgatgtactgaaacgcagcaactacgattcagagcctatgctaaaggcatgtggcatttcaattgctaaaagtttcactgaggttgatggtagggtgctgcaagcccccaagctcaaagctggtaatggagaagacatttttacacgcaatgggagatggaacttcaacaataagaggctcattaaagctagcagtgttgacaaatgggcagcagtcaacttttctgcacgctgcaatgtcagggaccttgtccgagatctcatcaagtgtggtggcatgaagggaattaacgtagaaccaccttttgatgcatttgaagagaatccttcaatgaggcgggcacctgctgtaagaagggtggaggaaatgtttgaacaagtgaaaacaaagctgccaggagcacccaagtttcttttgtgtattcttgctgagaggaagaattctgatatttatggaccttggaagaagaaatgccttgctgaatttgggattgttacacagtgtgtggcaccaccaccaagagttaatgatcagtaccttaccaacgtcctgctcaagataaatgcaaagctgggtggcttaaattcaatactccaagttgaatcatcccctgcaatgcctcttatatccaaggtcccaactatgattttgggaatggatgtgtcccacggttctcctggacagtctggtgtaccttccattgctgctgttgtcagttctcgtgaatggcctcttatctcaaaatatagagcatcagtgcgctctcaatcagctaagatggaaatgattgactcgttgtttaagccacagggaacagatgataacggcctcattcgggagtgtctgattgacttctacaccagttctgggaagagaaagccagatcaaatcattatcttcagggatggcgttagcgagagtcagtttagtcaggtgctgaacattgagttggaccaaataattgaggcatgcaagtttttggatgaaaaatgggaccccaagttcacattgattgttgcccagaagaatcatcatacgaaatttttcatccctggggcaccagataatgttcctcctggtactgtggtggacaacaaagtctgccatccaaggaactatgacttctacatgtgttcgcatgctggaatgataggaactacgagacctacacattatcacatccttcatgatgagataggcttcaaccctgatgaccttcaggagctggtgcactcactttcttatgtgtaccaaaggagtacaacagccatctcagttgttgctcccatctgctatgcacatcttgctgctgcccaggtcggacaattcataaagttcgatgagatgtcggagacatcctcaagccatggagagcacacatcggcaggcagtgtccctgtgcaggagctgccgcgcctccacgacaaggtcaggagctccatgttcttctgctgagctgcacatgctccggtgctttctgggtggttggcgtatgccatttgccatgttgcttttggtggatgtttatgaaccttggtagtttggtgacatcggtggtgacatgacatcgggtggcttgatgcccctaaaatgttttcgagactcaggaagaaccatgttgctttttggtggatgtttcagaaccatggtagttaattaagtaggtgacatggggtggcatgatcaatcccctaaactggttacgtgacttcggcagacttaaacttgttagaatgtggttgatcgccaaaaaaaaaaaaaaaaaaaa

SEQ ID NO: 4690 - protein, 902 aa, Panicum virgatum
  misc_feature: Ceres CLONE 1807595
  misc_feature: The sequence is a functional homolog of  SEQ ID NO 2 in the  11/375,241 US patent application
  misc_feature: The sequence is a functional homolog of  SEQ ID NO 2562 in the  10/374,780 US patent application
  misc_feature: Useful for making plants with modulated growth and phenotype characteristics
MDSHNGEADDLPPPPPLNACIEPLKSEETKKLLKPKRALIPRKGFGKKGQQIRLVTNHFKVSLKNTDEFFYHYYVNLKYEDDTPVGKGAGRSVIEKLQQTYATELANKDFAYDGEKSLFTIGALPQNINEFTVVVEDVSTGKTPANGSPGNDSPPGSDRKRVRRPYNTKTYKVELSFAAKIPMNAIAHALKGQESEHTQEAIRVIDIILRQHSANQGCLLVRQSFFHNNPSNFVELGGGVMGCRGFHSSFRATQSGLSLNIDVSTTMIVQPGPVINFLLANQKVDNPNKIDWQKAKRSLKNLRIKITPTNAVNKIVGLSDRPCRETMFTLKRRNDDNGDSEEISVYDHFVKNRGIELKYSADFPCINVGKQKRPSYFPIELCTLVSLQRYTKSLTTLQRSSLVEKSRQKPQERMSVLSDVLKRSNYDSEPMLKACGISIAKSFTEVDGRVLQAPKLKAGNGEDIFTRNGRWNFNNKRLIKASSVDKWAAVNFSARCNVRDLVRDLIKCGGMKGINVEPPFDAFEENPSMRRAPAVRRVEEMFEQVKTKLPGAPKFLLCILAERKNSDIYGPWKKKCLAEFGIVTQCVAPPPRVNDQYLTNVLLKINAKLGGLNSILQVESSPAMPLISKVPTMILGMDVSHGSPGQSGVPSIAAVVSSREWPLISKYRASVRSQSAKMEMIDSLFKPQGTDDNGLIRECLIDFYTSSGKRKPDQIIIFRDGVSESQFSQVLNIELDQIIEACKFLDEKWDPKFTLIVAQKNHHTKFFIPGAPDNVPPGTVVDNKVCHPRNYDFYMCSHAGMIGTTRPTHYHILHDEIGFNPDDLQELVHSLSYVYQRSTTAISVVAPICYAHLAAAQVGQFIKFDEMSETSSSHGEHTSAGSVPVQELPRLHDKVRSSMFFC

SEQ ID NO: 4691 - DNA, 1952 bp, Panicum virgatum
  misc_feature: Ceres CLONE 1807648
  misc_feature: Encodes the peptide sequence at SEQ ID NO. 4692
cccgctcccccctcccttctccacaagtcgggaggcggcagcgctctctccacaaagcccccgctcccacgcgcgcgccgccctcgccgccggggaggcggtgctcaggcggactccggaccgcgccgccctcttcctccgccacctcgagggattcctcgtcccgtgccctggccgtggcggggccgccggccagctgacggcaccccccccgccgtggcgcgccgcctctgcttccaaacggcggcacttcgctgatttgactttcaagcaccagttatgcaaagggacaccagctctagcgatgcttctgcttctcacacagggcgtgttagacgtcggagacagccaagtgaggctaccgcggatgggaatagagctaatggacagccattgcttgtcaatgatcggaacaagtataaatcaatgcttatccgtacatattcaacagtatggatgattggaggctttgcctcgattgtttacatgggtcatctatatatctgggccatggttgttgtgattcaaatatacatggcaagagagcttttcaacctactcagaaaatccagtgaagaaaaacaactgccagggttccgactgctgaattggcacttctttttcacggcgatgctgtacacttatgggcgctttcttagtcggcagcttgtgaatacagtaacttcagatcacttactgtataaggtcgtcagcggcctaataaagtaccagatgtttatttgctattttctttatattgcagggtttgtatggtttattttgactctgaagaaaaagacatacaagtaccaattcaaacagtatgcgtggacgcacatgatacttttaacagtttttgcacagtcctcgttcactgtggcaaacatatttgaagggattttctggtttcttctgcctgcttcactcattgtgatcaatgatatctttgcttatttattcgggttctttcttgggagaacaccactaatcaagttgtccccaaagaaaacttgggaaggttttattggtgcatcagtgacaactatcatctctgcatttctgttggcaaatgtaatgggccattcccgatggttgacatgccccagaaaggatctgtcaactggatggctttattgcgatcctggtccaatgtttaagccagagcattactcgttgggagaatgggtagcacactggttcccatggaaagaagttgccattatgccggtgcagtggcatgctttagccctaggtctgtttgcatcaataatagcaccatttggaggtttttttgcaagtggcttcaagagggcttttaagataaaggattttggtgacagcatacctgggcatggggggattactgacagaatggattgtcaaatggttatggcagtgtttgcgtacatataccaccaatcattcattgcgccccagaatttctctgttgagataatcttggatcagattataagaaacctaacctatgaggagcaaaaatacttgtacaagcagcttggcgaaatcttccatgagaggcagatgcaaagctgagttaatgtgcttatgagaagcatgatgtgttgtgtatttaagccttcggctcattctgtagctctagattcgtgtatagcagcattgctctaatgcacaatgatatagcgatgccttgtttaaaccattgtacagaatggtagaaaggagagaatgaatggcttttaggtgctttattcgctctccactgacgctgccttatgcagtttatcatatatgccgtgctaattatattcccttatcatcttttcttccctcttatattgtgaccagggacctggaaagctgtattcttgcttatcacttagtggtcctgattccggaccaaatgttcgaggatgcatagaataagaagggagcagagcaaattcttatttcaaaaaaaaaaaaaaaaaaaa

SEQ ID NO: 4692 - protein, 424 aa, Panicum virgatum
  misc_feature: Ceres CLONE 1807648
  misc_feature (2)..(332): Pfam Name: CTP_transf_1 Pfam Description: Cytidylyltransferase family
  misc_feature (1)..(420): SWISSPROT Homolog: EC 2.7.7.41 Phosphatidate cytidylyltransferase
  misc_feature (2)..(420): SWISSPROT Homolog: EC 2.7.7.41 Phosphatidate cytidylyltransferase
MQRDTSSSDASASHTGRVRRRRQPSEATADGNRANGQPLLVNDRNKYKSMLIRTYSTVWMIGGFASIVYMGHLYIWAMVVVIQIYMARELFNLLRKSSEEKQLPGFRLLNWHFFFTAMLYTYGRFLSRQLVNTVTSDHLLYKVVSGLIKYQMFICYFLYIAGFVWFILTLKKKTYKYQFKQYAWTHMILLTVFAQSSFTVANIFEGIFWFLLPASLIVINDIFAYLFGFFLGRTPLIKLSPKKTWEGFIGASVTTIISAFLLANVMGHSRWLTCPRKDLSTGWLYCDPGPMFKPEHYSLGEWVAHWFPWKEVAIMPVQWHALALGLFASIIAPFGGFFASGFKRAFKIKDFGDSIPGHGGITDRMDCQMVMAVFAYIYHQSFIAPQNFSVEIILDQIIRNLTYEEQKYLYKQLGEIFHERQMQS

SEQ ID NO: 4693 - DNA, 2121 bp, Panicum virgatum
  misc_feature: Ceres CLONE 1807674
  misc_feature: Encodes the peptide sequence at SEQ ID NO. 4694
gatatagagggggggcgaagtggtcgggcacctagctactagcttcctaccaattttttccttgggtaaagcgtgcacttgcagagagagaaatccagagctaaaagcgcttctttaatttagctcggttcgctcctgctttctctctccaacccatcccctcgctccaacatacaccacacaaaaaccaacaaagcgggcgagtgatcgggcagggcaagcggcaggaaataaatttcagcaaagctagaggcctccgatcagtaggagctcatgggtgccatgatggcgtccataaccagcgagctcctcttcttcctccccttcatcctgctggccctcctcaccttctacacgaccgccgccgcccaatgccacggcgcccgccagtggcggccgacgaagaagaagcggccgaacctgccgccgggcgcccccgggtggcccctggtcggcgagaccttcggctacctccgcccccacccggccacctccgtcggccgcttcatggagcagcatgtcgcacggtacgggaagatataccggtcgagcctgttcggggagcggacggtggtgtcggcggacgcggggctgaaccggtacatcctgcagaacgaggggcggctgttcgagtgcagctacccgcgcagcatcggcggcatcctgggcaagtggtcgatgctggtgctcgtcggcgacgcgcaccgcgagatgcgcgccatctcgctcaacttcctcagctccgtccgcctccgcgccgtgctgctcccggaggtcgagcgccacaccctgctggtgctccgctcctggtgcggctccgccggcggcggcggcggcgcctgctgcttctccgcccagcacgaggccaagaagttcacttttaacctgatggccaagaacataatgagcatggaccccggcgaggaggagacggagcggctgcggctcgagtacatcaccttcatgaagggcgtcgtgtccgcgccgctcaacttcccgggcacggcctactggaaggcgctcaagtcacgcgcgtccatacttggtgtaatagagaggaaaatggaggataggcttcagaagatgagcaaggagaactcaagtgtagaggaagatgatcttcttggatgggcgctgaagcaatccaatctctcaaaggaacagatcctggacctcttgctgagcctgctctttgccggacatgagacgtcgtcaatggcgctggccctcgccatcttctttcttgaaggatgccctaaggctgtccaagaactccgggaagagcatctcgagattgctaggagacaaaggcttcgcggggcgtccaaattgagctgggaagactacaaggagatggttttcacgcaatgtgttataaatgagacattgcggcttggcaacgttgtcaggttcctgcaccggaaggtcatccgagacgtgcactacaatgggtacgacataccaaggggatggaaaattctgccggtgttagcggcagtgcatctggattcgtcgttgtacgaggaccccaatcagttcaacccttggagatggaagagcaacgcgccgagcagcttcatgccgtacggcggcgggccgcggctgtgcgccgggtcggagctggccaaactggagatcgccatcttcctgcaccacctggtgctcaacttccggtgggagctggcggagccggaccaggccttcgtctaccccttcgtcgacttccccaagggcctgccgatcagggtacagaggatcgccggcgagcacagcgttttgaccgagagcacagcaatgtagcggcacggcaccgtgtctagctgggagtataggggatcgtacaattttttgtttcgttttggggtttggtgttcatgtagatgtgatggtaaagaagaagataggagaaggattatgttgtgtacagacagagtaaagaagagggggagaggatggtgggtgcaaaatatttgggtaggtagaacgtactagtagggttgtaagactgtctccaacagcagggacccaaacaaaagacccattccacactttgggtcatgtacagtaagagggtcacccacccaaatctttcttctccaacaaaaaaaaaaaaaaaaaaaa

SEQ ID NO: 4694 - protein, 508 aa, Panicum virgatum
  misc_feature: Ceres CLONE 1807674
  misc_feature: Great-hit functional homolog of the protein sequence given in SEQ ID NO 9177
  misc_feature: Useful for making plants with modulated biomass
  misc_feature: Useful for making plants with modulated heat sensitivity
MGAMMASITSELLFFLPFILLALLTFYTTAAAQCHGARQWRPTKKKRPNLPPGAPGWPLVGETFGYLRPHPATSVGRFMEQHVARYGKIYRSSLFGERTVVSADAGLNRYILQNEGRLFECSYPRSIGGILGKWSMLVLVGDAHREMRAISLNFLSSVRLRAVLLPEVERHTLLVLRSWCGSAGGGGGACCFSAQHEAKKFTFNLMAKNIMSMDPGEEETERLRLEYITFMKGVVSAPLNFPGTAYWKALKSRASILGVIERKMEDRLQKMSKENSSVEEDDLLGWALKQSNLSKEQILDLLLSLLFAGHETSSMALALAIFFLEGCPKAVQELREEHLEIARRQRLRGASKLSWEDYKEMVFTQCVINETLRLGNVVRFLHRKVIRDVHYNGYDIPRGWKILPVLAAVHLDSSLYEDPNQFNPWRWKSNAPSSFMPYGGGPRLCAGSELAKLEIAIFLHHLVLNFRWELAEPDQAFVYPFVDFPKGLPIRVQRIAGEHSVLTESTAM

SEQ ID NO: 4695 - DNA, 2121 bp, Panicum virgatum
  misc_feature: Ceres CLONE 1809249
  misc_feature: Encodes the peptide sequence at SEQ ID NO. 4696
acggcttttgacttcggctcacccgcaccatgaactcgctcctgaggccgccgctgccgggcccgagcccgtgcgcgaggagccgggtctcgccgtcgccggcggcggggcggctcggctcggcggcgttggtcggcggcgggcggagatgccgccgcgggctggctgtggcggcgtcggcggctccgtcgtggatggaggaggcgggcgtggcggtgctggaggagggcgggcgttggaacccgtcggtgtccgactcgtaccgcccggcggagctgccgcggccgaacgccacggtgctggaggcgcaggggcgggtgtgcacggggcccgagcagacgcgcccgctaggggaggagcaggccatgcgcgtcctcgataccatcctccgctccgcaatgggagaactcaaagaggagccagtctccagtgcacagctgggtgcattctttgctggaatgacaataagagctaattcttttccggaggccactcaatggagtgagggtgaacggcgagccatgagcatattttggccacgacttgtgcaagttcttcctcctgaggtgaagtttatagcagaccctgaaggaacgatcatgggtgcaaatggtttaacaggacctcggtatgttggtcaaggaactggagagatgagacttgttggtgctctgagggaagtgcttgctggtggccatttaggttatgaggaggttcagtgtgtactaaaggacattttgccaattggatcaaattcaagttcaacagtggttagtgaagcgcttctagcagcatttttgattggacagcggatgaatagagaaactgatcgtgagctcaaagcatattgtctagcctttgatgatgaactaggtcctcctccagttgctgatgttaagtccttgacacactatggtgaaccatatgatgggaatacacgctcttttaggagtactctatttgttgcagcagttcgagcctgctatggtgaatcttgcctccttcatggtgttgaatggatgccacccaagggtggaataacagaaggacagatgcttaaattcatgggtgcaaacatacacttatctccaacacaggccaagacactgttggaggatgagaacgctggttttgcatacttgaatcttcaagaagcttgcccaccactatattcaataattgggctcagggagcatattaagaaacggccaccgttggctaccactgagaaagttcaacaatttgtgagagcacggggaagagaatccatgattgcaggattttatcacgaaggctatgaagatccgttgcttatgcttatgagaaggagaactgttcatgctggactagttgtgaagggggaggaaggtgcgctatcaatgacaaccaaggaaagatcagctcatgcatcgaaagggcttccagttaaccattgttcagggttccggacaccaaacagcataaattcatcagagactgatggtattgctagagagagcttcagggtcatcgtgaatgcacaggagcttggttttgaatccacggaaactccaagaactgatagatcaatcctgaagaacttggagctgggtcttgccgcacttggcggtgagaaaggagcagcctatgaccgaatagttcttaatgcaactatggctgaccacttactgggctgcagcggagctgaggatatcaacaccgcgcttgagcgggctagagaagccattgatagtggcaaagctctgagaaggctcatgagttacataaagatctcgcacaaagtggcccaatcttgagtcttgactgtgctggctgtacaattttggtttccatgtcacgaccgaatacattgttccctgagtgccttcgccactcaatattacgagccgatgcttgaatattcccatggaagggcctgtcaataagtcagtcaaaatgaaacagtagcttgtagcttattgagaaagggtagccacaagggatgctttgttgtattgcccctgagagaagttgatgttttgtaacccatgcaaattctcttcaaaacccaaaaacagattatactgccatagtgaaaactcaaaagcctcgttgagtttttaaaaaaaaaaaaaaaaaaaa

SEQ ID NO: 4696 - protein, 588 aa, Panicum virgatum
  misc_feature: Ceres CLONE 1809249
  misc_feature (1)..(56): Pfam Name: Glycos_transf_3 Pfam Description: Glycosyl transferase family, a/b domain
MNSLLRPPLPGPSPCARSRVSPSPAAGRLGSAALVGGGRRCRRGLAVAASAAPSWMEEAGVAVLEEGGRWNPSVSDSYRPAELPRPNATVLEAQGRVCTGPEQTRPLGEEQAMRVLDTILRSAMGELKEEPVSSAQLGAFFAGMTIRANSFPEATQWSEGERRAMSIFWPRLVQVLPPEVKFIADPEGTIMGANGLTGPRYVGQGTGEMRLVGALREVLAGGHLGYEEVQCVLKDILPIGSNSSSTVVSEALLAAFLIGQRMNRETDRELKAYCLAFDDELGPPPVADVKSLTHYGEPYDGNTRSFRSTLFVAAVRACYGESCLLHGVEWMPPKGGITEGQMLKFMGANIHLSPTQAKTLLEDENAGFAYLNLQEACPPLYSIIGLREHIKKRPPLATTEKVQQFVRARGRESMIAGFYHEGYEDPLLMLMRRRTVHAGLVVKGEEGALSMTTKERSAHASKGLPVNHCSGFRTPNSINSSETDGIARESFRVIVNAQELGFESTETPRTDRSILKNLELGLAALGGEKGAAYDRIVLNATMADHLLGCSGAEDINTALERAREAIDSGKALRRLMSYIKISHKVAQS

SEQ ID NO: 4697 - DNA, 1259 bp, Panicum virgatum
  misc_feature: Ceres CLONE 1809251
  misc_feature: Encodes the peptide sequence at SEQ ID NO. 4698
aagtctactcagtactcacctcgcagcaatctggctgagagaaagaagccgtgtcaccgaccggcggcccccctcctctgcattcccccccaccgattcggccgccgggagagtcccgtaggctcgccggggtcgcggtcccgagcaggatggccgccaacttctggacgtcgtcgcactgcaagcagctgctggacccggaggatgtggagctggtgccggcggcggaccgggagcggggcatcacgccggaggagttccgcctcgtcaagatccacatgtccttccatatctggcggctggcacagcaggtgaaagttaggcaaagagttatagctacagcagtcacttacttcaggcgtgtgtatacaagaaagagcatgtcagagtatgatcctcgtttggttgcacctacttgtttgtatttggcgtcaaaggtggaggagagcacagtgcaagcacgtcttcttgtcttttacataaaaaagatgtgcggtacaggttccgatgataagtatcggttcgaaattaaggatattcttgaaatggaaatgaagctcctggaagcacttgattattatttggttgtttttcatccataccgtcctctcttacagttattgcaggatgctggcataacagatctgacgcaatttgcctggggcctcgtgaatgatacttacaagatggatcttattctcatatacccaccctatatgattgcacttgcctgcatatacattgcaagtgcccttaaagacaaagacacaacttcttggtttgaagaactccgagtcgacatgaacattgttaagaatatctcaatggaaattctggatttctatgacacctacaagatcgatcctcaaagaggcctcccagacgataagattagccctgtgctgaacaagttaccggcgaagtcttgacctccagtttcactatttgtcacctacttcaaacaaagcatgagctactaattagctcacacttccacggcgggagtgcacttacaagtgcacgtcttgtctgtcacatattgggccactacctcttagactcacaaattcaacttaaggcaaaatatctggaatgtcaagtttgaaagctctaatttgatggcccatggtagtagatgctctgtatgtgcttgtacttaaaaaattgttgacatcgtgacttttgatgtatcataccgaactcagcaacatctgcatatttttaaccatttgatagctcaaaaaaaaaaaaaaaaaaaa

SEQ ID NO: 4698 - protein, 259 aa, Panicum virgatum
  misc_feature: Ceres CLONE 1809251
  misc_feature: Great-hit functional homolog of the protein sequence given in SEQ ID NO 9352
  misc_feature: Useful for biocontainment applications
  misc_feature: The plant produces a reduced number of seeds.
MAANFWTSSHCKQLLDPEDVELVPAADRERGITPEEFRLVKIHMSFHIWRLAQQVKVRQRVIATAVTYFRRVYTRKSMSEYDPRLVAPTCLYLASKVEESTVQARLLVFYIKKMCGTGSDDKYRFEIKDILEMEMKLLEALDYYLVVFHPYRPLLQLLQDAGITDLTQFAWGLVNDTYKMDLILIYPPYMIALACIYIASALKDKDTTSWFEELRVDMNIVKNISMEILDFYDTYKIDPQRGLPDDKISPVLNKLPAKS

SEQ ID NO: 4699 - DNA, 1580 bp, Panicum virgatum
  misc_feature: Ceres CLONE 1809298
  misc_feature: Encodes the peptide sequence at SEQ ID NO. 4700
acagtgcctgtcagtaggagagcgaggggcagagccgcaggggaaggcagcggcggccggcggatccagctccctcgcagtgatgatacaaggttgaaatcttcttcctcctcttctcccacctctctcttctttcttctcctttcactttctcctcctccacctccacttgttccgatggcatcgaactatgcagccagtagaggtggccgaagcccccccagccccccagccagtaggggagaggaggagtgggggatggtgaagggagggcaaggaagcgacgccatggcggcggctggcgaggtggaggagaacatggcggcgtggctcgtcgccaagaacaccctcaagatcatgcccttcaagcttccgccccttggtccgcatgatgtccgggtgcggatgaaggccgtggggatctgcggcagcgacgtgcactacctcagggagatgcgcatcgcgcacttcgtggtgaaggagccgatggtgatcggccacgagtgcgcgggcgtgatcgaggaggttggctccggcgtgacgcacctcgccgccggcgaccgcgtggcgctggagcccggcatcagctgctggcgctgccgccactgcaagggcgggcgctacaacctctgcgacgacatgaagttcttcgccaccccgcccgtgcacggctcgctggccaaccagatcgtgcaccccgcggacctgtgcttcaagctccccgacggcgtcagcctggaggagggcgccatgtgcgagcccctcagcgtgggcgtccacgcgtgccgccgcgccggggtcgggcccgagacggcggtcctcatcatgggcgccggccccatcggcctcgtctcgctgctcgccgcgcgtgccttcggcgcgccgcgcgtggcgatcgtcgacgtggacgagcaccgcctcgccgtggccaagtccctgggcgcggacgcggcggtgcgggtgtcggcgaggcccgaggacaccgccgaggaggtggcgcggatccaggcggcgctgggcggcgcggagatcgacgtgagcctggactgcgccgggttcagcaagacgctggcgacggcgctggaggcgacgcggcccggggggcgggtgtgcctggtggggatggggcacaacgagatgacggtgccgctgacgtcggcggcgatccgggaggtggacgtggtgggcatcttccggtacaaggacacgtggccgctgtgcatcgagttcctgcgctccggcaaggtggacgtgaagccactcatcacccgccgcttcggcttctcgcagcgggaggtggaggaggcattcgaggtcagcgcgcgcggccgcgacgccatcaaggtcatgttcaacctctaggccggacgactaggtgggtagacggccgccggtcgcgctccggggatcgatcgatgataaaataaggtagtggaagtggccggcgccgtccgtcggtcggcgatcctccggcgaagggcgcagaaaaccttgatcggcggcgagatgccatggcgttgttttggattggaataaccgtggctttaatttgttgcttctaaaaaaaaaaaaaaaaaaaa

SEQ ID NO: 4700 - protein, 394 aa, Panicum virgatum
  misc_feature: Ceres CLONE 1809298
  misc_feature (1)..(112): Pfam Name: ADH_N Pfam Description: Alcohol dehydrogenase GroES-like domain
MASNYAASRGGRSPPSPPASRGEEEWGMVKGGQGSDAMAAAGEVEENMAAWLVAKNTLKIMPFKLPPLGPHDVRVRMKAVGICGSDVHYLREMRIAHFVVKEPMVIGHECAGVIEEVGSGVTHLAAGDRVALEPGISCWRCRHCKGGRYNLCDDMKFFATPPVHGSLANQIVHPADLCFKLPDGVSLEEGAMCEPLSVGVHACRRAGVGPETAVLIMGAGPIGLVSLLAARAFGAPRVAIVDVDEHRLAVAKSLGADAAVRVSARPEDTAEEVARIQAALGGAEIDVSLDCAGFSKTLATALEATRPGGRVCLVGMGHNEMTVPLTSAAIREVDVVGIFRYKDTWPLCIEFLRSGKVDVKPLITRRFGFSQREVEEAFEVSARGRDAIKVMFNL

SEQ ID NO: 4701 - DNA, 1857 bp, Panicum virgatum
  misc_feature: Ceres CLONE 1809310
  misc_feature: Encodes the peptide sequence at SEQ ID NO. 4702
atcgcttcgcgcagccttatccatgcaggcccagcgagagcaccaccgctcgccgctcccggaagccggcgcccgcgacgcgctcgatggaacgccgcgcctgagctatccctctccctgactcgcgctcccagcgccccgcgcgccgcgcgccgcggctgatgccgctcgccggcattgccctcgcgcctctcctcgtctcccccctcgcgcaatcgcctcgccgtggctgcgtcgccgcgagaaggccgagcgctctccggcgagctcggtgctcggccgcagccgcttccggtgaagccggggaggccggtgagctgccacgagcgacgctactctggagggcggcgaagctgcccatatactctgttgcgctcgtgccactcacggtagggagcgcctgtggttatcatcacgcaggcttattctttgccaaacgctactttattatcttggcagcggcagtccttgtgatcacttggctcaatctgagcaatgatgtctttgattcagatactggggctgacaagaacaagaaagaatctgttgttaacattattggcagtcgagcagtgacacaaaatgctgcaaatgtttctcttttcctcggctttgctgggctattttgggcctttacagaagccggtgatgctagattcattttcctggtgatgtgtgcaatcttctgtggttatgtttatcagtgtcctccatttcgattaagctaccaaggactaggtgagcctttgtgttttgctgcttttggtccattggcaaccacagcattctacttctcaagcagcaacgtaaatattgcaagtggaacggcactgctccctctcaccaaaacagttacagcttcatcagtccttgttgggttgacaactactctgatactcttctgcagccattttcatcagattgatggagatcttgctgttgggaagatgtctcccctggtcagagttggcactgaagcaggatcacgaatagtggtcgttgctattgccacgctttacattctcttggctgcatttggcgtatgcaaagctcttccatcagcttgcactgtcctttgcgctcttactctgccagtgggcaaattggttgtggattatgtgctgaaaaatcacgaggacaatgctaagattttcatggcgaagtactactgtgtgcggctgcacgctctgtttgggatggcgctggcttctggtttggtcttggcccgaaatggtatactagcctgacagatgagaaaccttgaaatccatgggagggatcctgagcagagagcaccaccctgcagacagccttccattgcattgcgttctgaacttctgaacgctgagatttggtgcagtactgaactggcgcagatttgccaagaaatggaaaggaaatgccagggaggtactcggtgcccactggccactgggccgtattagacgtcaagtccatgttgctggttgagttggcttgcttcagcatccggtttttgccagttgcacgtcttctacgctttgactggctcagcttgctcatgcagggtcaggttgccgttgcacatatagccgtataggaggatcccaatatgaattgaattccaagccaggacgagtcatgttcaagcattacttctctgtacaaacgtaccaactggccatgtagatttgcggggatttcacacgcccttgtgtttcacattttgccttccctggttggtggttagccagctaccgtgcaggttttgtaattggctaattgcaatgtcttgtttcatctctttgtccggacaagtaaacaatggtaatacaaccaaacatgtaaaacaaatgcgaaaaaaaaaaaaaaaaaaaa

SEQ ID NO: 4702 - protein, 361 aa, Panicum virgatum
  misc_feature: Ceres CLONE 1809310
  misc_feature (1)..(258): Pfam Name: UbiA Pfam Description: UbiA prenyltransferase family
MPLAGIALAPLLVSPLAQSPRRGCVAARRPSALRRARCSAAAASGEAGEAGELPRATLLWRAAKLPIYSVALVPLTVGSACGYHHAGLFFAKRYFIILAAAVLVITWLNLSNDVFDSDTGADKNKKESVVNIIGSRAVTQNAANVSLFLGFAGLFWAFTEAGDARFIFLVMCAIFCGYVYQCPPFRLSYQGLGEPLCFAAFGPLATTAFYFSSSNVNIASGTALLPLTKTVTASSVLVGLTTTLILFCSHFHQIDGDLAVGKMSPLVRVGTEAGSRIVVVAIATLYILLAAFGVCKALPSACTVLCALTLPVGKLVVDYVLKNHEDNAKIFMAKYYCVRLHALFGMALASGLVLARNGILA

SEQ ID NO: 4703 - DNA, 1618 bp, Panicum virgatum
  misc_feature: Ceres CLONE 1809375
  misc_feature: Encodes the peptide sequence at SEQ ID NO. 4704
gccgttcaactcgatcactccacacccagacccacccagctcacttgggtcgcgtcagctcataaaccaaacagagagacctcgtcgccaggggccaccagcccggagcagccagagagagcagcagagggggccaaatcaggaaggcgcgatgatgctggacgccatccgggagcacctgctggaggagccgtcggaggcgctggtgctggacaccatccggcagcacctcctggaggagccggcggaggcgcggccggcgtaccggcggagcgagagcttcgggagcctcgtggcggaccagtggagcggctcgctgccgttccgcaccgacgacgccgacgacatggtcgtgttcggggcgctgcgggacgcgttcgcctacggctggctccccgacggcgccttcgcgcgggtcaagcccgagccgctcccgtccccgggctcctccgactactcctacgacggcctcggcctcctgtacccggacccggagccgatgacgccgagcagcgacgccgcgacgcccaagacggaggaggccgcggcgggcgtggcgaggggcaagcactaccgcggggtgcggcagcgcccctggggcaagttcgcggcggagatcagggaccccgccaagaacggcgcgcgcgtgtggctcggcacctacgacaccgccgaggacgccgcgctcgcctacgaccgcgcggcctaccgcatgcgcggctcccgcgcgctcctcaacttcccgctccgcatcggctcggagatcgcggccgccacagccgccgccgcagccgcccccggggacaagaggccgtcgcccgagcccgcgacgtcatcggactcgtccttctccacgtcctcctcgtcctcttgctcgacgagcggctcgacgaagcggcggaagcgaggcgaggccgcggccgcgacgatggccatggccctggtgcccccgccttcccagctcaaccggccggcccagccatggttccccgctgcggcggccgagccggcggccatggcgccgcgcgtcgagcagctggtcatctgaggcgccgaccggaccaccagctcatgccgtccaccgggcgcgcggccaaggcaatgaggcgtgccacaacggactcaccctcaccggcagaggcgcggcgccggaattggacgaggctcctggcgtcgcacctgcacggtgccgcgcgactggcgacgcgaatgcgacggcggggggcgggacgcgcgcatcccggtgaaagctcccccggatggaacgcgataagatcgggagcaacttggcggggcaattcgcagctctggatggtgctgctgcgccgggcgactcgcccaagtgaaagaagctgtgtgtaatcaagtgtcgtcgtgtctagttgtctgcgaattttgggcccccaaggttctgccgttcagtgtttgcatcattgtcagagtgcttgtgcttctgataagtgataagattttcaaaaaatgtacaaaagtagtagggagacgatgagatttggaacaatccgctttgttctttgtcaacccccaatgggtgcggcatcgtctgataataaataaataaatacgaatatcacactgccaaaaaaaaaaaaaaaaaaaa

SEQ ID NO: 4704 - protein, 298 aa, Panicum virgatum
  misc_feature: Ceres CLONE 1809375
  misc_feature: Great-hit functional homolog of the protein sequence given in SEQ ID NO 9262
  misc_feature: Great-hit functional homolog of the protein sequence given in SEQ ID NO 9657
  misc_feature (1)..(66): Pfam Name: AP2 Pfam Description: AP2 domain
  misc_feature: The sequence is a functional homolog of  SEQ ID NO 503 in the  10/374,780 US patent application
  misc_feature: Useful for making plants with altered Lignin content
  misc_feature: Useful for making plants with altered cell wall content and/or composition
  misc_feature: Useful for making plants with altered oil content
  misc_feature: Useful for making plants with modulated growth and phenotype characteristics
MMLDAIREHLLEEPSEALVLDTIRQHLLEEPAEARPAYRRSESFGSLVADQWSGSLPFRTDDADDMVVFGALRDAFAYGWLPDGAFARVKPEPLPSPGSSDYSYDGLGLLYPDPEPMTPSSDAATPKTEEAAAGVARGKHYRGVRQRPWGKFAAEIRDPAKNGARVWLGTYDTAEDAALAYDRAAYRMRGSRALLNFPLRIGSEIAAATAAAAAAPGDKRPSPEPATSSDSSFSTSSSSSCSTSGSTKRRKRGEAAAATMAMALVPPPSQLNRPAQPWFPAAAAEPAAMAPRVEQLVI

SEQ ID NO: 4705 - DNA, 1667 bp, Panicum virgatum
  misc_feature: Ceres CLONE 1809393
  misc_feature: Encodes the peptide sequence at SEQ ID NO. 4706
gatccgatccagctgaagaaaacaaacaacttcgagcagctttcgtgcaattattccagcgccgcgcatgatcctccaacctccaagccgcaaagattccaatttgatagcgcccagaggagaagaagagggtaattattgatttctcggagccagaagtcgcaatggcgtctccaccgcttcagttcgcggccgcgcccttgctgctgctgctgctgctgctggcagtagcagtcccggccgcacggtccagccgtgtcttctccgtggctgactacggcgcggttggggatgggtcccgctacgacacagcggcgatccaggccgccgtggacgcctgcgcggcggcgggcgagggccgcgtcctcctcccggcgccgggcgactacctgacggcgaccgtccacctccgctcgcgggtggtgctggaggtggcccccggcgcgcggctgctgggcgggaccaggcaggcggactacccgcccgaatcgcgccgctggtacgtcgtcctggccgagaacaccacgggggccggcatcacgggcggcggcgagatcaacggccagggcgaggcgttcgtggtcacgcccagcgaggtgaagaacgtcatggtgagctggaacgccaccggcgattgcctgggcgacgagtgccggccgcggctcgtcggcttcattgactccaaggatgttaggatccacgacatcacactcaaccagcctgcctactggtgtcttcaccttgtcagatgtgacaacacagtgatccgcaatgtgtctatatttggggattttaagagtcccaacaatgatggcattgacattacggattctaacaacaccgttataaccgattgccacatagacactggagatgatgctttatgcccaaagtcatccactgggcccgtttgcaacttgacagccacaaactgttggatccggactaaatcttgtgctatcaagtttggaagtgcaagctacttcaacttcaataagctggtcttcaacaacattacaatagttgattcacatcgaggacttgggatgcagatccgggatggaggaaatgttagtgatgtgctgttttcaaacattaaaatgagcaccagatactaccatcctttatggtggggaagagccgaaccaatctacatcacaacttgcccaaggcacccagattcgaaagaaggtaccatttcagacataagattcatcaacatctcatcagtatcagaaaatggagttttcctggctggatcaaagcacgggctgctccgcaatctgaaattcaagaatgtcgacctgacctacaagcgttggacaaactacacgggaggcctgtatgattacagacctggatgcgagaagatggtgaagcataagactggtggcatgatggtggagcacgtctctggcctggagatcgacaacgtaaggatgagatgggcgagaggaagcctgaaaggctgggacgtcaaccccatccttttcaggccgtcgaccatcgacaagctgtctttccatgactggcagtcagtggatgttcagtgaatttgccccgccccaattgtacctgtgtatctgtatcacgaattcacgatgaataaaagggttgattcttttttgccaaatatgctaataagataaaaaaaaaaaaaaaaaaaa

SEQ ID NO: 4706 - protein, 462 aa, Panicum virgatum
  misc_feature: Ceres CLONE 1809393
  misc_feature: Great-hit functional homolog of the protein sequence encoded by LOCUS At3g57790
  misc_feature (5)..(347): Pfam Name: Glyco_hydro_28 Pfam Description: Glycosyl hydrolases family 28
  misc_feature: Useful for making plants with altered cell wall content and/or composition
MASPPLQFAAAPLLLLLLLLAVAVPAARSSRVFSVADYGAVGDGSRYDTAAIQAAVDACAAAGEGRVLLPAPGDYLTATVHLRSRVVLEVAPGARLLGGTRQADYPPESRRWYVVLAENTTGAGITGGGEINGQGEAFVVTPSEVKNVMVSWNATGDCLGDECRPRLVGFIDSKDVRIHDITLNQPAYWCLHLVRCDNTVIRNVSIFGDFKSPNNDGIDITDSNNTVITDCHIDTGDDALCPKSSTGPVCNLTATNCWIRTKSCAIKFGSASYFNFNKLVFNNITIVDSHRGLGMQIRDGGNVSDVLFSNIKMSTRYYHPLWWGRAEPIYITTCPRHPDSKEGTISDIRFINISSVSENGVFLAGSKHGLLRNLKFKNVDLTYKRWTNYTGGLYDYRPGCEKMVKHKTGGMMVEHVSGLEIDNVRMRWARGSLKGWDVNPILFRPSTIDKLSFHDWQSVDVQ

SEQ ID NO: 4707 - DNA, 1269 bp, Panicum virgatum
  misc_feature: Ceres CLONE 1809403
  misc_feature: Encodes the peptide sequence at SEQ ID NO. 4708
gctggtctccgggatttccacgggcgggagcggcggcggcgccgcgggttggaatctcctggcgcaaggtgcgtgtggaatggccggcctgatcagagcgcgcgcaggcccgggaagtttgctgcctgttcgtcggtcgtctaccgctcggccgccgccagcagcagcttcgcgagtgggggttcggtttgcaagccctctgtttctctctgctaaggtttgcaagagccgtggtttaatggcggcagctttggaggtcgcgaaggacggctcctcagcagttctggccaatcgccaaccctccaaagatgctattgagacgttgcgcaatgccgatgcggtatgtttcgatgtcgatagcactgtcatcatggatgagggtattgacgagctcgccgacttctgtggggcagggaaagctgttgccgaatggacagcgaaagcaatgacaggggatgttccatttgaggaggcactggcagccaggctgtctttaatcaagccatctctctcccaagttgaggagtgcttggagaagaggccgcccaggatttctccaggaatggctgatttgattaagaagctaaaagctaatagtactgatgtgttccttgtgtcaggaggcttccgacaaatgatcaagcctgtggcatttgagcttggtattcctgctgaaaacatcattgcaaaccaactgctatttggaacttccggggagtatgctggatttgatcccacagagcccacttcacgcagtgggggtaaagcaaaagcagtgcaacaaataaaacagaaccatggatacaagacggttgttatggttggagatggtgcaactgatcttgaggctcggcaacctgggggagcagacttgttcatctgttatgccggtgttcagatgagagaaccagttgcagcagaagctgactgggttgttttcgactttcaagagctcatcaccaagttgccataaattgactacttaccgcaattgtgaacctcgcattcttgatgctgagcagtgaaataactgcagcacatttcaagctgtagatgtcactggccattcttagatttagctgaactatctggttgtaagtatttgttatttttttgcccccacttttcatggatgatcttgaaccacaagtctgacggttatgttccgatattgtgagtgaagtatgttttaagcaactgttgtgtacgaaagtaatgaattgcctcacatttaggtgctggatcacacaaaaaaaaaaaaaaaaaaaa

SEQ ID NO: 4708 - protein, 297 aa, Panicum virgatum
  misc_feature: Ceres CLONE 1809403
  misc_feature (1)..(187): Pfam Name: Hydrolase Pfam Description: haloacid dehalogenase-like hydrolase
  misc_feature (71)..(296): SWISSPROT Homolog: EC 3.1.3.3 Phosphoserine phosphatase, chloroplast precursor
  misc_feature (84)..(296): SWISSPROT Homolog: EC 3.1.3.3 Phosphoserine phosphatase
MAGLIRARAGPGSLLPVRRSSTARPPPAAASRVGVRFASPLFLSAKVCKSRGLMAAALEVAKDGSSAVLANRQPSKDAIETLRNADAVCFDVDSTVIMDEGIDELADFCGAGKAVAEWTAKAMTGDVPFEEALAARLSLIKPSLSQVEECLEKRPPRISPGMADLIKKLKANSTDVFLVSGGFRQMIKPVAFELGIPAENIIANQLLFGTSGEYAGFDPTEPTSRSGGKAKAVQQIKQNHGYKTVVMVGDGATDLEARQPGGADLFICYAGVQMREPVAAEADWVVFDFQELITKLP

SEQ ID NO: 4709 - DNA, 1866 bp, Panicum virgatum
  misc_feature: Ceres CLONE 1809481
  misc_feature: Encodes the peptide sequence at SEQ ID NO. 4710
gagcttagcggagaaccactgcctccagcagcagcagcagcccacgcagctagctcagctcgatcgtcctctcctctccatctccatccatccattcgatctcgtgctccctcccactcctcgccacgcactaccgtctaccgcggcctgaggagatgatgagcggtggtaggctgaacgtggcgacgtccgcgcagggcgacgacttcccgttcgcgccgatgcagcagcagcagcagccgccgccgccgccctacgtcgggttcgagcacggcgtgatgggaggcggcggcgggatgcagcaccacctctacgacggcctcgacttcgccgcggcggcgctgcagttccaggaggcggcgcctcaccaccagctgctcacgctgccgtccagcctcgcgcccatggcgccgccgccgttgcagatgcccatgccgctgcccgggatgcccggcgacgtgtacccggcgctcggcatggtgaagcgcgagggcgcggacggcgggggcggcgcggcggggggcggcgggcggatcgggctcaacctcggccgccgcacctacttctcccccggcgacatgctcgccgtggaccggctcctgatgcggtcccgcctgggcggcgtgttcgggctcggcttcggcggcgcgcaccaccagcccccgcgctgccaggcagaggactgcaaggccgacctctccggcgccaagcactaccaccgccgccacaaggtctgcgagtaccacgccaaggcctccgtcgtcgccgccgccggcaagcagcagcgcttctgccagcaatgcagcaggtttcacgtgctgacggagttcgacgaggccaagaggagctgccggaagcggctgtccgagcacaaccgccgccgccggaagccggctgcctccacggcgtcgtccaaggacggggcgtcgccgcccgccaagaagccctgcggcggctccatgaccggctcctacaccactgacagcaagaacatgagcacggccaagtcgaccatgtcatcgaacacgggcagcgtgatcagctgcctggaccagggcaacaagcagcagctggcgaggccaacgcttaccctcggcgcgtcgccggacaaggaccaccagcaccagcagcagctcagcaccatgctccaggccaaggcggccgcgggcggcggccaccaccaccaccacccggagcagcacttcatcacctccctgcaggttcacagccacaacaatggcggcggcggcggcggcaacaacaacatcctgtcctgctcgtcggtgtgctccagcgcgctgccgccggccaacggcggcgaggtctccgaccagaacaccaccaacggcaacggcaacggcggcggcggcatgcacaatctgttcgaggtggacttcatgtaggccgtacgtgggtgtgcatgcaaagcgagcgagcacgggagtacgttcttctggcaaaggtgtccttggtgtgtagccgtgtaggtaaaaggaataggagaaagtgagagtgagagagcaaaaaaggcatgaagtgagagaaaaactagagagagagaaggctgagggtgtgtgcaaggattccatccatccatcagtgctcagtagcagctagctgcagcaggctggtctagcaaggtagagctagctaccgccttgcaaagttgcatggctatatagtagctctagcaaagccatgcatcctgcatccagcatcccccttgcattgggttcgttctctacctgtactgaactgcactgcagtgcgtctgcatccatccatccaagcctttctgcctttccatttcagtggggaataatgtgtctgctattatttcatcttcaaaaaaaaaaaaaaaaaaaa

SEQ ID NO: 4710 - protein, 415 aa, Panicum virgatum
  misc_feature: Ceres CLONE 1809481
  misc_feature: The sequence is a functional homolog of  SEQ ID NO 104 in the  10/666,642 US patent application
  misc_feature: Useful for making plants with modulated growth and phenotype characteristics
MMSGGRLNVATSAQGDDFPFAPMQQQQQPPPPPYVGFEHGVMGGGGGMQHHLYDGLDFAAAALQFQEAAPHHQLLTLPSSLAPMAPPPLQMPMPLPGMPGDVYPALGMVKREGADGGGGAAGGGGRIGLNLGRRTYFSPGDMLAVDRLLMRSRLGGVFGLGFGGAHHQPPRCQAEDCKADLSGAKHYHRRHKVCEYHAKASVVAAAGKQQRFCQQCSRFHVLTEFDEAKRSCRKRLSEHNRRRRKPAASTASSKDGASPPAKKPCGGSMTGSYTTDSKNMSTAKSTMSSNTGSVISCLDQGNKQQLARPTLTLGASPDKDHQHQQQLSTMLQAKAAAGGGHHHHHPEQHFITSLQVHSHNNGGGGGGNNNILSCSSVCSSALPPANGGEVSDQNTTNGNGNGGGGMHNLFEVDFM

SEQ ID NO: 4711 - DNA, 1230 bp, Panicum virgatum
  misc_feature: Ceres CLONE 1809491
  misc_feature: Encodes the peptide sequence at SEQ ID NO. 4712
atctggcccgcatagttttatcccaacggtcccaagcagctggctgctcctttgaccttcaactccggcgccgccgtacgtccccgagaccctgatgggccggccggcgcgctcccggtctccggccaccgtgccgcctccgccgactaccgaacttcgctccaccaagatctcattccgctcccgtaagatcgtcaagacaccaccgggaaaacccctcacaacggccgccgaggcaccaccgttaacggcgccggcgcctttacttccagtgctgccggcgctttcctcgccgggagcgatagctgccgcgctaagccacctccaagctgcggaccccctcctctccgcggtcatcgcctccactgagccccccaccttcgccgcttctccctccctccccgcatttcactccctcgcacgctccattctctaccagcagctcgcgaccgccgccgccaacgccatctatgctcgtttcctcgaactcctccctgccgcagtctccgacggggtaacccctgccgcggtccttgccctcgccactgccgacctgcgcaccatcggcgtctccggccgcaaggcctcctacctccacgacctcgcgaccagattcgcagccggggagctttctgattccgccgtcgccgccatggacgaatctgcgctcctcgccgagctcaccaaagtgaaaggcgttggcgagtggacagtccacatgttcatgatctcgctgcagcgccccgacgtgcttccgtgcggcgaccttggcgttcgtaagggcgtgcaggagctgtacaacttgaagaccctgcccaagccagaggagatggcggcattgtacgagcggtggaggccctaccggtcagtcggcgcgtggtacatgtggcgcctcatggagagcaagggcgctgcagccaagaagaagaagaagggtaatgcgagctcttagttaggtatgtaatgtcaatatgccatgtatgtcatgatcttatgtatttgctgtcccaggttgttagatttaatcatttagatgattctggggtagacggtgaccaagatttgtgaattgttgcggctctgtctgtccttgcagagctgcaaccgaagtcaattgctaacacgcttgccattgtattagatattcaaaatcgatactactatgcttgtaagcttgtaccgctgagcataataatttgagggtttctttaaaaaaaaaaaaaaaaaaaa

SEQ ID NO: 4712 - protein, 285 aa, Panicum virgatum
  misc_feature: Ceres CLONE 1809491
  misc_feature: Great-hit functional homolog of the protein sequence given in SEQ ID NO 9672
  misc_feature: Useful for making plants with modulated nitrogen use efficiency
MGRPARSRSPATVPPPPTTELRSTKISFRSRKIVKTPPGKPLTTAAEAPPLTAPAPLLPVLPALSSPGAIAAALSHLQAADPLLSAVIASTEPPTFAASPSLPAFHSLARSILYQQLATAAANAIYARFLELLPAAVSDGVTPAAVLALATADLRTIGVSGRKASYLHDLATRFAAGELSDSAVAAMDESALLAELTKVKGVGEWTVHMFMISLQRPDVLPCGDLGVRKGVQELYNLKTLPKPEEMAALYERWRPYRSVGAWYMWRLMESKGAAAKKKKKGNASS

SEQ ID NO: 4713 - DNA, 1351 bp, Panicum virgatum
  misc_feature: Ceres CLONE 1809538
  misc_feature: Encodes the peptide sequence at SEQ ID NO. 4714
atcgccgcctcctcttcccgcgccccccgcccgcctctctggagcgacggttgcctgctcccactccaaccatggccgccaccgccgccgccctggtgcgggctctctcctcaccaccgtccccgtctcctccgctctcctcgcgaccgagaccgagagcccttcgcggggacactctcctctcgctccgcgaaaagccgcgcgcccgcgtcgtctgtgccgccgccgcctccggctcctccaacttcgggaatcaaacatcactgatgcctcctttcagctttacacttgatgaaggtttttccaggtccaaaaagccgtatagatggcaacgggtattgcttaaagtaagtggggaggctcttgctggagatcacacagaaaacattgacccaaagattacaatggcaattgcaagagaggtcgcttctgtcaccaagctaggtgtagaggttgctattgttgttggtgggggcaatatcttccgtggggcctcttgggctggatgtagtgggcttgatcgctcatctgcggattacatcggaatgctggctactgtgatgaatgctatatttcttcaagcaacaatggagagcattggaataccaacccgtgtccaaactgccttccgtatgtcagaggttgcagagccatacatacgccgaagagctgtcaggcatttagagaaaggaagggttgttatattcgctgctaggacagggaacccattctttacaactgatacagccgctgctctccgttgtgcagaaatcaatgcagaggtagtgcttaaagcaacaaatgttgatggtgtgtatgatgcagacccccgacataacccaaatgcccgccttcttgagacagtgagctatcatgaagtgactacaagagatctctcggtaatggacatgactgccattacactatgccaagaaaacaacattcccgttgtcgtgttcaacttgcaaaagcctgggaacattgcaaaggctattgttggtgagaaggttggtacctttattggatgcacaggaaatcaggaacaaaatggaaacgcactgcatgaagaaagaagattggttaacgaggcgtgagctcaacagctgctcgatctgtgctctccctctttccttatttagtttatgcgtaggaagttttaggaggttgggtttggagctggtgctagaattagctagactagattagctacaaagttcttatagctgcaaccttgaaagaagacaattagaccaaaattttccagccaagtgctgctatcctatgtacaatagactcaaggagattacctaataaaataaaatctttttgcagaaaaaaaaaaaaaaaaaaa

SEQ ID NO: 4714 - protein, 340 aa, Panicum virgatum
  misc_feature: Ceres CLONE 1809538
  misc_feature: Great-hit functional homolog of the protein sequence given in SEQ ID NO 9263
  misc_feature (1)..(211): Pfam Name: AA_kinase Pfam Description: Amino acid kinase family
  misc_feature: Useful for biocontainment applications
  misc_feature: Useful for making plants with modulated biomass
  misc_feature: The plant is abnormally small.
  misc_feature: The plant produces a reduced number of seeds.
MAATAAALVRALSSPPSPSPPLSSRPRPRALRGDTLLSLREKPRARVVCAAAASGSSNFGNQTSLMPPFSFTLDEGFSRSKKPYRWQRVLLKVSGEALAGDHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAARTGNPFFTTDTAAALRCAEINAEVVLKATNVDGVYDADPRHNPNARLLETVSYHEVTTRDLSVMDMTAITLCQENNIPVVVFNLQKPGNIAKAIVGEKVGTFIGCTGNQEQNGNALHEERRLVNEA

SEQ ID NO: 4715 - DNA, 1594 bp, Panicum virgatum
  misc_feature: Ceres CLONE 1809556
  misc_feature: Encodes the peptide sequence at SEQ ID NO. 4716
atgtggctgcaggcgacgggcaaacgagcgagaaatcttgacgcgtgcgaactgagccacggcaacgcggcgagcccacgggccgcggctcgccacgcggccggcggagcatcgccgcgtgccccatccccttggcgaacgggcgcgcgtcgcgccacgccgtaaccgctgccaccacacccccgtagcggcggcgagcgcgcgctgctcggcagccgaacccaaagcgcgcagctttgctctccttcgccaggtcggcgggtgcgctcttgccgggacccttgccctcgccgtgaccgtttgctgcgctcggcgctccgcggcgcgccatggagctgctggtccgcggcggcggccggccgccgcgtcctcctccccgcagccgtcgctccagctcccccgccgcgcctgcgtcgctggctcctgccgcccccgtccccgccgccccgggttcccttcgctccgcgcagctgcggcggccgcggcggcgaccaccgccgtggagccggaaacaaaagaacagcagaatgacacttcagaaactgaggtgttcgcgtgccctgtttgctatgaaccattgataagaaaagggccaccaggcataaacttgccagcaatttataggtcaggattcaagtgttcaaagtgcaacaagtcatttaccagcaaagacatcttcttggacctcactgtaacttctgggacaaaagaatatactgaacagaagcctgcgagaaccgagctgttcaggagtccgcttgtctcatttctttatgagagagggtggcgtcaaaacttcaatcggagcggcttccctggtcttgacgaagagtttcaaatggctcaagagtatttccaacccgttgctggaggtatccttcttgatgtcagctgcggaagtggcttgtttactaggaaatttgcaaaatctgggacatactcagctgtaattgctttggacttctccgagaatatgcttcgccaatgctatgaatttattaagcaagatgatactctcctcaacgcgaatttagcacttgtgagggcagatatttcaaggctcccttttgcctcttgttctgtagatgccgttcatgctggagctgctatccattgctggccctcaccctctaatgcggtagctgaaataagccgtgtcctcaaacctggtggtgtgtttgtgggcacaactttcttatcctctcccaggaacaacccattttctgttgaagcattaaggccactgagacagattgttggaccagttaacacaagctacaattacttcaccgaaggagagctagaagacttgtgcaaatcgtgtggccttgttaactatagcaataaggttcagaggtcattcatcatgttctccgggcaaaagccatactgaagaaatctcaatcgctactgtttctttaggatgccgtgtaaaatgaatctactcgagtttcatacatttacatatcaaatagagaatagtgtgcccagggttcctcatttctgtatagatgtgcgtcgctgaatgtttccataacaatgatgtacaaaaatgcatgctgcggattcttgaaagaaacactaccagtgcctt

SEQ ID NO: 4716 - protein, 184 aa, Panicum virgatum
  misc_feature: Ceres CLONE 1809556
  misc_feature (1)..(101): Pfam Name: Methyltransf_11 Pfam Description: Methyltransferase domain
MAQEYFQPVAGGILLDVSCGSGLFTRKFAKSGTYSAVIALDFSENMLRQCYEFIKQDDTLLNANLALVRADISRLPFASCSVDAVHAGAAIHCWPSPSNAVAEISRVLKPGGVFVGTTFLSSPRNNPFSVEALRPLRQIVGPVNTSYNYFTEGELEDLCKSCGLVNYSNKVQRSFIMFSGQKPY

SEQ ID NO: 4717 - DNA, 1857 bp, Panicum virgatum
  misc_feature: Ceres CLONE 1809568
  misc_feature: Encodes the peptide sequence at SEQ ID NO. 4718
gagttcaggcctttgcggttgcaggtccaccaccaccccgcgccgcccggccggcgcgctgcaggtagggcattagtttaagggattctcttccgcggcggccggccgggtggctctgccgcgccacgccccgcgcacatcgcgctgcgcggccctctgcccagctctgctgccgcggcgtgcgtgaaagatgggcctgtggggacgggctccctccttccctgcgctgcgccatgaatgagtggtgcgccttttcttcctcccttccatctggcgcaggttgcctccttcctttccgcgctcctctgtccatgccccgctgctggtgctggcccctgcttcttgctaacggagtagtaggtgttcttggctagcgagcagcgccggcgccggcggcgatggcgaaggagacggagtactatgacgtgctcggcgtctgtcccgcagcatctgacgacgagatccgcaaggcctactacatcaaggcgaggcaaatgcatccagacaagaatcccaacgacccgcaggcggccgagaagttccaggctcttggagaggcctaccaggttctgagtgaccctctacagaggaaggcctatgatggctacggtaagaacagcgtatcgagggacaacatactggatggcactgttgttttcaccctcctttttgggagcgagctgttcgaggactacattggtcatcttgcaatggcaacaatggcctccactgagatgacaagcgacaacgacaaccccgaaaagcttcaagacaggctcaagaatgtacaaagggaaagagaggaaaagctggctagattcctcaaggaattcctctcccaatatgttcgtggtgacaaagaaggatttgctaatcgtgcagaagctgaggcgaagaggctctccagcacttcatctggattggatattcttcgcaccatcggatatgtgtattctcgacaagcagcaaaggagcttggcaagaaggccatgtacctaggagtgccattcgtggctgagtgggtcaggaacaagggccacctatggaagtcacagatcacagcagcaaaaggagccctgcagctgttgcagttgcaacaggaggcctgcctgcagagtaacaaggatggcaatgccacggagcaggatgttgactttcagatgaggatgaacaaggatctgatgatgagctcactgtggaagctgaatgttgtggacatcgaaatgactctcctgcatgtttgtgaaatggtgctttacgaaaacaatgtcaagaaagaagatctgaaggcccgagcaatggccttgaaaattcttgggaagatatttcagagggacaaggaggcattacctgggccagggccagggccgtcagggccatcaaaacgaacagttcttgatgatgacagcagttcagatgacagttcagatgatgacatagctcggacggtgccatatcgaactcctgcatttactcagggaatcggaaggctgttcagatgcttatgcaaccccgcttatgatgttgacgatgattttgagccccgcaaatgagttctgaagaagcaaacaccaatagatgtgttcaaatgttcgtgaattttttctcaagtatatgattcagagccatgtgagtccatatcattcatcgccatcctttatcttaaggatacacacgtagatgctacttcagctctggtgagcacaatgacatttcagatttcaaggttccctttctctctcccaagaacagtagcacttctatttccccctttttttgaaatagattcagctgggttgtgttgtgcctatgtaatttgttgttatcgatgttgtcgaaaaaaaaaaaaaaaaaaaa

SEQ ID NO: 4718 - protein, 384 aa, Panicum virgatum
  misc_feature: Ceres CLONE 1809568
  misc_feature (1)..(63): Pfam Name: DnaJ Pfam Description: DnaJ domain
MAKETEYYDVLGVCPAASDDEIRKAYYIKARQMHPDKNPNDPQAAEKFQALGEAYQVLSDPLQRKAYDGYGKNSVSRDNILDGTVVFTLLFGSELFEDYIGHLAMATMASTEMTSDNDNPEKLQDRLKNVQREREEKLARFLKEFLSQYVRGDKEGFANRAEAEAKRLSSTSSGLDILRTIGYVYSRQAAKELGKKAMYLGVPFVAEWVRNKGHLWKSQITAAKGALQLLQLQQEACLQSNKDGNATEQDVDFQMRMNKDLMMSSLWKLNVVDIEMTLLHVCEMVLYENNVKKEDLKARAMALKILGKIFQRDKEALPGPGPGPSGPSKRTVLDDDSSSDDSSDDDIARTVPYRTPAFTQGIGRLFRCLCNPAYDVDDDFEPRK

SEQ ID NO: 4719 - DNA, 1978 bp, Panicum virgatum
  misc_feature: Ceres CLONE 1809592
  misc_feature: Encodes the peptide sequence at SEQ ID NO. 4720
gtgcgcgcttgtgctcgtgctccccgaccaggccaggccacagcgcgctagctagctaggcgccagcgcggcggggtggcggtggcatgctgcgcggcgcccgcgcccgcgcccgatctgccgccgcggccgggatctgacgccggcggggccgtgacgcggaggaacaggatgtcggcgacgccgcggggcgtgaggcggcgggccgggagcgtcgcgctcggggacctgctgcggcgggaggcgtcggcggagcgcgccgcggcggcgggcgggggcgagcggcccgccgtcgcggcggggcaggccgggcgcgcgaagaagggcgaggacctcgcgctgctcaagcccgcctgcgagcgccgccccggcgcgccgtccacctccttctccgccttcgccctgttcgacggccacaacggcagcgccgccgcggtgtacgccaaggagcacctcctcggcaacgtgctcggctgcgtccccgccgatctgagcggggacgagtggctcgccgcgctcccgagggcgctcgtcgcgggcttcgtcaagaccgacaaggacttccagactaaagctcattcctcagggacaaccgtgacgctcgtcataattgacggctccgttgtgactgttgcttccgtgggcgattcgcgttgtgtccttgaagctgagggatccatctactatttgtcggctgaccatcgttttgatgccagtgaagaggaggttggacgtgtaacagaatgcggaggcgaagttggaaggctaaatgtcgtcggtggtgccgagattggtccccttagatgttggccaggtggtctgtgcctgtcaagatcaattggtgatcaggacgtaggtgaatttataattcctgtcccttatgtgaagcagatgaagttgtctaattctggaggccgccttattattgcaagtgacggtgtttgggatgctttaactgccgaaatggcttttagttgcgcacgaggtctttctcctgaggctgcagctgatcaaattgtcaaagaagctgttgcatcaaaaggattgagagatgatacaacttgcattgtcattgatataataccaccaaagaaaccaaaatccactatagaatctccaaaaacaccaggaaaaggccttggccttctcaaaagtttctttttgaggaaaacattgtctgactcattatctgttgcggataaggataattatcctgagccagatttggtggaggaagtcttcgaggacggatgtccattcctttcaaggaggcttaattctgaatatccagtccggaatatgttcaaactctttgcatgcgcaatttgccaaattgacttgggatctggtcagggggtatccatacacgagggtttgtcaaagcccggaaagttgcgtccctgggatggccctttcctttgtcacagttgccaggaaaagaaagaggcaatggaggggaagcgtcactcacgagagtcatcatcaagaaatagtgggtcaagtgaatagtatccaaggccaggagtcatcttgaggcaaccaactagtggcgtgcaccagggctaatgcttttgttgcaatcagcattatccctgtaacagatgttgggaggcactgtgcctagcctatatatgttggagaagttatacagtactggattgtagaagcaaatctgatcgactcttgatatagagggctctggcagtggcagacaggcgtgatgccaagagattagcaaacaatgttgacgatggccaatagtcatgtaaattattcatgttatagaggtgtgtgacaaatagctgcggttttttaattctcgactaggattaagcattgagaccctgtaattcaactgggaggcctcaattaaaggtcaacaacaatgtagcccgctctcatgtagaatgtatggtgccctataatcttcatgattcaacactgtaattactacatccaaaaaaaaaaaaaaaaaaaa

SEQ ID NO: 4720 - protein, 445 aa, Panicum virgatum
  misc_feature: Ceres CLONE 1809592
  misc_feature (2)..(255): Pfam Name: PP2C Pfam Description: Protein phosphatase 2C
MSATPRGVRRRAGSVALGDLLRREASAERAAAAGGGERPAVAAGQAGRAKKGEDLALLKPACERRPGAPSTSFSAFALFDGHNGSAAAVYAKEHLLGNVLGCVPADLSGDEWLAALPRALVAGFVKTDKDFQTKAHSSGTTVTLVIIDGSVVTVASVGDSRCVLEAEGSIYYLSADHRFDASEEEVGRVTECGGEVGRLNVVGGAEIGPLRCWPGGLCLSRSIGDQDVGEFIIPVPYVKQMKLSNSGGRLIIASDGVWDALTAEMAFSCARGLSPEAAADQIVKEAVASKGLRDDTTCIVIDIIPPKKPKSTIESPKTPGKGLGLLKSFFLRKTLSDSLSVADKDNYPEPDLVEEVFEDGCPFLSRRLNSEYPVRNMFKLFACAICQIDLGSGQGVSIHEGLSKPGKLRPWDGPFLCHSCQEKKEAMEGKRHSRESSSRNSGSSE

SEQ ID NO: 4721 - DNA, 1766 bp, Panicum virgatum
  misc_feature: Ceres CLONE 1809620
  misc_feature: Encodes the peptide sequence at SEQ ID NO. 4722
cttgtcttctctcgccctctgcttttttccgatttcctcttctccacaactccctgccaagaagatcattctcactaactcccaccatggctgcgccgccccctcccagactctgaccagcgcgcgcacgagagttgagaatcaccccggtcgcttgctagttgtccggccgccgccatgccgctgctgcgccagctcctccctatcctcgtggtcctcgtgtccgcggcggcgtgctccgcggccgcgcagccgaccaccgccgaggccgctcccgagagcacgccgggcgccggcatcagggtctcgttccgccccagcgtggccatcgtggtcggcatcttcaccatgatcttctccctcactttgctcctcctcatgtacgccaagttctgccactcgtcctccacgcccctccccgccgcgatcccgaccgcccccgcgccgccgcagggcggcgtcccaaagccggtggtcgagtcgctgcccttcttccgcttcgccacgctgcgcggggcgcgccaggggatggagtgctcagtgtgcctcgcccgcttcgacgacgccgaccacctccgcctcctcccgcgctgccgccacgccttccacctggcctgcgtcgaccgctggctcgagtccaacgccagctgcccgctctgccgggcgcgcgtcgacgctgacgacgcctcgctcgggctcaagtacccctccagcgcccgcatcgtcttcggcggcgacggcctgtcctccggccgcctcggcgacgacgcggcgagcgggcgcgacctcctcgacatcttcgtggagcgcgtgccgtccgcgaggttcgcgggggccgcgggccggaagcaggcggacgaggaggcgccggcgagggcgccgtcgccggagctggacaggcacaagcaccgcatcatcgtgtcggacgtcgtgttcaagagccggtggagcgatctcaactccgccgccctcatcggcctcgacaccgagatgatgcgctccatgtccagcggccgcttctccctcccggattccccggagctgaacgaagccaagctatccacagcagcagaggaggaggttggtggtgccgcaccgacgacggagaggaagcggctgctggtggacggccgaggcggcggcgggtggtgcagcagctccgcggcggttgacgccgtgccggcggcggcgtcgaggatgatatcctccggggtgcggtccatgtcggagatcgtgagcctgcctcggctgcgcggcgcggcgagggagcggctgtcggaggaggagaaccggcggtggctgccgatcgcgcggcggacggcgcggtggttcgccggccgcgccagggcgaaggaggaggccgagccgggagcggcgagtgcccacgtcgtggcggcgcatgtgtgaatagaataggaatcgaatcgatcaaacaatggattgaattttggatggaacaaaagtgtaaacaaacaaagagtcgagatcagccgaagaggagaagtcaaatgtgaattatcgagcggcacggccaggtcagccgacgctgcaagcttacaaaatctaacatgcgtcgtcgaatcgaagaggccagttgctatccaggtatatagaaagattttagcttggcattagctcatacagttggcattcatcccagccaaaattagctgcctaaaaattagctagctggctggttgagcttcaagtaagtatatatcatctctttttccaaaaaaaaaaagtaaaaaaaaaaaaaaaaaaaa

SEQ ID NO: 4722 - protein, 409 aa, Panicum virgatum
  misc_feature: Ceres CLONE 1809620
  misc_feature (1)..(42): Pfam Name: zf-C3HC4 Pfam Description: Zinc finger, C3HC4 type (RING finger)
MPLLRQLLPILVVLVSAAACSAAAQPTTAEAAPESTPGAGIRVSFRPSVAIVVGIFTMIFSLTLLLLMYAKFCHSSSTPLPAAIPTAPAPPQGGVPKPVVESLPFFRFATLRGARQGMECSVCLARFDDADHLRLLPRCRHAFHLACVDRWLESNASCPLCRARVDADDASLGLKYPSSARIVFGGDGLSSGRLGDDAASGRDLLDIFVERVPSARFAGAAGRKQADEEAPARAPSPELDRHKHRIIVSDVVFKSRWSDLNSAALIGLDTEMMRSMSSGRFSLPDSPELNEAKLSTAAEEEVGGAAPTTERKRLLVDGRGGGGWCSSSAAVDAVPAAASRMISSGVRSMSEIVSLPRLRGAARERLSEEENRRWLPIARRTARWFAGRARAKEEAEPGAASAHVVAAHV

SEQ ID NO: 4723 - DNA, 1449 bp, Panicum virgatum
  misc_feature: Ceres CLONE 1809685
  misc_feature: Encodes the peptide sequence at SEQ ID NO. 4724
ctgcctattggaggaaagcacggcagcaagcagacggagccggcgccgagagagcccagcgccggagatctcccccctccgccgccgccatggagacgctggccagcgccatgcggcgcgagaaccgccgcttcaaggccccctccgccggtgccgcctccgccggcgccggcgtcgcctcgggcagggtccctctcgtcatggctttcctttcctgcctcgcctggctctacgtcgccggccggttgtggcaggacgcgcagacccgggcgatcctgtccggtctcctcgagaagaattccggcaacctcccgaaggtgctgtcggtggaggacaagctgaggaacctcggatgcaaggagatcgggaggaagattgttgaggcggagatggacctgaccaaggccaagagcgagggatacttgtgggggaacaggactgctgctgtggattctgagaagaagcagcagcttcttgccgtcattggagtttacactggtttcggctcccggctcaagaggaacaccttccgtggctcgtggatgccaagaggtgatgctctgaagaagcttgaggaaaagggtgtagtcattcgttttgttattggtcggagtgcaaatagaggggataccttggaccgtaatattgatgatgaaaatcggaggacaaacgacttcttgattcttgaaagtcatgaagaggctgcagaagaattaccgagcaaagcaaaaattttctttagtgctgcagttgaagcctgggatgcagaattctacgtcaaagttgaggataacattaatctcgacttagctgggttaattgagatgcttgaaggccggcgaggtaaccaaggattgtacatgggctgtatgaaatcaggcgttgtcgtaagcgaagagggccaacaatggtacgaacctgagtggtggaaatttggagactcaaaaacatattttcgccatgcttctggttctttgtttattctctcgaataatttggctcgttacatcaacataaacagtgcatcacttcagagctatgcacatgatgatatatcagtaggttcatggatgatgggggtgaatgcaacttacgttgatgatgatcagttgtgctgcggtagttctagacaagagaaagtatgttccaatgcttgagttgagcggaaggcatggttctggctgcttatcgcgatgaagaattctttgtacatctggcattttacacactggaaaaggctactatccagatagtattgtattactctatcagaatatctaaccaactttaggagaacaagtttttgcaaccatagaattcttcacctgtagattgatgttcctgctgaccctcttccttggagccagaccacacttatgaagaaccatacacctgaatttgcaatacatttatggatgcatagttctgataaaaaaaaaaaaaaaaaaa

SEQ ID NO: 4724 - protein, 355 aa, Panicum virgatum
  misc_feature: Ceres CLONE 1809685
  misc_feature (1)..(198): Pfam Name: Galactosyl_T Pfam Description: Galactosyltransferase
METLASAMRRENRRFKAPSAGAASAGAGVASGRVPLVMAFLSCLAWLYVAGRLWQDAQTRAILSGLLEKNSGNLPKVLSVEDKLRNLGCKEIGRKIVEAEMDLTKAKSEGYLWGNRTAAVDSEKKQQLLAVIGVYTGFGSRLKRNTFRGSWMPRGDALKKLEEKGVVIRFVIGRSANRGDTLDRNIDDENRRTNDFLILESHEEAAEELPSKAKIFFSAAVEAWDAEFYVKVEDNINLDLAGLIEMLEGRRGNQGLYMGCMKSGVVVSEEGQQWYEPEWWKFGDSKTYFRHASGSLFILSNNLARYININSASLQSYAHDDISVGSWMMGVNATYVDDDQLCCGSSRQEKVCSNA

SEQ ID NO: 4725 - DNA, 1561 bp, Panicum virgatum
  misc_feature: Ceres CLONE 1809689
  misc_feature: Encodes the peptide sequence at SEQ ID NO. 4726
gcggagcggagatgcagcagcctcaagtgccgtcggcggcgctcgcggtggtgccgtcggcgtcggcggtggcccacccgaacgatccggcagggggagacgcgccgccgaagcaggtcgcgcaggcgatggagcgtctggggcgtgcggggcggcttatcgcggaaatccggctcggcgcggaccgcatcctcgaggccctcttcgtcgccggcggcgcgcccccgtatagcgcgccccagcacatcgacaggacatcgcgcgctatcgtccaggaggaggctgccatgcgccgccacttccaggacctccgcgccctcggcaggcaattagaggagtctggagttcttaatggggcccttaaagctcgaggaaattcatggggcttgcacatgccacttgtttgtccagatggtgctgttgtagcttatgcttggaagcgtcaactggcaggtcaggctggtgcatctgctgtggacagaaccaggttagctttaaaggccttcactgaccagaaaagaagattctttcctcatctagaagatgaagtccttagccatctccatgatggtgagcctggtgtcaccaaaaagccaaggttgtctaccagtaatggagagcttggggaagaatctttatctgaaatactgaaaaatctggaaaatgaagtgcctaacatgaaaatattcacataccggcatctggattggtctaaaagagcttcgtcattagcatctctgatggatgatgagtttgtggatccatctaaagagttgaacctgcaaaatttgggcaaattgagatccagtgctctgacaacttccattgaccaggttgcagtgattgagttgttggttccttcaatatttcgagctatagtgtcattgcaccctgctggatctactgatcctgatgcagtggctttcttctctaccaccgagggaggaagctaccttcacgcaagaggcacgtcaatgcatcatgtctttaagcatgtaaaggagcattctgacaaggcattgcagtactttgtcagtgtggagcccagtaaagcactatctctgcttttgcgttggattgccagctatcagactctgtttacaaaggtttgcagcaaatgcagacggcttctgatgatggacaaatccttggctttgcttttgccaccagtgcaccgcccatatcaccagacttcaaatgttggcccagatcttcaggaggcgtatcacattggatgttcttcctatgaaggctagctaatgattcttacgaacactcgagactctttaagatagcatagattggttccaacgctgtcacctaacaaagcacatgtgcaagaatcgttctatgtacaacagtgtttttttttttggacgtgtaacatatctgttgagaactgaaggttgttgttgcataggtagttggattttctacctgtaatcttcacccccacaaccccaccaccaccaaattgtactttgatcgtttgtgtatcttgtgggaagctgttgcagaaacctacatagttatgttgattcaaaaaaaaaaaaaaaaaaaa

SEQ ID NO: 4726 - protein, 414 aa, Panicum virgatum
  misc_feature: Ceres CLONE 1809689
  misc_feature: Great-hit functional homolog of the protein sequence given in SEQ ID NO 9234
  misc_feature: Useful for making plants with modulated oxidative stress sensitivity
  misc_feature: Useful for making plants with modulated oxidative stress sensitivity
MQQPQVPSAALAVVPSASAVAHPNDPAGGDAPPKQVAQAMERLGRAGRLIAEIRLGADRILEALFVAGGAPPYSAPQHIDRTSRAIVQEEAAMRRHFQDLRALGRQLEESGVLNGALKARGNSWGLHMPLVCPDGAVVAYAWKRQLAGQAGASAVDRTRLALKAFTDQKRRFFPHLEDEVLSHLHDGEPGVTKKPRLSTSNGELGEESLSEILKNLENEVPNMKIFTYRHLDWSKRASSLASLMDDEFVDPSKELNLQNLGKLRSSALTTSIDQVAVIELLVPSIFRAIVSLHPAGSTDPDAVAFFSTTEGGSYLHARGTSMHHVFKHVKEHSDKALQYFVSVEPSKALSLLLRWIASYQTLFTKVCSKCRRLLMMDKSLALLLPPVHRPYHQTSNVGPDLQEAYHIGCSSYEG

SEQ ID NO: 4727 - DNA, 988 bp, Panicum virgatum
  misc_feature: Ceres CLONE 1809706
  misc_feature: Encodes the peptide sequence at SEQ ID NO. 4728
ctctcctggtccgtcagcagtcaacctctgtcatctgtctgctgttgctgctgtcgctgctgctgttgcggacttgcggcggcggctctacccagatcggcggcggcagggccctcttgcgggtagatcaggcgggcggcggcaatggggcacccgtacgcgccggcggacctgcagctgccgggcttcgtaccgctgcagctatcgcagggcccgatcctcgtgacctacatcggcgcctccctcttcgtccttctctccatctggctcatctccggaagatgtggcggattatccaagatcgaccgtctgctcatgtgctggtgggcattcacagggttgacccacatactgatcgagggtcccttcgtcttcacccctaacttcttcaagaaggagaaccccaatttcttcgatgaactttggaaagagtacagcaagggggactctaggtacgttgctagggacaccgcaactgttacggttgaagggattaccgcagtattggaaggccctgcatcacttcttgctgtctacgctattgcatcccggaagtcctacagccatattcttcagttcactgtctgcttgggtcaactctatggatgcttggtttacttcattactgcctacttggatggtttcaatttctgggccagtcccttctacttctgggcatacttcattggtgcgaacagttcgtgggttgtgataccaacactcattgccatgagatcctggaagaagatttgtggagcatttcaagctgaaaaggtgaagaccaaataaaaacggccttggccactgtttcatcagaaacttgacactgaaattcttgtgtttgtactgaaaactgcttctaccatttgctgaaacaacattgtaatacaagaaaatgtgatttcgttcccaatcaaacagcgttgctggctattccttcgaaataatagaagctgtactcttaactcaaaaaaaaaaaaaaaaaaaa

SEQ ID NO: 4728 - protein, 214 aa, Panicum virgatum
  misc_feature: Ceres CLONE 1809706
  misc_feature: Great-hit functional homolog of the protein sequence given in SEQ ID NO 9427
  misc_feature: Useful for making plants with altered sterol content
  misc_feature: Useful for making plants with modulated nitrogen use efficiency
MGHPYAPADLQLPGFVPLQLSQGPILVTYIGASLFVLLSIWLISGRCGGLSKIDRLLMCWWAFTGLTHILIEGPFVFTPNFFKKENPNFFDELWKEYSKGDSRYVARDTATVTVEGITAVLEGPASLLAVYAIASRKSYSHILQFTVCLGQLYGCLVYFITAYLDGFNFWASPFYFWAYFIGANSSWVVIPTLIAMRSWKKICGAFQAEKVKTK

SEQ ID NO: 4729 - DNA, 1716 bp, Panicum virgatum
  misc_feature: Ceres CLONE 1809721
  misc_feature: Encodes the peptide sequence at SEQ ID NO. 4730
atcttcttctccgcctcggctccaagctgcagccccccgccctgccaagtctccaaccgccgctcgctccgatccggcaccctctgctctctaaccccacgctctgtcgatctgcgctgccgcggagatggcggagcaggagcagcggccgctgctcgagatagagcaatgtgtcacatctataccagaagatcatgaagccacatgttggggctgtgggctcaggcttgtttttgcaagctattcgcctgtctataagtgtggctggtgtggagcaattacgcaaagcaaccagactgcaagaaaacctgatagtgtatgcttttcccactggaggcgtttacgggaccgattctttgtgactgtgctcatcctcttcatgctctttgttatatgtggtggggtctgggcggtgtatccaattgttttctctgtcagcaaattttgtggtatttttcactgcatggtaacagctatcttggctttatgcaccatcacaagttattgtttagcctcttttaaatccgctggtgcaccaacaaacatacgatggggcagctatcccatggttgggaaaagtgatcttgagagctacacgttttgtacatactgcaataaaccaaagcccccgagagcacatcactgccgatcttgtaaaatgtgtgtggtggacatggatcatcattgcccatttattggcaactgtgttggagcatcgaatcatcaagcctttgtcatttttctgatatctgtggttataagttgtgcttatgctgcttcaatgaccatatatgcgagttataagacatggccctctgtcgatttcccaaatctagaatcatctcgtcattcaatgagttctatgaaaatattgttggagatcattactaccatagcaggatctccattcttcttgtctgcaaggggtctagttctggtatacctagcatttgctagtttatcagtcaatgctggtataggcgtcttgctgtgccagcagcttagctatatctatgaaggaaatacatatctcaaccatttaagttcaccaaatgccatgcatggagagagagggttccataacattgttagatttttcgggtgcccctacccaatttccagagttctgttgcgatactcaaatactggcaagttgcaggataattcaggctccaaacttctttagaggttttggtgctttactctttttcccagcaacttgtatggaactatttgtatacctatagaattgtgaatctctgttgaccaccatagattagcttgtgtaattgaaggtgttcaggaatgcaatactcatgataatccatgttctggagaaagcattagttcgtcagtggatgtttctcatattgatcggcctgcgtattcattgccctgcactgacaatcataaggtgccgatggtcttgcatatctgaaattctgcgcgtcgtcactatctttttcatcactatcttcacgcatggatcacgcttggttgctccagaagaaatggacatcaggattgagtgatgctaggaggtcaatttttttttcttggaccacgtccttctgatgttgtcgatacagttgacatgtataggaaaacaaccccgcatttgtttcggtaacattcactgaactagccattgtaaattggtcaatcaagcatcgatgagtggggtacatttgcttttaaaaaaaaaaaaaaaaaaaa

SEQ ID NO: 4730 - protein, 352 aa, Panicum virgatum
  misc_feature: Ceres CLONE 1809721
  misc_feature (1)..(64): Pfam Name: zf-DHHC Pfam Description: DHHC zinc finger domain
MAEQEQRPLLEIEQCVTSIPEDHEATCWGCGLRLVFASYSPVYKCGWCGAITQSNQTARKPDSVCFSHWRRLRDRFFVTVLILFMLFVICGGVWAVYPIVFSVSKFCGIFHCMVTAILALCTITSYCLASFKSAGAPTNIRWGSYPMVGKSDLESYTFCTYCNKPKPPRAHHCRSCKMCVVDMDHHCPFIGNCVGASNHQAFVIFLISVVISCAYAASMTIYASYKTWPSVDFPNLESSRHSMSSMKILLEIITTIAGSPFFLSARGLVLVYLAFASLSVNAGIGVLLCQQLSYIYEGNTYLNHLSSPNAMHGERGFHNIVRFFGCPYPISRVLLRYSNTGKLQDNSGSKLL

SEQ ID NO: 4731 - DNA, 2283 bp, Panicum virgatum
  misc_feature: Ceres CLONE 1809729
  misc_feature: Encodes the peptide sequence at SEQ ID NO. 4732
gtatgatacccccacgcgaactcctcttcccacgccgcctcgcctccccttccaagttccacccctcgccgtccctcgcggcctcgccctcctctgcgccgcgctaaaaccctagccctcgaattcctcttcccccgcgcggagcagacgagcccgctcccctgtcgcccatggcgtcctcgggggccgcctccaacctatgggtgctcctcggactcggcatcgccggggttctgctggcggcgcggaagctgaggcgccccgcgcgccccgaccacggggccttcatcgcccgcctcgagctcctcccgccgccgcagcctccgccgccgcaggcgccccacccactcaccggtctctgctttgccatcgctgacgcattgcatgtcagtggttatattacaagtttcggcagtcttgaatgggcaaagacacatgatgcagagacacaaacatctccagtggtttcagctcttgttgatggtggtgctgtttgtgttgggaaaactgttattgacgagatggcatacagtatccatggagagaataagcattttgatacaccaacaaatcctgctgctctggatcgagtaccaggtggatgctcaagcggatcggctgttgcagttgctggtggaatggtagattttgccctgggtattgactcaataggaggagtaaggataccaggtgcttattgtggtgtcttggcattcaggccttcacatgctgttgtttccagtggtggtgtcattcctgttgcgcctagcctggacaccataggctggtttgcaagggatccaagtgtgttgcgtcgtgttgggcatcttcttcttggacttaattatgctgatattcgcccacctagacatttttacatagcagatgattgctttgaactttcgaaggtacctgctagaaggcttactcaggtggtgacaaaatctgtgaagctttttggaagacaggtcactcgtatgaatcttgaaaattatttgtcttcaaaaatatccagcctgaggaactcttcaaatgggcataagaaaggggattcaaagttcccttcgttgttggcactttgtaatgccatgcgatcgcttcacaagtgtgaattcaaagatcagcatatggagtggataaactcagtcaagcctgctgtggatgctcgcatagtcagtaatttgtctgaggatggtgattcagatattgacggctgccaagatgtgagaaacaaagcacgcttggctctaggtgcacttcttaaggatgatgggattttggtcattccaactgctttgggatgccccccgaagcttaatgctaaggaactctcttctgaaagctacaattctcagacattgtgcctttcatctttagcgagtatgtcagggtgttgccaggtttcgattcctctgggtactcatgataagtgtcctgtttcggtttcattcattgcaaggcacggttgtgatcgttttttattggataccattcaaacaatgtatgcaaccatccaagagcaggtggagatcctagcaaaatctaatgtttcaagtaaacaggcaatgaatgaagaagcggctgaagctgctaaagagaaaggtaatgctgcatttaaggaaaaacaatggcaaaaggcggtaaatttctatacggaagcaatcaaattaaacggaaaaatggctacatactatagcaacagagctgctgcctttcttgaactcactagctaccgtcaagctgagacagattgcacaagtgccatcgatcttgatccaaagatcgtgaaagcttatttacggagaggaactgcaagggaaatgatgggttattataaggaggctgttgaagatttcaaccatgccctcattctagaaccgatgaacaagacggctggtgttgccattaacaggttaaagaagttgtttccataaatacgaatccggtgaattgtctccgcatgatgtgattgcatcagattttgtgcacacacaagttgtgcgtgtccgggggagtgggatcgaagtacctggagctcaaccgacggatgctgctagcctggtacacatgctttatgctcttacaaggtaccgagtcatcacagctggtggcaactgatttccagagctgtggtcagttacagtcaatttacccggttcccatcccccccccccccccccccaagttttggaaaagcagaaaataaaccacaagtttttggaagttgatcacagtaaacaatgtcttcaaaagcgctttacggaaaaaaaaaaaaaaaaaaaa

SEQ ID NO: 4732 - protein, 587 aa, Panicum virgatum
  misc_feature: Ceres CLONE 1809729
  misc_feature (1)..(432): Pfam Name: Amidase Pfam Description: Amidase
MASSGAASNLWVLLGLGIAGVLLAARKLRRPARPDHGAFIARLELLPPPQPPPPQAPHPLTGLCFAIADALHVSGYITSFGSLEWAKTHDAETQTSPVVSALVDGGAVCVGKTVIDEMAYSIHGENKHFDTPTNPAALDRVPGGCSSGSAVAVAGGMVDFALGIDSIGGVRIPGAYCGVLAFRPSHAVVSSGGVIPVAPSLDTIGWFARDPSVLRRVGHLLLGLNYADIRPPRHFYIADDCFELSKVPARRLTQVVTKSVKLFGRQVTRMNLENYLSSKISSLRNSSNGHKKGDSKFPSLLALCNAMRSLHKCEFKDQHMEWINSVKPAVDARIVSNLSEDGDSDIDGCQDVRNKARLALGALLKDDGILVIPTALGCPPKLNAKELSSESYNSQTLCLSSLASMSGCCQVSIPLGTHDKCPVSVSFIARHGCDRFLLDTIQTMYATIQEQVEILAKSNVSSKQAMNEEAAEAAKEKGNAAFKEKQWQKAVNFYTEAIKLNGKMATYYSNRAAAFLELTSYRQAETDCTSAIDLDPKIVKAYLRRGTAREMMGYYKEAVEDFNHALILEPMNKTAGVAINRLKKLFP

SEQ ID NO: 4733 - DNA, 2087 bp, Panicum virgatum
  misc_feature: Ceres CLONE 1809738
  misc_feature: Encodes the peptide sequence at SEQ ID NO. 4734
actactcggcagcattctactccctagtgtcacacggactatccacccgtgctcgtaagtaattgagacatcagcgtctaagctagtgtccaacgcaaagtcatagaaattaagatcagcagcatggaagcgaacgggtcgcaagaacaactgcctcgccgtagcatcggcctcgatcatgagtccctgcagcagccgcagagcgatcctaggaggaagggtggatggatcaccttccctttcctcggagtggccatgatggggcttggtgtggcgacgagcggcgccttgagcaacctggtcgtctacctgatcaaggagtacaacgtgccgagcgtcgacgcggcccagatctccaacatcatcgccggctgcatcagcttggccccggtggccggagccatcgtcgccgacgccttcttcggctgctacccggtcgtcgcggtctccatggccttctccgtcctgtccttggttgtgttcaccctgacggcaagcctgcgcggcctccgtccggcgccgtgccagccggccgccggcccatgcgagccggcatcggccgggcagatggccgcgctgtacgccggcgtgttcctgatgtgtgtgagcgccgcaggctcgcggttcaaccaggcgaccatgggcgccgaccagttcgactccgcggccgaccgcgacgtgctcttcaactggttcttcatcttcttctacacctcctccgtcctgggctccacggtcatcgtctacgtccaggacacggtgtcgtggaagctcgggttcggcgtctccgccgccgccagcgtggtgggcctcgcggcgctgctcctggggtcgcggtactaccgccggccagccgtgcggggcagcccgttcacggggctcgcgagggtggccgtcgccgccgtcaggaagaggaaggtcgtcgtccatgtggcgacgtcaggggagctgaaattctaccacggacgacgacggagcggtggcgccgacgacaaagctgctggtaacagtgaaactggcattattattgctccgagcgacagcttcagctttctgaaccgcgccgcactgatcaccgacggcgacaccatcagcccggacggatcagtggcccggccgtggcgcgtctgcacggtgcagcaggtggaggacttcaagacggtgctgcgcatcctaccgctctggagcgccaccatcttcctcagcatcgccctcggcgtccagatcaacttcaccatccttcaggcgctcgtcatggaccgcgccgtcggccgcttcaccatcccagcaggatccatggtagtcggctgctttgtcgccgtggtcgtctccctcggcctgttcgaccgcatcctcctcccactctggcggcgcgtcaccgggcacgatccaacggcgctgcagcgcatcggcgccggccacgtgatcactatcgtcagcatggccgcatccgccgtcatcgagcgccggcgcatggccaccgtgcacgcgcacggcgagggcagcgacccggcgtgggtgtcgccgctgtcggccatgtggctgctcctgccgttcgctctgtccggagccggcgaggctcttcacttccccggccaggtgacgctgtactaccaggagtttcccccgtcgctgaagaacaccgcgacgggcatggtcgccatgatcgtcgcgctcggtttctacctgagcacggccctcattggcatcgtccggcgcgccacggcgtggctgccggacaacatgaacgcgtccaggctggagaacctctactggctgctggccgtgctgttggccgtcaacttcggatactacatgttgtgtgccagattgtacaagtaccagaacgtcggcaagtagctggagatttcaagatcagggccggccagaaggtatcactcctagcgttctggccagtgacttgttgatctatgcagtgtgctaaagctgtgaaataagatactacaattgcaagtgggagatgagtttgatgtcagttacattgttggtaatttagtagattgttgggaaacagacagattataaaataaaaattatcagcttacgaaaaaaaaaaaaaaaaaaaa

SEQ ID NO: 4734 - protein, 578 aa, Panicum virgatum
  misc_feature: Ceres CLONE 1809738
  misc_feature: Great-hit functional homolog of the protein sequence given in SEQ ID NO 9675
  misc_feature: Great-hit functional homolog of the protein sequence given in SEQ ID NO 9762
  misc_feature: Useful for making plants with altered carbon content
  misc_feature: Useful for making plants with altered nitrogen content
MEANGSQEQLPRRSIGLDHESLQQPQSDPRRKGGWITFPFLGVAMMGLGVATSGALSNLVVYLIKEYNVPSVDAAQISNIIAGCISLAPVAGAIVADAFFGCYPVVAVSMAFSVLSLVVFTLTASLRGLRPAPCQPAAGPCEPASAGQMAALYAGVFLMCVSAAGSRFNQATMGADQFDSAADRDVLFNWFFIFFYTSSVLGSTVIVYVQDTVSWKLGFGVSAAASVVGLAALLLGSRYYRRPAVRGSPFTGLARVAVAAVRKRKVVVHVATSGELKFYHGRRRSGGADDKAAGNSETGIIIAPSDSFSFLNRAALITDGDTISPDGSVARPWRVCTVQQVEDFKTVLRILPLWSATIFLSIALGVQINFTILQALVMDRAVGRFTIPAGSMVVGCFVAVVVSLGLFDRILLPLWRRVTGHDPTALQRIGAGHVITIVSMAASAVIERRRMATVHAHGEGSDPAWVSPLSAMWLLLPFALSGAGEALHFPGQVTLYYQEFPPSLKNTATGMVAMIVALGFYLSTALIGIVRRATAWLPDNMNASRLENLYWLLAVLLAVNFGYYMLCARLYKYQNVGK

SEQ ID NO: 4735 - DNA, 1727 bp, Panicum virgatum
  misc_feature: Ceres CLONE 1809741
  misc_feature: Encodes the peptide sequence at SEQ ID NO. 4736
acacccccgttcatggccctcgccaccgcggccacggccgcagccgtctctctccaatctctcctcacccggcctgcctgcgtcctccgcttcggccgccgcctccctccccacctcctccgcgccacctcctctacctccaacgccccggacttcaacatcaccttcgcggagcccgccccggcaaagaaggcgaatgcctcgtcccccgctccttccgcgcagcctctggtcccgtggatcgtccgcggggaggacgggaagccacgtctcagcacctcgccgccgccggaggtgctccaggccattgcgctcgcggaggcggaggccaagaaggcggctaagaaggaaagtctcaagggtcagaagggtgcggttgccgccgccgccgctgcttccagtgccggcgtcaagaccaaggaaaggaaggctgccccggccgcgccgcccaagttctcaaaggcggccaggaggttctacaatgagaatatcaaggagcgcgagccgcagcggctcgccaaggtccttgccgctgcaggagtggcctcaagaaggacgagtgaggagctcatcttccaagggaaagtgactgtcaatggcgcagtctgcacttctcctcagaccaaagttgacatcttgaaggattctatctacgttaatgggaaccgcatttccaagaagctgcccccaaagctgtattttgctgtgaacaagccaaaagggtatatctgctcgtgtggtgaagaatcaaagtctgttgtctccttatttattgactatttgaagggttggaacaagattcaaccagggctgccaaaaccacgcttatttactgtgggtcgtcttgatgttgccacaactggtttgataatagtcacaaatgatggagagtttgctcagaaacttgcgcatccttcttcaaatgtaacaaaggaatatgtagtaactattgatggtgctgtgcacaagaaacacctcatagctatcagtgaaggcacaaaaattgatggggtcatgtgcgtacctgatttagtagagccattggctgaatcagatacaagaaagacccgtctaaagatagtggtccatgaaggacgaaatcatgaagttcgtgaacttgtacagaatgcagggctaaaggtttacgcattgaaacgcgttcggataggcaggttccggcttccggcagatctgggaattgggaagtttgttgagctcaaacaggctgatatcaaggcactagaaggcaacaactagatatgacaggctgatatcaaggcactagaaggcaccaactagtgatgacatctgtgttccttcactgatgatttttgaactaatgtggataagtacatctccgtcaaaggatggcagcaatccttctgatggtcacaattcaggagctgctactccactcagaaaacctgtgaatctcctgggtgtccattggtggtggtggtggctgatgagcaagttcagcaagcatatttttgcctggaagaacctgtgaactgcttcgctgagaaaccatggtcctaaaaaacagcagaacctccaattccgacggtggagcagcctttggtgaaggatataacattgtcaaatagcagaactcgtgaaagcatgtactctgtatatcggtgtaaatctacatgctctcatgcgagcacatgaaccatttttccaacggttaaacagtaattgatggcttacgagtatacttggcc

SEQ ID NO: 4736 - protein, 414 aa, Panicum virgatum
  misc_feature: Ceres CLONE 1809741
  misc_feature (1)..(147): Pfam Name: PseudoU_synth_2 Pfam Description: RNA pseudouridylate synthase
MALATAATAAAVSLQSLLTRPACVLRFGRRLPPHLLRATSSTSNAPDFNITFAEPAPAKKANASSPAPSAQPLVPWIVRGEDGKPRLSTSPPPEVLQAIALAEAEAKKAAKKESLKGQKGAVAAAAAASSAGVKTKERKAAPAAPPKFSKAARRFYNENIKEREPQRLAKVLAAAGVASRRTSEELIFQGKVTVNGAVCTSPQTKVDILKDSIYVNGNRISKKLPPKLYFAVNKPKGYICSCGEESKSVVSLFIDYLKGWNKIQPGLPKPRLFTVGRLDVATTGLIIVTNDGEFAQKLAHPSSNVTKEYVVTIDGAVHKKHLIAISEGTKIDGVMCVPDLVEPLAESDTRKTRLKIVVHEGRNHEVRELVQNAGLKVYALKRVRIGRFRLPADLGIGKFVELKQADIKALEGNN

SEQ ID NO: 4737 - DNA, 1589 bp, Panicum virgatum
  misc_feature: Ceres CLONE 1809790
  misc_feature: Encodes the peptide sequence at SEQ ID NO. 4738
acccacgagcccaacaccaacacacttcccggccccgcgcctcccacccaacccatccgccaccgccgcccgactcctccctcctcgccggaatggcggtctgggccgcgcaccacgccagctgcaggccccaccaaccgtcctcctcctcctcgtcccagcgcccgcgccgggtcgcccgcctcctcccgctcccgctcccgaccaggcggggcggcgcctccctcgcgaggccgcgcgcgagcctcgccgccgcggcgcccgtggcgaggacggcgtcggaggaggccgtctacgaggtcgtgctgcggcaggcggcgctcgtggagggcgccgtcgcgagcaagggcgcggcggcggcggcggggcggcggcggcggcggcagcagcagcgcccgcgctgggcggaggagaaggaggacgaggggctccgcgggtggggcctcctcggcgacgcctacgaccgatgcggcgaggtctgcgccgagtacgccaagaccttctacctcggcacacagcttatgactcctgaaaggcgcaaagctgtctgggcaatctatgtatggtgcagaagaactgacgaactagtggatggtcctaacgcgtcttacattacaccaactgctcttgatcggtgggagaagcggctagaagatcttttcgaaggtcgtccgtatgatatgtacgatgcagccctcgcagacactgtgccaaagtttccggtagatatccagccattcaaagatatgattgaagggatgaggcttgacttgtggaagtccagatacaggacctttgatgagctctacctctactgctactacgtcgccggcacagttggcctcatgacagttcctgtgataggcatcgccccagactcaaaggcctctactgagagtgtgtacaatgctgcactggctcttggcatcgctaaccagctgacgaatattctcagagatgtaggcgaagatgcaaggagagggagaatataccttccactggacgagcttgcacaggcaggtctgaacgaagatgacattttcagagggaaagtgactgataagtggaggaggttcatgaagggccagattcagcgtgccaggttgttcttcgatgaggctgagaagggtgtggcccatctagattctgcgagcagatggccggtcctcgcgtctctctggttgtacaggcagatccttgatgccatcgaggcgaacgactacaacaacttcaccaagcgcgcctacgtaggcaaggcgaagaagctgctgtcgctaccggccgcttacgcaagagctgctgttgggtcatgatgcgtctgtagatcagatattcattttttgtttttcttcttctctcagcttggtgttcccttttttttccttcatctttgggagatctgttgggtgttgtatataatcagtttcagctgcctgcatggcataagcctgtctgtcacacacaatttttagcctagggaactcattccaggtccctcaatactcagctcttgtcacgacacagaatggaaagaaagttagaattcaagaagcattattagttgtggataaaaaaaaaaaaaaaaaaaa

SEQ ID NO: 4738 - protein, 406 aa, Panicum virgatum
  misc_feature: Ceres CLONE 1809790
  misc_feature (1)..(275): Pfam Name: SQS_PSY Pfam Description: Squalene/phytoene synthase
MAVWAAHHASCRPHQPSSSSSSQRPRRVARLLPLPLPTRRGGASLARPRASLAAAAPVARTASEEAVYEVVLRQAALVEGAVASKGAAAAAGRRRRRQQQRPRWAEEKEDEGLRGWGLLGDAYDRCGEVCAEYAKTFYLGTQLMTPERRKAVWAIYVWCRRTDELVDGPNASYITPTALDRWEKRLEDLFEGRPYDMYDAALADTVPKFPVDIQPFKDMIEGMRLDLWKSRYRTFDELYLYCYYVAGTVGLMTVPVIGIAPDSKASTESVYNAALALGIANQLTNILRDVGEDARRGRIYLPLDELAQAGLNEDDIFRGKVTDKWRRFMKGQIQRARLFFDEAEKGVAHLDSASRWPVLASLWLYRQILDAIEANDYNNFTKRAYVGKAKKLLSLPAAYARAAVGS

SEQ ID NO: 4739 - DNA, 1661 bp, Panicum virgatum
  misc_feature: Ceres CLONE 1809808
  misc_feature: Encodes the peptide sequence at SEQ ID NO. 4740
gcgccctcgattcgcttgccgcatcgacatggacaggcccacccgcccgctcgctctgcttcccttgctcctctgcctctgcctctgcgtcgcctcgccccgcgccggctccgccgcgtcggtcaccgccggcacccccgacgggtcggagcggtgggggtacgtcgaagtccggccaaaggcgcacctgttctggtggtactacaggagcccgcagaggacgacggcgccggggaagccatggccgaccgtcctctggctgcagggcggcccgggcgcgtcgggcgtcggcctcggcaacttcctcgaggtcgggcccctggacgtcaacctgaagccgcgcaactcgacatggctgcagaaggccgacctcatcttcgtggacaacccggtgggcgtcgggtacagctacgtggaggacgacagcctgctggtgaccaccgactggcagcaggccgccgacgccaccgcgctgctcaaggcgctcgtcagggaggtgcccacgctgcagagcagcccgctgttcctggtcgccgagtcctacggcggcaagtacgccgccacgctcggcgcctccgtcgccagggccgtccacgccggcgagctcggcatcacgctcggaggcgtcgcgctcggggatagctggatctcgccggaggatttcacgctcgcgtacacgccgctgctcctcagcgtgtcgaggctggacgacaacgccggcgacgaggcgaaaaggaaggcggaggccgtgaggcggcagatcgcggcggggcagtgggcgccggcgcagggctcttggggcgacctgctggatttcatcagcaccaagagtggcaacgttgatatgtacaacttccttctggacagcggcatggacctggtgtccgcggacacaccgacgggctcgtcggcgacggcgagcagcgtgcaggcgctgaggtatgcggcgtacctcggcggcgaggactcagactccaacaccatcgacggcatcatgaacggggtggtcaaggagaagctcaagatcgtccccaaggacctcaagtgggtggagatctcccaggatgtctataacgcgctggtcaacgatttcatgaagccaagaatcgatgagattgacgagctgctgtcttatggagtcaatgtgacagtgtacaatggccagctcgacgtgatctgctcgaccaacggcgcagaagcctgggttgagaagctcaaatgggatggtctgaagagcttcctgagcctgccaagggaatctctgtactgtggccagagcaaaggaaccaaggcttttgtcagatcctacaagaacctgcacttttactggattcttggagctgggcactttgtgcctgccgaccagccgtgtatcgcgctgagcatgatcagcagcataacccaatctccagccagctagggattatgtgtcatatgcaaagatcaaaaggaggctttaacttcaagcagttaggacaaggacattgcagcattcttgaagtacagtaaaggttgcttactttaaaggcaatgtaattgatgatacttgtgcttttcttcttatgcttttcattcagggaaaatagggacattgatgtgatataaaaaggcctcatatttgattcccaaaagaaaggggcgaaaaaaaaaaaaaaaaaaaa

SEQ ID NO: 4740 - protein, 463 aa, Panicum virgatum
  misc_feature: Ceres CLONE 1809808
  misc_feature (1)..(427): Pfam Name: Peptidase_S10 Pfam Description: Serine carboxypeptidase
MDRPTRPLALLPLLLCLCLCVASPRAGSAASVTAGTPDGSERWGYVEVRPKAHLFWWYYRSPQRTTAPGKPWPTVLWLQGGPGASGVGLGNFLEVGPLDVNLKPRNSTWLQKADLIFVDNPVGVGYSYVEDDSLLVTTDWQQAADATALLKALVREVPTLQSSPLFLVAESYGGKYAATLGASVARAVHAGELGITLGGVALGDSWISPEDFTLAYTPLLLSVSRLDDNAGDEAKRKAEAVRRQIAAGQWAPAQGSWGDLLDFISTKSGNVDMYNFLLDSGMDLVSADTPTGSSATASSVQALRYAAYLGGEDSDSNTIDGIMNGVVKEKLKIVPKDLKWVEISQDVYNALVNDFMKPRIDEIDELLSYGVNVTVYNGQLDVICSTNGAEAWVEKLKWDGLKSFLSLPRESLYCGQSKGTKAFVRSYKNLHFYWILGAGHFVPADQPCIALSMISSITQSPAS

SEQ ID NO: 4741 - DNA, 2359 bp, Panicum virgatum
  misc_feature: Ceres CLONE 1809831
  misc_feature: Encodes the peptide sequence at SEQ ID NO. 4742
atccagccactcgataaaagccggcgccgagcagccaagaatctcttgggacagaaccgtacactccctgctcgcttccgttgatctccggactcacgagagcgagagatcgaggttgttggcggccatggcggcggcccactgcgcgtccacttcctcagccttcctcggcctcccgcgcggcaacggcaggcggcgcaattcctgccgcttcgtcgccaacgccaggctggtgccggtgtccgccacgctggacaaggagaccgcggcggcgaagccgcggaggtcccggaaccgccggtccaggaaggcgaccaagtccgagtccacggcgctgctcgccgccgacgagcccgcggaggccaaggacggtggagcccccgaggaggcggcaaacggtggcggcggcagggggatggtagcgctggacgacgtgatcgtgaacccggtggggctcggccggcgctcccggcaggtgttcgatgaggtgtggcgcaagttctcgcggctcggccagatgtccagcgcctcctccgccgctgtggccgagcaggaccccgccgtcctcttccgcagcgggcccatgtgcgagttcaccgtgcccggcgcgcaggacatcaccgtcctcgtcgtcggcgccaccagccgcatcggccgcatcgtcgtccgcaagctcatgctccgcggatacaacgtcaagacattagtcaggaggaatgatccggaagtgattgacatgcttccgaggtctgtggacatcgtggttggcgatatcggtgatccttcttcagttcaggctgccgtttcaggttgcaacaaggtaatttactgtgctaccgcacggtcgactatcaccggagacctcaacagggttgataaccaaggagtaagaaatgttaccaaggctttccaggattactacaatcagctggcccagtcaagggctggtaaaagcagcaagagcaaactgacgattgcaaaatttaagtccgccaaatctgtgaaaggatgggaggtgcgtcagggatcatacttccaggatatctacccttctagattcgatggaggcaccgatgcgtcatttgaatactcggaaaggggacaggctgttttctcagggtttgttttcacaaggggtggctacgttgaaatgtctaaacggctttcgcttcctctgggttccacactagacaggtatgatggattgcttctttcggtgggcggaaatggaagatcatatgttattattctcgagactggtccactggctgacacctcacagaccaagaaatattttgcccggatgaacacaaaagttggattttgcagagtgagagtgccgttttcagctttccggccagtaaacccacaggatcctccattggacccctttcttgtgcacacactaaccatcaggtttgagcccaagaagcagagacctggtgattcatctgaaggagctgctagtgaccccagaaactttgagctgaaaatggagtttataaaagctttgccaagtggtcaagaaacagacattgtgctggtctcatgcacgggctcaggaattgaagctaacaggcgagaacaagtcctcaaagcgaagaaggctggagaggacgcattgaggagatctggcctcgggtataccattgtgcgcccaggtccgctgcaggaagaacctgggggtcagcgcgccttgatcttcgaccaagggagcaggatctctcagggcatcagctgcgccgatgtggccgacatctgcgtgaaagcgctgcactattcgacagcaaggaacaagagcttcgatgtgtcctacgagcatgtgtcggagcaagggaatgagctgtatgaacttgtggctcatctacgtgacaaggccaacaactacctgtcgccggctctctcggttctggagaagaacacctgatctgatcaccagtgagcggtgactatgagctagcacgacgactctacgagtgatgcacacacatgtacaggttctccacctgccttgtactgtgcatacgagccgcattcccgtctgtcttgtgaagcttttctctttgggcccccattttcggctaagataccgtgtggggtccgcattcagagggtaggagatttctagtgtgtgcgtgcctcatgtcactcgtctacatgaggtattatccaatgcatagaaggaagaggactagaggagcacaaaggaagggactttggaaggccatccttttgtaggcaccgagtgtagtggcagtttcggagactgagactggaacccagaggcatgtagatgtacaatattattgaacaatgatatatatagtctctaatctcagaaaaaaaaaaaaaaaaaaaa

SEQ ID NO: 4742 - protein, 599 aa, Panicum virgatum
  misc_feature: Ceres CLONE 1809831
  misc_feature (1)..(92): Pfam Name: Epimerase Pfam Description: NAD dependent epimerase/dehydratase family
MAAAHCASTSSAFLGLPRGNGRRRNSCRFVANARLVPVSATLDKETAAAKPRRSRNRRSRKATKSESTALLAADEPAEAKDGGAPEEAANGGGGRGMVALDDVIVNPVGLGRRSRQVFDEVWRKFSRLGQMSSASSAAVAEQDPAVLFRSGPMCEFTVPGAQDITVLVVGATSRIGRIVVRKLMLRGYNVKTLVRRNDPEVIDMLPRSVDIVVGDIGDPSSVQAAVSGCNKVIYCATARSTITGDLNRVDNQGVRNVTKAFQDYYNQLAQSRAGKSSKSKLTIAKFKSAKSVKGWEVRQGSYFQDIYPSRFDGGTDASFEYSERGQAVFSGFVFTRGGYVEMSKRLSLPLGSTLDRYDGLLLSVGGNGRSYVIILETGPLADTSQTKKYFARMNTKVGFCRVRVPFSAFRPVNPQDPPLDPFLVHTLTIRFEPKKQRPGDSSEGAASDPRNFELKMEFIKALPSGQETDIVLVSCTGSGIEANRREQVLKAKKAGEDALRRSGLGYTIVRPGPLQEEPGGQRALIFDQGSRISQGISCADVADICVKALHYSTARNKSFDVSYEHVSEQGNELYELVAHLRDKANNYLSPALSVLEKNT

SEQ ID NO: 4743 - DNA, 1703 bp, Panicum virgatum
  misc_feature: Ceres CLONE 1809988
  misc_feature: Encodes the peptide sequence at SEQ ID NO. 4744
gtttctctctgcccccctaccttcttctctcctccctcatctttctctctcctctcctctcccctcccctcccctcccctcccgtgcgaactcacgcccccacctcacgagcgcctccgtcgcgagagaggcagcaggcggtgcgcctgggggaggcgtcgatggatctggagaggtcgccgccggcgtcgccggcggaggcggccggtggcggaggcgggggcgggggcgcggcgtgctccatctgcctggatccggtgctcgccctcggcgggggccgctccgtcgccaagctgcaatgcggccacgagttccacctagactgtattggatctgcatttaatgcaaaaggaggaatgcaatgccctaactgtcggaagattgagaaaggtcgctggctttatgcaagcggacaccgcccttctgccgatattgatatgggtggctggccgactagtgacaactatgatatcacctctgaccttccatttggatttcagtggtgcccctttagtggattcacccagctagcttctgtgtttgaggagcgtgaagctgagccaacttcttatcacacaattggagatcactcaagttctgcaagcagttcacttgtttgcccatatctttccctgcgtggttttcttcatcctgtgcatgtaccttctacttctaattctggtgctgaaagcacttcatttcatcggcattcaactggcttggaaggccatgcaactccagatttgagtaatgctcaagttttccatgctactgagtcaagaaatcatgacagtgagcacaggcatttgagtaatcttcctgtatcaggaattcctgatcattctatgactccatttggtataggactaccaagatatgacaccagcggccaacagagatccagatcatatgcacgtcatcatcccctaatccataggccaacacctcgcggtggaaacaatttggtggcacccttagggtcagttccagctgctgtggcagagactagaagccatggtcatggtgcaagaggccatatgtaccaacagtcaatgcactctatgcagagcagcccattccctcctaccactagaagggttaggccaagggccttgacaattacatctttcattgcggcagcatcctcagctgaggttggagggccacatggattttcagcccctggagctgtgaacaggagcattcctgatgctgagggcatcactagacccatcgaccgaccatatccatgggggcgagagggctttgcgcccttcccttggatccctgctgaaggtgagtctcactggtggggcaccttcaatcctatgcagaacccggcacatgcaagttttaccagaaggcctgctggtgagcggatgacgcagaatcacccagagaacggctatcagcctgtgcctcctccccagaggatgccgccgttcttgtgattagtgaaggctattcttcaattattatgtataaaatttatttgattctagacttgagagaacagggggaagaagatcagctgcgctgcactgtcaaaactggtctgttgaaagatctctatgaagtttatgccgctggtattttagcgttttcggtccagcagcactcaggctttgttgagcgctgtagttcgtcctaactgatgtgttgttgcattgagcagaattatttgaaaacatgagttaaactgc

SEQ ID NO: 4744 - protein, 429 aa, Panicum virgatum
  misc_feature: Ceres CLONE 1809988
  misc_feature (1)..(44): Pfam Name: zf-C3HC4 Pfam Description: Zinc finger, C3HC4 type (RING finger)
MDLERSPPASPAEAAGGGGGGGGAACSICLDPVLALGGGRSVAKLQCGHEFHLDCIGSAFNAKGGMQCPNCRKIEKGRWLYASGHRPSADIDMGGWPTSDNYDITSDLPFGFQWCPFSGFTQLASVFEEREAEPTSYHTIGDHSSSASSSLVCPYLSLRGFLHPVHVPSTSNSGAESTSFHRHSTGLEGHATPDLSNAQVFHATESRNHDSEHRHLSNLPVSGIPDHSMTPFGIGLPRYDTSGQQRSRSYARHHPLIHRPTPRGGNNLVAPLGSVPAAVAETRSHGHGARGHMYQQSMHSMQSSPFPPTTRRVRPRALTITSFIAAASSAEVGGPHGFSAPGAVNRSIPDAEGITRPIDRPYPWGREGFAPFPWIPAEGESHWWGTFNPMQNPAHASFTRRPAGERMTQNHPENGYQPVPPPQRMPPFL

SEQ ID NO: 4745 - DNA, 1653 bp, Panicum virgatum
  misc_feature: Ceres CLONE 1809992
  misc_feature: Encodes the peptide sequence at SEQ ID NO. 4746
gcagacgctccctaaccttctgctctcagctctgctctgcttcctgcgtgcacccgtccccacaacccccgcacgccatggccgcggccatcctccgccgcctcacacccacccccaccacggccgccagcccgcgcgtggcgccgcggccgcggccgctgccgctgctcgcgcgcggggtgtcggactcaacggatgcgatcaccgtggagacctcggtgcccttcatgtcccacatcgtggaccctccctcgcgctccgccaccacctccgcgcgcgagctcctctccttcttccgcgacatggccctcatgcgccgcgccgagatctcggcggactcgctctacaaggccaagctcatccgcggcttctaccacctctacgacgggcaggaggccgtcgccgtcggcatggaggccgccatcacccgcgccgacgccatcatcaccgcctaccgcgaccactgcgcctacctcgcgcgcggcggggacctcgtcgccgccttcgccgagctcatgggccgccgggacggctgctccaggggcaaggggggatccatgcacttctacaagcgggacgccaacttcttcggcgggcacggcatcgtcggcgcgcaggtgccgctcgggtgcggcatcgccttcgcgcagaagtacaggaaggagggcaccgtcaccttcgacctctacggcgacggcgccgccaaccagggccagctcttcgaagcgctcaacatggccgcgctctggaagctgcctgtcatattggtctgcgagaacaaccactatgggatggggactgcagagtggagggcgtccaagagccctgcttactacaagcgcggggactatgtgcctggattaaaggtcgatggaatggatgttcttgctgtgaagcaagcttgcaaatttgccaaagatcatgtccttgaaaatggaccaattattcttgagatggacacctatagataccatgggcactctatgtcagatcctggtagcacctaccgcaccagggatgagattgcagggataagacaggagcgtgatccaatcgaaagggttaggaagctcatattggcccatgatttcgcaacagcccaagagctaaaggacatggaaaaggagataaggaagcaagttgacgcagccattgctaaagcaaaggagagtccaatgcccgatccatctgagctcttcacaaacgtttatgtcaacgactgcggtttggagtcctttggggtagacaggaaggtggtgaggaccgttcttccgtaggctggcaaagaaggacagtttcattaatatgcatgaacatatatccgcgtaccgaggatagctacactactagcgattgcaagtacagacgaagggatcctgctgtgcgttgcttttttgtgctacgaaataagcttttgtgtgtgtgaagagatgcataggcaaacaactgatggatattctgtttctgcatcacgcctcagtggcccttcccttttggatccttgtttatgatttgctctggccgttgagtcgtgacaatgtgcagctgaaaccttgtcgcgtgtgatgcagatgtatggaacatcttctccctaaatgaattactattatgttcaatgagggaaaccttgtttaaaaaaaaaaaaaaaaaaaa

SEQ ID NO: 4746 - protein, 399 aa, Panicum virgatum
  misc_feature: Ceres CLONE 1809992
  misc_feature (1)..(298): Pfam Name: E1_dh Pfam Description: Dehydrogenase E1 component
  misc_feature (36)..(399): SWISSPROT Homolog: EC 1.2.4.1 Pyruvate dehydrogenase E1 component subunit alpha, mitochondrial precursor
  misc_feature (6)..(399): SWISSPROT Homolog: EC 1.2.4.1 Pyruvate dehydrogenase E1 component subunit alpha-2, mitochondrial precursor
MAAAILRRLTPTPTTAASPRVAPRPRPLPLLARGVSDSTDAITVETSVPFMSHIVDPPSRSATTSARELLSFFRDMALMRRAEISADSLYKAKLIRGFYHLYDGQEAVAVGMEAAITRADAIITAYRDHCAYLARGGDLVAAFAELMGRRDGCSRGKGGSMHFYKRDANFFGGHGIVGAQVPLGCGIAFAQKYRKEGTVTFDLYGDGAANQGQLFEALNMAALWKLPVILVCENNHYGMGTAEWRASKSPAYYKRGDYVPGLKVDGMDVLAVKQACKFAKDHVLENGPIILEMDTYRYHGHSMSDPGSTYRTRDEIAGIRQERDPIERVRKLILAHDFATAQELKDMEKEIRKQVDAAIAKAKESPMPDPSELFTNVYVNDCGLESFGVDRKVVRTVLP

SEQ ID NO: 4747 - DNA, 1801 bp, Panicum virgatum
  misc_feature: Ceres CLONE 1809997
  misc_feature: Encodes the peptide sequence at SEQ ID NO. 4748
actccatttaccccgctaaaaaccatacacgccaagatatatacttgtgtctgtgtatatataccatggcctaattcaccatggacgtcgccggtgatggcggaggcggccgccgccccaacttccctctgcagctcctcgagaagaaggaggagcagccgtgctccagctcggctgccgtgggcggcaacgccgggaatggatcgggggccgccggaggcgaggtgcaggtgcgcaaggcggcgcccaagcgcagctcgaccaaggaccggcacaccaaggtggaaggtagagggcgtcgcatccggatgccggctctgtgcgcggcgcgggtgttccagctgacgcgggagctgggccacaagacggacggcgagaccatcgagtggctgctgcagcaggccgagccggcggtgatcgcggccaccggcaccggcaccatcccggccaacttcacctccctcaacatctccctccgctcctcgggctcgtccttctccgccccggctcacctccgcacggccttgcctagccccgccaccgccgcccggttcggccgcgctgacgcgtgggaccgggttgtcggcctgggcttcccttcggagggcccggcctcgtcgtcatcgtcgccgtccccgttgttgctcaacttccactcgggcagcgtcggccttgacgtgcagccgtcgccgtctgccgccgccgcagccgccgacatctcaaggaagaggcggtgggaacaagaaatgcagcaggcccagcagcagcagcagcaggcgcagcaatatcagcagcagatggcggggtacacgcagagccaaatgccgggaaccgtgtggatggtaccgagcagcaacaacacgccgggtggggcgccttccggcggcggcggcagcggtggaggaggcggcggcgagtccatctggacgttcccgcagatgggcagcgccacggccgcggccgccgtgtaccgggggaacgtgccgagcgggctacatttcatgaacttctctgcaccggtggcgctgcttcccgggcagcagctggggctcggcaccgtggggagcggcggtggaggcggtggcgagggccacatggggatcctcgccgccctcaatgcgtaccggacacaggccgcgacggatcccgcggcaggccagggcggcggagcaagtaccggaggaggagggtccggccagcagcaacacggtggcggccgcggcggcgagcggcatgagagcatgagcaccagcgactcgtagccgacgggggtctccgaggatcgcatacatcgcacagctggtgtggctttgatctgttctttgtcttggtttcaattttttttcctttctttttttgtggtttccttcgtcctcctcctcctagctagacaccccctgcgaggattacgctcagctccattccatggcatgcgataggatcagccacgatcctaacgcgggctgtgcttgtgacctgtgtgagtgagagagcggggtgtgccatgggagagggaagaggagggaaacgcagaagcagcagcagcagagattgttcattttgttctttagttttagggtttgcattgatcaagtgcgagcagaagagatttttatcgagcatggcaccattcatccgccgtgatggttcattctttttccccatccaaacaagcagtgctagttgctagttcttcttccatcttgctgcagagacttgagtattagtagttggttgcttgattattgtgctaaaacaatcttttttaaattttagctagcaaaaaaaaaaaaaaaaaaaa

SEQ ID NO: 4748 - protein, 393 aa, Panicum virgatum
  misc_feature: Ceres CLONE 1809997
  misc_feature: The sequence is a functional homolog of  SEQ ID NO 166 in the  10/225,068 US patent application
  misc_feature: The sequence is a functional homolog of  SEQ ID NO 220 in the  10/374,780 US patent application
  misc_feature: Useful for making plants with modulated growth and phenotype characteristics
MDVAGDGGGGRRPNFPLQLLEKKEEQPCSSSAAVGGNAGNGSGAAGGEVQVRKAAPKRSSTKDRHTKVEGRGRRIRMPALCAARVFQLTRELGHKTDGETIEWLLQQAEPAVIAATGTGTIPANFTSLNISLRSSGSSFSAPAHLRTALPSPATAARFGRADAWDRVVGLGFPSEGPASSSSSPSPLLLNFHSGSVGLDVQPSPSAAAAAADISRKRRWEQEMQQAQQQQQQAQQYQQQMAGYTQSQMPGTVWMVPSSNNTPGGAPSGGGGSGGGGGGESIWTFPQMGSATAAAAVYRGNVPSGLHFMNFSAPVALLPGQQLGLGTVGSGGGGGGEGHMGILAALNAYRTQAATDPAAGQGGGASTGGGGSGQQQHGGGRGGERHESMSTSDS

SEQ ID NO: 4749 - DNA, 1483 bp, Panicum virgatum
  misc_feature: Ceres CLONE 1810006
  misc_feature: Encodes the peptide sequence at SEQ ID NO. 4750
gacacgaggaatcaatcgctttcggcgccgccgccgcatccgccgcgccacgcgcaactccctccgccgcctctctccccatgaccacctcccgcgtcctccacttcctccgtggcccggcgacctcccccgcccccgcggaccgccgccggggccctcgccaaccgcagcgcctccgcttcgcgccggctggcgacgggatgcggcgcgtctccgtggcctgctcctcctcctcctccaccagcggtgaggacgagggcatgacgtacaagggcgccggcgtggacatcgacgccggcaccgagttcgtgcgccgcatccgcaagatggcgcccgggattggcggattcggcggcctctaccccttcggaaatcacttccttgttgctggcactgatggtgtagggacaaagctgaaacttgcctttgaaaccggtattcatgatacaattggcattgacctggtggctatgagtgtcaatgacattgtaacttcaggtgctgaaccaatgttcttcctagattactttgctaccagcaagcttgatgtcgaccttgcagagaaggttatcaaggggattgtggatgggtgcgagcaatcagattgtgttctcctaggaggcgagacagcagagatgcctgatttctatgcggagggtgaatatgatctaagtggttttgctgtgggtaaagtgaagaaggataagctcattgatggaaaaaacattgttaagggagatgtccttataggtcttccttccagtggggttcattctaacgggttctctcttgctagaagagtactggagaaaagtggactttcattgagtgaccaactcccaagaaatgatggagtaacaactactgttggtgaagcccttatggcaccaactgtcatctatgttaagcaggtactcgagatcattagcaagggtggtgtgaaaggactggcccacattactggtggtggatttacagacaatattccgagagtgtttccttctggtcttggggcaaaaatttttactggatcatgggaagtgccacctgtcttcaagtggcttcaacaggttggaaacattaatgatgcagagatgcggcggatattcaatatgggcatcggaatggttcttgtagtaagcagagagtcagcagacagaattattgaagacacccatggatcaaatcctgcttatcgcattggagaggtgatcgagggagagggggttcactatgtctgacccgttaagccttgatagcttgtagcagcttgaggcttcggctggacaaaggagtccagtttctgtaacagcataatcttatggggctatgttctgcagtgtagtggttctacattactactcccacaagaaacgtgggggtatccaaataatgtttaagtggttccatgagaacttgcccctaaacggctgatattattatttggatctacttgagtacttaaaaaaaaaaaaaaaaaaaa

SEQ ID NO: 4750 - protein, 386 aa, Panicum virgatum
  misc_feature: Ceres CLONE 1810006
  misc_feature (28)..(385): SWISSPROT Homolog: EC 6.3.3.1 Phosphoribosylformylglycinamidine cyclo-ligase, chloroplast precursor
  misc_feature (35)..(385): SWISSPROT Homolog: EC 6.3.3.1 Phosphoribosylformylglycinamidine cyclo-ligase, chloroplast/mitochondrial precursor
MTTSRVLHFLRGPATSPAPADRRRGPRQPQRLRFAPAGDGMRRVSVACSSSSSTSGEDEGMTYKGAGVDIDAGTEFVRRIRKMAPGIGGFGGLYPFGNHFLVAGTDGVGTKLKLAFETGIHDTIGIDLVAMSVNDIVTSGAEPMFFLDYFATSKLDVDLAEKVIKGIVDGCEQSDCVLLGGETAEMPDFYAEGEYDLSGFAVGKVKKDKLIDGKNIVKGDVLIGLPSSGVHSNGFSLARRVLEKSGLSLSDQLPRNDGVTTTVGEALMAPTVIYVKQVLEIISKGGVKGLAHITGGGFTDNIPRVFPSGLGAKIFTGSWEVPPVFKWLQQVGNINDAEMRRIFNMGIGMVLVVSRESADRIIEDTHGSNPAYRIGEVIEGEGVHYV

SEQ ID NO: 4751 - DNA, 1976 bp, Panicum virgatum
  misc_feature: Ceres CLONE 1810018
  misc_feature: Encodes the peptide sequence at SEQ ID NO. 4752
cccgacccctccgtattcgcttgcattctcaatctcccgacctctccctctacctcgccgctcgcctccgtcgccgtcgcgccgccccccacgccactctgctcgaccgcgcccccctctgctgccctccagctccgtcgcgacccctcttctcgcgcgcgcgccgctcctgctcccctctgctccacgcgcgccctcctgctccgccgcgctcccccacgccccctctgccgctgcgccgcatccctccgcttcgccgcaccgctccgctcccctgcgtcccttctccggcgggattggagaggcaccgcgggggtccgtgacccgcacggcggcgctgcagggagcggaggacaacgacaagatgtcgagcgtgaggtggagcggtggagaggaggagatgaagatggtccgctttccaattttttgaggaaccctcttaatttgaagagagctcttgggggttcctttccctcaggagaggctggactaggagagggatatacaatgacaggtggatcaggtgtggtagtgatagacaatggtggtggccttctcaaggctggctttggcggggacaaggatccaattgctattgtccccaactgcatggccaaaccccctggtggcaacaccaagaaatggcttgtggctgaccagctacaggcagacgatgttgatgtgactggcatgactttgaagcgtcccattgatcgtggttaccttatcaatactgaggtgcagagggaggtttgggagcgggttgtacgcaacctgctgcaggtggatcctagcaactcatccttgttactggtggagcccatgttcaaccctccggctctgcagcatgcagctgatgagctggtgtttgaggaatttggtttcaactctctctgcgttgcagatactccttcccttgtccacctttatgaggctagccaccaaccaacacactttcgtgcccaatgcagccttgttgttgactgcggtttctctttcacccatgcatcccctgtgcttcagaactttactctgaattatggtgtgcgacgtatggaccttggcggcaaggccctcacaaactatctcaaagagcttgtctcataccgttcccttaatgtcatggatgaaacactcctcattgatgatgcaaaggaaaagctatgctttgtctcccttgacatccctggtgatcttcgccttgccaggttatcattcaaggacaacccttttagatgttcttacattctccctgatggtataacatacaagaaagggtttgtcaaggatatggatgaagcacttagatactgctctctatctcttgatcaagaatcagatagaaaagaccatagcgtggagacaaataagttcgaggataggaaaaagccagaattaagtcaaaatgaatttgtcttgacaaatgaaaggttccttgtgccggagatgctttttcatccaatcgatcttggtataaatcaagctgggcttgctgagtgcatagttcgtgctgtacaagcctgccacccatatcttcaacctgtgctttttgagagcatcatcctgacaggtggaagcacattgttccccagattcactgaaagactggagatggagcttcggcctcttgtccctgatgactaccaggtgaagataattcgtcaagagaaccctatccttggagcttggagaggtggatccattttggcgtccagccctgatttcgaatcgatgtgtgtcacgaaatccgagtacgaggagatggggtcggcacggtgtcggcgtaggtttttccattgaagggtaggccagaagattagaaggaggtgggtgttttttttttgttttgttttgtagatatgacaagcagtatcgcttagatcagggtatctgacaattcagtcatgcacaacagcagtactagttggagttctttctggttcagctttgcgcttgaaaaaaaaaaaaaaaaaaaa

SEQ ID NO: 4752 - protein, 430 aa, Panicum virgatum
  misc_feature: Ceres CLONE 1810018
  misc_feature: Great-hit functional homolog of the protein sequence given in SEQ ID NO 9506
  misc_feature: Useful for making plants with modulated flowering time
MTGGSGVVVIDNGGGLLKAGFGGDKDPIAIVPNCMAKPPGGNTKKWLVADQLQADDVDVTGMTLKRPIDRGYLINTEVQREVWERVVRNLLQVDPSNSSLLLVEPMFNPPALQHAADELVFEEFGFNSLCVADTPSLVHLYEASHQPTHFRAQCSLVVDCGFSFTHASPVLQNFTLNYGVRRMDLGGKALTNYLKELVSYRSLNVMDETLLIDDAKEKLCFVSLDIPGDLRLARLSFKDNPFRCSYILPDGITYKKGFVKDMDEALRYCSLSLDQESDRKDHSVETNKFEDRKKPELSQNEFVLTNERFLVPEMLFHPIDLGINQAGLAECIVRAVQACHPYLQPVLFESIILTGGSTLFPRFTERLEMELRPLVPDDYQVKIIRQENPILGAWRGGSILASSPDFESMCVTKSEYEEMGSARCRRRFFH

SEQ ID NO: 4753 - DNA, 2485 bp, Panicum virgatum
  misc_feature: Ceres CLONE 1810046
  misc_feature: Encodes the peptide sequence at SEQ ID NO. 4754
acccccacccgctcgagaccgtgcccgcgacgcgcctctgcgcccgtaaacaatttgcccgcccgatccccaccaagaaatgccgtggaaccgcgccggcccacgccccgctgtacagttgtcgcgcggccgagtagtttaatccccgggggaggagagcagggggccgacccggatggccgtgccctcgtcgggttcctgcagacccagtcccggctttgaggcgcccctccgccgccgcggcggccctttctggttgcgtctgggaggaatggttgcggagttggtggattctacgctggggttttaggaggattccggcggtccgggctctcggctgggggtagcggaactccgagtttgtggcctggattgggcgctggagccgctgattgggttgaagtttgggaggtaaaagctgccattgttcttctgacttcaaaaggggatgtgttcttctgacttcaaaaggggatggctttcccagatgatggaaagatgaagggctgtcagccaaagctttttgggacaaaagataagaaagtcgataagaggacagaccgtgcaagctgctccacagctaaatgtggatcaagcaactcgaagtcaccatcttcgtcccccttccggaaactttcagaagttaggagcatacgactaagccattttctaagccactcttcaaacgctacaaaatatgaacatatcaggatatttgtcgccacgtggaatgttggaggaaaagcacctaccgctgagttgaaattggatgattttcttcctgctgatgaccattcagatatttatgttttagggtttcaggaaatcgtccctctcaatgctggtaatgtgcttgtgatagaagacaatgaaccagctgcaagatggcttgctcttataaaccgtgcgctaaatagacaagttggcactgatgctgatatttttcagaacaaaccatctccctcccttgattcaacctcatcccaatcaacgccaggccttgatgcttcatcctccaaccgttcaagaacagctagtggttctgtaatctttcaaaagtccttgaaatccatcaggaaatcttacatgccatcccggagaaaacagcttaaattctgcaattgcccggtggaaatggccaaaaaatcctacaaagatgcttgctttcggtgcccacaagcatatgctaatgaaatagactcttctgaagaggacgaattggatgacagattgaatgatatatttggtctaagtgatgatggcgttatttcggctgcttctgcctacagggaccagcttaagtataacctcatatcttgcaaacaaatggttggtatttttgtcacagtatgggcaaagaaagagctagtgcagcatataggccatttgagaacatcctgtgttggtcgtggaataatgggatatcttggaaacaagggatgtatatcagtaagcatgacactgtatcagacgagcttttgtttcatctgcagccatttggcttcaggtgagaaagaaggagatgagttgaggcggaatatagatgtgttagagattctgaggctcacacaatttcgaaggatttgtagaagatctgggccaagaatccctgagagaattcttgatcatgatcgggcaatatggttaggggatctgaactaccgtatttccttgagctatgaagataccaagaaacttctgactgaaaacaactgggatgccctttttgagaaggatcagctcaatatccagcgtgcgtctggaagagtgttcaaggggtggagtgaggagaagatatattttgcccccacatacaagtactcttgcaactctgattcttatgctggtgagacagccacatcaaagaaaaagaggagaaccccagcctggtgtgatagaatactatggcatggagatggtattgctcagttgtcctacttccgaggggagtctaaattttccgaccaccgtcctgtctgcggaacctttatcgtggaggttgaaatgctagatggcaaatcaaaacggcgctcatcaaacactaacattagaatcggtgctgaagagctgttaccgacaagtgccaggacctaaatcaccaattagatttttgtgtgactcacgaacacggtaccgcggaacctacacaaggacgtctaggtatctgtttctcagggaaattttctgcaaccagagagatacgattggagatcatatggtttttttgttgtacagcaaatataatcagagtacagtttcgaaagcagcagttagtcattagtttatgttgtgtatacctgccaaatttcccccacaatattggctcatttgcttccaatatagcagccaaatcatattttttcttttcaaagtttgtattttgacttttgtagtttgtagctgtgtcaagttttgagtcttccaggaactgaatcttactgaaaagaaacgctctttccaaatgcaaaaaaaaaaaaaaaaaaaa

SEQ ID NO: 4754 - protein, 539 aa, Panicum virgatum
  misc_feature: Ceres CLONE 1810046
  misc_feature (1)..(429): Pfam Name: Exo_endo_phos Pfam Description: Endonuclease/Exonuclease/phosphatase family
MAFPDDGKMKGCQPKLFGTKDKKVDKRTDRASCSTAKCGSSNSKSPSSSPFRKLSEVRSIRLSHFLSHSSNATKYEHIRIFVATWNVGGKAPTAELKLDDFLPADDHSDIYVLGFQEIVPLNAGNVLVIEDNEPAARWLALINRALNRQVGTDADIFQNKPSPSLDSTSSQSTPGLDASSSNRSRTASGSVIFQKSLKSIRKSYMPSRRKQLKFCNCPVEMAKKSYKDACFRCPQAYANEIDSSEEDELDDRLNDIFGLSDDGVISAASAYRDQLKYNLISCKQMVGIFVTVWAKKELVQHIGHLRTSCVGRGIMGYLGNKGCISVSMTLYQTSFCFICSHLASGEKEGDELRRNIDVLEILRLTQFRRICRRSGPRIPERILDHDRAIWLGDLNYRISLSYEDTKKLLTENNWDALFEKDQLNIQRASGRVFKGWSEEKIYFAPTYKYSCNSDSYAGETATSKKKRRTPAWCDRILWHGDGIAQLSYFRGESKFSDHRPVCGTFIVEVEMLDGKSKRRSSNTNIRIGAEELLPTSART

SEQ ID NO: 4755 - DNA, 917 bp, Panicum virgatum
  misc_feature: Ceres CLONE 1810056
  misc_feature: Encodes the peptide sequence at SEQ ID NO. 4756
tcctctcccgttcctcccgcagaaaacggatcgggcgccaggggcctctcaggagtcaggaccgagcgccgcctccagctcctccaggcgcgttgcagcgctcctccccacccaggccgcggcgcccctcctgcgcagctccgccccaaggccgcggcacccctcactgcgcagctccggccaggccgtgcccccctccccgcgtgcagcactcctggggaggagctcctgctgcaacggcgtggagagaggcggggcggggcacaaggacgtctggagcgcggcggcgaagcgcggcgatggagttctgcccggcgtgtgggctgctactgcagatagatccgggcacaggaggccaccgcctgcgcctcttctgtcccgtctgcccgatgcagaacaagatcgtgaagaaggcgaaggtggtaaagaaggaggtagagcccatcttcagcaaagccgacgcgatgaagttggcgcccaagaccgcaacttcatgcccaagatgcaaccatggagaagcatacttcaagcagatgcagattcgatcagccgatgagccaatgacaacattctataggtgttgcagagaagaatgccagcttgaatggagagatgactgatctagcaactagcattttccactttgctttcactacatgcttgttctgcttcagttttgagtggtgatatgccctgttgcacatgtaattcttcttgtaaccaccttgtccttcagtacaaacttcggtgaaatgttattatggtgccgcattttggctgcagaagacactactagtaggagtgaagtgttttggaatgtatgtgcttcatgctggctacatttggtagcgtgaatggcattttcaaaggaataaagtgttcctgagttaatttagcaaaaaaaaaaaaaaaaaaaa

SEQ ID NO: 4756 - protein, 106 aa, Panicum virgatum
  misc_feature: Ceres CLONE 1810056
  misc_feature (1)..(54): Pfam Name: RNA_POL_M_15KD Pfam Description: RNA polymerases M/15 Kd subunit
MEFCPACGLLLQIDPGTGGHRLRLFCPVCPMQNKIVKKAKVVKKEVEPIFSKADAMKLAPKTATSCPRCNHGEAYFKQMQIRSADEPMTTFYRCCREECQLEWRDD

SEQ ID NO: 4757 - DNA, 1000 bp, Panicum virgatum
  misc_feature: Ceres CLONE 1810059
  misc_feature: Encodes the peptide sequence at SEQ ID NO. 4758
attttcagtaacgccctggaacacaacacccagagcgcgcgagagaggatcatggcgaccgagatccagggctactacgaggacggaaccgcggtggtgtcgttcgacgaggactacatcgacacgacgcttacggactccggcgacgtggtggactggtgggtggccgagacctaccgcatgcaccgccgcggccacgtcgccggcctcgacgtggagtggcgccccgccaccggccgcgcgccgcccggccccgtcgccgtgctgcaggtctgcgtcgaccaccgctgcctcgtcttccagatcctccgcgccgactacgtcccggccaagctgtccgccttcctcgccgaccgccggttcaccttcgtcggcgtcgggatccgcgacgatgccgccaagctgcgggccgggtacgggctgcgggtcgcgagcgccgtggacctgcgccgcctcgccgccgacgcgctcgggaggcccgacctgctccgcgcggggctgcaggcgctggtgctggaggtgatgggcgtgcagatggacaagccgcaccacgtgcgcgtgagcgcctgggacgcgcccgcgctctcggacgaccagctcaagtacgcctgcgccgacgcgttcgcctcgtacgaggtcggccggaggctctacgacggcgactactagggacgacttcaattcaggggtgcggtgctgtgtcagtatcagtgcgtcctgtttcctggagcttcgttcgtgctgcctcctctgttccgcttccgcgtcgttagggtcggtcgtgtcctaaactcctaatctgcaagtcgtggcatgtaatttgtcctgcttttggtacccttgaaccgctcgctcgtgttggcagtactagtcgttttgggtgtctggattgtgtggatcacgcgatccgcgttgatcatgttgatcctcgtagggtgaatgagtgcatgtgggagcaagcagtttggtctcttcgcaacaaaaaaaaaaaaaaaaaaaa

SEQ ID NO: 4758 - protein, 205 aa, Panicum virgatum
  misc_feature: Ceres CLONE 1810059
  misc_feature (2)..(184): Pfam Name: 3_5_exonuc Pfam Description: 3'-5' exonuclease
MATEIQGYYEDGTAVVSFDEDYIDTTLTDSGDVVDWWVAETYRMHRRGHVAGLDVEWRPATGRAPPGPVAVLQVCVDHRCLVFQILRADYVPAKLSAFLADRRFTFVGVGIRDDAAKLRAGYGLRVASAVDLRRLAADALGRPDLLRAGLQALVLEVMGVQMDKPHHVRVSAWDAPALSDDQLKYACADAFASYEVGRRLYDGDY

SEQ ID NO: 4759 - DNA, 1829 bp, Panicum virgatum
  misc_feature: Ceres CLONE 1810103
  misc_feature: Encodes the peptide sequence at SEQ ID NO. 4760
agctgcagaagctataggacgatcaaccacggggcgtgcaatgggggcagggaggagaggcggcatgcgggcgacgctgctcttggtgctggtggctttgtcgttcgtcaccgtggcgagggcggcggcgagcggcggcggcggcgcaggaggtgaggacggggagaggttccttaggctgtggacgacagacggaggtggagaagctgatggccaggaggaggatttcttcaagtgggatgaggaggaggacgacgacgatgaggcggaggagggccacgtcatggcgtgggggaaggggacggagcggccggcgacctgcaggaacgtggtgaacgtcgacaccttcggcgcggcgggggacggcgacgccgacgacaccgaggccttctcgagcgcgtggaagacggcgtgctcgctggacaacgcggtgttcttggtgcccgccggccgccgctacaaggtcggcgccatcaccttcatggggccgtgcaaggccaagattatcatccagatccaggggacgatcgtggcgccggaggagccgtcggagtgggacccccggagcccgcggctgtggctgctcttctcggggctcgccggcgcccgcatccagggcggcggcgtcatcgacggctccggctccaagtggtgggccaactcctgcaagatcaacaagtccaacccgtgcaaggctgcccccacggccgtgacgatcgactcgtcccggggcgtgagggtgaagggcctgcgcgtgcagaacgcgcagcagatgcacctgacggtgtaccggtcccggaacgtgcgcctcgccggggtccgcatcgaggcgccggaggacagccccaacaccgacggcatccacgtcgccgagtccaccgccgtcaccatccagaactgccgcatcggcaccggcgacgactgcatctccatcgtcaacgccagcttcaacatccgcatgaagaacatcgactgcggcccgggccacggcatcagcatcgggagcctggggaaggacgggacgttcgcggcggtggagaacgtggcgctggacacggcgcggatcagccgggcgcagaacggggtgcggatcaagacgtggcagggcggcgccggctacgtccagaacgtgcgcttctccaacgtggccgtcgacgacgtggaccaccccatcgtcatcgaccagttctactgcgacgcccgggcgggtccctgccggagcagcacctcctccggcgtgcaggtcgccaacgtggcgtacctcaacatcagcggcacctcccggcgcgccgaggcgatccggttcgcctgcagcgacgccgcgccctgcaccgacatcgtgctccgcgacatcaacctgcgccgcagcggcggcgacggcgggggcggcgaggtgcagaccgtctgcaactgcgccatcggcttcgactacggccgcgtcagccccgccgccgactgcctccgcagcagcacctgcggcggcgcgcccgaccaccgccccgacgacgacgacggcaaggggaaggccgtggccgggacgatgccggcgcccatcctgcacaccgagctgtgacgagcagctagctcgaacatgctcatcgaacatggctcatgagatcgctgctaatgctggctgagatcgatcaacctactaagcaggcccccttttgacactgcagtttgttaattattactactaattagtggcagtaacaatgcatgccgtaattttcatttcttgttttaccgcgtgctgtacaaaatttggagctagccacacactctcggatgcttaatttttaccgcgccaaaaaaaaaaaaaaaaaaaa

SEQ ID NO: 4760 - protein, 510 aa, Panicum virgatum
  misc_feature: Ceres CLONE 1810103
  misc_feature: Great-hit functional homolog of the protein sequence encoded by LOCUS At1g23460
  misc_feature (1)..(343): Pfam Name: Glyco_hydro_28 Pfam Description: Glycosyl hydrolases family 28
  misc_feature: Useful for making plants with altered cell wall content and/or composition
MGAGRRGGMRATLLLVLVALSFVTVARAAASGGGGAGGEDGERFLRLWTTDGGGEADGQEEDFFKWDEEEDDDDEAEEGHVMAWGKGTERPATCRNVVNVDTFGAAGDGDADDTEAFSSAWKTACSLDNAVFLVPAGRRYKVGAITFMGPCKAKIIIQIQGTIVAPEEPSEWDPRSPRLWLLFSGLAGARIQGGGVIDGSGSKWWANSCKINKSNPCKAAPTAVTIDSSRGVRVKGLRVQNAQQMHLTVYRSRNVRLAGVRIEAPEDSPNTDGIHVAESTAVTIQNCRIGTGDDCISIVNASFNIRMKNIDCGPGHGISIGSLGKDGTFAAVENVALDTARISRAQNGVRIKTWQGGAGYVQNVRFSNVAVDDVDHPIVIDQFYCDARAGPCRSSTSSGVQVANVAYLNISGTSRRAEAIRFACSDAAPCTDIVLRDINLRRSGGDGGGGEVQTVCNCAIGFDYGRVSPAADCLRSSTCGGAPDHRPDDDDGKGKAVAGTMPAPILHTEL

SEQ ID NO: 4761 - DNA, 1479 bp, Panicum virgatum
  misc_feature: Ceres CLONE 1810125
  misc_feature: Encodes the peptide sequence at SEQ ID NO. 4762
atcgaaaaccccctcgttttatttccgcagctccctccccttctccgctccaccaccctgctcttgcccaagcagcacgcgcatcgcgctcccagatccccctcccgcattccccgaggccagtgaacaggatgagtgcttcagcagctgctggtgtgaagatggtgtctgcacgcccctgcatcacggcctcgcaaggaatgcttgcctcgagggcggcggtttccaggattgaaaccactgctagatttgcaagctgccccaaaatctgctgctccaggcctctcagttctaagcgtgctggttttgttgtaagagcaatgtcaggagagagtggcccacaggggcttcccattgatctcagaggtaaaagggcattcattgctggagttgctgatgacaatggctatggatgggcaattgcaaaagctcttgctgcagctggtgctgaaattcttgttggaacatgggtgccagcacttaacatatttgagacaagtctgaggcgtggaaagtttgacgaatcacgcaagttgccagatggatctcttatggatgttgttaaagtctatccacttgatgctgtctatgattcccctgaggatgttcctgaagatgtcaaatcgaacaaaaggtatgctgggtcatcaaactggactgttaaggaagttgccgaaacagtaaagaatgattttggcagcattgacatacttgtgcattctcttgctaatggccctgaggtaacaaagcctttgttggagacatcaagaagaggctatcttgctgctatttcagcatccagttactcctatgtttcattgcttcagcatttccttcctataatgaatccaggtggtgctagcatctctctaacgtacattgcgtctgaaagggcaattcctggatatggtggtggcatgagttctgcaaaagcagctcttgagagcgatacacgggtgcttgctttcgaatctggacgtaaaggcaaaatcagagttaacaccatatctgcaggccctctggggagcagagcagctaaggcaattggatttattgagaagatgatagagtactcttatgtcaatgcaccactgcagaaggagctgttggcagatgaggtggggaacacagctgcattcctggtgtctcctttggcttctgccatcactggttcgaccgtctatgtcgacaacggactcaatactatggggcttgcggttgacagccctacgataacgtcataggcatggctgtggtagatagatgggctttcctgcttcattgctgcgcgattcttgaataaagaccttaattagttagtgtgagaggtaagggcaggaaatgttaaaaaaaatgacctcttgccaccgttggtgttgggaggccatttataatccatttggtactcaacattagagtaattcctggatgatgtggtttgaaaagattgaagcagtccaaaaaaaaaaaaaaaaaaaa

SEQ ID NO: 4762 - protein, 370 aa, Panicum virgatum
  misc_feature: Ceres CLONE 1810125
  misc_feature (1)..(366): SWISSPROT Homolog: EC 1.3.1.9 Enoyl-[acyl-carrier-protein] reductase [NADH], chloroplast precursor
MSASAAAGVKMVSARPCITASQGMLASRAAVSRIETTARFASCPKICCSRPLSSKRAGFVVRAMSGESGPQGLPIDLRGKRAFIAGVADDNGYGWAIAKALAAAGAEILVGTWVPALNIFETSLRRGKFDESRKLPDGSLMDVVKVYPLDAVYDSPEDVPEDVKSNKRYAGSSNWTVKEVAETVKNDFGSIDILVHSLANGPEVTKPLLETSRRGYLAAISASSYSYVSLLQHFLPIMNPGGASISLTYIASERAIPGYGGGMSSAKAALESDTRVLAFESGRKGKIRVNTISAGPLGSRAAKAIGFIEKMIEYSYVNAPLQKELLADEVGNTAAFLVSPLASAITGSTVYVDNGLNTMGLAVDSPTITS

SEQ ID NO: 4763 - DNA, 1682 bp, Panicum virgatum
  misc_feature: Ceres CLONE 1810133
  misc_feature: Encodes the peptide sequence at SEQ ID NO. 4764
gccgcaaggtaagtaggtaactccctccctctttgccgatctggcgatccccgcgtcgaaaccccgaggtttctcgcgtcgtcttgtattgctccgccggtagcacaaggcggatttgggatctggggtgcggggcgggcgggccggcccagcgctggcgtggtccgaatccgactaactgacgcgaaaggcgcggattttgggggctgtatgggttcacggcgggagttgggggttttcatgctgggttccacgcttgggcatttcgtcgaacatcgctcgtgccttcttgttgccgacgtgctggctgtgttctgggatttgtttggagcgacgagggtttactgcttcgtccaccaggttcctgtctgcggcgagtgcatatgcttcccggagcatcagctgtgcgtggtaaaaaactatgctgaatgggttgttaattcggattatgattggccacaacattgttcatcttgcaattcagttctgaaagctggaagtgaagaaaccacacgcttgggttgcttacatgtgatgcacacaaaatgcttgatatcacatatccaaagttttccaacccaaacagcaccagctggatatgtctgcccctcgtgttccacgcctatatggccaccgtcaagcattaaagatacaggttctcgccttcatgcaaaactgaaagaagcaataatccagactggattggagaagaatgtatttggaaatcattttgtgacaatatctaaagctgatactcggacccctcctgcttttgcatcagatcctcttaaacatttatccagttctggtgatagagaatcgaatggtgcaagcataattagttcagctcaagatgcgtctttgccatcaacactgcattctgcaatgtacacttctgctagtttaggatctgggacacctatccatattgaacccgaaattgttgaaatagagggtcctagtccagtgataacacaattcccagaacaggagtccaacttcatcagaagtccgagcccacatgggcctggtgccatgacaagaaaaggtgttactagcgttgatagacaaaattcagagatttcttattatgctgatgacgaagatggaaatcgtaaaaagtataccaaaaggggtacatttcgtcatagaattctaaggatgctgctgcctttctggtctagtgcactgccaacactaccagtcacagcaccttcaaaaaaggagagtgatggcccagagggtcgcccccggcagagatcatcaagaatggatcccacaaagattttacttgcaatggctatattggcatgtatagcaacgatgggaattctctattaccggttgtcccagcgcagtctttctgaaagcttcgttgaggatgagattcagtagcactctgatattttcgaccttgcaatcttgtactgctcagctgctgattcgaagggttttaccctcctgtttttttttttcttacccctttctgtgggcctttttggtggtttgagggtgggtagttatttgttacgtataagagttatagttgactactgctatgttcttattcgtgctcatatttatgtaactataatgccatacaatattgtattatctgcctctggggagaaatcatagaaaatataccatctaccctttgttaaaaaaaaaaaaaaaaaaaa

SEQ ID NO: 4764 - protein, 394 aa, Panicum virgatum
  misc_feature: Ceres CLONE 1810133
  misc_feature (1)..(51): Pfam Name: zf-C3HC4 Pfam Description: Zinc finger, C3HC4 type (RING finger)
MGSRRELGVFMLGSTLGHFVEHRSCLLVADVLAVFWDLFGATRVYCFVHQVPVCGECICFPEHQLCVVKNYAEWVVNSDYDWPQHCSSCNSVLKAGSEETTRLGCLHVMHTKCLISHIQSFPTQTAPAGYVCPSCSTPIWPPSSIKDTGSRLHAKLKEAIIQTGLEKNVFGNHFVTISKADTRTPPAFASDPLKHLSSSGDRESNGASIISSAQDASLPSTLHSAMYTSASLGSGTPIHIEPEIVEIEGPSPVITQFPEQESNFIRSPSPHGPGAMTRKGVTSVDRQNSEISYYADDEDGNRKKYTKRGTFRHRILRMLLPFWSSALPTLPVTAPSKKESDGPEGRPRQRSSRMDPTKILLAMAILACIATMGILYYRLSQRSLSESFVEDEIQ

SEQ ID NO: 4765 - DNA, 1710 bp, Panicum virgatum
  misc_feature: Ceres CLONE 1810174
  misc_feature: Encodes the peptide sequence at SEQ ID NO. 4766
aatcaggggagcgtacgaagtgcccgcctcgcttcccttccgccgcttcaagaatcagcaagagctcccccgcctccctccagcctcgcgaatcgcgttcagaaatccgaccaccaccggtctcgaaggcgtctcgaacggagccctagatctccggcggcctcgctttgggatgcccggggaatccggcggtgctgcctgctgcgaggcggcgcctcttgcggtttggctgtgactgctctcccgtgcagattatgctcgttgattgaggtggaattgggtgatgctcggtgcgcagtaggagcgctgctctcgagttgggcggggagcgcgggaggaattacaggggcgagtccaggagggagatgaaggatgtggccgtggctggaaaggattgcgtccgcgtgctgggaccgggtccggaagtacgcgcttacgaggaaggatgaggacgacggccacgatgacggcgacggtgacgccggggccggggccgacgagctgctgtggtcgcgggacctcgcgcggcacgcggcgggcgagttctccttcgccgtcgtgcaggcgaacgacgtgctggaggaccacagccaggtcgagacgggcaccgccgccaccttcgtcggcgtctacgacggccacgggggcgccgaggcgtcccgcttcatctccaaccacctttctgcgcacatcgtccgtctagcacaagaacatggaacaatgtctgaggatgtggttcgaaacgccttttctgctacagaggaaggcttcttgtcgctagtgcgcaggacacatttgataaaacctgctatggccactattggatcttgctgtctggttggcatcatatggagagggacactctacctagccaatcttggtgattctcgggcagtcgttggttgttccagtggacaaaacaagattgttgcggagcagttaacaagagaccacaatgctggcatggaagagataaggcaggagctcaggtctcttcatcctgatgattcgcaaatagtcgttcttaagaatggtgtttggcgcatcaaaggcattatacaggtttcaaggtctataggtgatgcatacttgaagaagcgagaattcgctcttgatccgtccacggctcgtttccacctctctgaacctctccgtcggcctgttctgacttcagaaccatctatctgttcaagagttcttagttcgcaagacaggtttttgatctttgcatcagatggattatgggagcacatctcgaaccaggaggccgtcgaaatggtccacaatagtccacgagaaggtattgcgaggagattagtacaagcagctctaaaacaagctgccaggaagagggaaatgaggtacggtgatattaagaagctcgatagaggagttcgccgctacttccacgacgacatcacggtcgtggtcgtcttcatcgatcacgagcagctggggcaggagggttcatcagcctctgttcctgaactctcagttcgtgggtttgttgatgcaggaggcccctccagcttttcagggctgaacgacgttacttgacacggtaaaaccttgtgttggcttgaatgcctgtcgttttgattgtaatagtagtttcagactggtatttcgtagctctgttatcctgttcgtgcatagctgctaccgcttcgcataaatttaacttttggccaaaaaaaaaaaaaaaaaaaa

SEQ ID NO: 4766 - protein, 394 aa, Panicum virgatum
  misc_feature: Ceres CLONE 1810174
  misc_feature (1)..(271): Pfam Name: PP2C Pfam Description: Protein phosphatase 2C
MWPWLERIASACWDRVRKYALTRKDEDDGHDDGDGDAGAGADELLWSRDLARHAAGEFSFAVVQANDVLEDHSQVETGTAATFVGVYDGHGGAEASRFISNHLSAHIVRLAQEHGTMSEDVVRNAFSATEEGFLSLVRRTHLIKPAMATIGSCCLVGIIWRGTLYLANLGDSRAVVGCSSGQNKIVAEQLTRDHNAGMEEIRQELRSLHPDDSQIVVLKNGVWRIKGIIQVSRSIGDAYLKKREFALDPSTARFHLSEPLRRPVLTSEPSICSRVLSSQDRFLIFASDGLWEHISNQEAVEMVHNSPREGIARRLVQAALKQAARKREMRYGDIKKLDRGVRRYFHDDITVVVVFIDHEQLGQEGSSASVPELSVRGFVDAGGPSSFSGLNDVT

SEQ ID NO: 4767 - DNA, 2717 bp, Panicum virgatum
  misc_feature: Ceres CLONE 1810202
  misc_feature: Encodes the peptide sequence at SEQ ID NO. 4768
gtcaccgacggttgaacccagcggcccagccccagcctcccagtgcggagatgcgaggaacgaacaaaaaggaaaaccgaagatgggcggcggcgcggcggcgttggtgtcagactgtcaggactcaggaagccgagcgcgcgtcgtgctcgcatagcctctggggtcttgtacacgatgaccccgtatgcgaggcgacgcaggatcatcggatgtaaatgggaacctagatgctactgggtgatggactagctgggtcgtggtctgatgctgaccgggtcagttttgctgctgatggaaacctagatgcgtttgctgatggaaacttatggttttaagcggtggggtgctttactggcctatgagttttttgaatgttgtaccaggaagccaagcttgttacatccgctggatcagatcccaaaggaacggacatgaagaaataatgggatgtgccccttctttctccttaggaaaaattagcctcaaaggcacattccagatttgcttttgaagaagtggttctgcacatcgaggaaaaattgtgtcagtcattttttttgctaattatagtagtggaatttttaataaatatgtcaaatatttttcatagctacctgctgacacaagtgaacaaactgtttgtttctggctttggtgtatcacttggctacaaagaaaggcttcactggttcaagggctgagtttatacgaggcagtgtcagctatcaggtttacccatggcttgtgcagttaattaaccccccaacatttaaacttttgatccccaacatgatctttagatacttgaaatctatcactatggattaaggaaagaaaattgacacaaagtcaacatgtcatagcttgcaaacggctatcacttacacgttagcagtatctccaagaatactttgctggatttttttcaagagggtcgaatattgcgatatcttgacgccgataaatgttgtcatcatacagcatagatgatattgggtgtataaatgtatgcagcactaaagattattctcattattaactagtgcattacagtaatgttaaacccagtttttattcctgaaatgtaattgagaaataaatgcataatccttgtgcgatatggctggatatcattgtaagcatgctcggcacagtttggaccctatatattccctttaaggctcaactttctttgacataacaaaacctcaaagctttcgctctttgccaatacttggaagattagatccttgctcatggaaaagcgctaggtggttgtgttgttctgatcccgaatttttatttgaggatgagcaatctgaatcaaagggggaaggacttcttggaagttatggatccaaagaatactcaagagtggacatcctgtgaagaagaggagttcaaggcacattttgccgagttgtggtatgaaaaatcatgtaacaggatggaagcacttgcaaagaggttccctgcaaagtctattcagcagttgagggataaatatgctgaggtcttcgcggatatgctctgtggtgagacagatggtgaaccaagcagagatgatgcaactgttgattgggatgattggtgcaaacttttagaaggagagacacgggacttggttatggacccattagttgagacatctttatttgaaccttccaaacaattgttattcggaccagctggggatcaggaggaaatacaaaagtcacactgcaagttatcacggaagaggaaacagtattggactgctgaggaacacagggattttctacatggtgtgaattgcctgggacgaggtgcatggaaattcatctccgagtatttcgtcccttccaggaccccagcgcagctagcaagccatgctcagaagtacttcgacagaatagagaagaatgagctagatgacacgaggcagaggcatagcatcaatgatgtcaggcttgtcaaccatggtatgaacatttctggccactcctgtactgccccagggaaggggaaaggaattgcatcaagcatcccgccaataatcctaactgaggacatagatattctgccgagtctggcacagggaatgcctgaatttgggcaagcgagtaacagtccaagcaacttagcagaacagatgacacatgacaatcatatatcagagagtttccagttggaagtttcaggcatcccatcaccaagagtgcaggggagtgttatgcttgatcaatccagggaagaaaatagggcctaccccagccgcaagagaagcattggcgcagccaccaacaggaggcgcgagaagaaaagaatgctccctggtgtcctgactgcccaaaccccacaagctctgcaatttgggcaaggaagcaatggcacagccaatttatcatacgagatagtgcccatcaagcggcacaatttacaccaaaacgtgccaccattctgaagcttggtggaagccctcctgttagagcaaatatgctttgatttgcacttccaggtgggttatatgtgtaatgttgatgcagtgacaggctgaactagtataattgcctgccttcataataacgaagctgtgtttggcttcaccagcatctggcccatgatgtgatacggaaaccagttaatgtttgccttttggtataattattatgttctgtgaacttaatctatctaccagtactttgtttgagatataaaaaaaaaaaaaaaaaaaa

SEQ ID NO: 4768 - protein, 377 aa, Panicum virgatum
  misc_feature: Ceres CLONE 1810202
  misc_feature (2)..(48): Pfam Name: Myb_DNA-binding Pfam Description: Myb-like DNA-binding domain
MSNLNQRGKDFLEVMDPKNTQEWTSCEEEEFKAHFAELWYEKSCNRMEALAKRFPAKSIQQLRDKYAEVFADMLCGETDGEPSRDDATVDWDDWCKLLEGETRDLVMDPLVETSLFEPSKQLLFGPAGDQEEIQKSHCKLSRKRKQYWTAEEHRDFLHGVNCLGRGAWKFISEYFVPSRTPAQLASHAQKYFDRIEKNELDDTRQRHSINDVRLVNHGMNISGHSCTAPGKGKGIASSIPPIILTEDIDILPSLAQGMPEFGQASNSPSNLAEQMTHDNHISESFQLEVSGIPSPRVQGSVMLDQSREENRAYPSRKRSIGAATNRRREKKRMLPGVLTAQTPQALQFGQGSNGTANLSYEIVPIKRHNLHQNVPPF

SEQ ID NO: 4769 - DNA, 1849 bp, Panicum virgatum
  misc_feature: Ceres CLONE 1810215
  misc_feature: Encodes the peptide sequence at SEQ ID NO. 4770
atcaccacctccgcaccaccgccccagctcacctccctggctcggtggctccctccccactccacgctcgcccgcccgcccgccaccgcctcctgctcctcgcctcgcctctcgctcgccaaaccctagacgcagatcccctcctcccaccaccgcgcagcattacgctcagatccacccccgcgagctcattcagatccacccatgcggctccagctcgtcttccccctcctgctgctcgccgtggcggcggcagcttccgcggctgaggccgcggcgacgctatcttcgaggatggttcaccggctgtctgacgaggcgcggctggaggcgggcccgagcggggaacggtggccgcggcgcgggagtggggagtactaccgcgcgctggtgaggagcgatctccaacggcagaagcggcggctcggcgtcaagtaccagctcctctcgctctccaaagggggcggcaccttctcctccggcgacaacttaggctggttatattacacttgggtggatgttgggacgccaaacacctcctttctggttgcattggacaccgggagtgacctattctgggtaccctgtgactgtatccagtgtgctcctttatctggctaccgaggaagtctggatagagatctcggaatatacaagcctgctgaatcaacaacaagtcggcatcttccttgcagccatgagctatgctttggttcaggctgcacaaacccaaagcagccttgcccatacaatattgagtacttttctgaaaatactaccagctctggtttgctgattgaagatacagtgcacttctactccagggagggccatgtaccagtgaatgcttcagttattattggttgtggaagaaagcaaagtggtgactatttggatggtgttgcgccggatggactccttggccttggaatggcagatatatcagttcctagtttcctggcaagagctggactagttcggaattccttctcgatgtgctttaaggaagataattccgggagaattttctttggagatcaaggagtgtccaatcaacagtctacaccgtttgttcctctgtatggcaaacttcaaacttatgctgttaacgtcgacaaatcttgtattggacataaatgtcttgagggtactagcttcgaggctttagttgatagtggaacatcatttacttctcttcctcccgacgtttataaggctgtcacagtggagtttgacaaacaaatgaatgcttcaagagtgccttatgaagacagtacattgaaatactgctacatggctagtcctcttgagatgcctgatgtaccaaccataactctgacttttgctgcgaacaagagcttccaggctgttaatcctatccttccatttaatgacaaacagggagcactcgccgggttctgcttagccatccttccatcatcggaacctattggaattatcgcccagaatttccttgttggatatcatgtggtgttcgaccgagaaaacatgaagctgggctggtaccgctctgaatgccgtgacgttgacaacagcacgactgttcccttgggcccatcgcagcacaacagtccagaggacccgttgccgtcgaacgagcagcagacttcgccggcagtgacgcctgcggtcgcaggcacggctccgccctccagtgcaacgacgaacctacagaagctcctcgctagctcttacccgttgctgttactgacaatgtccactgtgttcttcatctcatgaacaactgatagaatactaatccatagccctgtatattctatgtgctttatatatgatgctttttgttcaaaaaaaaaaaaaaaaaaaa

SEQ ID NO: 4770 - protein, 518 aa, Panicum virgatum
  misc_feature: Ceres CLONE 1810215
  misc_feature (1)..(346): Pfam Name: Asp Pfam Description: Eukaryotic aspartyl protease
MRLQLVFPLLLLAVAAAASAAEAAATLSSRMVHRLSDEARLEAGPSGERWPRRGSGEYYRALVRSDLQRQKRRLGVKYQLLSLSKGGGTFSSGDNLGWLYYTWVDVGTPNTSFLVALDTGSDLFWVPCDCIQCAPLSGYRGSLDRDLGIYKPAESTTSRHLPCSHELCFGSGCTNPKQPCPYNIEYFSENTTSSGLLIEDTVHFYSREGHVPVNASVIIGCGRKQSGDYLDGVAPDGLLGLGMADISVPSFLARAGLVRNSFSMCFKEDNSGRIFFGDQGVSNQQSTPFVPLYGKLQTYAVNVDKSCIGHKCLEGTSFEALVDSGTSFTSLPPDVYKAVTVEFDKQMNASRVPYEDSTLKYCYMASPLEMPDVPTITLTFAANKSFQAVNPILPFNDKQGALAGFCLAILPSSEPIGIIAQNFLVGYHVVFDRENMKLGWYRSECRDVDNSTTVPLGPSQHNSPEDPLPSNEQQTSPAVTPAVAGTAPPSSATTNLQKLLASSYPLLLLTMSTVFFIS

SEQ ID NO: 4771 - DNA, 2086 bp, Panicum virgatum
  misc_feature: Ceres CLONE 1810273
  misc_feature: Encodes the peptide sequence at SEQ ID NO. 4772
atatctatcactcccaagctgcaatttcacactgcaatagctaggaatcaaaatatagagccttgcagcccttgctctcgcctaagttgtctagctagctagttttgagtagcgtcgttgttatacttgctactacctagagctagctaacaatggccgccgcacctgcacgcaccttctccgtgcgctccgtggagcctcttcccgtttcagcttcgctggcggcaaccagaaacaacgaccagcgaggccgcccccgtggccgttccatcatcgcttcggcggcggcgtcgaaaacgctcctgcccagtgattttgacctccagctccaggagggcctgacaagcgtgcaaaagattctgcaggaacgtaggaacagcggccgggagatgatggccaccatcgacaacctcaagcgcctctgcatcgaccactacttccaggaagagatccagagcgccatgggcgcgtgcttggatctcattcacagcgatgacctcttcgatgcaacacttgcattcaagctcgtgagagaggccggccatgatgtttcagcagatgatgttctacggaggttcactgacggcaccggcgagttcaagcttgctcttagcaaggacatcagaggcctcctgagcctccacgacatgtcacacctggacatgggagaggagccatcactgcacaaggcaaaggagttctcaagcaagcaccttgcatctgccatcaggtacctggagccaggcctcacaaggtacgtgaggcagtcccttgaccatccctaccacctgagcctgatgcagtataaggccaggcaccacctcagctacctgcagagcctgcccactagggacactgcaatggaggggctagcaattgcagagttccagctcagcaaacagctgcatcaggaagaaatgcaggaggttaaaagatggtggatggatcttggattgtctcatgaaataccagtggtgcgggaccaggtgcccaaatggtacatgtgggccatgacaagcctccagggaccctccttgtccggatatcggattgataccacaaagataatctcactcgtctatgttgtggatgacatttttgatcttgttggcacaccggaggagctttccctcttcacccaggcaatcaaaatgtggaatactgcggttgctgattcactccccagtggcatgagatcatgctacaaggctatttacaacaccacgaatgagatcgctgatatggttgaagtggagcatggattcaaccctgtcaatcatctcaggaatgcatgggcggcgctgtttgatgggttcatggttgaggcaagatggctggcaaccgatgaggctcctactgcagaggactacctgagaaatggtgttgtcacgtcaggagtgccacttacatttgcacacatattcgccatgctagggtatgacaaaagtaacgaagctggagcaaagctcgccgatgaccacatcccttctgtcatctcttgcccggctaagatcctcagactttgggatgacttgggaagtgccgaggatgaggctcaggaaggactggacggatcgtacagggatttctacctgatggagaaccctagctgcacccccggggacgcggaggcacacatgcggaggttgatcgcgagggagtgggaggagctcaacagggagtgcttctccaggaggaccttctcctctaggttcacacaggcttctttgaacgtggccaggatggtcagcgtcatgtactcgtacgacaaggagcagaggctccttgttctcgaggactacgcgacgatgctgctgctttgagactgcgtggtcgatgagaaattgagaataacccacgcagcaatttgttcaggaagcagcagagcgcgcaggactactatagcttggaccgtactttagattcaagtaattgaatacgcatcaaccctaatgcatgtttacgtatacagtagtacaagtctacaacaacacaatatatatgtacgatgaaaagaacagtagccatccacttgtttgccaaataaaaaaatacagtacaatgataaaaaaaaaaaaaaaaaaaa

SEQ ID NO: 4772 - protein, 556 aa, Panicum virgatum
  misc_feature: Ceres CLONE 1810273
  misc_feature (1)..(274): Pfam Name: Terpene_synth_C Pfam Description: Terpene synthase family, metal binding domain
MAAAPARTFSVRSVEPLPVSASLAATRNNDQRGRPRGRSIIASAAASKTLLPSDFDLQLQEGLTSVQKILQERRNSGREMMATIDNLKRLCIDHYFQEEIQSAMGACLDLIHSDDLFDATLAFKLVREAGHDVSADDVLRRFTDGTGEFKLALSKDIRGLLSLHDMSHLDMGEEPSLHKAKEFSSKHLASAIRYLEPGLTRYVRQSLDHPYHLSLMQYKARHHLSYLQSLPTRDTAMEGLAIAEFQLSKQLHQEEMQEVKRWWMDLGLSHEIPVVRDQVPKWYMWAMTSLQGPSLSGYRIDTTKIISLVYVVDDIFDLVGTPEELSLFTQAIKMWNTAVADSLPSGMRSCYKAIYNTTNEIADMVEVEHGFNPVNHLRNAWAALFDGFMVEARWLATDEAPTAEDYLRNGVVTSGVPLTFAHIFAMLGYDKSNEAGAKLADDHIPSVISCPAKILRLWDDLGSAEDEAQEGLDGSYRDFYLMENPSCTPGDAEAHMRRLIAREWEELNRECFSRRTFSSRFTQASLNVARMVSVMYSYDKEQRLLVLEDYATMLLL

SEQ ID NO: 4773 - DNA, 2332 bp, Panicum virgatum
  misc_feature: Ceres CLONE 1810283
  misc_feature: Encodes the peptide sequence at SEQ ID NO. 4774
aacaacccctaaacccccggtgtcgagtccgccgacgagcgacaccctgagctcactccgaccaccatggcctcctccatcctctcctcctccgctaaaccctgctactccgccaccaaaacccccgcccccatcgccaaccgcttaccaccccaaaatcccgcaaccacaaccctcccctctcgcgccgccgccccccgcttcgcccatggcctctccgccgccgccgtccgagcgagccccagcacccgccgcctcctcgcgctggcccgccccgtccggacgtctcagcagcagccgccgccgcggcggcggcggcccgagtacgtccccaaccgcatcgacgaccccaactacgtccgcatcttcgacaccacgctccgcgacggggagcagtccccgggcgccaccatgaccagcgccgagaagctcgtcgtggcgcgtcagctcgcccgcctcggcgtcgacatcatcgaggccggcttcccggcatcctcccccgacgacctcgacgccgtgcgttccatcgccatcgaggtcgggaacgcgcccctcggggaggacggccacgtgcccgtcatctgcggcctctcgcggtgcaacagtaaggacatcgacgccgcgtgggaggccgtcaggcacgcgcgccgcccgaggattcacaccttcatcgccaccagcgagatccacatgcagcacaagctcaggaagacgcccgagcaggtggtggctattgccagggagatggtggcctacgcccgcagcctgggatgccctgatgtcgaattcagccctgaggacgctggaaggtcaaatagagagtttctgtatcatatattagaggaagtcataaaagctggagctacaactctgaatatcccggacactgttggatacacccttccatatgaatttgggaacttaattgctgacataaaggcaaacactcctggaattgaaaatgctatcatttccacccattgccagaatgaccttggtcttgcaaccgccaacacattagcgggtgctcgtgcaggagcacgtcagttagaggtgactattaatggtattggtgaaagagccggaaatgcttctttggaggaggttgtcatggcaattaaatgtcgtggggaactcttagatggtttatatactggaatcaattcccaacatattactttgacgagcaaaatggtacaagagcacagtggacttcatgtacaaccacacaaagctattgttggtgccaatgcctttgctcatgaaagtggaattcatcaggatggaatgcttaaatataaaggaacttatgaaataatatcgcctgatgacattggtttaacacgtgcaaatgaatttggtattgttcttgggaaactcagtggaaggcatactgtgagatctaagctagtggagcttggatatgaaatcagtgacaaggaattcgaggacttctttaaacgctacaaagaggttgcagagaagaaaaagcgtgtaactgatgaggacatagaagcattattgtcagatgagatattccagcctaaagtaatctggtcccttgctgatgtacaggcaacatgtggaacacttggtttgtctacagcaactgtgaaactgataggaccagatggcgaggagaaaatagcatgttctgttgggacaggtccggtcgatgcagcttataaggctgttgaccaaattatccagattccaacagttctccgagaatatggtatgacctcagtcacagaaggcattgacgcaattgctacaactcgggtggttgtcactggagacgtgaccaacaactccaagcatgccttgactggtcactctttcaatcgctccttcagtgggagtggcgcatcaatggatgttgttgtgtccagcgtcagagcttacctgagtgccctgaacaagatgtgcagttttgctggcgctgtaaaagccagcagcgaggtatctgagaacacacgtgttaaaagcaaagagtgagaccgtcgtcatccgattctcatatgggctgagcgatgtaagagctcttgaacagtaactgttcatagcgacttttcgtttcagtaataggctggttaatgttggggtttcccctccgtcagtgtgaagattgtgcgttctttctagaggatgtccgcttagaacatggatgaagtttttggcctgtgcggtgtacaatttgtatgttatagaccatactttcaataaggaaataatagtagggtctactgtgtccacccattgaatgatttcacaacctcgaatatgtcgttttttctggtggttgagaatacaaaaaaaaaaaaaaaaaaaa

SEQ ID NO: 4774 - protein, 643 aa, Panicum virgatum
  misc_feature: Ceres CLONE 1810283
  misc_feature (82)..(639): SWISSPROT Homolog: EC 2.3.3.13 2-isopropylmalate synthase B
  misc_feature (83)..(639): SWISSPROT Homolog: EC 2.3.3.13 2-isopropylmalate synthase A
MASSILSSSAKPCYSATKTPAPIANRLPPQNPATTTLPSRAAAPRFAHGLSAAAVRASPSTRRLLALARPVRTSQQQPPPRRRRPEYVPNRIDDPNYVRIFDTTLRDGEQSPGATMTSAEKLVVARQLARLGVDIIEAGFPASSPDDLDAVRSIAIEVGNAPLGEDGHVPVICGLSRCNSKDIDAAWEAVRHARRPRIHTFIATSEIHMQHKLRKTPEQVVAIAREMVAYARSLGCPDVEFSPEDAGRSNREFLYHILEEVIKAGATTLNIPDTVGYTLPYEFGNLIADIKANTPGIENAIISTHCQNDLGLATANTLAGARAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLSGRHTVRSKLVELGYEISDKEFEDFFKRYKEVAEKKKRVTDEDIEALLSDEIFQPKVIWSLADVQATCGTLGLSTATVKLIGPDGEEKIACSVGTGPVDAAYKAVDQIIQIPTVLREYGMTSVTEGIDAIATTRVVVTGDVTNNSKHALTGHSFNRSFSGSGASMDVVVSSVRAYLSALNKMCSFAGAVKASSEVSENTRVKSKE

SEQ ID NO: 4775 - DNA, 1441 bp, Panicum virgatum
  misc_feature: Ceres CLONE 1810305
  misc_feature: Encodes the peptide sequence at SEQ ID NO. 4776
aaaaaaaggctcccttgtagcaatcgtggccccatcttctccaccgccggtgttcgccatggcttcctcggccgtagctgctcgccgcctcctactcctccgccaccaccgccaccttctacccagacgctacatctcttcctcgtccgcagccgatagcctcggcgacggcggcggcggccgcctcaagatcttcgaccgcgacctgaagcgccggcaccgagaccgcgcggcgtgggcgatgcgggagaccgacgggttcgtggatgccgtcgccgagaacctcctagatcgccttgaggactgcaggaaggcgttcccctccgcgctctgcctcgggggttctgccggtgccgtccgccgcttgctccgcggccgcggtggaattgaggagctgatcatgatggacatgtcgcccgacatggtgaagaagtggcgagaatcagagaatgctaccgacgacggaccagagacgcactttgttgtcggtgatgaggagttccttccaatcaaagagagctcacaggatttgataatgacctgtcttgggcttcactggacaaatgatcttcctggagcaatgatacagtgtaggctggcattgaaacctgatggcctttttctcgctgcaattcttggtggagaaacactgaaggagcttcgaattgcatgcaccattgcacaaatggaacgagaggggggcatcagtcctcgaatgtcacctttagcacaagtccgtgatgcaggaaaccttttgacaagggcaggcttcacccttccaggagttgatgttgatcagtatactgttaaatacaacaatgctttggaacttgttgaacatcttagagcaatgggggaaacaaatgctctgtttcaaagaaatcctgtgttaaaaagggatacagccttggcgactgcagcaatttaccagtcaatatttgggttagaggacggatctattccagcaacctttcaagtaatttacatgactggctggagggagcatccatcacagcaaaaggctaagagaaggggttccgcgaccatatcatttagtgacatacaaaaagaatttgctcctagtgagaactgagccttgctgcttcaaaatgacagtgttcctaccccccttgatctaaaaaagaaaaacaatacatggggaaagaaaagaactcttccaacagctgtaccccgaagcttcatatttcggagggatcacatttgcagaaagcaagtgcgcttctgttgcttgtatcaattttctgtgggaaatcatttaatctgtatcaaccatgatcctgcagcgaatagtagtgcatgggaaccaatgttgcctgttgtatgtagtttcatactgaggttgaggaaacccagaacatgtgaaatgttacgagacactaccactgttattgtcgtgactcaaaaaaaaaaaaaaaaaaaa

SEQ ID NO: 4776 - protein, 344 aa, Panicum virgatum
  misc_feature: Ceres CLONE 1810305
  misc_feature (2)..(101): Pfam Name: Methyltransf_11 Pfam Description: Methyltransferase domain
MASSAVAARRLLLLRHHRHLLPRRYISSSSAADSLGDGGGGRLKIFDRDLKRRHRDRAAWAMRETDGFVDAVAENLLDRLEDCRKAFPSALCLGGSAGAVRRLLRGRGGIEELIMMDMSPDMVKKWRESENATDDGPETHFVVGDEEFLPIKESSQDLIMTCLGLHWTNDLPGAMIQCRLALKPDGLFLAAILGGETLKELRIACTIAQMEREGGISPRMSPLAQVRDAGNLLTRAGFTLPGVDVDQYTVKYNNALELVEHLRAMGETNALFQRNPVLKRDTALATAAIYQSIFGLEDGSIPATFQVIYMTGWREHPSQQKAKRRGSATISFSDIQKEFAPSEN

SEQ ID NO: 4777 - DNA, 1467 bp, Panicum virgatum
  misc_feature: Ceres CLONE 1810310
  misc_feature: Encodes the peptide sequence at SEQ ID NO. 4778
cctcgcccctactcgtgcatccccattgtcccttccgcgccatttgtgcaggggggggtgcagggaagctctgagcgctctgcgcatcggggactggggcttctcgaaggcttaaaagcgatcccagaaagagaggaggccattcctgctcgggacagcggcagtgtcgggaggtgtccgctcgctgctggctgcgccgccgtgtacgtgctctgttcttcacgtgcgcgcgcgcgccatggccggctgctcgagctcttccgccgtgctcctcgcgtcgctcgtctgcgccgcgggcctcttcggcgccggggaggcgtcgggggcggcgcacagggtggtcgaccccgagtggcacccagccactgccacctggtacggcagcgccgagggcgacggcagcgacggcggcgcgtgcgggtacgggacgctggtgaacgtggtgccgatgaaggcgcgcgtgggcgcggtgagccccgtgctgttcaagtccggcgagggctgcggcgcctgctacaaggtccggtgcctcgaccgcggcatctgctcgcgccgcgccgtcacggtcatcgtcacggacgagtgccccggcggcgtctgcgcagggggccgcacgcacttcgacctcagcggcgccgcgttcggccgcctcgccgtcgccggcgccggcggacagctgcgcaaccgcggcgagatcaacatcgtgttccgcaggacggcgtgcaggtacgggggcaagaacatcgccttccacgtgaacgagggctccaccagcttctggctctccctcctggtggagttcgaggacggcgacggcgacatcggatccatgcagctcaagcaggcaaactcggcgcagtggcaggacatgcagcacatctggggggccacgtggagcctcaccccgggcccgctcgtcggtcccttctccgtgaggctgacgaccctgaccggcaagcagacgctcacggcccaggacgtcatccccagaaactgggcccccaaggccacctacacctcccgcctcaatttcgcgtagaggaggcccaagtattcagtattctccgcccgcggggtagtcaaatgggctttagatacgatcattttgaggcccttattgtttatgtgcagtgggcttctgcccatactagtgccgtgttagcagttcatgcatgagcaggtagttgggccctggtagccctctccatcaaaagcgggagagagagcgtgtggccgggtgggccgcaagcttcctggaggctggaaatggggagttccggggaagagcggcaggttgtgatacttatatttccgcgtttttaatttgttgtgaccgttactacaatgcccttattacatgggttgtaacttgtgcaccgtaaactatatcgtgtattgttagttcacgttatctgtcgaagaaatggtgccatctgataatttgtgcaaaaaaaaaaaaaaaaaaaa

SEQ ID NO: 4778 - protein, 266 aa, Panicum virgatum
  misc_feature: Ceres CLONE 1810310
  misc_feature: Great-hit functional homolog of the protein sequence encoded by LOCUS At4g28250
  misc_feature: Useful for making plants with altered cell wall content and/or composition
MAGCSSSSAVLLASLVCAAGLFGAGEASGAAHRVVDPEWHPATATWYGSAEGDGSDGGACGYGTLVNVVPMKARVGAVSPVLFKSGEGCGACYKVRCLDRGICSRRAVTVIVTDECPGGVCAGGRTHFDLSGAAFGRLAVAGAGGQLRNRGEINIVFRRTACRYGGKNIAFHVNEGSTSFWLSLLVEFEDGDGDIGSMQLKQANSAQWQDMQHIWGATWSLTPGPLVGPFSVRLTTLTGKQTLTAQDVIPRNWAPKATYTSRLNFA

SEQ ID NO: 4779 - DNA, 1782 bp, Panicum virgatum
  misc_feature: Ceres CLONE 1810342
  misc_feature: Encodes the peptide sequence at SEQ ID NO. 4780
gacagacagaccaggggacacggacgggggcgaccgcctcccccctcccatcgcctcagccgtcgccgccggaggaagcctgccgcccgcgccgccgcatagatacgaattgaatcgcgctctgttgatgggcagcttgcgcgctccgccggcgccggctccgctcgttgggaacgctagggttttatttggttctgggctccgttgtgcctccgctagagtcctcaaacccagagggttgactaccagtagcgcgatgaagtcgtatagattgtctgagctcagcgacgccgaggttagcggcctcaaggctcgtccccgcattgacttctcgtccatattcggcacggtgaatccaattgttgaggacgtccgtatcagaggcgatgctgcggttaaggattatacagaaaagtttgacaaggtcactctcgatgatgttgttgtacgtgttagcgatcttccagatgcagagcttgatccagctgttaaagaagccttcgacgttgcatatgacaatatatatgccttccatgtttcacaaaaattacccgagaagacagttgagaatatgagaggggtaagatgtaaaagaataacaagatgcattagttctgttgggctgtatgtcccaggtggcactgcagtcttgccttcaactgcattgatgcttgctgtgcctgcacagattgctggatgcaaaactattgttcttgccacaccccctagtcgtgatggtagcatatgcaaggaggttctttactgtgcaaaaaaagctggggtcacacacgtactgaaagctggaggagctcaggctatctcggctatggcatggggaactccgtcgtgcccaaaggttgagaagatttttgggcctggtaaccagtatgtaacagctgccaaaatgattcttcagaacagtgaagctatggtatctatagacatgcctgctggcccttctgaagttttagtcattgctgacaaatattcaaacccagttcatgttgctgctgatttgctatctcaggcagagcatggcccagatagtcaagttgttctagttattgctggagatggtgttgatttggataccattgaagcagaagttagcaagcagtgcaacgctcttccaagaggtgaatttgcttcaaaagcacttagccacagtttcactgtatttgccaaagatatggttgaggccatatcattctcaaatttgtatgcccctgagcatctgatcatcaatgtaaaggatgctgagcagtgggaggagttcatcgagaactcaggttcagttttcttgggtcagtggaccccagagagcgtgggcgattatgcgagtggaacgaaccatgtccttccaacctacggatatgcgaggatgtgcagtggtgtatcactgaattctttcctcaaatacattaccgtccaatccctaacagaggaagggctgagaaagctgggtccgtacgtcgcaaagatggctgaagtcgaagggctcgaggcgcacaggagggccgttaccctgaggctgcaagaggttgaggccactgtgaccgtctagctgctgccatgacccattttattgttcaaactttatgtgggacgttgaaatttttcccgtctcctacaggaactgaactgttgatgtcttccaaaacaggccctaggatgttagaaagaggtgtttcaactagtatatcaaataatgctcatgtaattctcatctgtttcgcgaataaacatgagctgaacttactgtaaaaaaaaaaaaaaaaaaaa

SEQ ID NO: 4780 - protein, 478 aa, Panicum virgatum
  misc_feature: Ceres CLONE 1810342
  misc_feature (1)..(348): Pfam Name: Histidinol_dh Pfam Description: Histidinol dehydrogenase
  misc_feature (35)..(474): SWISSPROT Homolog: EC 1.1.1.23 Histidinol dehydrogenase, chloroplast precursor
  misc_feature (39)..(478): SWISSPROT Homolog: EC 1.1.1.23 Histidinol dehydrogenase, chloroplast precursor
MGSLRAPPAPAPLVGNARVLFGSGLRCASARVLKPRGLTTSSAMKSYRLSELSDAEVSGLKARPRIDFSSIFGTVNPIVEDVRIRGDAAVKDYTEKFDKVTLDDVVVRVSDLPDAELDPAVKEAFDVAYDNIYAFHVSQKLPEKTVENMRGVRCKRITRCISSVGLYVPGGTAVLPSTALMLAVPAQIAGCKTIVLATPPSRDGSICKEVLYCAKKAGVTHVLKAGGAQAISAMAWGTPSCPKVEKIFGPGNQYVTAAKMILQNSEAMVSIDMPAGPSEVLVIADKYSNPVHVAADLLSQAEHGPDSQVVLVIAGDGVDLDTIEAEVSKQCNALPRGEFASKALSHSFTVFAKDMVEAISFSNLYAPEHLIINVKDAEQWEEFIENSGSVFLGQWTPESVGDYASGTNHVLPTYGYARMCSGVSLNSFLKYITVQSLTEEGLRKLGPYVAKMAEVEGLEAHRRAVTLRLQEVEATVTV

SEQ ID NO: 4781 - DNA, 1631 bp, Panicum virgatum
  misc_feature: Ceres CLONE 1810357
  misc_feature: Encodes the peptide sequence at SEQ ID NO. 4782
atacgatttctctccattcttcccccctccttctcatcccctcccccctcttctcctctcttgaacactccgccgaaaagtccgaattgcttgacaaccagctcgaggagggggtgattggaagaacagccgccgatttgtttggtcggtcggagcgcacgatgatggcgaacgcgaagctccagaagcaagcgctgctgccgccgcgcagcccgttcccgacggcggcggcaggggcgccgtcgccgtacgccgaccgcagcccgatcgcccggccgcagggcgccgccgcccacccccggcacggccacgggcaccaccagcgcacttcgtccgagagcttcatcgaggagcaacctccttcgtggctcgatgacctgctcaacgagccggagacgccagcggcgcggcagcacggccgggccggccaccgcaggtcgtcaagcgactcgtttgcgctgtttgacggagctgctgctggcgccggtgcttacgccaatggcttcgaggggatggggggaggaggtgggcagcctgtgccatgggctggtgttcaggagtactatgccaagccaggttcgtttgggagggcacatggccggccatgggagcaaggattgccgaatctggctggtttccggcatggtggcggcctgccgataccgacaaaagacaaggttggggggcatcatggaccactgaacacattaagggatcataaccatggcatggacaagagaacaactgatgatgctggtcatgatcaaaaggttggggcgaaggagggtgtgctgccgaagcatgcacagtcagaggcggacaacaagcgggctaaacagcaatatgctcagaggtcccgtgtccggaagcttcagtatattgcagagctggagggtagagttcaggcattacagtcagaaggggtagaagtgtctgctgaaatggagtttctaacccagcagaatattatgcttgacctggaaaataaagctttgaagcaaagactggagagtctagcacaggagcaactaattaaacgctttcaacaggagatgtttgagcgggaaattggtcgtctcagatcactatatcagcaacagcaacagcaacaggctcctgctcttgttcgcagtaacagcagagaccttgatgcccagtttgccaacttgtctctgaaacacaaagaccccaactcgggccgggatgctctctctgggcgtcttcgtacttaattcatttcatccttctgttcttgtgggttctatatcaattgccaccactgtgtggttgtcctctccatcaagaaaggagaagtgtgcttggattgcgtgataacaccggaaaaggctaatagctatggatctgatctttattctttctggatatgcacctggcggtcatcctcagcttgcgtccattgttgatgctcgaccagtcggcggtgtttagggttttcgttttagctagatgctttccatgcatcattgtaccacttcacatgctagggttctaatctgtcactatcctcttgtttcctgagctgtcttcatacattgtagccatgtttggattagttctgccttatcagtggaatgtggagcactagtcagcatcagataagttgtgctttg

SEQ ID NO: 4782 - protein, 356 aa, Panicum virgatum
  misc_feature: Ceres CLONE 1810357
  misc_feature: Great-hit functional homolog of the protein sequence given in SEQ ID NO 9622
  misc_feature (1)..(49): Pfam Name: bZIP_1 Pfam Description: bZIP transcription factor
  misc_feature: Useful for making plants with altered terpenoid content
MMANAKLQKQALLPPRSPFPTAAAGAPSPYADRSPIARPQGAAAHPRHGHGHHQRTSSESFIEEQPPSWLDDLLNEPETPAARQHGRAGHRRSSSDSFALFDGAAAGAGAYANGFEGMGGGGGQPVPWAGVQEYYAKPGSFGRAHGRPWEQGLPNLAGFRHGGGLPIPTKDKVGGHHGPLNTLRDHNHGMDKRTTDDAGHDQKVGAKEGVLPKHAQSEADNKRAKQQYAQRSRVRKLQYIAELEGRVQALQSEGVEVSAEMEFLTQQNIMLDLENKALKQRLESLAQEQLIKRFQQEMFEREIGRLRSLYQQQQQQQAPALVRSNSRDLDAQFANLSLKHKDPNSGRDALSGRLRT

SEQ ID NO: 4783 - DNA, 1926 bp, Panicum virgatum
  misc_feature: Ceres CLONE 1810375
  misc_feature: Encodes the peptide sequence at SEQ ID NO. 4784
agcgaagcgcaggagccgccaggccactagcagtagaggcacgggaggcgcagcagaaaaggacgggactcgaggaggcggagcaggagccatggcggcgtcggcgaaggggcgtctcgtgccgctgctcgcggtggcggcggcgctcgcggccgtgctcctctaccgcgcgcctttctccaagagtttgggcggcgaagggtgcagcctcctcccgcacgaccacttctggatcgccagcgaacgcgtcgtcacgctcggccgcgtcggacccgccgcagtggaggtcaaagggggcctcatcaacgcgatcgccgtcggggactaccgcaacttcgtgctccggcggccgctcctggattatggagacgctgtcatcatgcccggactcatcgacgtgcatgcccatctcgatgagccaggacgcgaggagtgggagggcttctccactggtacaagggccgctgctgcaggtgggataacaacgctagtggacatgccactcaacagctttccatcaacagtttctgaagaaacactcaagctgaagctggaagcagctcgggataagctatttgttgatgtagggttctggggtggcctcgtgccagagaatgccttcaatccaagtgctttggagagcctcctaaatgcaggagttttaggactaaagtcttttatgtgcccctcaggcatcaatgactttcccatgacaaattcaacccatatcgaggaaggattggttacactggcaaaatatcggagacctttacttatccatgctgaacgtattcctgatattgaggatgatgatggactcgatggtgaactagatcctcgatcctatgcgacgtatctgaagtctagaccaccagcatgggaggaatcagctatcagagatttgcaacgtgcgatgaaggacacagaggcagggggtcggtcagaaggagctcatattcacatcgttcatctgtcagatgcaaaagcttcccttgaacttatgaaggatgctaaacgcagtggtgcaagtgtgactgtagaaacatgtcctcattacctggcattttcagctgacgaagttccagatggggatactcgcttcaaatgtgcccctcctatacgtgatggcatgaacagagaaaatctttggaaagccctgcttgacggacacatagacatgttaagctcagaccactcaccatcagctcctgatctcaaactaatggaagaaggcaactttttaaaggcatggggaggtatatcatcattgcagtttgttctccctgtgacatggtcgtatgggaaaaagtacggcattaccttgaatcaactagccgcatggtggagtgaaaatccagctaagcttgcagggcaaaagaacaagggagctattctgccgggataccatgctgacatcgtagtatggaaacctgaggcacagttcgaacttgatgacagccattctgtgtaccataaacaccggaatatttctgcatatttagggaaagagctttctggtaaggtcctgtctacttttgtgagaggaaatcttgtgtttgctgaagacaagcatgcaaaggccgcctgtggtgttacaatcctcgcgaagtaagattgcaagttcaaaggtggatgcagagctgatacagtactgcccttgctgatccatagcgtatatgctcgtatgcgctgtgtatttgtaggatgtgtatagtataattgaagccatttatgcaattattgtagtgtcgtagagaacccgcaaccggattggcttcaagtttgccccagttgccaattggtctgttggaccttctgtatttataatttcttttctttttctatattgatatggaaaaacgaccggtccaaatttattttctccatataaattttctgttgatagaaaaaaaaaaaaaaaaaaaa

SEQ ID NO: 4784 - protein, 506 aa, Panicum virgatum
  misc_feature: Ceres CLONE 1810375
  misc_feature (1)..(352): Pfam Name: Amidohydro_1 Pfam Description: Amidohydrolase family
MAASAKGRLVPLLAVAAALAAVLLYRAPFSKSLGGEGCSLLPHDHFWIASERVVTLGRVGPAAVEVKGGLINAIAVGDYRNFVLRRPLLDYGDAVIMPGLIDVHAHLDEPGREEWEGFSTGTRAAAAGGITTLVDMPLNSFPSTVSEETLKLKLEAARDKLFVDVGFWGGLVPENAFNPSALESLLNAGVLGLKSFMCPSGINDFPMTNSTHIEEGLVTLAKYRRPLLIHAERIPDIEDDDGLDGELDPRSYATYLKSRPPAWEESAIRDLQRAMKDTEAGGRSEGAHIHIVHLSDAKASLELMKDAKRSGASVTVETCPHYLAFSADEVPDGDTRFKCAPPIRDGMNRENLWKALLDGHIDMLSSDHSPSAPDLKLMEEGNFLKAWGGISSLQFVLPVTWSYGKKYGITLNQLAAWWSENPAKLAGQKNKGAILPGYHADIVVWKPEAQFELDDSHSVYHKHRNISAYLGKELSGKVLSTFVRGNLVFAEDKHAKAACGVTILAK

SEQ ID NO: 4785 - DNA, 1480 bp, Panicum virgatum
  misc_feature: Ceres CLONE 1810409
  misc_feature: Encodes the peptide sequence at SEQ ID NO. 4786
aagcaggtacttaatatatgcgctacgaggtgttcgtcttcgtcatcgttcagccaaagtctcaacatatatctctctctatatataactggtactagctgccatatatatatatgaaagctagagcctgagagaagcagcttgctggccgggaataatagtggtgaagaaggcgctgtaggccggagagagagagaggcagcagcagggagaatgagagggtttgagaggaaaggagtccggcagtacaactggtcggaggtgccgcggatgcggtggacggaggagcttcaccggcagttcgtcgaggccgtcgagtgcctcggtggccaggacgaagcaactcctaaacgaattcttcagttgatgggcgtgaaaggagttagcatatctcatatcaagagccatcttcagatgtacagaagctctagcaacagcagcagtgcccatcagtccagcctccagaagtcgacatcaagcagcaacagcaagcgcgtgttcttgaaccgtgaagatcactgcgcctacgcgtcaccggatggaaacacggcagcttcggacaagaacatgtacgccgccttgctccgcggttgcagtcagtcgtcaccaaaccaaataataccatcgctacaggaagtattcagaagctgggaacaaagtagagggcgtgttccttggaactccaacgtgctgacaatagagaaggcggcggttaagccaagtcacactacttccaacaagaggcctgatgagaagcaaccggactgcgacctcacgctgtcgatcggcctgtgggaggacgcgagcagcgacgccgacggctcgagcacgatcagtgaggagctcccggctccggcagccggtgctcgcggtgtcgccaccgtgaaggaggaggacagcaagccggcactgaacctggacttgaccatctcgtcgtcttggctggcgtgacgccggccggccggcacactcacgtaacgctcgtgtacagttgtacggacacatgcagagttagtagcagagattgtgtgatcaggcttcagtagactgcatatggcgtggtagtccgatcctgataggtctctcggattttcgtgtcatccccgtcgccactccgatccgttcttgtcatttttttttctttttagatttttaaattttcgggtttgttcgattaggaatcggggcttcagacgacaatgggtgaggaatttctgctctccttttctttctcctcgggagaaggcgttgcatacctgaattcctcacctatcatcgtctgaaatgttctatttctgatcgatctctagactcttagataggagtatgcacgttgctactacaggctatttcagtaaaaggcatatatatatatatatatatatatatatatatatatatatatatatatataggacagatatacatatcgatcttgaatttactattttcagttgcagaaaaaaaaaaaaaaaaaaaa

SEQ ID NO: 4786 - protein, 245 aa, Panicum virgatum
  misc_feature: Ceres CLONE 1810409
  misc_feature (1)..(52): Pfam Name: Myb_DNA-binding Pfam Description: Myb-like DNA-binding domain
  misc_feature: The sequence is a functional homolog of  SEQ ID NO 1339 in the  10/374,780 US patent application
  misc_feature: Useful for making plants with modulated growth and phenotype characteristics
MRGFERKGVRQYNWSEVPRMRWTEELHRQFVEAVECLGGQDEATPKRILQLMGVKGVSISHIKSHLQMYRSSSNSSSAHQSSLQKSTSSSNSKRVFLNREDHCAYASPDGNTAASDKNMYAALLRGCSQSSPNQIIPSLQEVFRSWEQSRGRVPWNSNVLTIEKAAVKPSHTTSNKRPDEKQPDCDLTLSIGLWEDASSDADGSSTISEELPAPAAGARGVATVKEEDSKPALNLDLTISSSWLA

SEQ ID NO: 4787 - DNA, 2102 bp, Panicum virgatum
  misc_feature: Ceres CLONE 1810424
  misc_feature: Encodes the peptide sequence at SEQ ID NO. 4788
gaacccgacgaggtgctctggtcgccagctcggattggccgctctgcctcctcatcctccttccagtcctccgccctcggttctcgcgccgcggcgtcccctgctccctcgattcaaaattctgaatcttttcccgtctcaattccgttccgtcgtcgtctcgctctcgtccctgcagttcttgacttcgagttacattacatacagcatcaaaggacttcagcttctctgagctggattgtgtggacatccccatccaggacatctcacctcaccggccttgattccagcagctccccgaccttcctttccttcccctcagttcttggagcccagctccgcgaaatccacccaaaattctagctattccttctccttctccaaggttgctgcgctcgccggattcaagccccgattccttccggtcctctccaggcggagcggcggctcgcattgcgctgatggcggggctcgccgcggcgctgctggtggcgctgtgctgggcggcggcgccgggggcggcggcgctggggatgaactggggcacgcaggcgtcgcacccgctgccgcccaaggcggtggtgcaggtgctccgggacaacggcatcaagaaggtgaagctcttcgacaccgacttcgccgccatgagcgcgctcgccggcagcggcatcgaggtcatggccgccatccccaacatcatgctcgccgacctcgccgccgacgccggcaaggccaaggactgggtcaagcgcaacgtcaagcgctacgacttcgacggcggcattaccatcaagtacgtggctgttggcaatgagccgttcttggcgtcatacaacggctcgttcatcaaagtcaccttcccggcgcttcagaacatccagaacgcgctcaacgacgccggcgtcggcgacaggatcaaagccaccgtcccgctaaacgccggcgtgtacaactccccggccagtaacccggtgccgtcggcgggccggttccgcaccgacatctcgggcctcatgacggacatcgtcaagttcctggccaagaacaacgcgcccttcaccgtcaacatctacccgttcctcagcctgtaccaaaacgacaacttcccgctcgactacgccttcttcgacggcggcgcgacgccggtgaacgacaacggcgtgctgtacaccaacgtgttcgacgccaacttcgacacgctggtggcggcgctcaaggccgtcgggaacggcgacatgcccatcatcgtcggcgaggtcggctggcccaccgacggcgacaagcacgccaaggcgtcctacgcggggcgcttctacgccgggctgctcaagcggctggccgcgaacacgggcacgccggcgcggctgaaccagtacatcgaggtctacctgttcgggctcgtcgacgaggacgcgaagagcgtggcgccgggcaacttcgagcggcactggggcatcctccggtacgacgggcagcccaagtacccgatggacctcgccgggcagggccggaacacgatgctggtgccggcgaaggggatcaagtacctgcccaagacatggtgcgcgctgaaccccaacgccagggacctcggcaagctcggcgccaacatcgactacgcgtgcacgttcgccgactgcacgccgctgggctacggctcgacgtgcaacggcatggacaccgccggcaacgcctcgtacgcgttcaacgcctactaccaggtgcagaaccagaaggacgacgcctgcgacttccagggcctcgcgctgcccaccgagaaggacccgtccacggcgacctgcaacttcaccatacagatccaggccggggcagcagccgcggaggcgctgcgcggccggagcgccggcgcggcggccggggtgctcttggcgttgctgcagctcctggcgctgtggtagtgctagtagctgccgctgccgcgagcagtggtagttttgtgattacgtgcccggttgtttttgttgcaatttcttttttatgtcttttggactggatttagatgcatgtattctaggatgcaatggatgtggttaattgattggatgttttcaccggctgttcaaaaaaaaaaaaaaaaaaaa

SEQ ID NO: 4788 - protein, 485 aa, Panicum virgatum
  misc_feature: Ceres CLONE 1810424
  misc_feature: Great-hit functional homolog of the protein sequence encoded by LOCUS At1g64760
  misc_feature: Useful for making plants with altered cell wall content and/or composition
MAGLAAALLVALCWAAAPGAAALGMNWGTQASHPLPPKAVVQVLRDNGIKKVKLFDTDFAAMSALAGSGIEVMAAIPNIMLADLAADAGKAKDWVKRNVKRYDFDGGITIKYVAVGNEPFLASYNGSFIKVTFPALQNIQNALNDAGVGDRIKATVPLNAGVYNSPASNPVPSAGRFRTDISGLMTDIVKFLAKNNAPFTVNIYPFLSLYQNDNFPLDYAFFDGGATPVNDNGVLYTNVFDANFDTLVAALKAVGNGDMPIIVGEVGWPTDGDKHAKASYAGRFYAGLLKRLAANTGTPARLNQYIEVYLFGLVDEDAKSVAPGNFERHWGILRYDGQPKYPMDLAGQGRNTMLVPAKGIKYLPKTWCALNPNARDLGKLGANIDYACTFADCTPLGYGSTCNGMDTAGNASYAFNAYYQVQNQKDDACDFQGLALPTEKDPSTATCNFTIQIQAGAAAAEALRGRSAGAAAGVLLALLQLLALW

SEQ ID NO: 4789 - DNA, 2059 bp, Panicum virgatum
  misc_feature: Ceres CLONE 1810554
  misc_feature: Encodes the peptide sequence at SEQ ID NO. 4790
aatccaacccccgcgcctccccgggaaccgcccgcccttcccctcccgcggcggggatctcctccgggctggtccctgaccggagcgcccccgtcgccggactcgccgccgccgcctccgagacccttacgcgcgcgcgggacacggcctcgcagcggtcgcccgcaggagcctctcctgactgctgggtcgattcgcggggggatttcggtcgggagatcgcccccttcccctcccccctctccgattgggccgcttcgtgagccgggatggggctgcagcagtccaaggaggagctgctgtaccagcaggtcaactacggcaacgccgacgggattcggaccctccgcgcgcagggcgccggacttgagtggattgacaaggaggggaagacgcccctgatggtggcctgcatgcggcccgacctgctcaacgtggccaaggtgctcatcgagttgggagccaatgtcaacgcctacaggccaggatcattttgtgggactccattgcaccatgctgccaagaaagggctcgagcagactgtccatttacttctcacacatggagccaatcctttcataccaaatgatgattgcaatactgcccttgaattggcaagagaaaagggccatgtgaatgtcgtacgggccatagagggacggatttctcttttttgtggatggatgagggagaattacgctcctgcttttttggatgcgattgctccacagttcatgacaagaaagatttgggctgtggttttaccccgtgaggtgcgggctccaaccaggctttttaagttggagctagctatatatcctgaattacaggcttctaaaccacgtgctgtagttaaactatggaaatgtaaaattgaggaaccaaagcttaatctggctgacccttccattatcatttttgacaaaggaacaaaaactcgatacaagatcttacctgcctatgaaggtgacaaacaacagcttcaaaggttttataatgcatgttgtggcatggcacaggttttcaacacggctccagtgccgccagcaaatctcccaatgccaaatctattacctgcaaactcatctgcagcatcttcagaacaatctgcacccagcaaggaggatgttgaattagcgatggctatcaatgcctcaattcaatcagctatcgcagagggagtgcccaatgttcaactaaatgcatccactcccagcaccaatggctggggtacccctccaagcaattctcacaatggatggggacctccagcagctcctgctcctgcaccatcaaagttgagcagccaatcccaaggccaggttgacaccccaagcagcagcacatacaatggatgggacatgcctgggacaagctctagccaaagctcatctagacccaacaaaactcaaaccaatcctccagtcgtgattccgcaggaagcacctccggctcttcctaccccaaccgccccaccatttgcggaagaaaccttctacagcggccctgttcagtatccatccgtagatgctactcctgtcgatgtagccatgcctgctaccaccgaaggtggcacagcggcagcatctgctagaccaggagaaaatgaggctaatgcgaacggcagtggcaacactccctccggcacctgtgttatttgtctggatgcccctgtggaaggcgcctgcattccgtgcggccacatggctggttgcatgtcctgcttgaaggatatcgagtccaagaagtgggggtgccctatctgccgcgccacgatcaaccaggttgttcgcctctatgctgtttgaggagttgaaacggtgagcctggaacgtcagcaatggatggttctcgcgacaagttttgatgggagcatctttattatatataaaaacaaattatgcagctgtgattgtgcagttcgtactgcagtgtaaattatgactcgtgtgtaatgtgatactcgggccgttatatacagtgatgtgtatataagtgtaagacaattttgttgtgataccaataacagatctcgaaacaaaaaaaaaaaaaaaaaaaa

SEQ ID NO: 4790 - protein, 512 aa, Panicum virgatum
  misc_feature: Ceres CLONE 1810554
  misc_feature (1)..(39): Pfam Name: zf-C3HC4 Pfam Description: Zinc finger, C3HC4 type (RING finger)
MGLQQSKEELLYQQVNYGNADGIRTLRAQGAGLEWIDKEGKTPLMVACMRPDLLNVAKVLIELGANVNAYRPGSFCGTPLHHAAKKGLEQTVHLLLTHGANPFIPNDDCNTALELAREKGHVNVVRAIEGRISLFCGWMRENYAPAFLDAIAPQFMTRKIWAVVLPREVRAPTRLFKLELAIYPELQASKPRAVVKLWKCKIEEPKLNLADPSIIIFDKGTKTRYKILPAYEGDKQQLQRFYNACCGMAQVFNTAPVPPANLPMPNLLPANSSAASSEQSAPSKEDVELAMAINASIQSAIAEGVPNVQLNASTPSTNGWGTPPSNSHNGWGPPAAPAPAPSKLSSQSQGQVDTPSSSTYNGWDMPGTSSSQSSSRPNKTQTNPPVVIPQEAPPALPTPTAPPFAEETFYSGPVQYPSVDATPVDVAMPATTEGGTAAASARPGENEANANGSGNTPSGTCVICLDAPVEGACIPCGHMAGCMSCLKDIESKKWGCPICRATINQVVRLYAV

SEQ ID NO: 4791 - DNA, 1180 bp, Panicum virgatum
  misc_feature: Ceres CLONE 1810563
  misc_feature: Encodes the peptide sequence at SEQ ID NO. 4792
gacacatcacaacaaaagtcacacacacaaggcaacacactctcaattctccacaccacaagaccaccagctcagctctcagtaaaccccatccactcctttatcatcgtctccctccccctcatctcccttccctccattctcacctcagtcctcctgccatcaatggcgaatgcttctctccagtcctttcttcttccccaacatcattctttcgtcaacaacagcagcagccatgacagctccccttctgctctactgaagctctctaccaacaacagcggcagcatttccttcaggctctactccaacatctccccctcggtaaccacaacttcgaccactaactcatcagctccgactccagtcacccctgccgcagcagcagactcgccacccaccccctccatagacctgcttggtcgccagcttgcagcaggggactaccgccaagctgatgataccacccgggcgctcctcatcgagctcgcgggggagtctgcgaggcgccgagggtacgtcttcttctctgaggtccagttcatctccaccgaggacctccgcgccattgacaagctctggaaggggcacagcaatggcaagtttgggtacagcattcagcggcgactttgggagaagtcacagcgtgacttcacccgcttcttcatcaaggttggctggatgaagaagctagacaccgagatagagcagtacaactacagggcatttcctgatgagttcatttgggagatgaaggatgacacacctgaaggtcacctgccgctcactaatgccctcagggggacacagctgctagggaacatcctcacccacccggcctttgaggaagagagccaggaaaatgaagtcgcagcagaggagagtgctacagctgctggtcagagcaaagatgataacaaaggtagggacagaccaaagtttatgaaagatttcaagcctaactactccttttgaggctggaaaaaaaggcatgggagtttgtgatgcagagatgctggcatggtgtaattgatttaaaagaacatgtatctatagttctatttgtcttactttcttcaacatacatgagaaattgtgcaatatattatgaatataattggttcaggtgttttctctgcacatgaatgatgcttgcagacaaaaaaaaaaaaaaaaaaaa

SEQ ID NO: 4792 - protein, 269 aa, Panicum virgatum
  misc_feature: Ceres CLONE 1810563
  misc_feature: Great-hit functional homolog of the protein sequence given in SEQ ID NO 9727
  misc_feature: Useful for biocontainment applications
  misc_feature: The leaves start out wild- type green and gradually turn yellow-green in color, while the cotyledons stay wild-type green.
MANASLQSFLLPQHHSFVNNSSSHDSSPSALLKLSTNNSGSISFRLYSNISPSVTTTSTTNSSAPTPVTPAAAADSPPTPSIDLLGRQLAAGDYRQADDTTRALLIELAGESARRRGYVFFSEVQFISTEDLRAIDKLWKGHSNGKFGYSIQRRLWEKSQRDFTRFFIKVGWMKKLDTEIEQYNYRAFPDEFIWEMKDDTPEGHLPLTNALRGTQLLGNILTHPAFEEESQENEVAAEESATAAGQSKDDNKGRDRPKFMKDFKPNYSF

SEQ ID NO: 4793 - DNA, 1980 bp, Panicum virgatum
  misc_feature: Ceres CLONE 1810639
  misc_feature: Encodes the peptide sequence at SEQ ID NO. 4794
tgccaaccggccacccgccggccttcgccgcgccaaccgaggtcaatgtcggcccccgccgcgccggtgcagccggcgcccccgcgcccggtgcgtttcggcatcctcggctgcgccgacatcgcgcgcaaggtctcgcgaacccttctgatgctcccgcccggcgccgccaccgtcgccgccgtcggcagccgctccgaggacaaggcccgccgcttcatcgccgagaccggcctccccgcggcgcgcccccacggctcctacgagtccctcctcggcgacccggacgtggaggccgtctacctcccgctccccaccagcctccacgtgccctgggccacggccgccgccgcgcggggcaagcacctgctcctcgagaagcccacggcgctgtgcgccgccgacctcgacgccatcctcgccgcctgcgatgcctcgggggtccaattcatggacaccaccatgtggatccacaacccgcgcaccgccaagatgcgggagatcgtcgccgacaaggacgccttcggcgacgtcagagtgatacacagtatgtgtggctttcgggcatctgaatatttcctccagaatgacatcagagtaaagccagaccttgatgccctgggtgtgcttggtgatgtaggatggtacagcatccgttcaatcttgtgggctgttgaatatgaactgcctgagactgtgatcgctcatcgtcatcctgtcaagaaccaagctggcgtaattcttgcttgtggtgcaacattgtactgggcagatggcaagactgccaccttcaactgctcttttcttaccaacctcgcttttgatgtcaccgtatatggaacacatggtacactccatgtcactgacttggtcattccgtatgaagaaaagtatggggagttcagtgtggcctcaaagtcaaattttgtcaaacccactatcggatgggatcctttgccatgcaagcatgttgttactacagatttgccacaggaggcactcatggttcaggaattctcgaggcttgtgcagaacatccgggatgctggtggcaggcctgaggggaagtggccggctatcacacgaaagacacaggtgatgttggatgccgtaaaggcttctattgacaagggatctgagcctgttgaggttgccagctgaatacaacaaatggcatctcgtactggtcagcttgtacttcatggcttcaacatttattttctcaaactacacttctgtaccgggcataaacctaattataataatttgaaggaatctggtcaggggataagttcgattacgatgccggctaggagcagcggatctggagggagaggcgggggcagactgggcaccggcgctgcagaccacgatccgtggcaagtattgagcgccggcggctcaggccacgctgagctgcgctcgtgacccaaggcggtggctcaggccacgccaagcagcacccatgatgcaaggcggtggctcgaacccacggttagctgcacccatggcgcaaggcgacggctcgggccacggcgagctgtggtggctcaggcctgctgcgactgcggtgcaaggtggcggctcaggctacggtgagctgtggcggctcggacccgtggtgagctgcgtttgcggtaagtagcggccgtagcaagaggtggcgttttaagcccgaggcaagcagtaccagcggtgaggagcggcagcataggaagcttgtgccggtagcgtgcggtggccgcttggctgggggcaagatgggatgtggtggttcgttttttcttcaaatgacgtggtttcctttttttccgtcaagcatgcgagtatgagcaatggagattgggtgtttgtggtattgtggtaatgctgcagctagacagtttgagggaagatagagaagatgtactatattctcttgaccatgaaaatagcaacacttgtatgattttttcatttcaaaaaaaaaaaaaaaaaaaa

SEQ ID NO: 4794 - protein, 371 aa, Panicum virgatum
  misc_feature: Ceres CLONE 1810639
  misc_feature (1)..(125): Pfam Name: GFO_IDH_MocA Pfam Description: Oxidoreductase family, NAD-binding Rossmann fold
  misc_feature (1)..(113): Pfam Name: GFO_IDH_MocA_C Pfam Description: Oxidoreductase family, C-terminal alpha/beta domain
MSAPAAPVQPAPPRPVRFGILGCADIARKVSRTLLMLPPGAATVAAVGSRSEDKARRFIAETGLPAARPHGSYESLLGDPDVEAVYLPLPTSLHVPWATAAAARGKHLLLEKPTALCAADLDAILAACDASGVQFMDTTMWIHNPRTAKMREIVADKDAFGDVRVIHSMCGFRASEYFLQNDIRVKPDLDALGVLGDVGWYSIRSILWAVEYELPETVIAHRHPVKNQAGVILACGATLYWADGKTATFNCSFLTNLAFDVTVYGTHGTLHVTDLVIPYEEKYGEFSVASKSNFVKPTIGWDPLPCKHVVTTDLPQEALMVQEFSRLVQNIRDAGGRPEGKWPAITRKTQVMLDAVKASIDKGSEPVEVAS

SEQ ID NO: 4795 - DNA, 2204 bp, Panicum virgatum
  misc_feature: Ceres CLONE 1810640
  misc_feature: Encodes the peptide sequence at SEQ ID NO. 4796
actccccggcgccgcgacgagggctccgcctctgctccccgccattcccgaagcttccagaagcttcgcctggcaatggcgaggcttctcgtgctccgggcggcgccgtaccgccactcctcccacctctgcgccgccaccctcctcgtgttctccccctcccagcaccgccgcttcgcctccttcccctcttctgccccctccgccgcgcgccgcatcgtaccgtcgccgctccgtgtaccgatccgcgccttggagtcctcccctgggcctaccaaggaggagcaggagccgtcccccgccgccggggaggccaaggagccgccaccgcccgcggcgtcggcgttcgaggtcgaggagctcgggtgggggacccagctcgccgtgaaactccgtatgctcgtggcgccgccgtggcagcgcgtccgcaagggaagcgtcctcaacatgaagcttcgcggcgagatatctgatcagttgaagacacgcttctcatcagggctgtcactaccacaaatttgtgagaattttgtgaaggcagcatatgacccacgaatctcagggatttatctgcacatagagccgctgagatgtggatgggcgaaggtggatgagatcagaagacacattgtggatttcaagaagtcaggtaaatttgttgttggttacatgcctgtttgtggggagaaagagtattaccttgcttgcgcatgtggtgagctatatgcaccaccaagtgcttatgttgctctgtttggtctaactgttcagcaaacatttctcagaggtgttctcgagaaagttggagtagaaccagaaattcaacggattggtaaatacaaaagtgccggagatcagcttgcacgcaagagcatgtcaaatgaagttagggagatgttggcgacattgcttgacaatatttatggaaactggcttgacacaatatcttttacacatgggaagaaaaaagaagaaatcgaggaattcattaattcaggggtctaccaggttgccagactcaaggaagaaggttggataacagatttactgtatgacgatgaggtaatggcaatgctaaaggagagagtaggacagaaagataagaaaagtctgcgtatggttgactacagtaaatactcacgtgttagtaagcggactcttggattacaaggaggaggagaacagattgccataatcagagcttctggaagcataacacgtactcgtggcccattgagtgttcctagttcaggcattattgctgagcagttgattgagaagatacggactgttagagaatcagaaaagtacaaagctgttatcctccggatagatagccctggtggcgatgctcttgcttctgatctgatgtggagggaaatccgacttcttgccaactccaagcctgtagttgcttccatggctgacgttgctgctagtgggggttattacatgacaatggctgcaccagtaattgttgctgagaaacttacccttacaggatcaattggagttgttacagggaagttctgccttcaaaagctttatgagaggattgactttaataaagaaattctatccaagggtcgatatgctgagcttaatgctgctgatcaacgacctttaagaccggatgaggcagagctttttgaaaagtcagcgcaaaatgcttatgcattatttcgtgataaagcagccatgtcaagatcaatgagtgttgatcagatggagactgttgctcaaggtcgagtctggagtggccaagatgcgttttcaagagggttggttgattcagtaggtggactctcacaagctcttgctattgcaaaacagaaggctaatataccaaagcataagaagatccagctagttgaagtctcaaagccctcgccaacattacccgaaattttatcaggcattgggggttcattgcttggagttgacagggcagtaaagggagtgcttcaggacatgtcctccctaagtggagtgcaagctaggatggatggaatcttgtttgagaatttaggagatatgtcgggcgaaaatcgattattcttgctcataaaagatatcctaaactattttgattgacactagcattccagtaccttatgttttacaaacgcttgtatttagggatgagggaaaattcataatgccattactcatctactttacactaaaaaaaaaaaaaaaaaaaa

SEQ ID NO: 4796 - protein, 672 aa, Panicum virgatum
  misc_feature: Ceres CLONE 1810640
  misc_feature (1)..(155): Pfam Name: Peptidase_S49 Pfam Description: Peptidase family S49
MARLLVLRAAPYRHSSHLCAATLLVFSPSQHRRFASFPSSAPSAARRIVPSPLRVPIRALESSPGPTKEEQEPSPAAGEAKEPPPPAASAFEVEELGWGTQLAVKLRMLVAPPWQRVRKGSVLNMKLRGEISDQLKTRFSSGLSLPQICENFVKAAYDPRISGIYLHIEPLRCGWAKVDEIRRHIVDFKKSGKFVVGYMPVCGEKEYYLACACGELYAPPSAYVALFGLTVQQTFLRGVLEKVGVEPEIQRIGKYKSAGDQLARKSMSNEVREMLATLLDNIYGNWLDTISFTHGKKKEEIEEFINSGVYQVARLKEEGWITDLLYDDEVMAMLKERVGQKDKKSLRMVDYSKYSRVSKRTLGLQGGGEQIAIIRASGSITRTRGPLSVPSSGIIAEQLIEKIRTVRESEKYKAVILRIDSPGGDALASDLMWREIRLLANSKPVVASMADVAASGGYYMTMAAPVIVAEKLTLTGSIGVVTGKFCLQKLYERIDFNKEILSKGRYAELNAADQRPLRPDEAELFEKSAQNAYALFRDKAAMSRSMSVDQMETVAQGRVWSGQDAFSRGLVDSVGGLSQALAIAKQKANIPKHKKIQLVEVSKPSPTLPEILSGIGGSLLGVDRAVKGVLQDMSSLSGVQARMDGILFENLGDMSGENRLFLLIKDILNYFD

SEQ ID NO: 4797 - DNA, 3791 bp, Panicum virgatum
  misc_feature: Ceres CLONE 1810686
  misc_feature: Encodes the peptide sequence at SEQ ID NO. 4798
aactcacgttgccgcggcttccgccatcggtgcggtgccctgtcctcccccctcccctctcgttgcctgcctcgcgtagttaagcccggcccccgcccactaccgctactagtagcagcacgcgctctcttgcagcgggagatgcggtgctgatccgtgccagcacctgctcggatctcgggagtagtagctcgtcggttcttggcgagccgagctcgcgcgccatggagggcgacgcggaggccgtgaagtcggggaggcgcggcggcgggcaggtgtgccagatctgcggcgacggcgtgggcaccaccgctgagggggacgtcttcgccgcctgctacgtctgcggcttccccgtctgccgcccctgctacgagtacgagcgcaaggacggcacacaggcgtgcccgcagtgcaagaccaagtacaagcgccacaagggtagcccagcgatccgtggggaggaaggcgatgataccgatgacgcaagtgacttcaactaccctgcatctggcaatgatgaccagaagcagaagattgctgacagaatgcgcagctggcgcatgaatgctgggggcagcggggatgttggccgccccaagtatgacagtggcgagatcgggctctccaagtatgacagtggtgagatccctcgaggatacatcccgtcggtcacaaacagccagatctcgggagaaattcctggagcttcccctgatcatcatatgatgtcccctactgggaacattggcaagcgcgctccgtttccctatgtgaatcattcaccaaatccgtcacgggagttctctggtagcattgggaatgttgcctggaaagagagagttgatggctggaaaatgaagcaggataaaggaacaattcccatgactaatggcaccagcattgctccctccgagggtcggggtgttggtgacattgatgcatctactgattacaacatggaagatgccttactgaacgatgaaactcgacagcctctatccagaaaagtgccaattccttcctccaggatcaatccttacagaatggtcattgtgctgcgattggttgttctaagcatcttcctgcactatcgtatcacaaatcctgtgcgcaatgcatacccgttatggcttctatctgttatatgtgagatttggtttgctctttcctggatattagatcagttcccaaagtggtttccaatcaaccgtgagacttaccttgatagattggcattaaggtatgaccgtgaaggtgagccatctcagttggctgctgttgacatctttgtcagtacagtcgacccactgaaggagccgcctcttgtcactgccaatactgttctatcaattcttgctgtggattaccctgtcgataaggtctcttgctatgtatctgacgatggagctgcaatgctgacatttgatgcactagctgagacttcagaatttgctagaaaatgggtaccgtttgttaagaagtacaacattgagcctagagctcctgaatggtacttcagccagaaaattgattacttgaaggacaaagtccacccttcatttgttaaagaccgccgtgccatgaagagagaatatgaagaatttaaagttaggataaatggccttgttgctaaggcacagaaagttcctgaggaaggatggatcatgcaagatggcacaccatggccaggaaacaataccagggaccatcccggaatgattcaggttttccttggtcacagtggtggccttgatactgagggcaatgagcttccccgtttggtctatgtttctcgtgagaagcgtcctggattccaacatcacaagaaagctggtgccatgaatgctcttgttcgtgtgtcagctgtgcttaccaatggacaatacatgttgaatcttgactgtgatcactacatcaacaacagcaaggctctcagggaagctatgtgcttccttatggatcctaacctaggaaggagtgtctgctatgttcagtttccacaaaggttcgatggtattgataggaacgatcgatatgccaacaggaacactgtgtttttcgatattaacttgaggggtcttgatggcattcaaggaccagtttatgtgggaactggttgtgttttcaacagaacagctctatatggttatgagcccccaattaagcaaaagaagaagggtggtttcttgtcatcactatgtggtggcaggaagaaggcaagcaaatccaagaagggctcagacaagaaaaagtcacagaagcatgtggacagttccgtgccagtattcaatcttgaagatatagaggagggagttgaaggtgctagatttgatgatgagaaatcacttcttatgtctcaaatgagcttggagaagagatttggccaatctgcagcttttgttgcctccacactgatggaatatggtggtgttcctcagtctgcaactccagaatctcttctgaaagaagctattcatgtcataagttgtggctatgaggataagactgaatggggaactgagattgggtggatctatggttctgtgacagaagatattcttactggattcaagatgcatgcacgaggctggcggtcaatttactgcatgcctaagcggccagctttcaagggatctgctcccatcaatctttcagaccgtctgaaccaagtgctccggtgggctcttggttctgtggaaattcttttcagccggcattgccccttatggtatggctatggaggacgcctgaagttcttggagagatttgcttacatcaacaccaccatttatccactcacgtctatcccacttctcatatactgtgttctgcctaccatctgtctgctcactgggaagttcatcatgccatcgattagcaacatgactagtatttggttcatctctctctttctttcaatttttgccactggtatcctcgagatgaggtggaatggtgttggcattgatgagtggtggaggaatgaacaattctgggttattggaggtatctctgcccatcttttcgccgtattccagggtcttctcaaggtgcttgctggtatcgacaccaactttactgtcacatcaaaggcctctgatgaagatggtgacttcgcggagctctacatgttcaagtggacaactcttctcatcccaccaacaaccatcttgatcatcaacctggtcggtgttgttgctggtacctcctacgctatcaacagcggttaccaatcatgggggccgctctttggcaagctcttcttcgccttctgggtgatcgttcacttgtacccattcctgaagggtctcatgggcaggcaaaaccgcaccccaaccattgtggtcgtctgggcgattcttcttgcttctatcttctccttgctgtgggttcgcatcgatccgttcaccacccgtgtcactggcccagatactcaaacatgtggcatcaactgctaggaacgtggaaggttgtagaaacagagaaataccacgagtcgtgtttttgagaatatgacaatgccacagccaccaattgcctgttaaaaatgccacagccaccaattgtctgttaagttataaggaggtggcgctatttacggctagtacggaccaaggggatattgtttatcagaaagttacttgtgttgatatgcattcttttgttgataagctatactactttgtggagagtgtctgacagacgagttttgtaatgttatgaagaacaagaaaataagatagtttgcattttttttaatttcaaaaaaaaaaaaaaaaaaaaaaaaa

SEQ ID NO: 4798 - protein, 1078 aa, Panicum virgatum
  misc_feature: Ceres CLONE 1810686
  misc_feature: Great-hit functional homolog of the protein sequence encoded by LOCUS At5g05170
  misc_feature: Great-hit functional homolog of the protein sequence given in SEQ ID NO 9310
  misc_feature (1)..(413): Pfam Name: Cellulose_synt Pfam Description: Cellulose synthase
  misc_feature (1)..(1078): SWISSPROT Homolog: EC 2.4.1.12 Cellulose synthase A catalytic subunit 3 [UDP-forming]
  misc_feature (147)..(1062): SWISSPROT Homolog: EC 2.4.1.12 Cellulose synthase A catalytic subunit 1 [UDP-forming]
  misc_feature: Useful for making plants with altered cell wall content and/or composition
MEGDAEAVKSGRRGGGQVCQICGDGVGTTAEGDVFAACYVCGFPVCRPCYEYERKDGTQACPQCKTKYKRHKGSPAIRGEEGDDTDDASDFNYPASGNDDQKQKIADRMRSWRMNAGGSGDVGRPKYDSGEIGLSKYDSGEIPRGYIPSVTNSQISGEIPGASPDHHMMSPTGNIGKRAPFPYVNHSPNPSREFSGSIGNVAWKERVDGWKMKQDKGTIPMTNGTSIAPSEGRGVGDIDASTDYNMEDALLNDETRQPLSRKVPIPSSRINPYRMVIVLRLVVLSIFLHYRITNPVRNAYPLWLLSVICEIWFALSWILDQFPKWFPINRETYLDRLALRYDREGEPSQLAAVDIFVSTVDPLKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGGFLSSLCGGRKKASKSKKGSDKKKSQKHVDSSVPVFNLEDIEEGVEGARFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCVLPTICLLTGKFIMPSISNMTSIWFISLFLSIFATGILEMRWNGVGIDEWWRNEQFWVIGGISAHLFAVFQGLLKVLAGIDTNFTVTSKASDEDGDFAELYMFKWTTLLIPPTTILIINLVGVVAGTSYAINSGYQSWGPLFGKLFFAFWVIVHLYPFLKGLMGRQNRTPTIVVVWAILLASIFSLLWVRIDPFTTRVTGPDTQTCGINC

SEQ ID NO: 4799 - DNA, 2339 bp, Panicum virgatum
  misc_feature: Ceres CLONE 1810690
  misc_feature: Encodes the peptide sequence at SEQ ID NO. 4800
acgagccggcgcccaccgtttcctcccctcctcagctcctcttgtgtcacgcccccgctcgtctcctccccccccccccgcgccgctcccgctcccgctccgcgctcccgtctcaccccgccgccgcgcaggcagtttccctcgttcgccgcgcccggctccgccgtcctgcaccggccagtctcgtggaggtgttaggaattgttcgtgctgaattgagaattgatcggtggaagctgcacattcactgttttatacctcagatctcaaaagtgataaattgacctggctggctgagaattgtgagataaataatgtctttcattaggcaagcagacccatcagcatcctgtgcagaaactccttacattcacaaatttgacccaccaggctcagttttccctgcacaaagatttgcctctggcaaagaattgcttcatcatggacctcaaccatataaatctgagggctatagacagtctggtttcaacgggacagcagctcatgtatttcagaactcgttttacaatactgatagccatgtggagtgtcacttcaatgaagcaacatgttctccaacaatctccaatgtatctcagcagaactcccaatctttatcagacaaccagacctccgatcttgaagtagagtttgatggagatgagatgaagctaaagcttcaggagcttgagcatgctttactcgatgatggtgatgagatcttttctgatttgttggggatcattgatgatgagtggaatgataacatgaagaacaatgactggactaataccatgaagaatatcatgagtccagactctccaaaagagtcatcaccagaatcaagcctctgttgtcctgacagcaataatggagaagcacgggccccaaaacagttgctctttgactgcgctgaagcaatatctgaatataatgtcgacgaagcacaatcaatcatagcagaactacgacagaaggttgcgattcagggagacccttctcagagaattgcagcctatcttgtggagggccttgctgccacaatacagtcttcaggaaaagggatctacagggctctgaggtgcaaggaggctcctactctgtaccagctttcagctatgcagatcctcttcgagatctgcccatgcttcaggctaggcttcatggctgctaactatgctattcttgaagcctgcaaaggtgaagaggttgtgcacattattgacttcgatatcaaccagggtagccaatatataacgctgatccagttcctacggaataacagtaacaagccacgtcttttgaggataactggtgtcgatgacccagagtcagttaacagggctgttggaggactaaaggttgttgggcagcgacttgagaagcttgcagaggactgtggggtcccatttgagttcagggcagtggcttctaacattgaggatgtgacacctggaatgctagattgccgtcctggagagaccctcattgttaactttgcatttctgctgcaccacctgcccgatgaaagcgtctcaatggtgaacgaaagggaccagctcctccgtatggtaaagggtctccgaccaaaactagtgacattggtggagcaggatgcaaacactaacaccaccccattccttgcaaggttccgggaggtctatgactattactcagcactttttgattcactagatgcaacccttccaagggaaagcccagatagaatgaatgtggagaggcagtgtctcgcacgagaaattgtcaacatcttagcttgtgaaggtcctgaccgtgtggaaaggtatgaagtggctgggaaatggagagcaaggctgacaatggctggttttgtgccgtccccatttaacactaatgtgatcgatggcataaagtctctattaaaatcatactgtgacaagtacaggttcgagaaggtccatgatggcctccacttcggctggggagacaagacgctcgtcgtctcgtcggcatggcaatagaagctcggatcttagcactgctgcattttaggcttacctggtgcaagggctgtgaagagatttccaccatcgtattgttgacctatcatatactcatgtgtcatatctgaccttagcgtgctgcttgtagacttgtgagatctgcctaggttgttagatgaaatatatgttgtgtagagtcactgtggtgtatttgaattttgcccttcttttggagggggtagaatcgcaatgtgtcgacattgtttcatgtataaaatactgtatggatgctctagtagctgatagatgatgggataaataacaacaattcgtcaaaaaaaaaaaaaaaaaaaa

SEQ ID NO: 4800 - protein, 562 aa, Panicum virgatum
  misc_feature: Ceres CLONE 1810690
  misc_feature (2)..(305): Pfam Name: GRAS Pfam Description: GRAS family transcription factor
MSFIRQADPSASCAETPYIHKFDPPGSVFPAQRFASGKELLHHGPQPYKSEGYRQSGFNGTAAHVFQNSFYNTDSHVECHFNEATCSPTISNVSQQNSQSLSDNQTSDLEVEFDGDEMKLKLQELEHALLDDGDEIFSDLLGIIDDEWNDNMKNNDWTNTMKNIMSPDSPKESSPESSLCCPDSNNGEARAPKQLLFDCAEAISEYNVDEAQSIIAELRQKVAIQGDPSQRIAAYLVEGLAATIQSSGKGIYRALRCKEAPTLYQLSAMQILFEICPCFRLGFMAANYAILEACKGEEVVHIIDFDINQGSQYITLIQFLRNNSNKPRLLRITGVDDPESVNRAVGGLKVVGQRLEKLAEDCGVPFEFRAVASNIEDVTPGMLDCRPGETLIVNFAFLLHHLPDESVSMVNERDQLLRMVKGLRPKLVTLVEQDANTNTTPFLARFREVYDYYSALFDSLDATLPRESPDRMNVERQCLAREIVNILACEGPDRVERYEVAGKWRARLTMAGFVPSPFNTNVIDGIKSLLKSYCDKYRFEKVHDGLHFGWGDKTLVVSSAWQ

SEQ ID NO: 4801 - DNA, 1688 bp, Panicum virgatum
  misc_feature: Ceres CLONE 1810706
  misc_feature: Encodes the peptide sequence at SEQ ID NO. 4802
atcgttgaatcttgagaattgagagacaaatatccgtcgaggaggcgagagctcgaaggggaagcgagacgaccgccatggcaggcgccaccaacggcggcggcaacggcgcgaacggcggcggcaaggtgatcagcctgccgctgcagtacttctgcgtgctggcggtggttgtggtggccgtgatggtgctgtcgctggccttcatgtcgccggcggccatggtggccgtccgccagaacctcggctccgtggccgccgcctccgccgggagcagcagcaacagcagcggcgccggagcgggaggcgcgggcctggccgccccagcaccgccggtggcccggagggagaaggagcaggcgcagcggccgccggtggtgctgttcaacttcggcgactcgaactcggacaccggcggcgtggcggcggccggaggcatccggatcatgccgccggagggccgcacctacttccgccgccccaccgggcggctctccgacggccgcgtgatcatcgacttcttctgtgagagcctgggaacccatgagctgaatccatacctcaagggaattggttcagactacagcaacggcgtcaacttcgccatggctggctcgacagcgagtcacggtgtctctacctactccttgaacgtccagatcgaccagttcgtctacttcaggcacagatccctcgagatgttcgaacgaggactgaaaggcccggtgagcaaggaggggtttgagaacgccctgtacatgatggacattggtcacaatgacatggttggcgtggcgcacacaccatccgataactgggacaagaagatcactgatatcgtcggcgaggtcagaaaagcgatttctattctctacgacaatggcgcgaggaagttctggatccacggcaccggcgccctggggtgcctgccggcattggtggtgcaggaggagaagggcgagcacaacgcgcacggctgcctcgccagcgtcaaccgggccgccaaggcgtacaacaagaagctcagccagctctgcgacgacatgcggttgcacctcaaggacgccaccatcgtgtacaccgacatgttcgccatcaagtacgacttcgtcgccaaccacaccaaatacgggattgagtggccgctcatggtgtgctgcggcaacggcgggcctccgtacaacttcaagccggggaagcccggctgcggcgacctatgtccgccggaggcgaaggtggtcagctgggacggcgtgcacttcacagatttcggcagcgggcttgcggccaaactcgcgatgagtggcgagtactccaaacccagagtgaagctggcaagcttgatccatggcggctccaagaaagcgtcggattcttgatgcggatcaatgagtccatgacctttgaatccatcaactgtggatggggtaacggggaagaactggggatgaaggccgttgtggttggagatgttgcttcggactgtttcttgacgtcgattgactccttgtgcacagaaggcaaagtagcaatggagatgctcagttacaagcaaaaatcgggtgcccttgatttgtggtgcagtcgtgcagagtataaagattttgtaccttggtgtacgtgtatagactatatttatgatagttattacgagttcccatagctcctaaaaaaaaaaaaaaaaaaaa

SEQ ID NO: 4802 - protein, 433 aa, Panicum virgatum
  misc_feature: Ceres CLONE 1810706
  misc_feature (1)..(305): Pfam Name: Lipase_GDSL Pfam Description: GDSL-like Lipase/Acylhydrolase
MAGATNGGGNGANGGGKVISLPLQYFCVLAVVVVAVMVLSLAFMSPAAMVAVRQNLGSVAAASAGSSSNSSGAGAGGAGLAAPAPPVARREKEQAQRPPVVLFNFGDSNSDTGGVAAAGGIRIMPPEGRTYFRRPTGRLSDGRVIIDFFCESLGTHELNPYLKGIGSDYSNGVNFAMAGSTASHGVSTYSLNVQIDQFVYFRHRSLEMFERGLKGPVSKEGFENALYMMDIGHNDMVGVAHTPSDNWDKKITDIVGEVRKAISILYDNGARKFWIHGTGALGCLPALVVQEEKGEHNAHGCLASVNRAAKAYNKKLSQLCDDMRLHLKDATIVYTDMFAIKYDFVANHTKYGIEWPLMVCCGNGGPPYNFKPGKPGCGDLCPPEAKVVSWDGVHFTDFGSGLAAKLAMSGEYSKPRVKLASLIHGGSKKASDS

SEQ ID NO: 4803 - DNA, 1990 bp, Panicum virgatum
  misc_feature: Ceres CLONE 1810733
  misc_feature: Encodes the peptide sequence at SEQ ID NO. 4804
gtgctcggctcttccctccatatcctgcttacttctctagttctctgcagtgttccttgttccgcttgtatgtatgctcgctcttcgcgcgtatgaaatggccggagccgaagctttcgggtgcagtgtgcgcgagcggctgaggcggcgcgaagcctccaaatgttcgggcggcgtggagccggccgcggcaattgccggcggccgtcggtcgtcgccatcctgtacgggttcggacgttcggtgaccacatattgggaaccggctggtctctgttagttgggaaatggtgaagccagctgggctcccggctgcctgagcctgtgtgtcagtgtgtgtgccgcgcggtggttatccgagtcgagtcatcgacgtcgccggtgtgcagggcgagagacggcgaggggtgctgctgggtcggcagccgatgtgcaggccgggatccggatcgcgattgggttatggaacatggatgggccgaatcatcctgctggttattattgggcctcgctagagtgctagcgcactcgataaagcattttgtgctattgatttctcaattctactgtaccacagaagattgattcatcacatcttaacaactgaacatttctgcattgtttccccagaatccgaaaaaatggcggcggctgcaaccgcaaccctatccttggcttcagttccttgcaggaagcatcagctccggcgtggcgccagtaccttcaacgcgcgacaactcagtgcttccagctcccactggcagccctctgccactctgaggtggggagtgccaagaccacgcgccggcgcggcgaagcgggtcatcgtcgcccaggccggcgccggcagctacaaggtggccatccttggcgccgcgggtgggattggggagccgctctcgctcctgatcaagatgtccccgctcgtctcggcgctgcacctctacgacaccgccaacgtcaacggtgtcgccgccgatctcagccactgcaacacgcaggtggaggtcgccggcttcaccggaaaagatgagctcgtcgtcagcctagacggcgcggacgtggtggttatccccgccggcgcgccccggaagcccggcatgacgccggacgacctgttcagcgtcaacgccggcatcgtgaaggagctcgtggaggcggtggcggaccacgcgccgggcgcgctgatccacatcatcaccaacccggtgaactccacggtcccgatcgccgccgaggtcctcaagcggaagggcgcgtacgacccgcggaagctgctcggcgtcacgaccctggacgtggtccgcgccaacgcgttcgtcgcggcggccaagggcctcccgctggccgacgtcgacgtgccggtcgtgggcggccacgcggggaccaccatcctgccgctgctgtccaaggcgcggcccaaggcggcgttcacggacgaggaggtcgaggagctcacggccagggtccagaacgccggcaccgaggtggtggaggccaaggccggcgccgagtccgcgacgctgtccatggcgtacgccgcggcgcggttcctggaggcgtcgctgcgggggctcgacggcgacaccgacgtgtacgagtgcgcgtacgtgcagtcccaggtggtgccggagctcccgttcttcgcggccagggtgaagctcgggagggaaggggtggaggaggcggtgggatcggagctcagggggctctcggactacgaggcgcgcgcgctggaggccctcaagccgcagctcaaggccagcatcgacaagggcatcgcgtacgtgcagcagcagcaggaggcagcgttgaactgagcctgctgaagaattggccatcgtcttgtgtcaggtctgggatgctgggctgtgccggttttgtagcactgcacacaaaacattctttttctactgaagattggagttggacggaacaatgaaaagaaaaaaaaactctgaatctttgcagaaaaaaaaaaaaaaaaaaaa

SEQ ID NO: 4804 - protein, 392 aa, Panicum virgatum
  misc_feature: Ceres CLONE 1810733
  misc_feature (1)..(171): Pfam Name: Ldh_1_C Pfam Description: lactate/malate dehydrogenase, alpha/beta C-terminal domain
  misc_feature (30)..(385): SWISSPROT Homolog: EC 1.1.1.37 Malate dehydrogenase, glyoxysomal precursor
  misc_feature (33)..(392): SWISSPROT Homolog: EC 1.1.1.37 Malate dehydrogenase, chloroplast precursor
MAAAATATLSLASVPCRKHQLRRGASTFNARQLSASSSHWQPSATLRWGVPRPRAGAAKRVIVAQAGAGSYKVAILGAAGGIGEPLSLLIKMSPLVSALHLYDTANVNGVAADLSHCNTQVEVAGFTGKDELVVSLDGADVVVIPAGAPRKPGMTPDDLFSVNAGIVKELVEAVADHAPGALIHIITNPVNSTVPIAAEVLKRKGAYDPRKLLGVTTLDVVRANAFVAAAKGLPLADVDVPVVGGHAGTTILPLLSKARPKAAFTDEEVEELTARVQNAGTEVVEAKAGAESATLSMAYAAARFLEASLRGLDGDTDVYECAYVQSQVVPELPFFAARVKLGREGVEEAVGSELRGLSDYEARALEALKPQLKASIDKGIAYVQQQQEAALN

SEQ ID NO: 4805 - DNA, 1259 bp, Panicum virgatum
  misc_feature: Ceres CLONE 1810791
  misc_feature: Encodes the peptide sequence at SEQ ID NO. 4806
actaccgcaccactccaccgcgccggagccgggaaggcagcaggaggaagaaagggcggccggcaccagcagccagcccactgccacgccgcgccggcggacgacggagatgaagaagtgcccgtcggagctgcagctggaggcgttcatccgggaaagcggcgccggcgccgcggagagcaagcccggaagcggaccgagcgagcccggcgggagcgacgtgttttcacccggcggcgtcggcttcggcgactcgaacaccatggatggaagcagttggtggtacgggagcatccgccccgcgaacccagtcgcgtcgcagacggcctccgtctccgctagccccagagcaaccaccccagcgaaccatactcttgaaagcgagtcagactccgacagcgaatcattgtatgaggtagaaggaggttcatgtgagcgaggcaccaaatctatggaaacaaagcgaataaggaggatggtgtccaacagggagtctgctcgacgatccaggcggagaaagcaggcacaattatctgaactcgagtcacaggtcgaacaacttaaaggtgaaaatgcaactctgttcaagcaactttcagaggccaaccagcagttcaccacagcagtcacggacaacagaatcctcaaatcggatgtagaagccttaagagtcaaggtaaagatggcagaggatatggtagcgagaagcgcaatgtcctgcggcctaggtgaccttggtctggcaccatatctgaattcaagaaagttgggccaagctttgaatatgctcacagtcacaggattggatttgctagggagtgaggcattcagaggtccaacggcagctcggcaggttcagaactcaccagtacaaagcactgcaagcctagagagtctggataacaggaagtccagcgaggtgaccagctgtgcggcagacatgtggccttgagattcaggacactgatcagattcatagcttgctaggcagaaaccgcaccagctcattacctcaaacaattggtgcctctggagcatagcttctgccaagtttccttgaaccatatttctacagaaggctttacacgatcactatgcatcgatcatttgatgtggttatctgatacttctccagtgggaaagataccatttacagaagttgtcatggcaagcagggaatgtggcaaacctcaagtatagtttcaagtataaaatgaccttgtctttgtacaaatctgcaaaaaaaaaaaaaaaaaaaa

SEQ ID NO: 4806 - protein, 280 aa, Panicum virgatum
  misc_feature: Ceres CLONE 1810791
  misc_feature (1)..(62): Pfam Name: bZIP_1 Pfam Description: bZIP transcription factor
  misc_feature (3)..(55): Pfam Name: bZIP_2 Pfam Description: Basic region leucine zipper
MKKCPSELQLEAFIRESGAGAAESKPGSGPSEPGGSDVFSPGGVGFGDSNTMDGSSWWYGSIRPANPVASQTASVSASPRATTPANHTLESESDSDSESLYEVEGGSCERGTKSMETKRIRRMVSNRESARRSRRRKQAQLSELESQVEQLKGENATLFKQLSEANQQFTTAVTDNRILKSDVEALRVKVKMAEDMVARSAMSCGLGDLGLAPYLNSRKLGQALNMLTVTGLDLLGSEAFRGPTAARQVQNSPVQSTASLESLDNRKSSEVTSCAADMWP

SEQ ID NO: 4807 - DNA, 1720 bp, Panicum virgatum
  misc_feature: Ceres CLONE 1810870
  misc_feature: Encodes the peptide sequence at SEQ ID NO. 4808
agcaaaggagccgcacctctccaccaaagcatcaggggccccagggcagcctctcgtccacccccgaccgatcctcctcgcctgactgcgccgccatcccgcacgcctacttccacccaactgcgccagtctctctcccagtcccaggcctgaccttcctcgtctcagcgctctagactgcatgccgtgacacggaaagccggggagatccacggaggcttggattgatttcttcttcccttggttcttcgtcctcaatcggcgccagatccgtttcagttttcggccccccatcggactacccaaggtggaagatacttgggttagtcagagcatagaacaaggggctgaattttgaaattgatttttccataggatggaatccttgtggaagctgacctacttgcttgagcctgcatcacttgctctcattgccacagccatttcggtggcctatgcatcagcatcgcgtgctctagactatggcaaggagatggagaggaacttggatttttcagaggcttccattacattggatcggtcgcaggctctaatgattccccttgcaagctcatgcagtctgttgctgatgttctacttgttctcatctgtctcacatctcgtgaccgcttttaccactgtggcctcagcaatggcactgttcttttgcctgtctccatacattacctacctcaagacacaattcaatctaatggatccattcatgtccaggtgttgttcaaagtcgtttacccggttgcaaggtttgctgatgctcttctgcatagccacagtgttagcctggctggtttcagggcattggttgctaaataatgttctggggatttccatatgtatagcatttgtcagccatgtcaggcttcccaacataaagatttgtgcattgcttctggtatgcttgtttgtgtacgatattttctgggtgttcttctcagagaggttctttggagcaaatgttatggtctctgttgccactcagaaggcatctaatcctgttcacacagtagcaaacaagcttagtctgccagggttgcagttaattacaaagaaactggagcttccagtcaagcttgtttttccgagaaatttgttgggtgggattgttccaggaagtagtcccggtgattacatgatgcttggccttggagacatggctattccagggatgcttctagcccttgtactcttcttcgacaaccggaagcacaaagatgcgaatattccatcagatgtgtctccctcaaagcggcaaaactatgtctggcatgccctaacagggtatggtgtaggcttggtagctgcattagctgctgggatattgtctcaatctccccagcctgccttactctacctggtgccatcgacactggggcctgtcatgtacttgtcatggttaaggaacgagctgtgggagctgtgggaaggatctgggccgattctaaacgagaaagctcgtttgctggaggtctaagatccaaggggaccaaaaaatatcagcgcccaccatgatgcaatctaatttaacatcacttcagctcctcatactgaggatagtatttataagctagaattgtctagtaatgtaagcttgtacgctgctgttttcctcgcaagaggaagcacatatgtatcacctaactgcttgtaatagaaaggttcaatgcatttcagcttataccaaaaaaaaaaaaaaaaaaaa

SEQ ID NO: 4808 - protein, 371 aa, Panicum virgatum
  misc_feature: Ceres CLONE 1810870
  misc_feature (1)..(314): Pfam Name: Peptidase_A22B Pfam Description: Signal peptide peptidase
MESLWKLTYLLEPASLALIATAISVAYASASRALDYGKEMERNLDFSEASITLDRSQALMIPLASSCSLLLMFYLFSSVSHLVTAFTTVASAMALFFCLSPYITYLKTQFNLMDPFMSRCCSKSFTRLQGLLMLFCIATVLAWLVSGHWLLNNVLGISICIAFVSHVRLPNIKICALLLVCLFVYDIFWVFFSERFFGANVMVSVATQKASNPVHTVANKLSLPGLQLITKKLELPVKLVFPRNLLGGIVPGSSPGDYMMLGLGDMAIPGMLLALVLFFDNRKHKDANIPSDVSPSKRQNYVWHALTGYGVGLVAALAAGILSQSPQPALLYLVPSTLGPVMYLSWLRNELWELWEGSGPILNEKARLLEV

SEQ ID NO: 4809 - DNA, 1483 bp, Panicum virgatum
  misc_feature: Ceres CLONE 1810891
  misc_feature: Encodes the peptide sequence at SEQ ID NO. 4810
atgcccgctcgcccctcccattccttcagtggcggcggcgcacctcccggcgacttgagctccctcgttgaggtcctcggggaggcggggacgggctgaccgccatcgaagcggcaggggcaggtggatctcgctgattcgtcacccaagtaattaaggcgtgctcaccatggaagtggaagaagcaggaggcggagtggagaacgccggcaaggacgaggtggaggcggagtaccattcgcacgacttcgagtgggaggacctcagggcggaggtggaatccgaccccgccttttcctaccacctctccccctttcctggccccgccgcgagcaccgcctcaccgccgcagccttcgtcggaggcctggagaagcttccaccgtcgccacgcttccggcaagtttttcaaggaaagaaggtatttgctcaaggaatttcctgagctgcctaacagcaaagattgtgccaagattttagaagtgggatgtgggaatggaagtactgctgtttccatactgcgtaaagacactcttgagaaggcaaatgagattatatctaatacaaaaggggttgatatcaaggacagattccacccctttttaatggatgtttctaaagaattttttccagattggttattctgcaatgcctgtaaaagttcacatgatagttgtcatgaaatgagaaaacagctcccagacttcctgagagagaatcaatgttgtgtcggtggcatggattttatcactatgatattcacattatcagccatacccttcgccataatgccaagtactatagagcaatgtgtttctgttctgaaaccaggtggccttcttctgtttagggattatggtctttatgacatgacgatgcttcggttcttacctcatcaaagagttggattttgggaatatatgcggtcagatggcaccttgtcatacttcttcacactggacactgtgagagaactctttcatgctgctgggcttataacgttggagctggaatactgctgtgtcaggtcagtgaaccgaaagaacgggaagaagatgcagcgggtatgggtgcatggaaaattcatgaagccaacaagctgatgctgacaaaccgtgaatgttgtcttccaacaaactgccattgctttggcaattctagccaccggatcagagagtccctttgcctgaccactcgttttgtcttcatagctgcaactagcgttgtatgtggggttggagtttaatctggcctgcctgatctggcagaatgtcgtgttgtttcactgtaggaaggcggagtcagtgtccagtgagcaagggggaggctaccagtgtcatgcaagctggattttttttttcgattttgcgttcatgtaggcgtggagtgatagttcaagctgtttattcaattttcctaaacatgcttgaggatctagtgcaattgaagtttagcttccacagtaaaaaaaaaaaaaaaaaaaa

SEQ ID NO: 4810 - protein, 310 aa, Panicum virgatum
  misc_feature: Ceres CLONE 1810891
  misc_feature (1)..(135): Pfam Name: Methyltransf_12 Pfam Description: Methyltransferase domain
MEVEEAGGGVENAGKDEVEAEYHSHDFEWEDLRAEVESDPAFSYHLSPFPGPAASTASPPQPSSEAWRSFHRRHASGKFFKERRYLLKEFPELPNSKDCAKILEVGCGNGSTAVSILRKDTLEKANEIISNTKGVDIKDRFHPFLMDVSKEFFPDWLFCNACKSSHDSCHEMRKQLPDFLRENQCCVGGMDFITMIFTLSAIPFAIMPSTIEQCVSVLKPGGLLLFRDYGLYDMTMLRFLPHQRVGFWEYMRSDGTLSYFFTLDTVRELFHAAGLITLELEYCCVRSVNRKNGKKMQRVWVHGKFMKPTS

SEQ ID NO: 4811 - DNA, 1312 bp, Panicum virgatum
  misc_feature: Ceres CLONE 1810896
  misc_feature: Encodes the peptide sequence at SEQ ID NO. 4812
aatacggctttcctctctgctagcttagtcatccacacacagcacaacacaatggcgctcagcgaggtgagcaaggccttgctccaagcccaggtcgagctgtggaaccagaccttcagcttcatgaagtcggtggcacttgcggttgccttggacctccgtatcgccgacgccatccaccaccacggcggcactgccaccctcccccagatactcgctaggattggcattagcccgtgtaagcttgctggcctccgtcgcctcatgcgcgttctcacggtcgcaggaaccttcaccaccatccagcaaccggaagcctcgtcaggcgggcacgatgagcttgtttacaagctttcgacggtctcccgcctcctcacgacgagcgatgatgacggtgagacctcggcgagctgcttgtcccctatgctgagccacgtgctcaaccctttccatgactcggtgctcagcatgggcctcaccgcgtggtttcggcacgatgaggagcccgacaagtgcccatatgccctgatgcgcggcgcgaccgtgtgggagatgtgcgggagcagcgacgcggtgaacgcgtccatcaacaatgccatggccgcggacagccgcttcctgatgcggatggtcatggaggagtgcggcggtatcttccgcggtatcaactcgctggtcgacgtcgccggtggcgtcggtggagccgccgctgccatcgccgccgcgtttccatctttgaagtgcacggtgctggatctccctcacgttgtcgccaaggctccatctgttagcaacgtgcagtttatcgcgggcgacatgtttgagagcattccagccgctaatgccatattcctaaagtacgtactgcatgactggggagatgacaagtgcatcaagttattgaagaactgcaagcaagctatcccttcaaaagatgcaggcggaaaggtaataatcatagatatcgtggttggatccagcccgtcagatgttaagcttctagagacgcaagttttgtgtgatctcgatatcatgaaaattggtggggttgaacgagacgagcatgagtggaagaagatattccttgcagctggattcagggactacaatattatgccgcttggcctccggtcggttatcgagctctatccatgaatgatgctcactctgtctgctagataaataaaagcatatggcatgtgaacgtagtagttactttctgttgtactactatatattccgtttcagattttgaattcagtcagtttgaataatctgttcagacaaattgtaaaaaaaaaaaaaaaaaaaa

SEQ ID NO: 4812 - protein, 367 aa, Panicum virgatum
  misc_feature: Ceres CLONE 1810896
  misc_feature (6)..(254): Pfam Name: Methyltransf_2 Pfam Description: O-methyltransferase
MALSEVSKALLQAQVELWNQTFSFMKSVALAVALDLRIADAIHHHGGTATLPQILARIGISPCKLAGLRRLMRVLTVAGTFTTIQQPEASSGGHDELVYKLSTVSRLLTTSDDDGETSASCLSPMLSHVLNPFHDSVLSMGLTAWFRHDEEPDKCPYALMRGATVWEMCGSSDAVNASINNAMAADSRFLMRMVMEECGGIFRGINSLVDVAGGVGGAAAAIAAAFPSLKCTVLDLPHVVAKAPSVSNVQFIAGDMFESIPAANAIFLKYVLHDWGDDKCIKLLKNCKQAIPSKDAGGKVIIIDIVVGSSPSDVKLLETQVLCDLDIMKIGGVERDEHEWKKIFLAAGFRDYNIMPLGLRSVIELYP

SEQ ID NO: 4813 - DNA, 1312 bp, Panicum virgatum
  misc_feature: Ceres CLONE 1810945
  misc_feature: Encodes the peptide sequence at SEQ ID NO. 4814
aaaacagtcatcttcccatccacgcaactccagctccaagcgactcgatcatcatcccaacggcgatggcgtccgcctccctcccggcgcccgctcccggccgcgccgagctgctcaaggccttcgaggagtcccgcacgggcgtgcgcggcctcgtggagtccggcgtctcctccgtcccggagatcttccgccacccggacccgtacgcctccatcccgctcgccccgcccggcgtctccatccccgtcgtcgacctctccctccccttcccctccgccgccgcggccgccgccgaggccgcccggacctggggcttcttccacctcgtcaactaccaccacgccctcccccagcccacggacggcggcggcggcggcgactaccccgcgcgcgccctcgccgcggtgcgctctttcaacgagctcccgcccgccgagcgcgcgccgcactacggccgcaccgtggacggcggagtcatctactccaccaacgtcgacctgtataactccccggcggcaagctggcgcgacaccatccagatcatgctcgggccgaaccgccggcccgacctcgccgcccggatcccggccgtctgcagcgccgagctgctcgagtgggaggcgcgcgccaccgccgcggcgcgcgccgtgatggggctcctctccgaggggctcgggctcgggcccgccgcgctggaggaggcgtcctgcctcgaggggaaggtcatggcgtgccactactacccgcactgccccgagccggagcgcaccatgggcatcgtcccgcacacggaccctggcgtgctcaccgtgctcgcgcaggatgacattggtggcctgcaggtgaagcaccaggatgaggcagggagaagctgctgggtggatgtgaagcccgtgcccggagcgcttgtgatcaacgtcggggacctcttgcagataatgtccaatgacaagtacccgagcgtcgagcaccgggtgaccatgaacacgcgcgaggaacccagagtttggatcgccatcttcttcagtcccgggaagagaggggactcagtattctacggcccattgccggggctggtttcttcggagaacccacccaggtacaggaatttcaccatggccgaattcttcgggaccttcttctcgcgagacctctctagcaaagctctaatcgaccacttcaagctgtaatgcaagtggtgactgtctagtgtcgacccaaaaaattcagacctgtgtagtgtagagctgtgtgcggttgctggtaatgtaaagaaattgttctggctcaaaaaaaaaaaaaaaaaaaa

SEQ ID NO: 4814 - protein, 375 aa, Panicum virgatum
  misc_feature: Ceres CLONE 1810945
  misc_feature (1)..(106): Pfam Name: 2OG-FeII_Oxy Pfam Description: 2OG-Fe(II) oxygenase superfamily
MASASLPAPAPGRAELLKAFEESRTGVRGLVESGVSSVPEIFRHPDPYASIPLAPPGVSIPVVDLSLPFPSAAAAAAEAARTWGFFHLVNYHHALPQPTDGGGGGDYPARALAAVRSFNELPPAERAPHYGRTVDGGVIYSTNVDLYNSPAASWRDTIQIMLGPNRRPDLAARIPAVCSAELLEWEARATAAARAVMGLLSEGLGLGPAALEEASCLEGKVMACHYYPHCPEPERTMGIVPHTDPGVLTVLAQDDIGGLQVKHQDEAGRSCWVDVKPVPGALVINVGDLLQIMSNDKYPSVEHRVTMNTREEPRVWIAIFFSPGKRGDSVFYGPLPGLVSSENPPRYRNFTMAEFFGTFFSRDLSSKALIDHFKL

SEQ ID NO: 4815 - DNA, 1270 bp, Panicum virgatum
  misc_feature: Ceres CLONE 1810949
  misc_feature: Encodes the peptide sequence at SEQ ID NO. 4816
actccactgctactagcctactactgctccgccgcctagcctgctacaagtctactagaagcggcttggtagagagccagatagattggcaaagcttcttcggcgggcagcgacagcgagctgagaccccgtgcgcctctatcggccgggcgcgttcggcggcctcgaggagatggacccgcgggagtgccagttcgtggtggtgccgccgccgcggccgcgccacggccagtacgaggagggcccgttcgcgcaccaccagatggtggtggccggggaccccgaccccggcggcgcggggcgaggcggcggcggcggcggcggggagaggaagcggcggttcacagaggagcaggtgcggtcgctggagacgacgttccatgcgcggcgcgccaagctggagccccgggagaaggcggagctggcgcgggagctgggcctgcagccgcgccaggtggccatctggttccagaacaagcgcgcgcggtggcgctccaagcagctcgagcacgactacgccgcgctccgcgcccagtacgacgcgctccactcccgcgtcgactcgctccggcaggagaagctagcgctcgccgcccaggtggacgagctcaaggggaggctgagcgggcggcaggaccagccgagcggcagcagctgcgaggtcagcggcggcgcggaggcggccgacgacggcaggatgaacagcgccagctgcgtggcggaggacgacggcgccgtgacgcccgcggtggccgcctcggaggaatcggcggcggcggcggcggcggccgagtactgctgctacgaccacgccgcgtacggagggggccttctgcccgagccgttctgcaccaccccggagctgtgggacacatggccgctgctggagtggaacgcggtcgcatgagcaaagcaaccccccgccacgacggaggagaacgaatatagcatccgtgtactctactcgtgtctctgtagtctgtaagatagcgtgcgcgtggattcatgttgctctctagctgtagctagcacactagcaagtgatgatcagctgatgatgcggcgagagagatcgacggggacagaacaggtagaaactggggcggacaagaattctggacgcggccggcctgggagcttcatgcgctcatggcattgtacaccagggatggatcgacggctcctcggccgcgttctgcagctgttattaggattcatccgtgttcgcgagcgagattcttcacaagttcaaaaaaaaaaaaaaaaaaaa

SEQ ID NO: 4816 - protein, 244 aa, Panicum virgatum
  misc_feature: Ceres CLONE 1810949
  misc_feature (1)..(56): Pfam Name: Homeobox Pfam Description: Homeobox domain
MDPRECQFVVVPPPRPRHGQYEEGPFAHHQMVVAGDPDPGGAGRGGGGGGGERKRRFTEEQVRSLETTFHARRAKLEPREKAELARELGLQPRQVAIWFQNKRARWRSKQLEHDYAALRAQYDALHSRVDSLRQEKLALAAQVDELKGRLSGRQDQPSGSSCEVSGGAEAADDGRMNSASCVAEDDGAVTPAVAASEESAAAAAAAEYCCYDHAAYGGGLLPEPFCTTPELWDTWPLLEWNAVA

SEQ ID NO: 4817 - DNA, 1537 bp, Panicum virgatum
  misc_feature: Ceres CLONE 1810961
  misc_feature: Encodes the peptide sequence at SEQ ID NO. 4818
gccgcctgttgcgttcgcccctccttttactttcgcccattcgcaccgctctctcccgtggccttccttttcctggcggcgacagagcggcgccgtccttcatcgggtcttcgtcggtctcttcgccgacgacgagcacccaccagcgggacaataagcttggtctagcaaatagattatgagctctgtgctcatctaatagcatttctacaacaattcttttactggaaggtttattagttgtttgcaacaatgaaggatcatctattgctcaatgtcgatgacctaagcattcctgagcccaatgaggtcacgagggcattaaagaacacatcatctgggggaaccattgcacacccaccctccatggctcatgccattttagcaatgggagaaagcatggtttcggaagaagaacctcttctacagatggtggagtgtcgcatttgtcaggaggaggatagtattaaaaatctagagagtccatgcgcttgcactggcagtctaaagtatgctcatcgggcttgtgtacagcgatggtgcaatgagaaaggagatgtaacatgtgaaatatgtcatgagccttacgaacatgggtacactgcacctcccagagctcatcctgatgaaactaccattgatataagtggtggttggaccattactggtactgcattcgacttgcgagatcctagaatccttgcagtggcacaaaaccaaatcctggaagctgagtatgatgattattctgccacgaatgccagcactgctgccttttgccgctctgcagctcttgttttaatggctctcttattattgagacatgcactgactctaactgatgaagatgatgatgatacttctgcagtattttcactttttctattgcgcgctgcgggtttcctgctaccattctacattatggcatgggcgattagtatcttgcagcgccgcaggcagagacaggaggcagctgctctagctgcaacagaggtggcattcatcctgcagtcggggcaagggaggggagtgcatttcaccatcgcaccagactcccctagcacacctcagcatgaaccaccacacccttaatgatatctatcaaggagtggctggctgtggcaatggtcgcagcaaccgcagattgcttatttgcacaggatcccccaaggattcatttgccgtggttgcagtctagtgcagaaccggataatttccacctgaagtttcattgcatatcagtgtactgagtgcaaagatgcatgttcgtgctttggatttcactagtgcgttgtgcatgtcggctgggaagtaacggggtgtatataacttaagagatatctggggcctgatcgccctaattgtcaaagtttgaaaaacagcgctttctgaggcgtatgtttgatgtggtctttacatatggcttaccaatactaacccagacgatgtagaaatatttgcgcgataatcttgtactatattctggggatgtcagaaatgtttacactaatgttctagtgacagcggggcttttcac

SEQ ID NO: 4818 - protein, 279 aa, Panicum virgatum
  misc_feature: Ceres CLONE 1810961
  misc_feature (1)..(46): Pfam Name: zf-C3HC4 Pfam Description: Zinc finger, C3HC4 type (RING finger)
MKDHLLLNVDDLSIPEPNEVTRALKNTSSGGTIAHPPSMAHAILAMGESMVSEEEPLLQMVECRICQEEDSIKNLESPCACTGSLKYAHRACVQRWCNEKGDVTCEICHEPYEHGYTAPPRAHPDETTIDISGGWTITGTAFDLRDPRILAVAQNQILEAEYDDYSATNASTAAFCRSAALVLMALLLLRHALTLTDEDDDDTSAVFSLFLLRAAGFLLPFYIMAWAISILQRRRQRQEAAALAATEVAFILQSGQGRGVHFTIAPDSPSTPQHEPPHP

SEQ ID NO: 4819 - DNA, 1446 bp, Panicum virgatum
  misc_feature: Ceres CLONE 1810962
  misc_feature: Encodes the peptide sequence at SEQ ID NO. 4820
atagacttccttgtcccgacgcgcaaacccgaagaaaaatcaatttttaattaataaaagcggagcctcgaagagaaagctctgctcggcttcttgccttcttcacttcctcgaccgctcaaagcctccggcctccgcaatcctcttccctccacggtcgggtgcgatattccatgaaaagggcgcgatttcgggaggaccgtcgtgagcgaactcgacctgtgtcccgagggaagcatcggcggctgtcggggacttctcagcttccgccccttttctcttatttttataaatctcagttgctggattggaactgagaggggatcctgaacatatggcaagattttgctgcttcggtgccggtttctcagagttcacaaggcaagggtcaacggcatctggtaaagggaaaggccgtcagggccaagtcaaggtctgctatggctataaccttgtaagaggaaagacaaatcatccaatggaggactaccatgtcgccaattttgttgaagtaaagggaagcgagctaggcctttttgctatttttgatggtcaactaggagatactgttcctgcgtacttacagaagaatctattttcaaatattttgaatgaagaagaattttggacacatccagatagggcgatcacaaaagcttacgaaaaaacagaccaagctattctgtcacatactccagacttgggacaaggcggctccactgctgtaactgccattcttgtaaacggcaggaagttgtgggtagctaatgtcggggattcgagagctgttcttttgaaaggtggtgaacccatacagatgtcaatagaccatgatccgaatgttgagcgtagtgtaattgaaaataggggcggctttgtttcaaacatgccaggagatgtcccccgagtatgtggtcagttggctgtctccagagcttttggagacaggaatctaaaatcacttctgagatcagagcctgatataaaagttgaaaacatcgatcacaccgctgagctacttgtccttgcaagtgacggtctttggaaggtgatgaacaatcgggaagtcattgatgtggccaaaaggttcaaggatccatatgcagctgcaaagcaattaaccgccgaagcattaaaaagagacagtaaagatgatatatcatgcatcgtcgttcggttcaaggcgtaaatcgattgcagctgacacaggagggggttgtgaacttgtgatcaagagcagaaaaatgatttgtgtggcacaacttaggctgcctgacgatggctgtggtagtccaaagacaagaataattagttaattactactgggttgtttggttgtaaatgatttggcggctccattgcatgttcatatataaatatgctatcatctgtaagactgtaaataatggttgcagattttggaagctaacccagtggtccgttgcg

SEQ ID NO: 4820 - protein, 284 aa, Panicum virgatum
  misc_feature: Ceres CLONE 1810962
  misc_feature (1)..(240): Pfam Name: PP2C Pfam Description: Protein phosphatase 2C
MARFCCFGAGFSEFTRQGSTASGKGKGRQGQVKVCYGYNLVRGKTNHPMEDYHVANFVEVKGSELGLFAIFDGQLGDTVPAYLQKNLFSNILNEEEFWTHPDRAITKAYEKTDQAILSHTPDLGQGGSTAVTAILVNGRKLWVANVGDSRAVLLKGGEPIQMSIDHDPNVERSVIENRGGFVSNMPGDVPRVCGQLAVSRAFGDRNLKSLLRSEPDIKVENIDHTAELLVLASDGLWKVMNNREVIDVAKRFKDPYAAAKQLTAEALKRDSKDDISCIVVRFKA

SEQ ID NO: 4821 - DNA, 2559 bp, Panicum virgatum
  misc_feature: Ceres CLONE 1810986
  misc_feature: Encodes the peptide sequence at SEQ ID NO. 4822
gtcgcacgcagcagcagcagcagcagcagcagcaggggctgtttggctgaggtcgggcgggtcgcccccacctccccgaaatcccctcgcgcaccagagaaattctccagccaccgccaccaccgccgcgcccagcacctccctctcccccacccccacccccgctaggcgctacctagactcacgccgcgccccttcttcctccccacgccggagcgacctcgccttcacgcgggaagagatccgggccccgcggctcggattcggccgcgctgctggattccgcggccgaggcctcgattcggccgctgggcccccaatctggtattatggtcatgaagatggagatggaggacgacggcgctgtcggaggaactggtgggacatggacggaggaggaccgagctctcggcgctgctgtcctcggaacagatgcctttgcatatttaacaaaaggcggcggtgccatatccaagggtcttgttgctgcatctctgccagatgacttgcaaaacaaactccaggagcttgttgaatcagacggccctggtactggttggaattatgccatcttctggcagctctcacgcacaaagtccggtgaccttgtccttggatggggggatggctcctgccgtgagccccgagatagagaggtgggagctgctgcttctgcaggcagtgatgataccaagcagcggatgcgcaagcgtgtgctgcagaggttacacatggcattcggggttgcggatgaggaggattatgcccctggtattgatcaggtgacagatactgagatgttcttcctagcgtctatgtactttgcattccctcgtcgtgctggtggccctggccaagtatttgcagcaggcatccccctctggattcccaataatgagcgcaaggtattcccagccaactactgctaccgcgggttccttgcaaacgcggcaggatttaggactattgtgttggtgccgtttgagagtggtgttcttgaactgggctcaatgcagcacgtagctgagagttctgatactatccagaccatacggtctgtgttcacaggggcaagcggtaataaggctgcagttcagagacatgagggaaatggccccactcctcctgaaagatctcctgctttggcaaagatttttggaaaggatttgaaccttggccggccttcagcagtgcctgcggttggtgtatctaagatacatgaaaggtcatgggaacagagggctgctggtggtggtgggacctcattgcttcccaatgtccagaaaggattgcagaattttacttggagtcaggcacggggcctgaattctcatcagcagaagtttggcaatggtgtgctgattgtgagcaatgaagctgcacaccgcagcaatggagctgcggacagccctagtgcaacacagtttcagcttcaaaaggcgcctcagcttcagaaactgcagctccagaaattgccacatattcagaaaacaccacagctagtgaaccagcagccgctgcagccacaggtacctagacaaatcgattttagtgccgggagcagctccaagtctggagtgctggttacaagagcagctgttctggatggggagagtgcagaggtggatggcctgtgtaaagaggaaggcccgccacctgttatagaggaccggcggccaaggaagaggggaagaaagcctgcaaacgggagggaagaaccacttaaccatgtcgaggctgagcggcagaggagggagaagctcaaccagcggttctacgcactcagagccgttgtcccaaacatatcaaaaatggacaaggcgtccctgctgggcgatgcgataacgtacatcactgacctccagaagaagctgaaagatatggagacagagagagaaaggcttttggagtcaggtatggtggatccgagggagcgagcgcctaggccagaggtggacatccaggtggtgcaggatgaggttcttgttcgagtgatgtctcccatggagagccatccagtcaagaaagtcttccaagcatttgaggaggcagaagtccgcgttggtgagtcgaaggtgactggcaacaacaacgggacagtggtgcattccttcatcatcaagtgccctggcactgagcagcagacgagggagaaagtgattgccgcgatgtctcatgcgatgagcagttgagcagagcttaggaccagattggcgccgtagggggtgtcggtgtaccatgttgcttgcaaacaagcagccgcagcccttgacatgtcccgttgtcgataggaggagagttgtaggtggagaaaggaaagttcagattctgacctttagcgttgcaggaagagggggaaaaaaagggggctctgccgctgtttggtagatttcttgtggtggtccgtgtagttttttctttttaatgtttttttttggggatggggatggatggatacactgtgtgtcctagtgtaagcttgatgatgcagcagaacaataaacagcagtacatgttttttctcttgtcatgaatgagctggaaatttcaatttcattt

SEQ ID NO: 4822 - protein, 620 aa, Panicum virgatum
  misc_feature: Ceres CLONE 1810986
  misc_feature (1)..(50): Pfam Name: HLH Pfam Description: Helix-loop-helix DNA-binding domain
  misc_feature: The sequence is a functional homolog of  SEQ ID NO 1177 in the  11/479,226 US patent application
  misc_feature: The sequence is a functional homolog of  SEQ ID NO 528 in the  10/412,699 US patent application
  misc_feature: Useful for making plants with modulated growth and phenotype characteristics
MVMKMEMEDDGAVGGTGGTWTEEDRALGAAVLGTDAFAYLTKGGGAISKGLVAASLPDDLQNKLQELVESDGPGTGWNYAIFWQLSRTKSGDLVLGWGDGSCREPRDREVGAAASAGSDDTKQRMRKRVLQRLHMAFGVADEEDYAPGIDQVTDTEMFFLASMYFAFPRRAGGPGQVFAAGIPLWIPNNERKVFPANYCYRGFLANAAGFRTIVLVPFESGVLELGSMQHVAESSDTIQTIRSVFTGASGNKAAVQRHEGNGPTPPERSPALAKIFGKDLNLGRPSAVPAVGVSKIHERSWEQRAAGGGGTSLLPNVQKGLQNFTWSQARGLNSHQQKFGNGVLIVSNEAAHRSNGAADSPSATQFQLQKAPQLQKLQLQKLPHIQKTPQLVNQQPLQPQVPRQIDFSAGSSSKSGVLVTRAAVLDGESAEVDGLCKEEGPPPVIEDRRPRKRGRKPANGREEPLNHVEAERQRREKLNQRFYALRAVVPNISKMDKASLLGDAITYITDLQKKLKDMETERERLLESGMVDPRERAPRPEVDIQVVQDEVLVRVMSPMESHPVKKVFQAFEEAEVRVGESKVTGNNNGTVVHSFIIKCPGTEQQTREKVIAAMSHAMSS

SEQ ID NO: 4823 - DNA, 1334 bp, Panicum virgatum
  misc_feature: Ceres CLONE 1811032
  misc_feature: Encodes the peptide sequence at SEQ ID NO. 4824
gcccacgcgcgccagtagtcttgccaatggactcgtcgcgttccccccgcctgctcctcctcctcctgcccgccctcctcgccccgtcgtcggcgggggtcatccggctgccgagcgggaaggcgggggcgcgggcgtgcgccgcgccgccggaccccgccgcgtacgaccgccccgtcatcggcatcgtctcgcacccgggggacggcgcgggcggcaggatcagcaacaccaccgccacctcctacatcggcgcctcctatgtcaagttcgtcgaggccgccggcgcgcgggtcatcccgctcgtctacaacgagcctgaggagcgcctcctcgagaaactgagtttggtgaatggtgtgctgttcactggtggatcagagaagcaaggtgtatattttgagacaataaaaaaagtgtttcagtatgttttggacaggaatgacgcaggcgaaccatttcctttatttgctcaatgcctaggctttgagcttgtaagcatgattgtcagcaaggacaataatatcttggagacgtttgacgcccacgatcaagcatctactcttcagtttcccagctattcttttgagggcacagtgtttcaaagatttgactctgacctcatcaagaaagttagcaccagctgtcttgtcatgcaaaatcacatgtatggtatatcgccaaagcgtttgcgagagaatgatgaactatcaagtttcttcagagtcttgactacatcgtctgatgaaaacggcaaggtctacgtctcaactgtacaagcaaataaatatccaatcacttgcacgcagtggcatcctgagaaagccatttttgagtggagaaaaccaatgatcccacacagtgaagacgcagtacaagttactcaacattttgctaatcattttatcagccaagctcgcaagtctcccaacaggcctcctgcagacaaggtgctcgataacctgatctacaactacaatcccacatttagtggaaaaacctcgaaatcttttgaggtggtttacatattctcctgagacggaagcaggcgcgggagggtcttcctgaaccagcatagcattgttattgtagtgtggttgtgtatccatcatactcggaagacgggagcctatagattctgggcttcctgtattgctttactcttgccgccatattggtgagcactgctgctatttgtgcacttcgcgccaccatcgcatattcaccttcggcaggagcatttatgtactgaactgaacatgccttgaagagtatgcatgtatatatgtgagaatttggtgcccaagagtctccaaaaaaaaaaaaaaaaaaaa

SEQ ID NO: 4824 - protein, 336 aa, Panicum virgatum
  misc_feature: Ceres CLONE 1811032
  misc_feature (1)..(217): Pfam Name: Peptidase_C26 Pfam Description: Peptidase C26
  misc_feature (7)..(336): SWISSPROT Homolog: EC 3.4.19.9 Gamma-glutamyl hydrolase precursor
MDSSRSPRLLLLLLPALLAPSSAGVIRLPSGKAGARACAAPPDPAAYDRPVIGIVSHPGDGAGGRISNTTATSYIGASYVKFVEAAGARVIPLVYNEPEERLLEKLSLVNGVLFTGGSEKQGVYFETIKKVFQYVLDRNDAGEPFPLFAQCLGFELVSMIVSKDNNILETFDAHDQASTLQFPSYSFEGTVFQRFDSDLIKKVSTSCLVMQNHMYGISPKRLRENDELSSFFRVLTTSSDENGKVYVSTVQANKYPITCTQWHPEKAIFEWRKPMIPHSEDAVQVTQHFANHFISQARKSPNRPPADKVLDNLIYNYNPTFSGKTSKSFEVVYIFS

SEQ ID NO: 4825 - DNA, 1016 bp, Panicum virgatum
  misc_feature: Ceres CLONE 1811044
  misc_feature: Encodes the peptide sequence at SEQ ID NO. 4826
accacagcttccgccattgatcactgcgcacacaagctcacgcatcgtcaggaagagaggtagacaggggccaatcaagaagcagagatggcgggggagaagaagggcctgcagctgctggacttctgggtgagcccgttcgggcagcgctgccgcatcgcgctggccgagaagggcctcccctacgagtacctggagcaggacctgcgcaacaagagcgagctcctgctgcgctccaacccggtgcacaagaagatccccgtgctcctccacgacggccgccccgtctgcgagtccctcatcatcgtccagtacatcgacgaggcgttcccggccgagccggggctgctccccgccgacccctacgcgcgcgcgcaggcccgcttctgggccgactacgtggacaagaagctctacgactgcgggacccggctgtggaagctcaagggcgaggcccagcagcaggcccgcgcggagatgctcgagatcctccggacgctggacggcgcgctcggcgacggcaagttcttcggcggcgaggcgttcggcttcgccgacgtcgcgctcgcgccgttcacggcgtggttcctcacctacgagcgccacggggagttcagcgtggagaaggagtgccccaggctggcggcgtgggcgaagcgctgcggggagagggagagcgtcgccaagaacctcccgccgccggagaaggtctacgagttcgtcgccggcatgaagaagaggttcggtatcgagtaaacgttagttgttgtggtgctgcgtggctcggttggggtgtgtgtgtggcgatgggatactatacttgttttcctacctgccagtactgtcggttgggtgttgttggtgtcaagtgtcattgtgtcccgatctggcgtgcaggtgcaccggctggcccgtgtggccatcctgcactccagcaagggagaaaagctaaacaacgctcggttgttttgaataaagaataaaggatttccgcggaaaaaaaaaaaaaaaaaaaa

SEQ ID NO: 4826 - protein, 222 aa, Panicum virgatum
  misc_feature: Ceres CLONE 1811044
  misc_feature (1)..(96): Pfam Name: GST_C Pfam Description: Glutathione S-transferase, C-terminal domain
  misc_feature (1)..(74): Pfam Name: GST_N Pfam Description: Glutathione S-transferase, N-terminal domain
  misc_feature (10)..(217): SWISSPROT Homolog: EC 4.4.1.5 Lactoylglutathione lyase
MAGEKKGLQLLDFWVSPFGQRCRIALAEKGLPYEYLEQDLRNKSELLLRSNPVHKKIPVLLHDGRPVCESLIIVQYIDEAFPAEPGLLPADPYARAQARFWADYVDKKLYDCGTRLWKLKGEAQQQARAEMLEILRTLDGALGDGKFFGGEAFGFADVALAPFTAWFLTYERHGEFSVEKECPRLAAWAKRCGERESVAKNLPPPEKVYEFVAGMKKRFGIE

SEQ ID NO: 4827 - DNA, 1104 bp, Panicum virgatum
  misc_feature: Ceres CLONE 1811073
  misc_feature: Encodes the peptide sequence at SEQ ID NO. 4828
ataaacaaaccaaaccaaaccgaagagaaggggagcaaaggcagcaaaaccccacctcctcggtcccccgtcccctgcttccattgccgggctgtgcgcggcgacgtgtctggccggggatggtggagatggatggcgccgtgggggtgggaggaggcgggcaccaggcgccggcgccggcggcgcacccgcggctgtggcggctggtggacgagcggtgcgacccgcgcgccctggagacggactacgtgcggcggttccaccggcacgagccccgcgagcaccagtgctcctccgccgtcgccaagcacatcaaggctcccgtccacctcgtttggtctctggtgaggcggtttgatcaaccacagcttttcaagccctttgtcagtcggtgtgaaatgaaagggaacattgagatcggcagtgtgagggaggtcaatgtgaagtctgggctgccagccacaagaagcacagagaggctggagctgttagatgacgatgagcatatactcagcgtcaggttcgttggaggtgatcacaggctgcagaactactcctccatcctcaccgtccaccccgaggtcatcgacggccgaccagggacactggtgatcgagtccttcgtggtggacgtccccgacggcaacaccaaggacgagacgtgctacttcgtggaggccctgctcaagtgcaacctcaagtcgctcgcggaggtgtcggagaaccgcgtcaccagggatcaaacggagccccttgaccggtgatggagatgggtcttgatcggttcgtcgattcggaacatcgatttccttagaatgtgcaaagctattctccaatggagcccctaggttcttggaacttgcatgaaagagttttgaggaagcgttactgctgtgctctgttcaaaattatgtttcctccttgcgattgtgttggctgttcttctacagcgttgtatgtcgcccaatcagaagaacagaatgctgtgctattttagtgatgaagtaaaagaaaaaaagttagaactgtgaagccctgaacatctacttcaacctgattaatgtagactagagggtttctctgcaaaaaaaaaaaaaaaaaaaa

SEQ ID NO: 4828 - protein, 214 aa, Panicum virgatum
  misc_feature: Ceres CLONE 1811073
  misc_feature (3)..(143): Pfam Name: Bet_v_I Pfam Description: Pathogenesis-related protein Bet v I family
  misc_feature (1)..(133): Pfam Name: Polyketide_cyc Pfam Description: Polyketide cyclase / dehydrase and lipid transport
MVEMDGAVGVGGGGHQAPAPAAHPRLWRLVDERCDPRALETDYVRRFHRHEPREHQCSSAVAKHIKAPVHLVWSLVRRFDQPQLFKPFVSRCEMKGNIEIGSVREVNVKSGLPATRSTERLELLDDDEHILSVRFVGGDHRLQNYSSILTVHPEVIDGRPGTLVIESFVVDVPDGNTKDETCYFVEALLKCNLKSLAEVSENRVTRDQTEPLDR

SEQ ID NO: 4829 - DNA, 1416 bp, Panicum virgatum
  misc_feature: Ceres CLONE 1811077
  misc_feature: Encodes the peptide sequence at SEQ ID NO. 4830
gtagagaagcgagactcgtggccgagagagagaacgagggaggagtggtcacccaccgaaatggaggcggccgccacgtcgccgtcgccggagcagccgctgctccgcgccccgtccccgccccccaatccccgcgccggagccagctccggcggcccggcctccccttcgccccccgccgcgaggccgagccgcctcgcggcgctcatcgggcgcgccgcggggcagccgcgggccctcgatgctggtgcgcgagacggcggcgctgcagctgcagcagaggcgcgcggactgggcgcactcccgccccgtcgtcgcgctcgacatcgcatggaacgtcgccttcgccgccgccgccgcggccgtgctcgcgtcctccgcccacgagagccccgtcaggccgctccgcctgtggctcgtcgggtacgccgcgcagtgcctcgagcacgtcgcgctcgtctgctcggacacccgccgcgggcgccccaccgcgcgcggctcagcctccgacatcgagtccgcgggcgcggggacggacagctcggacaccgacggcgaagatgacgaagggaccgaagagaggagcagctatacaggttgctgcgagtctatgaacacgatgatatcgtttctgtggtggatcattgggttctactggatagtgtcaggcggggaggtgctcgagctcggtgctccacggctgtattggttaaccgttgtgtttctagcctttgatgtgttttttgctgtgttctgcgttgttgtggcctgcttcattgggattgcgctgtgttgctgcttgccttgtgttattgctattctctatgctctggctggccaggaaggtgcatcagatgcagatattggtcttcttcctaggtatagatattctgatccaagtgagaacggagaaaaaggggcagatgagggagtgatgatccctatcctgaataatagcgggacatcaacaagtgagcgtatacttcttcgtgaggatgctgaatgttgtatctgcctctcatcgtatgaagatggagcagagttatatgctctcccctgcaaccatcacttccattggacatgtattaccaaatggcttcgaatgcatgctacctgtccactttgcaagtacaacattctcaaaggcagtgacagtgcataacagactgtgctgacataatttccacacctcagaacctgtgtgcatcaacatccaattcgtaaagcaagcaagcaagcgaaggttctgcgatgtcctagtgtttctgatctggttgtgtgctgatttaagagctgttgtttcgagtgacaatgatgtgtggtttccgtttaggatatagcggtaacctgtaaatgaatgaaacctaacttacagtgggctttgctaatatcacctgtaaatatctttcgagttgt

SEQ ID NO: 4830 - protein, 306 aa, Panicum virgatum
  misc_feature: Ceres CLONE 1811077
  misc_feature (1)..(41): Pfam Name: zf-C3HC4 Pfam Description: Zinc finger, C3HC4 type (RING finger)
MLVRETAALQLQQRRADWAHSRPVVALDIAWNVAFAAAAAAVLASSAHESPVRPLRLWLVGYAAQCLEHVALVCSDTRRGRPTARGSASDIESAGAGTDSSDTDGEDDEGTEERSSYTGCCESMNTMISFLWWIIGFYWIVSGGEVLELGAPRLYWLTVVFLAFDVFFAVFCVVVACFIGIALCCCLPCVIAILYALAGQEGASDADIGLLPRYRYSDPSENGEKGADEGVMIPILNNSGTSTSERILLREDAECCICLSSYEDGAELYALPCNHHFHWTCITKWLRMHATCPLCKYNILKGSDSA

SEQ ID NO: 4831 - DNA, 2480 bp, Panicum virgatum
  misc_feature: Ceres CLONE 1811220
  misc_feature: Encodes the peptide sequence at SEQ ID NO. 4832
gctgagcgtcgcgttcttcggttgttcgtcgcgagatctcgccggcgccgtcctgcgccgcccgcctcctctcccacgctgccatctgccgccgccaccgtctcctgtgccggtgatcctctgtgacgcagttcgcctccggagctcgaccccgtcgctcccccgcctccggatgttacaattttcttcagtccttcagagtaattaacgtctattagtcgatcatggaagaacagcaagtcaagccatctgatctgccacccactacttcggacaaccgggattcggctgcaacccctcctattaccactgttgaccctgttcgtctggctgcttcaagtcaggttgctggtgcagatactgctgcttcttctgcagcaactgctgctcctgcaaaagatgatgcagggcgcgaggcaccaccatccatgttttctacatctggtttgtccacctgggctaagaacctaaaaattcctcagccttcctcaggtcaagaatcaccaacaggaaagaacacatttgcccgttttacaagtggccttggattacgtttgtctccaaaagctgcacagcaagatgagattgccgaaggaagcacctccccaacaacaggacagtctggtgtttttggttctttgacaaaaggcattgtagattcctctaagaatgctgtaaaggcagtgcaagtcaaggctcgccacatggtctcacagaataaaagacgataccaggaaggaggatttgatttagatatgacatatattactgagaacataattgctatgggttttcctgctggtgatttgagttcagggcttttcggatattttgagggtttctaccgcaaccatatggaggaagtcatcaggttctttgaaatgcaccataagggtaagtataaggtgtacaacctttgttctgaaaggctatatgatgcatcactctttgaaggaaaggtggcctgcttcccatttgatgatcataattgtcctccaatacaacttgtcatatcattttgccatagtgcgtactcatggttgaaggagggtatagagaatgtggtggttgtccattgcaaagctgggaaggctaggacagggttgatgatctcgagtcttctactgtttctaaagttctttcctactgcggaggagtccattgaatactataaccagaaaagatgtgtagacggaaaagggcttattctcccaagtcagattagatatgtgaagtatttcgagcgcatcttaacctacttcaatggtgaaaatcagccgccacgcaggtgtatgcttagaggctttcgtcttcatagatgcccctattggattaggccatcaattacagtttctaatcacaatggcattcttttttcttcaaagaagcatccaagaacaaaagaactgatgccggaagatttctggtttagtgcaccaaagaaggggattatggtttttgctttgccaggagaacctggcttagctgaggtagctggtgatttcaagatccaatttcatgatcgacagggtgatttttactgctggctgaatacaacaatgatggagaacagggtaactttgaatccaactgatcttgatgattttgacaagaggaaattgccatcaccgggcttccaggtagaggttgttctggtagattatgatggctcacaactgccaaaaccaaaaccaactgctggacctgctgataataaatctgatactaattcctcgggtagcacagttgcaaaagaaaataatgctgcacctgcagaatccaataagggaactggaagcaatgataaagatgaagttttctccgacagtgaaggggaagatggatcatccaagggaagaaaggagaagactgccagtggtggtcaaagcaacacaaatgctgctaaaccatctgaaacaagcaccgtgcaggaggcatcagctgctgctagtagactggagaaagtagctgtaacagaacaaggagctgcaaaggcacctgatgctacatccctcaaaactgaagtcagcagcaagagcagctccaccacggaaccacctccagctgttgattcttccagcatgagtgaattcaaagccattgcagcagatgcctcggtgttttctttcggagatgaagatgattatgaaagtgaatagtgcttttatggtgtttggttcccattgtacagtttggtgcctcctgtgggccatcatagaatgtcagttcgaagcagctgggaagagcaaaaagggttaattcattattgcattttgttttcactgtagaagttacatcaatctgtgatgttgtacccagatgaacttgttgtaactcaaccaggcctgaactttgttgataccactcctatttgttcacagaactactttgtacacaaccttaaacggtgccataacttctattgagtgtcaagtgcacgtttacaggaagactttgtacaaaaaaaaaaaaaaaaaaaa

SEQ ID NO: 4832 - protein, 644 aa, Panicum virgatum
  misc_feature: Ceres CLONE 1811220
  misc_feature (1)..(41): Pfam Name: DSPc Pfam Description: Dual specificity phosphatase, catalytic domain
MEEQQVKPSDLPPTTSDNRDSAATPPITTVDPVRLAASSQVAGADTAASSAATAAPAKDDAGREAPPSMFSTSGLSTWAKNLKIPQPSSGQESPTGKNTFARFTSGLGLRLSPKAAQQDEIAEGSTSPTTGQSGVFGSLTKGIVDSSKNAVKAVQVKARHMVSQNKRRYQEGGFDLDMTYITENIIAMGFPAGDLSSGLFGYFEGFYRNHMEEVIRFFEMHHKGKYKVYNLCSERLYDASLFEGKVACFPFDDHNCPPIQLVISFCHSAYSWLKEGIENVVVVHCKAGKARTGLMISSLLLFLKFFPTAEESIEYYNQKRCVDGKGLILPSQIRYVKYFERILTYFNGENQPPRRCMLRGFRLHRCPYWIRPSITVSNHNGILFSSKKHPRTKELMPEDFWFSAPKKGIMVFALPGEPGLAEVAGDFKIQFHDRQGDFYCWLNTTMMENRVTLNPTDLDDFDKRKLPSPGFQVEVVLVDYDGSQLPKPKPTAGPADNKSDTNSSGSTVAKENNAAPAESNKGTGSNDKDEVFSDSEGEDGSSKGRKEKTASGGQSNTNAAKPSETSTVQEASAAASRLEKVAVTEQGAAKAPDATSLKTEVSSKSSSTTEPPPAVDSSSMSEFKAIAADASVFSFGDEDDYESE

SEQ ID NO: 4833 - DNA, 1847 bp, Panicum virgatum
  misc_feature: Ceres CLONE 1811227
  misc_feature: Encodes the peptide sequence at SEQ ID NO. 4834
aatcccgcaccacgacgcgcactccccgcctccaccgccgtcctcgcgccggcacgcaggcactcgggagcccgtgcggatacatttaggcggcgcgcagctcgagggctcgccctttcccctgccgctccttctgtgttcgtgtcgtgggaccaagctgcggcaatggcgcacgacggcttcctcgggggctcccacgacctgccgtggccgctctctcatcatgctgctgtcaccggcgccgccgcaggcgggccgttctcagttctgcaggcgcatgtgcagcacgcgctgatgggcgccggcgctggggcggggtgggagcacgactccgcgatgagctcgatggtgccgtcgcagtcaccgtcgccgtcgtcgctcgcggtggccgccggaggtggagctacttttgaggccgccctgatggaacagctggcgagcaggctcggcgttagtgtaccttcaccgccgtcgtcgcggtacccatcctgctacagcaggaccgtgggctcgtccaagccagcggcggcgccgttcggggctcctctgctcgtcgcggactcggagcgcgccgcgcggctctcgtgcctcgcggcctctggcgggaagctgtctcgagcggcgagcagccagtcactcctcggcgagccggcgacggcgacggcgcctgcccccgctcagctgcacgcaagcgacgggtcgagcagtgacgaccccagccggaagcgaaaggcgccgggcggcaagtccaaggccaaggacgcggtgaccacggcgacaccgaaatcccgggagccggagatgagagccaagaaatgcaagctctccacgaacgccgctgatgacgaggagcggaagccggcggccggagatgcagggcgaagcaatggcaagggcaaggaggtcgccgcagagccgcccacggactacatccacgtgcgtgctcgccggggccaagccacggacagccacagcctcgccgagcgggtgaggagggagaggatcagcgagcgtatgaagctgctgcaggacctcgtccctggctgcagcaaggttactgggaaggccgtgatgcttgacgagatcataaactacgtgcagtctctacaacggcaagtggagttcttgtcgatgaaactatcgaccgtcaacccacggttggaactcgacgtggacagctccattcccaaagatgccaaccagccgtgcacgcctgcagcgtcttccctggcaccgccaccgccagtatactcgctggaaggagggtcaagcgcggcgctctgctacgcctcatctcaaggtgctacggcggcgagcgtggtgaccagtgccaaaagcttcgtaacgtcatccacctttgtgaaccatcacatccctgaccactcaattgaaggatttcaaaatgttaactcacagatggggagcttatgggaggaggacctccaaagcctggtgctgatggggttccggggcagtacgtgatcattgacgcgttgattgagggacagttcagtttcacctatcaccaatcaaggcaagagatgatcaatatgggggcgtgtttggagcagggccacttaacaacagggttgggctccaatcattggaaattctccatgattgtacatacacccgtgcatagaaagaggactcttattcgctaatcgcctcagctgaaagtttccagctcagcgaggctgagaaaaacagcgaaaaaagatgatattatttttcttgcatttccaagagaaattctcaaaagcactgtacttcaatgtaatgtaatgatgtttagtccattagacatcaagttgatggattttatacaaaaaaaaaaaaaaaaaaaa

SEQ ID NO: 4834 - protein, 438 aa, Panicum virgatum
  misc_feature: Ceres CLONE 1811227
  misc_feature (1)..(51): Pfam Name: HLH Pfam Description: Helix-loop-helix DNA-binding domain
MAHDGFLGGSHDLPWPLSHHAAVTGAAAGGPFSVLQAHVQHALMGAGAGAGWEHDSAMSSMVPSQSPSPSSLAVAAGGGATFEAALMEQLASRLGVSVPSPPSSRYPSCYSRTVGSSKPAAAPFGAPLLVADSERAARLSCLAASGGKLSRAASSQSLLGEPATATAPAPAQLHASDGSSSDDPSRKRKAPGGKSKAKDAVTTATPKSREPEMRAKKCKLSTNAADDEERKPAAGDAGRSNGKGKEVAAEPPTDYIHVRARRGQATDSHSLAERVRRERISERMKLLQDLVPGCSKVTGKAVMLDEIINYVQSLQRQVEFLSMKLSTVNPRLELDVDSSIPKDANQPCTPAASSLAPPPPVYSLEGGSSAALCYASSQGATAASVVTSAKSFVTSSTFVNHHIPDHSIEGFQNVNSQMGSLWEEDLQSLVLMGFRGST

SEQ ID NO: 4835 - DNA, 1629 bp, Panicum virgatum
  misc_feature: Ceres CLONE 1811259
  misc_feature: Encodes the peptide sequence at SEQ ID NO. 4836
gcctcaatctcctccattctccatccctctcgcagtctcgctaccccccacacggccacacaccatctccctttcaccggaggatttctttctttcccccacagatattcccaaagaatctcccgtgttgctgtcctcctcggattcctcttccccctcctccgctcccctcacgctccaattattcttctccctactgacttgctttgcttctctcttctccctgtcctctcctcccgctccttcgtgtttcttcctcctaccagcggagcaccagttgcgtgcctgtgcctcgtgccctcgtgccaagaagaacgccggaggtgaggctgtccggccgccggcgtcatgtgcgcggaggagccggaggacacggaaaggcttggttttggagaggaaggggtcgaggaggccgccgaattccccctgggtcagatggagagagtttgtgaaaacacaacttctgctgatttcaggcagaataagttaagcaattttgttccagtgctccgatcaggagattggtctgatattggaggtcgccaatacatggaagatgcccatgtgtgcattccggacctagctaagaacttcggtttcccatcattgaatagtgaaattgtttccttctatggggtatttgatggtcatggtggaaaagatgctacccattttgttcgcgataatttaccaagggtaattgtggaagattcagatttccctcttcagcttgaaaaggttgtcaggaggtcttttattcagactgattgccagtttgctgagacatgctctcaccattcctctggcacaactgcacttacagcaatgatttttggaaggtctcttctggttgctaatgctggtgattgtagggcggttctttcccggggtggcactgcaattgaaatgtccatagaccacaggccttgtagcctcactgaaaaattgcgcatagaatcgcgtggtggctatgttgatgacggctatctgaacggtttgttaggagtcactagagctcttggtgactggcatcttgagggtatgaaagaagttggcgagccaggaggtcccctgagtgctgaaccagagctcaagatgatcacattgacaaaggacgatgagttcttgataattggcagtgatggaatctgggacgtcttctcaaaccaaaactccgtggactttgcacggaggcgcctccaagagcacaacgatgtgaaactatgctgcaaggaaattgttgaggaggcaataaggcgaggggccagtgacaacttaaccgcagtgttggtttcgttccatgtggaggcccctccccagatcaaagtagaccgtcctggtagggtggcacggagcatatcagctgacgggctcaatagcctcaggatactcctgggaaggaaataaactaggtgcttcgttgcattgccgagttgtaactgtatgtagtcatctcggcgcctcattgttgttagttgctaaacgttgcatgggttattattcttgttggtgattgagccaacaaacttgctactattcttgttggtaattggaccaacaaatttgagctccactgtaacgaattttaagtagatgaaactaaaccttgaaaaaaaaaaaaaaaaaaaa

SEQ ID NO: 4836 - protein, 352 aa, Panicum virgatum
  misc_feature: Ceres CLONE 1811259
  misc_feature (1)..(255): Pfam Name: PP2C Pfam Description: Protein phosphatase 2C
MCAEEPEDTERLGFGEEGVEEAAEFPLGQMERVCENTTSADFRQNKLSNFVPVLRSGDWSDIGGRQYMEDAHVCIPDLAKNFGFPSLNSEIVSFYGVFDGHGGKDATHFVRDNLPRVIVEDSDFPLQLEKVVRRSFIQTDCQFAETCSHHSSGTTALTAMIFGRSLLVANAGDCRAVLSRGGTAIEMSIDHRPCSLTEKLRIESRGGYVDDGYLNGLLGVTRALGDWHLEGMKEVGEPGGPLSAEPELKMITLTKDDEFLIIGSDGIWDVFSNQNSVDFARRRLQEHNDVKLCCKEIVEEAIRRGASDNLTAVLVSFHVEAPPQIKVDRPGRVARSISADGLNSLRILLGRK

SEQ ID NO: 4837 - DNA, 2067 bp, Panicum virgatum
  misc_feature: Ceres CLONE 1811269
  misc_feature: Encodes the peptide sequence at SEQ ID NO. 4838
atctaaattttagcttcctctctcccccaactctcctctctcccacgccgtgcctatgcccgccgccatctgcgcaccgccgcgcgcctccccacctgccgcctcgccacgcgcaacatctctgtgctcgtgcgggagcgccgccgtcggacgacgtgctttctgtgcaggcccgccagaactccggcactgtcacccgccgctcgccgccagcaccaaaaagaagggttcatactcgcccagtagatcaattctacgccagatgattgtacttcctgggggtagaagggcgtacggaagcagaactcgggtggtattgaattgaaatggaaggcgggatgtcaagtttggaaactgccatgaaagcttcttcatcggttgcaagtggtactgcaaggaatgctgaccctgacatacagactgtccgttccaattcagtagagcagttttattttccaagacctggccaatctttgccaggcattccaccattctttgggcctccttcctccagtttgtatcttcctaatgacaatgaagctaaagttggcaaccaatttgaaccaaatctttcacagagtacagattgggacccgcaagctatagtaagcaacctaactttccttgagcagaagatcaagcaggtaaaagatgttgtgctgtccatgagcagccgagagaaccaagtagctggcggttcctgtgagctagcagcaaagcagcagctcataactgctgatctcactaacattataatccagcttatcacaactgctggttcgctgctcccttcaatgaagaacccacttagcagcaatccagcagtaaggcagctcagcaacactcttggttctcctatgggctttggcatgaatgctaatcagcgaccaagtgtagacagcaagaacgatattcctgacattggaaaggcctctggttacgaggaactgatcaatagccttaatactacccaagatgaaagagatgatctgatcaaatgtccaaatccttgtggtggggaagggtctgaaccgactccgatggaagaccatgatgtaaaggagagtgatgatggtgaacatgagggagagaatctaccccctggttcttatgtagtattgcaattggaaaaggaggagattttagcaccacatactcatttctgcttgatctgcgggaagggcttcaagagagatgcgaacctaaggatgcacatgaggggccatggagacgagtacaagactgccgcagctcttgccaagcccacgaaggattctggttcagatcatgcaccagttacaaggtactcatgcccatttgtgggttgcaagcggaacaaagagcacaagaagttccaacctctcaagacaatcttgtgtgtgaagaatcactacaagcgaagccattgtgacaagagctacacctgcagccgttgcaacactaaaaagttttctgtgattgctgacttgaagactcatgagaagcattgtggtcgtgacaagtggctctgttcttgcggaacaaccttctctaggaaggacaagctttttgggcatgttgcacttttccagggccacacacctgcgctccccatggatgacatcaaggtatcagaagcatcagagcaacagcaggacagcgagcctatgaatgaaatttcgaggagcatggggtgcttcccttgcagctcgtctgatggcatttcaaaccttgacatgaaaatgactgatgatgcacgcggctattactcgcatctgagctttgatccttgctttggcgcactggatgactttactcgccctggattcgacatctctgaggatcccttctcctttctgccttcgggatgcagttatgtacagcagaatggagacaactgatggaggtcaccgttgataatgacgacaagggcactggcagcctttatgtatggcgtatgcatgatgctagtctggttcttgctatattcaagagtcattttaggttatgcattcttttttcttaagtgtacttcatttggtggtcatcaataatgaacacttttagcaaaaaaaaaaaaaaaaaaaa

SEQ ID NO: 4838 - protein, 517 aa, Panicum virgatum
  misc_feature: Ceres CLONE 1811269
  misc_feature (1)..(23): Pfam Name: zf-C2H2 Pfam Description: Zinc finger, C2H2 type
  misc_feature: The sequence is a functional homolog of  SEQ ID NO 552 in the  10/666,642 US patent application
  misc_feature: Useful for making plants with modulated growth and phenotype characteristics
MEGGMSSLETAMKASSSVASGTARNADPDIQTVRSNSVEQFYFPRPGQSLPGIPPFFGPPSSSLYLPNDNEAKVGNQFEPNLSQSTDWDPQAIVSNLTFLEQKIKQVKDVVLSMSSRENQVAGGSCELAAKQQLITADLTNIIIQLITTAGSLLPSMKNPLSSNPAVRQLSNTLGSPMGFGMNANQRPSVDSKNDIPDIGKASGYEELINSLNTTQDERDDLIKCPNPCGGEGSEPTPMEDHDVKESDDGEHEGENLPPGSYVVLQLEKEEILAPHTHFCLICGKGFKRDANLRMHMRGHGDEYKTAAALAKPTKDSGSDHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMDDIKVSEASEQQQDSEPMNEISRSMGCFPCSSSDGISNLDMKMTDDARGYYSHLSFDPCFGALDDFTRPGFDISEDPFSFLPSGCSYVQQNGDN

SEQ ID NO: 4839 - DNA, 1353 bp, Panicum virgatum
  misc_feature: Ceres CLONE 1811290
  misc_feature: Encodes the peptide sequence at SEQ ID NO. 4840
accaaggcaccattctcctccatcagtgctccgttcttgaagccaataacagtgatcagttggtagtattccttccttcagctttctcgtccggcgcctcccaccgtccctcagcccgcatcactctcccacccccacccgtcgcaatggcatccgcggccgccatctccacgctgctgaggcctccccgcgtccaccccgcccgcgtcgcctccgcctttccactcccgatgcacgcgctccccttcctccctcgccgcccccgctccctgaccacggtccgcgccgtccaaacgcagcagggcgccgccgccgcccgaagcagtggcgccacccagcgctcctggaccagcgcgcccgtcgccgccgtcggcgccgccaccgaggacgagtccatcttcctcgtcaccgtcgacctctccggtgccccggccctggtggacgcgtacacgaccccggggcagtacctcatggcccgcgtcccctcgcagaagctctcgccggcgtacatgtgcatctcctcggcgcctcgctcggggctccagttcgacctgctcgtcaagcccgtgccggggaccacctcggagcagctgtgcaagctcggcgtcggggatgctgtggagctcgggcccgtcatggggcggggcttcgccatccagcacataaatccgccggcggccgcggagaccatgttcctgttcgctgtcgggatggggatcagtccgattcgtgcacttatcgagtttggttttgctgcctctgaaagaaaagatgtgagactttattatgctgccaaagatctgcaatctattccataccaggagcgtttcaacagttgggagcaaactggagttaaagtagtacagctcacacaacaatttcagcaatctttcttggaacagaacctgggtgagaaaacagtaaatccactttctactggagctgtaattgtggcaccgtcttcatcgcaagaggtaatcaccggagtccttttagactttggcgtgccacatgaaaaaatcttaacgatcgagtggtctcctgaggatccttttgcctccaaagtctaggccttattcagaggaacttatattacgggctccgacaataatggatgcttttcagcggagtgatgatgagaataaggaacattgcttgaataatgcttgtcgcactagttattagtgcaaatggcggagcgtgtttgtagtgcttgacgcatgcacgttcatgcggagcgcgtctgagtccttagctgagtgcgcagtgtgtttgttggacgtgggatggcacggccggtgaacaaataaaatggtcaacttaatttgatttcaaaaaaaaaaaaaaaaaaaa

SEQ ID NO: 4840 - protein, 307 aa, Panicum virgatum
  misc_feature: Ceres CLONE 1811290
  misc_feature (2)..(102): Pfam Name: FAD_binding_6 Pfam Description: Oxidoreductase FAD-binding domain
  misc_feature (2)..(62): Pfam Name: NAD_binding_1 Pfam Description: Oxidoreductase NAD-binding domain
MASAAAISTLLRPPRVHPARVASAFPLPMHALPFLPRRPRSLTTVRAVQTQQGAAAARSSGATQRSWTSAPVAAVGAATEDESIFLVTVDLSGAPALVDAYTTPGQYLMARVPSQKLSPAYMCISSAPRSGLQFDLLVKPVPGTTSEQLCKLGVGDAVELGPVMGRGFAIQHINPPAAAETMFLFAVGMGISPIRALIEFGFAASERKDVRLYYAAKDLQSIPYQERFNSWEQTGVKVVQLTQQFQQSFLEQNLGEKTVNPLSTGAVIVAPSSSQEVITGVLLDFGVPHEKILTIEWSPEDPFASKV

SEQ ID NO: 4841 - DNA, 1332 bp, Panicum virgatum
  misc_feature: Ceres CLONE 1811354
  misc_feature: Encodes the peptide sequence at SEQ ID NO. 4842
aatctccacttaaccccatcgccgcccgaagccgttcgccactcgccgccaatggccatggccttccacacccttgccgcctcgcgcgtccgcgtcggccccctcctccccgccgccgccgcggcgcccatgtcctcctccgtcgcggcgcaccgctaccaccaccggcgccgcttctccgccatcgtggccgcggcgcccgcggcggcgcccgccgcggcgccggcggagttcgacttcgactcctacatgacggaacgctcggagacggtcaaccgcgccctggacgcggcaatccccgagggggagccccccgcggcgctgcacgaggcgatgcggtactcgctgctggcgggcggcaagcgggtgcgccccgcgctgtgcctcgccgcgtgcggcgtcgtgggcgggcgggaggagtgggcgctggcccccgccgccgcggtcgagatggtgcacaccatgtcgctcgtccacgacgacctgccctgcatggacgacgacgacctccgccgcggcaagcccacctgccacatcgtctacggcgaggccatcgcggtcctcaccggggacgcgctgctctcgcaagccttccaccacgtagccaacgccggctcctacccgccggacgtcgactcggagaagcaccccgcccgcgtcgtccgcgccactttcgagctcgcgcgctgcatcggctcagagggcctcgtcgccggccaggttgtggatcttgccatgactggcgcatctgaagttgtgccccttgaacgcctggagtacatccacctccacaagactgctgcattgcttgaggcctcagtggtcatgggggcaatcatcggcgggggcacggatgagcaaattgagcggctgcggaagtacgcgaggtcaataggtcttctgttccaggtggtcgacgacatacttgacgtgaccaaatcgtcggaggaattagggaagacagcagggaaggatttggcaagcgacaagactacatacccgaagttgttggggctagagaagtcacgggagtttgcagaaaagttgctttctgatgcaaaggagcagcttgctggttttgacaaagaaaaggcagcacctctgttgcatttggcctactatatcgcccacaggcagaactgaggtgatgcttactctgttgttgttcttgttgatctgtaactttgtaagctcattgtacttgggtttcagaaatatccgaatcatcatgtgatgtatactagctgtagctttctaccttgctgtaagaaggctattcagttgaaaatatgaatatcaaatcaaattagtaaaaaaaaaaaaaaaaaaaaa

SEQ ID NO: 4842 - protein, 363 aa, Panicum virgatum
  misc_feature: Ceres CLONE 1811354
  misc_feature (1)..(269): Pfam Name: polyprenyl_synt Pfam Description: Polyprenyl synthetase
  misc_feature (58)..(363): SWISSPROT Homolog: GGPP synthetase 1 Geranylgeranyl pyrophosphate synthetase 1, chloroplast precursor
  misc_feature (58)..(363): SWISSPROT Homolog: GGPP synthetase Geranylgeranyl pyrophosphate synthetase, chloroplast precursor
MAMAFHTLAASRVRVGPLLPAAAAAPMSSSVAAHRYHHRRRFSAIVAAAPAAAPAAAPAEFDFDSYMTERSETVNRALDAAIPEGEPPAALHEAMRYSLLAGGKRVRPALCLAACGVVGGREEWALAPAAAVEMVHTMSLVHDDLPCMDDDDLRRGKPTCHIVYGEAIAVLTGDALLSQAFHHVANAGSYPPDVDSEKHPARVVRATFELARCIGSEGLVAGQVVDLAMTGASEVVPLERLEYIHLHKTAALLEASVVMGAIIGGGTDEQIERLRKYARSIGLLFQVVDDILDVTKSSEELGKTAGKDLASDKTTYPKLLGLEKSREFAEKLLSDAKEQLAGFDKEKAAPLLHLAYYIAHRQN

SEQ ID NO: 4843 - DNA, 2521 bp, Panicum virgatum
  misc_feature: Ceres CLONE 1811359
  misc_feature: Encodes the peptide sequence at SEQ ID NO. 4844
actgccacgtcagcaatacctcccccttgcccagtttccaccaccacacggccagccgccgccccggctccctccctcccttatgctagtttgcctccggcgaggcctctcgctcgtcaggcagcacacaccccggcggccccgcttccttccctcgccgcctctccatcccgcccgccgcttcctgcaccacctctccgccgcccacgggatgggtgagggctccgctgccggaaaggacgccaaggggaaggccaaggccaaggccaaggcccccgccgcggcttcggccccggtcgtcgcgcgcgatgactcctacctggaggccgtcacacacaagagggtccgcatgttcgaggagatccaggctaggcaggccgtcgaccggctcaacatcggcggcgaggtcatcaaagtaactctacctgatggcgctatcaaggaagggaagaagtggataacaaccccaatggatatcgctaaggagatatcaagcggattggcagctagctgtttgatagctcaagtggacgaaacactctgggatatggggaggccgctggaaggtgactgtaaattgcagttgttcaagtttgatagcaatgaagggcgtgacaccttctggcactcaagtgctcatattcttggagagtctattgagagagcatatggctgcaagctgtgtattgggccttgcaccacaagaggggagggtttctactacgatgcttactacaatgatctgacattgaatgaggagcactttggtatcatagaaagccaagctcaaaaggctgttgcggaaaaacagccatttgaacgcattgaggtcagcagagcagaggctcttgaaatgttcgctgaaaataaattcaaggtcgaaatcattaatgagttgcccgaagacaagaccattacagtatataggtgtggtcctttagttgacctatgccgtgggccgcacatcccgaatacttcctttgtcaaagctttcgcttgtctgaaggcttcatcatcatattggagaggaaaagcagaccgcgaaagcctgcagagagtatatggaatttctttccctgattctaaacgtctcaaggaatataaacattttttagaggaggctaaaaaacgtgatcataggttactaggacaggcacaggaactcttctttttccatccgcttagccctggaagctgcttcttccttccacatggtgctaggatatataataaactgatggactttttgcgacagcaatacagagatagaggataccaagaggtgttgagcccaaatatttacaatatgcaactttgggaaacttctggacatgcggcaaactacaaggagaacatgttcgttttcgagattgagaagcaggaatttggactgaagccgatgaattgccctggccactgtctaatgtttgataatagagttcgttcatacagagagttgcctcttcgcatggctgattttggagttcttcatagaaacgagcttagtggtgcacttacaggtttgacacgtgttaggagattccagcaggacgatgctcatatcttttgcagagagaaccaaatcaaggatgaagttaagggtgttttggagttcatcaatcatgtttacgagatatttggcttcaaatacgagttggagttgtctacgagaccagagaagtatttgggtgatattgaaacctggaacaaggcagagcaacaattgacagaggccttgaatgaatttgggaagccgtggcagattaatgaaggagatggtgctttctacggtccaaaaattgatattggtgtgtttgatgccctcaagaggaaatttcaatgtgcaaccctacagctggattttcagcacccccttcgcttcaagctgacttactctgccgaggatgaagccaaacttgaaagacctgtgatgatacacagagcaatcttaggatccgttgaaaggatgtttgccattcttttggagcattacaacggtaaatggcccttgtggctaagccctcgccaggtcattgtttgctcagtatcttctggttcagcggagtatggaaaacaggtccttgccaggctacatgaaactggttttcatgttgacattgacattagtgacagaacaatccaaaagaaggtacgggaagcccaagtagcccaattcaactacattcttgttgtaggtgcacaagaggcagagactggaaatgtatgtgttagggtaagagacagtgccaacctatccacaatgagcgttgatggcatcatcacacgtttaagggaggaaatagcagctttcaaatgagaatgatgctccatgaattttttccccctcagtcattgactccatttgtgattttggcggagtttggaatgatgaacacacctaattattggtgttacaatccttgtttctgtggtcaaaatgctaaaaacggatgtcttgagttagttacagatgtgcaagttaagtaccatgattttatgccaaaaaaaaaaaaaaaaaaaa

SEQ ID NO: 4844 - protein, 744 aa, Panicum virgatum
  misc_feature: Ceres CLONE 1811359
  misc_feature (45)..(738): SWISSPROT Homolog: EC 6.1.1.3 Threonyl-tRNA synthetase, cytoplasmic
  misc_feature (67)..(743): SWISSPROT Homolog: EC 6.1.1.3 Threonyl-tRNA synthetase, mitochondrial precursor
MLVCLRRGLSLVRQHTPRRPRFLPSPPLHPARRFLHHLSAAHGMGEGSAAGKDAKGKAKAKAKAPAAASAPVVARDDSYLEAVTHKRVRMFEEIQARQAVDRLNIGGEVIKVTLPDGAIKEGKKWITTPMDIAKEISSGLAASCLIAQVDETLWDMGRPLEGDCKLQLFKFDSNEGRDTFWHSSAHILGESIERAYGCKLCIGPCTTRGEGFYYDAYYNDLTLNEEHFGIIESQAQKAVAEKQPFERIEVSRAEALEMFAENKFKVEIINELPEDKTITVYRCGPLVDLCRGPHIPNTSFVKAFACLKASSSYWRGKADRESLQRVYGISFPDSKRLKEYKHFLEEAKKRDHRLLGQAQELFFFHPLSPGSCFFLPHGARIYNKLMDFLRQQYRDRGYQEVLSPNIYNMQLWETSGHAANYKENMFVFEIEKQEFGLKPMNCPGHCLMFDNRVRSYRELPLRMADFGVLHRNELSGALTGLTRVRRFQQDDAHIFCRENQIKDEVKGVLEFINHVYEIFGFKYELELSTRPEKYLGDIETWNKAEQQLTEALNEFGKPWQINEGDGAFYGPKIDIGVFDALKRKFQCATLQLDFQHPLRFKLTYSAEDEAKLERPVMIHRAILGSVERMFAILLEHYNGKWPLWLSPRQVIVCSVSSGSAEYGKQVLARLHETGFHVDIDISDRTIQKKVREAQVAQFNYILVVGAQEAETGNVCVRVRDSANLSTMSVDGIITRLREEIAAFK

SEQ ID NO: 4845 - DNA, 1206 bp, Panicum virgatum
  misc_feature: Ceres CLONE 1811384
  misc_feature: Encodes the peptide sequence at SEQ ID NO. 4846
agtgattccacccatcgtctcctttaccactcttgcagtctcgctcgcggataagacgaggcgctaccaaaccaaagcccccctccgctcaaaaaccccactcgagctcctacccccatccatggcgaccgccaccgccaccgccgcctcttcctcctcgctgaccgcgcctctcctccgcccgaaccccagcaccaaccccgcccccagatccctgcctctcctcaggaacaggaggtgcatttgcgccgtgaccgccgccgtctccgggggcgtgggggcggacggggctgcccagcggtgcgggatttggtcgatcagggatgatttgatggtgccgaggtcgccctacttcccggtggagtacgcggcggggcaggaacgtgggccgtcgcccatggtgatggagcggttccagagcgtcgtcagccagcttttccagcatagaattatccggtgcggtggccctgtggaggatgatatggctaacatcattgttgcacagctgctctatcttgacgccatcgaccccactaaggatatcattatgtatgtgaattcaccaggagggtcagtgacagctggaatggctatatttgatacaatgaagcatatcaggcctgatgtttccactgtttgtatcggattagctgcaagtatgggagcttttctacttagcgctgggactaaaggaaagcgatacagcttacctaactcaagaataatgatccatcaacctcttggaggagcccaaggacaagagactgatcttgagatccaggctaatgagatgctgcaccacaaggctaacttaaatggatacctggcataccacactggacagcccctggataagatcaacgtagacactgaccgtgattactttatgagtgcgaaagaagccaaggagtatggcctcattgatggagtaattatgaatcccctcaaggcccttcaaccccttccagcttccagctagtcgttaagtgctagatctctgtcaaacacttctgttgtatccgttagaattaaggtttccactgcgctgtttctattagtctggctagattatgttgcaaagtttgcatcccgaggattcaaaggttgtattgtataaaacaagatctacagtcggatgtccatcttttgtaatagctattgcaattgaattaacagtagcagtactaaaaaaaaaaaaaaaaaaaa

SEQ ID NO: 4846 - protein, 285 aa, Panicum virgatum
  misc_feature: Ceres CLONE 1811384
  misc_feature (1)..(182): Pfam Name: CLP_protease Pfam Description: Clp protease
  misc_feature (96)..(271): SWISSPROT Homolog: EC 3.4.21.92 ATP-dependent Clp protease proteolytic subunit 1
MATATATAASSSSLTAPLLRPNPSTNPAPRSLPLLRNRRCICAVTAAVSGGVGADGAAQRCGIWSIRDDLMVPRSPYFPVEYAAGQERGPSPMVMERFQSVVSQLFQHRIIRCGGPVEDDMANIIVAQLLYLDAIDPTKDIIMYVNSPGGSVTAGMAIFDTMKHIRPDVSTVCIGLAASMGAFLLSAGTKGKRYSLPNSRIMIHQPLGGAQGQETDLEIQANEMLHHKANLNGYLAYHTGQPLDKINVDTDRDYFMSAKEAKEYGLIDGVIMNPLKALQPLPASS

SEQ ID NO: 4847 - DNA, 1106 bp, Panicum virgatum
  misc_feature: Ceres CLONE 1811408
  misc_feature: Encodes the peptide sequence at SEQ ID NO. 4848
aaaaagaaaaaaatcatcccgctccagcatccagacttgtgagatccttcgatcacggcggccatggcgaacaccgcccgtctccccgcctcctcgtgcagtctgggcaccggcagcagcaccaccaccaggagcaggtgggcaaccatggccgccgttggatgcgctcccggcggcagcaacacccgccggaggagtgtgggccttttcctttgccgctcctcctccacggccggagctcaagggggcaggaggatggaggattacaataccgccatgaagcggatgatgcgcaacccctacgagtaccaccacgatcttggtatgaattatgctgtcatcagtgatagcctaattgttgggtcacaacctcaaactcctggagatatcgatcatttgaaaaatgaagagaatgttgcctacattctttgtttgcagcaggacaaggacatcgaatactggggcattgatttcccagctattctcagcaggtgcaaagaacttggcattcagcatatcagaagaccggcagttgactttgacccagattccttgaggtcacaattgccaaaggcagtttccgcattagaatgggctatatcgcagtgcaaagggcgggtttatgtccattgcactgctggacttgggagggctccggcagtcgcaattgcatacatgttttggttcgaggatatggatcttaacacagcctacaaaaagctgacctccataaggccctgtggacccaataagagagctattcgtgctgccacctatgatctagctaagaaggatgatccatggaaagagccttttgagaatctaccagagaatgctttcgagggcattgcggactgggagaagaagataattcatgatcggatacgtgctcttcgtgaagcatgagttgaaaaaggaaaccttgacaatgtcctctttcaggtgtgtgtttgcacatgctgcattacaatctatgtaactttcctacactgatgcccccttctcagggtaggaaaatagtgtacgcgtatgatgagaggtgtgatgcaggtgctatcgaaataaatcatatgcacggtcttattcatcaaaaaaaaaaaaaaaaa

SEQ ID NO: 4848 - protein, 280 aa, Panicum virgatum
  misc_feature: Ceres CLONE 1811408
  misc_feature (1)..(146): Pfam Name: DSPc Pfam Description: Dual specificity phosphatase, catalytic domain
MANTARLPASSCSLGTGSSTTTRSRWATMAAVGCAPGGSNTRRRSVGLFLCRSSSTAGAQGGRRMEDYNTAMKRMMRNPYEYHHDLGMNYAVISDSLIVGSQPQTPGDIDHLKNEENVAYILCLQQDKDIEYWGIDFPAILSRCKELGIQHIRRPAVDFDPDSLRSQLPKAVSALEWAISQCKGRVYVHCTAGLGRAPAVAIAYMFWFEDMDLNTAYKKLTSIRPCGPNKRAIRAATYDLAKKDDPWKEPFENLPENAFEGIADWEKKIIHDRIRALREA

SEQ ID NO: 4849 - DNA, 1552 bp, Panicum virgatum
  misc_feature: Ceres CLONE 1811419
  misc_feature: Encodes the peptide sequence at SEQ ID NO. 4850
gatcaagcaagcaccgcatcgccccgtatgcttcgtcgcgcgggcacgcgtgtcgtcgtcggcggcggcggcggcggccggcgaggaggagccctcatggcctccctcatccacttcctcccttcctccgcctactcctcctcccatctcccgccccagccccagccgcggccaactcccgcccccgcccccgccgcggcgcggccgtcccggctccgcctcccgttcgcgcgcgccgccgcgcggcgcgaccccgagcctctgccgttcccggcggaggcgcctccggatcccgcggtcgaggagcggaggtcgctggaggtgaggacgggggagctgttcctggggctggcggcgctgctgctgcgcgggaccggggccgttcgcgggggcggcggggcggcggcggtggaggaggtggaggcgagggacggggtggtgtgggagcagcggcccgaggacgtggaggccgagcggcggcggcgggagctcaccagccccgggttcagcttctccgcggctgggctgctcttcccctaccacctcggcgtcgcgcagtgcctcatggacaaaggatacatcactgagagaactccgttagctggctcatcagctggtgccataatctgtgcagtgattgcatctagaaacacaatgcaagatgctttgcaggtgactaaagatctagctgacaactgccggagtaaggggactgcatttcgtcttggggctgtgctcagggatgtccttgacaagtttctaccagatgatttgcacatcagatgcaatggaaggattcgtgttgctattactcagctatcctggaggcctaggggcttactagttgaccaatttgactccaaagaagatgtcattaatgctgtcattacatcctcttttattcctggatacctagctcccaggccggcaacatacttccgtaaccgcctatgcattgatgggggccttacattgtttatgccacccacttctgcttccgaaacagtccgaatatgtgctttcccagccaacagactgggtttgcaaggtattgggattagtccagactgcaatccggagaacagggctagcccaagacagctgtttaactgggctctggaaccggcggaagatgaaattctcgacaagttatacgagcttgggtacatggacgcagctgtatgggtcgagcagaagtctaccgagttgaatgcgaagaatgatcaacctctcgccgttgaatgaattgaacccctttggtctgctcaaaactgctgggttcatgttcatgggagttctatacttgtaatgtatcataaagattagattttttttaggagaagtacatgaaaagatgtcagggacttgccatcagtgttaggcatgacaacaatgctggaggcaagttgatattagggtttacaggctgatcggcattttcaaatgtatatattagacaacgaggtttgacctgagagctcgttttgtaatggtacaggggagtaatgtttgcaccttgcggactggcaactcctataaaaacaactttcac

SEQ ID NO: 4850 - protein, 405 aa, Panicum virgatum
  misc_feature: Ceres CLONE 1811419
  misc_feature (1)..(165): Pfam Name: Patatin Pfam Description: Patatin-like phospholipase
MLRRAGTRVVVGGGGGGRRGGALMASLIHFLPSSAYSSSHLPPQPQPRPTPAPAPAAARPSRLRLPFARAAARRDPEPLPFPAEAPPDPAVEERRSLEVRTGELFLGLAALLLRGTGAVRGGGGAAAVEEVEARDGVVWEQRPEDVEAERRRRELTSPGFSFSAAGLLFPYHLGVAQCLMDKGYITERTPLAGSSAGAIICAVIASRNTMQDALQVTKDLADNCRSKGTAFRLGAVLRDVLDKFLPDDLHIRCNGRIRVAITQLSWRPRGLLVDQFDSKEDVINAVITSSFIPGYLAPRPATYFRNRLCIDGGLTLFMPPTSASETVRICAFPANRLGLQGIGISPDCNPENRASPRQLFNWALEPAEDEILDKLYELGYMDAAVWVEQKSTELNAKNDQPLAVE

SEQ ID NO: 4851 - DNA, 1055 bp, Panicum virgatum
  misc_feature: Ceres CLONE 1811442
  misc_feature: Encodes the peptide sequence at SEQ ID NO. 4852
accaaaccccccacccgcgccatcccagcgatctcactcgccaacgaagcagcacaaacttggcctgtcgacacgccgaggccgcgcactccgaggagtagcgagaagagctcacgcgctctgttgtcccggagcagccagcggccatgtcgacgactacgatgatgacgacgacgacgacgacgacggtaaaggcgagcgacccgggctccgcgtggttcggcagcggcgcccggaccccgccggcggggatgggggcccacaacgtgcggctcatcaccacggccgtcgcggcgttcgtgtccgtgctcggcctcgccctcttcctgcacctctacgtctgccacgtccgccgccggaaccggcgccgcgcggcggccgtgctgccgacgacggcgccggccgcggccccaaagggcgggctggaccccgcggccatcgcggcgctgccgaccgccgtgtacggggaggcgggcgagccgggcgcctgcaccgagtgcgccatctgcctcggcgccgtgcaggaaggggaggtcgtgagggcgctgcccgcctgcgcccacgtgttccacgtcccctgcatcgacacgtggctcgcatcgagctcctcgtgcccggtctgccgcgccgaggtggagccgccgctggaggaggagggcgcggctcggttggtgcaggagaagctgcaggacgccgtgaaggaggaggcgggcagctgcagctcgacgccggagcgggggatcagcgcctgcgcgtcgctgatgaagatgctgagcagggagaggccggcgccgcggaggccgcagagcgccgtccatgccgacgccggggagctggacgacttggaacgtcagctgcaggctgtgaataattaatcttttaaaaaaaaagactttttaatctggtataattttcctcatcatttgtacatcccgccgcacttgcgtgagtggacaagtactaagagaggtgtgtgagctccttattttttttaatgaatgtaagggctcatttggaaagaagtggcatgcttccaaaaaaaaaaaaaaaaaaaa

SEQ ID NO: 4852 - protein, 242 aa, Panicum virgatum
  misc_feature: Ceres CLONE 1811442
  misc_feature (1)..(42): Pfam Name: zf-C3HC4 Pfam Description: Zinc finger, C3HC4 type (RING finger)
MSTTTMMTTTTTTTVKASDPGSAWFGSGARTPPAGMGAHNVRLITTAVAAFVSVLGLALFLHLYVCHVRRRNRRRAAAVLPTTAPAAAPKGGLDPAAIAALPTAVYGEAGEPGACTECAICLGAVQEGEVVRALPACAHVFHVPCIDTWLASSSSCPVCRAEVEPPLEEEGAARLVQEKLQDAVKEEAGSCSSTPERGISACASLMKMLSRERPAPRRPQSAVHADAGELDDLERQLQAVNN

SEQ ID NO: 4853 - DNA, 1513 bp, Panicum virgatum
  misc_feature: Ceres CLONE 1811500
  misc_feature: Encodes the peptide sequence at SEQ ID NO. 4854
aaatgcccaaaccctactactacccctgaccgacgagtcgatcctcttcccctgacggcagccgggcactcgtgcggtcctccctccctccgccgccaccagagtccttctgtcgtaggtgtcctcatccgctcgactgctccgcaggatttgctgtcggagtggggatccctccatacttcgattgacttttctcggtaagaaggctcgaccttgcctggtcggattggtccaagagtgccctaaattactacgcatcacagatggctgctgggagggtcatgggcatcagccagctcttgaagaaagcatttcgcctccatccatctggtccatttctgccttcttcaccccggataaatcatgaagagtctgttggattcattggactgagagcattgtctattcttggggttgatgcttctggtcttttaagcttcgctaccatagcatctgcagatgaagcagagcacggattggaagccccaagctatccctggccacatgctggcattcttagctcttatgatcatgcatcaataaggcgtggacatcaagtttatcaacaagtgtgtgcctcctgtcactcgatgtccttgatttcataccgggatctggttggtgttgcctatacggaagaggaaacaaaggcaatggctgctgagattgaggtggtcgatggtcctaatgatgaaggcgaaatgttcacacgtccgggtaagctaagtgaccattttccacaaccatatgcaaatgagcaagcagctcgatatgcaaatggtggggcataccccccagacctcagtctaatcacaaaggccagacacaatggccagaactacgtttttgctctgctcactggttatcgtgatccacctgctggtgtttcgattcgtgaaggcttgcattacaatccctactttcctggtggcgccatcgcgatgcccaagatgctgatggatggagctgtcgagtatgaagatggaactcctgcaacagaggcccagatgggcaaagatgttgtctcattcttgtcatgggccgcggaacctgagatggaagagagaaagctgatgggagtcaaatggattttcctgctctcgctcgctcttctgcaagctgcatattaccggcgcatgaagtggtccatcttcaagtctcgcaagctggtccttgatgtggttaactgaggcccaatgcctcatttcttcaaccatccagtcgataatttgaagtgtatggaataatccgtatatgatatacatgctgcaactggcatggtacccatgcctgagaaatgtagatctcttggttaccattaccctcagctgtggaggtgctgttttcggattttgcctggtaccagcgaagcatataatagaatgtatgtatacatactacatagccgatatttttgtgcatttcaactcctgtgatgttcagtgttcactggggaaataaattgtttatgctatacaacttcgtttgctatcaaaaaaaaaaaaaaaaaaaa

SEQ ID NO: 4854 - protein, 308 aa, Panicum virgatum
  misc_feature: Ceres CLONE 1811500
  misc_feature: Great-hit functional homolog of the protein sequence given in SEQ ID NO 9571
  misc_feature: Useful for biocontainment applications
  misc_feature: Useful for making plants with modulated biomass
  misc_feature: The plant is abnormally small.
  misc_feature: The plant produces a reduced number of seeds.
MAAGRVMGISQLLKKAFRLHPSGPFLPSSPRINHEESVGFIGLRALSILGVDASGLLSFATIASADEAEHGLEAPSYPWPHAGILSSYDHASIRRGHQVYQQVCASCHSMSLISYRDLVGVAYTEEETKAMAAEIEVVDGPNDEGEMFTRPGKLSDHFPQPYANEQAARYANGGAYPPDLSLITKARHNGQNYVFALLTGYRDPPAGVSIREGLHYNPYFPGGAIAMPKMLMDGAVEYEDGTPATEAQMGKDVVSFLSWAAEPEMEERKLMGVKWIFLLSLALLQAAYYRRMKWSIFKSRKLVLDVVN

SEQ ID NO: 4855 - DNA, 1118 bp, Panicum virgatum
  misc_feature: Ceres CLONE 1811516
  misc_feature: Encodes the peptide sequence at SEQ ID NO. 4856
atgcattaggagcgcaccgcaccgctccgcaccatttgcaggctgatcagtgagcgctcatgggtggctgggtgggtgggtgggctcaacaatcgctatcagtagcggatcagcccatgtgacgccacggcccaccgccgacgcccctccagagccgtgtcccggttcgcgagctccctccctccggccggcggcggcttgcccaccccgccgcgcggcagcccacccaatccacagccacccacctggccgctccacgccgcgctgcacacatcacccgtgccgtctcgcctcgcctcgcctcgcctgccccagtccacctgcccccgtccacttcctcgagtacctcgtgaccagcgcggcgggccggcgggagggaccgtgggggcatggaggagagcggcgcgagggcggcggtggtgcggcgcctgatggcggcgaaggccgagtccgggaagagcttctcggacgtggcggccgagacggggctcaccaacgtctacgtcgcgcagctgctgcggcgccaggcgcagctccagccggacacggcgcccaagctcagggcggcgctgcccgcgctcaccgacgagctcatcggcctcatgatgcagccgccgttccggtcctaccaccccgacatcgtccaggagcccgccatatacagattgaatgaagctgtcatgcattttggagagagcatcaaggaaatcatcaatgaggaatttggtgatggaatcatgtcggccatagatttctactgttcagttgacaaggttcaaggtgctgacggcaaagatcgtgtggtggtcacatttgacgggaagtatctgccttacactgaacagaaatctgaacatatgatgtcaaggccggcccgcaacacatcttgagacggttggtgacagcgagaaagattcttttacgacatggagctaccatgcagcaatttgggtttggaaagggtcgagcttgccttttttttcccctccaaataatcaacgaaaacaaacagccctgaactgataaagcctggttttacccttgttagctttacaggtacgccaataataaagaataaacatatggttgttggactgcaaaaaaaaaaaaaaaaaaaa

SEQ ID NO: 4856 - protein, 166 aa, Panicum virgatum
  misc_feature: Ceres CLONE 1811516
  misc_feature (1)..(74): Pfam Name: Cyanate_lyase Pfam Description: Cyanate lyase C-terminal domain
  misc_feature (5)..(166): SWISSPROT Homolog: EC 4.2.1.104 Cyanate hydratase
MEESGARAAVVRRLMAAKAESGKSFSDVAAETGLTNVYVAQLLRRQAQLQPDTAPKLRAALPALTDELIGLMMQPPFRSYHPDIVQEPAIYRLNEAVMHFGESIKEIINEEFGDGIMSAIDFYCSVDKVQGADGKDRVVVTFDGKYLPYTEQKSEHMMSRPARNTS

SEQ ID NO: 4857 - DNA, 1835 bp, Panicum virgatum
  misc_feature: Ceres CLONE 1811543
  misc_feature: Encodes the peptide sequence at SEQ ID NO. 4858
aagaagaagcaagcggctgccgtagccgccaagctgagaccatgactccctagtctttatagactgctcgatcgctgcagctaagatcagcaaagatcattaggccagttcctgcacgagctcaatcaagctccaggccaatggagaccccagctccccctccccctccgcagcagatgcacttcctgttcgtgaccagcccgctgcagggccacatcaacccggtgcgccgcctggccgcccgcgtgatggcggccaatccggacgcgcgcgtcaccttctccaccgccgtctccgggcaccgccgcatgttcccctccctggcgcgccccgacgacgaggccgtggacgccgcgggcgtgctgcacgtccccttctccgacggcttcgacgacgggttcagctccgcggcgcccggcgcgggcgccgcctacagggcccgcgccgccgcggccgggcgcgcgacgctgtccgccgccgtgtcgcgcctcgccgcgcgggggacgcccgtgacgcgcgtggtgtacacgttcctcgtgccgtgggcgcccgacgtcgcgcgcgcgcacggcgtccccgcggcgctcttctggatccagccggccgccgtgctcgccgtgtactaccattacttccacggccacgccacggccctcgccgcgtgcgcgaacggcgcgggcgccgcggccacgagcctgccggggttgccgccgctcgaggccggcgcgctcccgtcggccgtggccatcacctcgccggagcacaagcactacctgctgctcgacctgctgcgcgacctcttcctgtccctcgacgagcacaagcccatggtgctcgtcaacacgttcgatgccctggagtccgacgcgctccgggcggtgccgcagttcgaggtcgccgccgtcgggcccgtggtgccggacgacgcgtcctcctcgccgtcaagcgcgctggacctgctgcatccccaggacgccaaggtcccgtacatggagtggctggacgcgaagccggcgcggtccgtggtgtacgtgtcgttcgggagcgtcctctcgatgagccggcggcaggaggaggagatgcggcggggcctggaggccaccagccggccgtacctgtgggtggcgcgcacggccgccgacggcggcgcgagctcggacggggacccggacccggacagcggcagcgcgcgggggctggtggtggcgtggtgcgaccaggtgcgcgtgctggcgcacccggcggtggggtgcttcgtgacgcactgcgggtggaactcggcgctggagagcgtgacccgcggcgtgccaatggtggccgcgccgcaatggacggaccagcccacggtggcgtggatggtggaggcgcgcgcgggcgccggcgtgcgcgccggcgcggacggcgagggcgtggtcgagcgaggcgagctgcggcggtgcgtggaggaggtcatgggcggcggcggcgaggccatccgggcgcggtgcgatcggtggagggagctggcgcgcgaggccgtggcccccggcgggacgtcggagaggaatctgcgagcgttcgcgtcgggtgcggctgtggacggcgcctgacccacgaggtgatgagcccaccggcggcatcgtgattgctgtgactgattgtgtacctgtcatcggacgtgcgatgacccttcactgctgtctgctggtgcagaagccagcagggactgaatttaaggccgatgtttgtttcccacgactttttcaaggctgtcatattaaaaagaatcttattatttagctgtatcaaaaaaatttgcttataaattttttttacaaaaaaaaaaaaaaaaaaaa

SEQ ID NO: 4858 - protein, 482 aa, Panicum virgatum
  misc_feature: Ceres CLONE 1811543
  misc_feature (1)..(141): Pfam Name: UDPGT Pfam Description: UDP-glucoronosyl and UDP-glucosyl transferase
METPAPPPPPQQMHFLFVTSPLQGHINPVRRLAARVMAANPDARVTFSTAVSGHRRMFPSLARPDDEAVDAAGVLHVPFSDGFDDGFSSAAPGAGAAYRARAAAAGRATLSAAVSRLAARGTPVTRVVYTFLVPWAPDVARAHGVPAALFWIQPAAVLAVYYHYFHGHATALAACANGAGAAATSLPGLPPLEAGALPSAVAITSPEHKHYLLLDLLRDLFLSLDEHKPMVLVNTFDALESDALRAVPQFEVAAVGPVVPDDASSSPSSALDLLHPQDAKVPYMEWLDAKPARSVVYVSFGSVLSMSRRQEEEMRRGLEATSRPYLWVARTAADGGASSDGDPDPDSGSARGLVVAWCDQVRVLAHPAVGCFVTHCGWNSALESVTRGVPMVAAPQWTDQPTVAWMVEARAGAGVRAGADGEGVVERGELRRCVEEVMGGGGEAIRARCDRWRELAREAVAPGGTSERNLRAFASGAAVDGA

SEQ ID NO: 4859 - DNA, 2256 bp, Panicum virgatum
  misc_feature: Ceres CLONE 1811599
  misc_feature: Encodes the peptide sequence at SEQ ID NO. 4860
cgaagctggtcggtcgccgcccttgcctccagcaacacccacccatccacggcgatctacggcctactcgctcctcccgaaaccctagcccacgcatccaccctacgtcgtcgccgtccgcctccgcctctccgcctccgccctcgccttcgtcttgccgcctccacaccccaaaccctagacccttgctggtgcggccgatgggcaaacgcgaccgcgaggaggtggacgagctcgccgatgggggcgccgccgagaagcgcccgcgcgaggagggcgcgtcgctgctagggctcgcgagttacgaggatgacgaagaggaggaagcggccaggggccaggcaaatggccatcgcgctgaggggaacggggaggagggcgaggacgaggacgacgaggaggacgatgtgaggagggctccggagaggcggccgaggcaggtggagctgcgccgtgactgcccttacctcgacaccgtgaacagacaggtccttgattttgattttgagaagttctgttcaatatccttgtcaaatttgaatgtgtatgcgtgcttggtttgtggaaagtatttccaaggaagaggcttgaaatctcatgcttatacgcacagtcttgaagcaggccatcatgtgttcattaatcttcaaaccgagagggcttactgtcttcctgatggatatgagataaatgatccatcactagaagatattcgccatgttctgaacccaaggttcacgaaagagcaggttctaaatctcgacaagaacaagcagtggtctagagcacttgatggttccaattatgtacccggaatggtcggtcttaacaacatcaaggagacagattttgtgaatgtcacaatacagtcattaatgagagttactcctctgagaaatttctttcttatccctgaaaattatcaacatagcaaatcaccattggttcatcgttttggggaactgacacgcaagatttggcatgctaggaacttcaaggggcaggttagtccccacgagtttctgcaagctgttatgaaggccagcaacaagcggtttcagattggtgtacagtcagatcctgtggaatttatgtcatggctcttgaatacactgcatgcaaaattaaaaagttcaaagaagaaaaacagaagcataatacatgattgctttcagggagaacttgaagttgttaaggaagttcacaggaagcatataatggaaaaaaaagaagatggtgctgagctcaatggtggtgcaggttcagcggttggagcagcagatggtactgtcatggaaacatctaaggtcccattcttgatgctcggtcttgacctgccccctccacctcttttcaaagacgccatggagaaaaatatcatcccacaggtaccgttgtttaacatactgaagaagtttgatggtgagactgtgacagaggttgtccgcccatccattgctcggatgaggtaccgtgtcactagacttccgaagtatctgatccttcatatgcgacggttcactaaaaataacttcttcgtcgagaaaaaccctactctagtaaattttcctgtgaagaatttggaattgaaggattacattccattacccaagcccaaagaaaatgacaagctacggtcgaagtatgaccttatagcaaacattgtccatgatgggaagccaggtgaaggatgctacagagtgtttgtacagcggaaatcagaagaggcctggtatgagatgcaggatctccatgttactgaaactcttcctcaaatggtagctctttcagaagcctacatgcaaatatatgagcagcatgaatgagtcgcagtggtcatcgtgtagccttccacagccagtgtttttgcttaacagagatcagaatgttgccatctaatccttatctttggagcaattgttcgtgggaaggatttggtagttcctttgcacatgttcaatcaaacttagctacttgagaagtagagcttgaggaactgtactaggctgctattttgatgtttcggagactgaaacatcatgtattttttttagagcttctttggatgccccgctggtagagggaagtttctctgtctattgtagtgcagcctgtacctgttataatcattttgcttgcaaccgacacagtaccgatagcgtttgaagctggtaaagtaatttttatatgcaaaccgcacagaaaatgattatatgtcaaaaaaaaaaaaaaaaaaaaaaaaaaaaaaaaaaaaaa

SEQ ID NO: 4860 - protein, 541 aa, Panicum virgatum
  misc_feature: Ceres CLONE 1811599
  misc_feature (1)..(327): Pfam Name: UCH Pfam Description: Ubiquitin carboxyl-terminal hydrolase
MGKRDREEVDELADGGAAEKRPREEGASLLGLASYEDDEEEEAARGQANGHRAEGNGEEGEDEDDEEDDVRRAPERRPRQVELRRDCPYLDTVNRQVLDFDFEKFCSISLSNLNVYACLVCGKYFQGRGLKSHAYTHSLEAGHHVFINLQTERAYCLPDGYEINDPSLEDIRHVLNPRFTKEQVLNLDKNKQWSRALDGSNYVPGMVGLNNIKETDFVNVTIQSLMRVTPLRNFFLIPENYQHSKSPLVHRFGELTRKIWHARNFKGQVSPHEFLQAVMKASNKRFQIGVQSDPVEFMSWLLNTLHAKLKSSKKKNRSIIHDCFQGELEVVKEVHRKHIMEKKEDGAELNGGAGSAVGAADGTVMETSKVPFLMLGLDLPPPPLFKDAMEKNIIPQVPLFNILKKFDGETVTEVVRPSIARMRYRVTRLPKYLILHMRRFTKNNFFVEKNPTLVNFPVKNLELKDYIPLPKPKENDKLRSKYDLIANIVHDGKPGEGCYRVFVQRKSEEAWYEMQDLHVTETLPQMVALSEAYMQIYEQHE

SEQ ID NO: 4861 - DNA, 936 bp, Panicum virgatum
  misc_feature: Ceres CLONE 1811604
  misc_feature: Encodes the peptide sequence at SEQ ID NO. 4862
aacagtccgaggcccagggccagggtcaaccacggatctcgactggcggaagaggcgccccgcagagcccggccatggctgccgccggcgacgagccggcaacggtggaggtgacgctgcgagccgtcggcccgtcccgccccaccaccctccgcctccctccgcttctctcggtcgccgagctccgccgacgcatcgcgcgcgatcgccatctcgcagccacagaagaggcccgcctccgcctggtcctgcgggggaggacgctcccgcaccaagacgacgctcaactcaacctccgcgatggggatacactaatagtggctgtggcacctaagccgcctgctaagcatctccgtgacgatgacgacgaggaggaggaagaggaagagctgaagttcaaaatacctcaaacaacaacctggtggaagaggaaaatcttcatgttccttcgagacaaaatgaggcttcctgatatcattttgatggtgctgttttcgctcagtatgaaggcatggattattattgcaatgtggttcctatttgcacctatagctcaaaaatatggccttggacctctatatatacttggtactggtttcctgatcatacttcttaatctcggaagacgacaacagggtgatgttagtgcatattccatattcaatgaagactttagggagctgccaggaacacttaatgcagatcgcatagatagagacatccgggcaggtcaattttgagccttatctgggtaaatagcaaccatagtttgctgagatttgtacagaagcatagtgggcctttgtctttctttgtgcttggaaaacactttcaagattaagatagtgcccttctctaagtccagtgagtttgctgtgtgttgacgatgagaaattaccagcacacttttgaagataaaaaaaaaaaaaaaaaaaa

SEQ ID NO: 4862 - protein, 221 aa, Panicum virgatum
  misc_feature: Ceres CLONE 1811604
  misc_feature: Great-hit functional homolog of the protein sequence encoded by LOCUS At2g35360
  misc_feature: Useful for making plants with modulated oxidative stress sensitivity
MAAAGDEPATVEVTLRAVGPSRPTTLRLPPLLSVAELRRRIARDRHLAATEEARLRLVLRGRTLPHQDDAQLNLRDGDTLIVAVAPKPPAKHLRDDDDEEEEEEELKFKIPQTTTWWKRKIFMFLRDKMRLPDIILMVLFSLSMKAWIIIAMWFLFAPIAQKYGLGPLYILGTGFLIILLNLGRRQQGDVSAYSIFNEDFRELPGTLNADRIDRDIRAGQF

SEQ ID NO: 4863 - DNA, 1831 bp, Panicum virgatum
  misc_feature: Ceres CLONE 1811630
  misc_feature: Encodes the peptide sequence at SEQ ID NO. 4864
agtcctgaacaaacccgtcagaaacgcgaggtttgatagatcgttgttgttgttgaagcgtcgtctgtcagattgaactcgcaacctgcaaagccgatctatctgcccttcagacgccggcagccctgactaaaggacaatgcagctagcaagagctctccagaatggatcaatcatctactgtgcacggaccatatgaccaaaaaaaatctccaggcggcctatatatacatgatggcggtaacgagacaagaggcgcatgtgctccctccactggtcgcccagccggccggccgccccactcctcacagccacttgacggcgtccccatggccgcctcttgccgccacagccataggaacagcatggtgccgccacgggcacgcggatgcctgtcgtgcaccagcacggcccgtgttcgccgctggccggcaagcgcgagaaggcgccgtcccacgcggagatcctcgccgcggaccagcgccgcgtcgagtacatccaccgccgcgtgtctgagactaccggccgggtgaggccgaagcgcgccgcgtcaccggcggtccacctccggcccggcgcgccgtcgacggcggcaactccggcgtcggcctcgccctacgcgaagtcggcgaacctcccggcgtcgtccgggcgcgcgctgggcacgggcaactacgtggtgaccatcgggctcggcacgccgtcggcgcggttcacggtggtgttcgacaccggcagcgacacgacgtgggtgcagtgccagccgtgcgtgacctactgctaccggcagaaggagccgctcttcaccccggccaagtcgtccacctacgccaacatctcgtgctcgtcgtcctactgcgacgacctctacgtcagcggctgcgacggcggccactgcctctacgccgtccagtacggcgacggctcccagaccgtcggtttctacgcccaggacaccctcaagctctcctacgacgtcgtcaaggagttccggttcgggtgcggcgagaagaaccgcgggctgttcgggcggtcagcggggctgatggggctcggccgcggcaagacgtcgctgacggtgcaggcgtacgacaagtacggcggcgtgttcgcgtactgcctcccggcgacgccgtcggggacgacggggttcctggacctgggccccggcgcgccggcggcgaacgcgcggctgacgccgatgctgaccgacaacgggccgacgttctactacgtggggttgacaggcatcaaggtgggcgggcacctgctccccatcccggaggccgtcttctccgccgccggcgcgctcgtggactccggcacggtgataacgcgcctgccgccgtcggcgtacgagccgctgcggtcggcgttcgccaggggcatggacgcgctggggtacaggaaggcccccgcgttctcgatcctggacacctgctacgacctgacggggtaccaggggagcgtcgcgctgccggcggtgtcgctggtgttcaagggcggcgcgtgcctggacgtggacgcgtcggggatcctgtacgtcgcggacgtgtcgcaggcgtgcctggcgttcgccgccaacgacgatgacgccggcgtcgccatcatcgggaacacgcagcagaagacgtacggcgtgctccacgacctcggcaggaaggtcgtcgggttcgtccccggagcttgctgatccggctcgccggtggaccttcctgaataaccccaattaatcgcctgaatccgctaagcgatcggtgatcagcgttgaagattatcatgtctacaaatacgactgtcagatggtgcactataatataaattggcacac

SEQ ID NO: 4864 - protein, 434 aa, Panicum virgatum
  misc_feature: Ceres CLONE 1811630
  misc_feature (1)..(336): Pfam Name: Asp Pfam Description: Eukaryotic aspartyl protease
MPVVHQHGPCSPLAGKREKAPSHAEILAADQRRVEYIHRRVSETTGRVRPKRAASPAVHLRPGAPSTAATPASASPYAKSANLPASSGRALGTGNYVVTIGLGTPSARFTVVFDTGSDTTWVQCQPCVTYCYRQKEPLFTPAKSSTYANISCSSSYCDDLYVSGCDGGHCLYAVQYGDGSQTVGFYAQDTLKLSYDVVKEFRFGCGEKNRGLFGRSAGLMGLGRGKTSLTVQAYDKYGGVFAYCLPATPSGTTGFLDLGPGAPAANARLTPMLTDNGPTFYYVGLTGIKVGGHLLPIPEAVFSAAGALVDSGTVITRLPPSAYEPLRSAFARGMDALGYRKAPAFSILDTCYDLTGYQGSVALPAVSLVFKGGACLDVDASGILYVADVSQACLAFAANDDDAGVAIIGNTQQKTYGVLHDLGRKVVGFVPGAC

SEQ ID NO: 4865 - DNA, 1306 bp, Panicum virgatum
  misc_feature: Ceres CLONE 1811641
  misc_feature: Encodes the peptide sequence at SEQ ID NO. 4866
agcacgagccaccaagtgtcagctctcgatcaggcccgcaagctcggagagaaagggaggaggagtcgagatggcggaggtgatcgtgagcggaggcggagaggcgatggagggaggcgcggccgcgaaagggccggtggtggtgacgggggcggcgggcttcgtcggctcctggctcgtcaggaagctcctccgggccggctacgccgtccgggccaccgtgcgcgaccccgcgaacgttgggaagacgaagccattgctggaccttcccggagcagcggagcggctatccatctggaaggccgacctgaccgaggaaggcagcttcgacgatgcgatcaagggatgcaccggcgtcttccacgtcgccacgcccatggacttcgagtccaaagacccagagaacgaggtgatcaaaccgacggtggaaggggtgctgagcatcatgcgagcctgcaaggaggccggcaccgtgcggcgcgtcgtcttcacctccaccgccggggcagtcaacgtcgaggagcggcagaagcccgtctacgacgagaacaactggagcgacgtcgacttctgccgccgcgtcaagatgaccggatggatgtacttcgtgtccaagaccctggcggacaaggcggccatagcgtacgcggcggagcacgggatggacctcatcagcgtcatcccgccgctggtgatcggcccgttcatcagcgcgggcatgccgcccagcctcctcaccgcgctggcgctcatcacggggaacgagccccactactccatcctgaagcaggtgcagttcgtccacctcgacgacctctgcgacgccgagattttcctcttcgagcacccggccgccgccggccgctacgtctgctcctcccacgccaccaccatccacggcctcgccgccatgctcagggagaggtaccccgagtaccgcatcccggagaggttccgcgggatcgacgacggcgacctccagccggtgcacttctcgtccaagaagctcctcgacctcgggttcgcgttcaagtacacggtggaggacatgtacgacgccgccatccggacgtgccgggagaagggcctgatcccgctcgccacggccggaggggacggccccggcgagacggatgccgctcttgggagggaaggtccggcgattggcgcttagaaacacaccgctggtgtgattcaaaattgctgtcctacaactacaataatgatgccatatgtcgttctacctgtgaaacatgttggtatttgaattcataattttctggatcaaaaaaaaaaaaaaaaaaaa

SEQ ID NO: 4866 - protein, 367 aa, Panicum virgatum
  misc_feature: Ceres CLONE 1811641
  misc_feature (1)..(247): Pfam Name: Epimerase Pfam Description: NAD dependent epimerase/dehydratase family
  misc_feature (13)..(359): SWISSPROT Homolog: EC 1.1.1.219 Dihydroflavonol-4-reductase
  misc_feature (20)..(367): SWISSPROT Homolog: EC 1.1.1.219 Dihydroflavonol-4-reductase
MAEVIVSGGGEAMEGGAAAKGPVVVTGAAGFVGSWLVRKLLRAGYAVRATVRDPANVGKTKPLLDLPGAAERLSIWKADLTEEGSFDDAIKGCTGVFHVATPMDFESKDPENEVIKPTVEGVLSIMRACKEAGTVRRVVFTSTAGAVNVEERQKPVYDENNWSDVDFCRRVKMTGWMYFVSKTLADKAAIAYAAEHGMDLISVIPPLVIGPFISAGMPPSLLTALALITGNEPHYSILKQVQFVHLDDLCDAEIFLFEHPAAAGRYVCSSHATTIHGLAAMLRERYPEYRIPERFRGIDDGDLQPVHFSSKKLLDLGFAFKYTVEDMYDAAIRTCREKGLIPLATAGGDGPGETDAALGREGPAIGA

SEQ ID NO: 4867 - DNA, 1595 bp, Panicum virgatum
  misc_feature: Ceres CLONE 1811658
  misc_feature: Encodes the peptide sequence at SEQ ID NO. 4868
gagatcaataggggggcaacggaaacgagctccacgcacaacaccacaccacaccgcgctcctctgacgagacgaggcggcaacagaccaccacacccgccggcgcggcgcccacccaaatcgcagatcaaagcaccacgccggccggccagccggagggatccattgcttccgagcaatcgagaggcccggcgtcgcaggtaaatagttcatacttgtattcctggatctgatggtgtcggtctcttggagactctaattcagcaagcattgaattgaatccgtggaagtggagatgacttccctgaagaaatccgacaagaaggctgtccttgactttgcagcatggagtttcaatgttactacatccgttggaatcatcatggtcaacaaagctttaatggctaagcatggattcagtttcgccacaacattaaccgggcttcattttgtggcaaccaccttgatgacaatcgtatttcggtggttaggcctgagccagccctcccagttaccgctagcggatctgattaaatttgtgatattttcaaacttgtcaattgttgggatgaacgtgagcttgatgtggaactctgtgggcttttatcagatagcaaagctgtgcatgatacctgcttcatgtcttctggagattgtctttgatcatgtacattattcccgcgacacaaagctgagcataatggttgtgcttataggagttgcagtctgcacggttactgatgtcagtgtgaatgcaagaggtctaattgcatctgttatagctgtttggagcacagccttgcaacaatattatattcattttctccaaaggaagtactctctgaactcgttcaacctcctgggccacactgctccagcccaagcagggtccctcctgctagtgggaccatttgtgaattacttgttgacaggcaaaagggtggatcacttcaatttctcatctcttgctctgtttttcctcacactctcatgcttcatcgccattggggttaatctgagccaattcatctgcatcgggcggttctctgctgtgtcgttccaagtgctgggccacatgaagactgtgcttgttctgtcccttgggtttgtcttctttggcaaggagggcctgaaccttcaggtagtcctcgggatggtcctcgctgttcttggaatgatctggtacggtaacgcatcggctaaaccaggaggcaaagaaaggcgcagcgtcctaccagtgaaatctgggagtctcaagggaagttcagaagaaatggatggtgctgaaaaatagtcttgttaccatactccaactgagatggttacagggaatttttatgtgagattaaaattctggtgacgcgagtatcacaaaaaatagaaactctggcattacatagttacgtttgctgtagaaggtatacccttcctgtctagaaacttaggattgttatagttccaggtatacagtagtgacactttaatttctgtctctgtggatcattggtacggcagcgaggggaatgccacatgtattacgaggctagcttgaagaaagttttacccaatatagtgtttttttcttctttttttgg

SEQ ID NO: 4868 - protein, 332 aa, Panicum virgatum
  misc_feature: Ceres CLONE 1811658
  misc_feature (1)..(144): Pfam Name: TPT Pfam Description: Triose-phosphate Transporter family
MTSLKKSDKKAVLDFAAWSFNVTTSVGIIMVNKALMAKHGFSFATTLTGLHFVATTLMTIVFRWLGLSQPSQLPLADLIKFVIFSNLSIVGMNVSLMWNSVGFYQIAKLCMIPASCLLEIVFDHVHYSRDTKLSIMVVLIGVAVCTVTDVSVNARGLIASVIAVWSTALQQYYIHFLQRKYSLNSFNLLGHTAPAQAGSLLLVGPFVNYLLTGKRVDHFNFSSLALFFLTLSCFIAIGVNLSQFICIGRFSAVSFQVLGHMKTVLVLSLGFVFFGKEGLNLQVVLGMVLAVLGMIWYGNASAKPGGKERRSVLPVKSGSLKGSSEEMDGAEK

SEQ ID NO: 4869 - DNA, 1050 bp, Panicum virgatum
  misc_feature: Ceres CLONE 1811684
  misc_feature: Encodes the peptide sequence at SEQ ID NO. 4870
accatgcctttgatcgacgtcgtaggcggcagcagcagcagcagctcgcaccattgcaccgaggcggcgtgggcgcagcatctgcagcggccagcggcatgtcatcgtcgtcgccggagatggaggggacgagcagcaagaagttcaagggagtgcggaagcgcaagtggggcaagtgggtgtcggagatccggctgcccaacagccgcgagcgcatctggctgggttcctacgacgcccccgagaaggccgcgcgcgccttcgacgccgccttcgtctgcctccgcggcgccggggccgccggcgcggacctcaacttcccggactcgccgccgccctgccgcgtcggcggatgcagcagcgatccgcaggaggtgcaggcggccgcgctctcccacgccaaccgcgccgccgtcacggcccagcaggcggccgcggcgctcatggacgtcgacgacggctcgatgctgccgtggggctccgtggcgcagcacgacatggcgggtgttcttggcactggcagcgctgatgaggtggtggcgcccgtgcacgccgacgggagcatcgactggcggcccttcatggcgcacccgccgccgctcttctcccctaccgggtggggcaacaatgcatacgacttcctgcaggagctgccgccgccgggtgcggcggacgaggacatggaggacagtatccatggcgcaaccgcttctctctggagcttcgactcgagagactcctacttcagatactagcaagctagatacatgctgtacaaggctaccttcaagatggagccacggcggtggcggcgcatctctgcagctaggtgcatcctgcattgctacgaggcattaattacgtgctcatgactgctatgagtatatgatcagcaacctttcttaacataatttttctgataatgatgcctggcggtagaattcaaaaaggcgtggttcatatatcgttgagatcgtgatcacacaaaaatatttgattgggtgtaataatgtgtagctcccctttcctcaaaaaaaaaaaaaaaaaaaa

SEQ ID NO: 4870 - protein, 218 aa, Panicum virgatum
  misc_feature: Ceres CLONE 1811684
  misc_feature (2)..(67): Pfam Name: AP2 Pfam Description: AP2 domain
  misc_feature: The sequence is a functional homolog of  SEQ ID NO 170 in the  11/375,241 US patent application
  misc_feature: The sequence is a functional homolog of  SEQ ID NO 172 in the  11/375,241 US patent application
  misc_feature: The sequence is a functional homolog of  SEQ ID NO 174 in the  11/375,241 US patent application
  misc_feature: The sequence is a functional homolog of  SEQ ID NO 176 in the  11/375,241 US patent application
  misc_feature: The sequence is a functional homolog of  SEQ ID NO 178 in the  11/375,241 US patent application
  misc_feature: The sequence is a functional homolog of  SEQ ID NO 688 in the  11/435,388 US patent application
  misc_feature: The sequence is a functional homolog of  SEQ ID NO 798 in the  11/435,388 US patent application
  misc_feature: The sequence is a functional homolog of  SEQ ID NO 800 in the  11/435,388 US patent application
  misc_feature: The sequence is a functional homolog of  SEQ ID NO 802 in the  11/435,388 US patent application
  misc_feature: The sequence is a functional homolog of  SEQ ID NO 804 in the  11/435,388 US patent application
  misc_feature: Useful for making plants with modulated growth and phenotype characteristics
MSSSSPEMEGTSSKKFKGVRKRKWGKWVSEIRLPNSRERIWLGSYDAPEKAARAFDAAFVCLRGAGAAGADLNFPDSPPPCRVGGCSSDPQEVQAAALSHANRAAVTAQQAAAALMDVDDGSMLPWGSVAQHDMAGVLGTGSADEVVAPVHADGSIDWRPFMAHPPPLFSPTGWGNNAYDFLQELPPPGAADEDMEDSIHGATASLWSFDSRDSYFRY

SEQ ID NO: 4871 - DNA, 1497 bp, Panicum virgatum
  misc_feature: Ceres CLONE 1811712
  misc_feature: Encodes the peptide sequence at SEQ ID NO. 4872
aagtcatcccatactgataattgaagtggcttcactctgcggactgaccatgggcgccccgctaccaggcctgctctctgcgcttctgctgctcctcctcccggcttccctccgagtccgagaccaactcctcctcgcgtcccaccggcgagaggcggaggacggcatcggcggcggcctgcacccgatcgtgctgatccccgggctgtcctgccccgacctggaggcgcgattaaccgacgcctaccggcccttgaaaccgggctgcagccgggtggaacgggacgggtggttcgggctgttgacgaaccgcacctggaagctggacgccgagcgcgcggagtgcttcgtcgaccagatgcgcctcgtctacgatcccgtcctcggggacttccgtaacctgcccggcgtcgagacgcgcgtcccctacttcggctccgccgccgggtccggctccaagattccaacacacccggagttttgtatgggagcactgaggtctgcactaggaaggcttggctaccgtgagggagaaaccctcttcggagctccctacgacccgcggtacgctcccccgatgcccggccagacgtcccaattctactcccgctacttccgccagatggcaaggctcatcgaggacgcgagcgagaggaacaacggcaggcccgccatcgtcctcggccacagcttcggcggcgcggtggcgctcgagttcgtcaggaacgccccgctgcagtggcgggacagattcgtcaggcacctcatcacggtggcgccgacgtggtccgggggctacgtccaccctctgacggacttcgtctcaggcccggtagacttgttctttatcccggcggctccgcagctggccatgcgatcgatgtggaggacctttgagactgccgtggcgaccctaccgtccccggcggtgtttgggcgccggccgctggtgataaccaggaaccggaattactcggcctacgacatcgccgacctgctcgtggccgtcggttccgccgacgccgtccggcctttcagagagcgtgagctcccgaagatggagtacttcgaggcgccaatggtgccgttgacctatatcagtggggtgggtatcccgacggcggagcagctgatttaccaggacgacgacttcgataggctgcctgaagtggtgtacggcgacggcgacgacacgatcaatatcgctagcgtgctggcgttcgaggagaaggtgggtatgcagccgggacaaaaggagcgcttcaagtccatgaagtttgctggggttcaacactctgcattaatcagggatgaacgggcgctcagcgcaatcatggatgaaattgcagaagcaaatcgctaggcacaaaaggattgttatctcgtattaagattgttattacgatgctatactacaagtctacaacgtgtgcaacctttgtacacacaacggatcgatgcatctgttcaataaagaagctaagctaggtattgtat

SEQ ID NO: 4872 - protein, 437 aa, Panicum virgatum
  misc_feature: Ceres CLONE 1811712
  misc_feature (1)..(344): Pfam Name: LACT Pfam Description: Lecithin:cholesterol acyltransferase
MGAPLPGLLSALLLLLLPASLRVRDQLLLASHRREAEDGIGGGLHPIVLIPGLSCPDLEARLTDAYRPLKPGCSRVERDGWFGLLTNRTWKLDAERAECFVDQMRLVYDPVLGDFRNLPGVETRVPYFGSAAGSGSKIPTHPEFCMGALRSALGRLGYREGETLFGAPYDPRYAPPMPGQTSQFYSRYFRQMARLIEDASERNNGRPAIVLGHSFGGAVALEFVRNAPLQWRDRFVRHLITVAPTWSGGYVHPLTDFVSGPVDLFFIPAAPQLAMRSMWRTFETAVATLPSPAVFGRRPLVITRNRNYSAYDIADLLVAVGSADAVRPFRERELPKMEYFEAPMVPLTYISGVGIPTAEQLIYQDDDFDRLPEVVYGDGDDTINIASVLAFEEKVGMQPGQKERFKSMKFAGVQHSALIRDERALSAIMDEIAEANR

SEQ ID NO: 4873 - DNA, 1229 bp, Panicum virgatum
  misc_feature: Ceres CLONE 1811759
  misc_feature: Encodes the peptide sequence at SEQ ID NO. 4874
aatccattccattccatccaatcccaggggggagctgctgcgcgcgcctctcgtccgaaaactaaatctggtaactgctcttgcttgctcaaagagccgcaatggactacgacggcaggtacaccaaggatcagagcctcaagtgcgactgcctcctcttcgaccttgatgatacgctctacccattcacctccggcattgctgccgacatcgccaagaacatccgagattacatggtgcacaaactcggtgttgacgagagcgttagcttggaactctgcatcctcctctacaagcagtatggaaccaccatggctggtttgagggctgttggataccagtttgattacgatgatttccacagttttgttcatggaaggttggcgtatgacaaaatcaagcctgatccggtgcttaagaacattctgctcagcttacccatacgcaaagttgtgtttaccaacggtgatagaatccatgcttcaagggccctcaagaggcttggaattgaggactgtttcgaaagagttgtgtgttttgagacactgaacccaacatctcctccttctgcaccatgtgacaaacttgaaatctttgacattatgaagcatatggctcatccagagcccggggtggagctaccaaaatcaccaatcctgtgcaagccatcgagagaggcaatgctgctggccctcgaggtcgcctccatcaatccacagacaactatattgtttgatgacagcttcaggaacatcgaagctgcaaagcagatcggaatgcgaactgtcctggttggaacatccgagagaaagaaaggtgctgactatgccttggaaagcatccacaacatgaaggaagcgctgcctgaactgtgggaggaggcggagaaggatgaagatgtgaggaattcaagcaaagttggaatcgagacatcagtgattgcatagtattttttggcgtcaaatgtagcccttttgtttgccatggaggagagcacgagatggttgatcattatatttttgagagcccatctctgcactatcttccatctatctgaaaaagagctactaattaggggacaagaaaacaagctcctcgagggggttgggactaaccgatactataactgatgttacgtcccatatgctactatactgtgtggtaaggaataaaaatgtttcggtgaggcatagcacttctgtaccaacgaaaaaaaaaaaaaaaaaaaa

SEQ ID NO: 4874 - protein, 281 aa, Panicum virgatum
  misc_feature: Ceres CLONE 1811759
  misc_feature (2)..(220): Pfam Name: Hydrolase Pfam Description: haloacid dehalogenase-like hydrolase
MDYDGRYTKDQSLKCDCLLFDLDDTLYPFTSGIAADIAKNIRDYMVHKLGVDESVSLELCILLYKQYGTTMAGLRAVGYQFDYDDFHSFVHGRLAYDKIKPDPVLKNILLSLPIRKVVFTNGDRIHASRALKRLGIEDCFERVVCFETLNPTSPPSAPCDKLEIFDIMKHMAHPEPGVELPKSPILCKPSREAMLLALEVASINPQTTILFDDSFRNIEAAKQIGMRTVLVGTSERKKGADYALESIHNMKEALPELWEEAEKDEDVRNSSKVGIETSVIA

SEQ ID NO: 4875 - DNA, 1654 bp, Panicum virgatum
  misc_feature: Ceres CLONE 1811775
  misc_feature: Encodes the peptide sequence at SEQ ID NO. 4876
gttcactgccctccagctctcaatcaagtctctcagcaaccgaggcagcagcgacaccgccacgcgcgccatggttgccgagctcgccggcggcggcgacatgcccgtgcacagcttccggctgtcgacggtggtgccggggtcggtgaccggggaggcagtggactacgagctcgcggacgccgacctgctgcacaagctgcactacctccgcgcggtgcacgtgttccgcgccccggcgccgggggccgtccgggagctcaaggagcccatgttcccgtggctggacatgtacttccccgtcagcggccggctgcggcggcgcccggcggctgacgacggcgaggtaggcgcggcggcggggcggccgtacgtgcggtgcaacgactgcggcgtgcgcgtcgtggaggccgccatcgacgccaccgtggaggagtggctggagcaggaggcggagcgcggcggcctgtgcaaggcgctggcctacgacaaggtcatcggcccggagctcttcttctcgccgctgctctacgtgcagttcaccagcttcaagtgcggcgggatggccctcggcttcaagtgggcgcacctcatcggcgacatcccctccgccgccgcctgcttcagcacgtgggcgcagctcctcagcggcaagaaggccccggcacccaccctgcgcgacccgcacaccaagccgccgtcggccgcacctgccggcgcgacggccccaccgtcggtcaaggccaccgccgcgcccgtcggcgacgactggagggtccccaccgcctgtgaaatggtgcccttctccttccacgtcaccgagcagcagctgaagcgcctcctgctcggcgcgccagcggggcgccgtcatcatcaggtgggcacgttcgagctggtcgcggcgctggtgtggcgcgcggtggccgccatccggggtcccgaggaggaggaggcgacgcgcacggtgaccgtcgtgaagactacggacccggcggccgcgcctacaggcgacggccgcctggggctgaccaacgagcaccgcatcggccacgtcgtcgcgccgaccggcctgctgccggcggcagccgacgtcgcggagctggcggcgctgctggccgccgcgagcctcgacggggccggcgcggtcgcggctgcggcgctggcgggggcggacgacgccaacgcggtcgtgtacggcgccaacctgacgttcgtggacgccgagggcgttgacgcgtacgggctggagctcggcgcgcggcgccccgcgcacgcggagtacgccgtggacggcgccggcgacggcggcgcggccgtcgtgcaccgcgacgccggcgggcggggccgcaccgtcgcggccgccgtgcgccggggcgaggcggaccgcctccgcgcggttctccgtgacgcgctgcgcgttgcttgatggccgaggcagtagctttgcctttcttcagtgggttatcaataaagacacttcagcgtgtgctcctttgcgctgcttgtgttggtctgttcagtcctgcgctcccgtgcactcttgcaagcagtttatattagcgtgattcgaacttctaaatgcaattaatgtgtgttatgaacttccgatggtatggatttgctatgtttggctcaaaaaaaaaaaaaaaaaaaa

SEQ ID NO: 4876 - protein, 451 aa, Panicum virgatum
  misc_feature: Ceres CLONE 1811775
  misc_feature (1)..(123): Pfam Name: Transferase Pfam Description: Transferase family
MVAELAGGGDMPVHSFRLSTVVPGSVTGEAVDYELADADLLHKLHYLRAVHVFRAPAPGAVRELKEPMFPWLDMYFPVSGRLRRRPAADDGEVGAAAGRPYVRCNDCGVRVVEAAIDATVEEWLEQEAERGGLCKALAYDKVIGPELFFSPLLYVQFTSFKCGGMALGFKWAHLIGDIPSAAACFSTWAQLLSGKKAPAPTLRDPHTKPPSAAPAGATAPPSVKATAAPVGDDWRVPTACEMVPFSFHVTEQQLKRLLLGAPAGRRHHQVGTFELVAALVWRAVAAIRGPEEEEATRTVTVVKTTDPAAAPTGDGRLGLTNEHRIGHVVAPTGLLPAAADVAELAALLAAASLDGAGAVAAAALAGADDANAVVYGANLTFVDAEGVDAYGLELGARRPAHAEYAVDGAGDGGAAVVHRDAGGRGRTVAAAVRRGEADRLRAVLRDALRVA

SEQ ID NO: 4877 - DNA, 1262 bp, Panicum virgatum
  misc_feature: Ceres CLONE 1811776
  misc_feature: Encodes the peptide sequence at SEQ ID NO. 4878
acaacacaggccaccgccattcccgttgccgcgttcttggactctgtttctctcgttgttgaagctcctgctgtcagtttggaggctgtgatcggggaagaagaagaagaagatgacgatcaccattgaacagccccagctcgacgcggtggcggagaggaaggcccccgccggcggcgaccccgcggagctcgtgctcgacggcggcttcgtcgtgccggacgccaacgccttcggcaacacattcagggactacaacgcggagtcggagcggaagaagacggtggaggagttctaccgggtgaaccacatccggcagacgcacgagttcgtgtcccggatgcgggccgagtacgggcggctggacaggacggagatgggcatctgggactgcatcgagctgctcaacgagttcatcgacgacagcgacccggacctggacatgccccagatcgagcacctcctccagaccgccgaggccatccgcaaggactaccccgaccaggactggctccacctcaccggcctcatccacgacctgggcaaggtgctgctgcacccaagcttcggagagctccctcagtgggcagttgttggtgacaccttccctgtcggctgcgcgttcgacgagtgcaacgtccacttcaagtacttcaaggagaaccctgactaccacaaccccaagttcaacaccaagttcggcgtctactccgagggctgcggccttgacaacgtgctcatgtcatggggccatgacgactacatgtacctggtggccaaggagaacatgaccacccttccttctgctgggctgttcatcatcagataccactctttctaccccctgcacaagcatggagcctacacacacctgatgaacgaagaggacaaggagaacctcaagtggctgcatgtgttcaacaagtatgacttgtacagcaagagcaacgtcaggatagatgtggagaaggtgaagccctactacatgtccctcatcgacaagtacttcccggcgaagctgagatggtgaaaaggggcacccaccctggaggggaaccaaagcgttgttccaagtgccaatgtaccatagacaaacatacagtacaatgtgccgtgtatgagcattttcatacccgagtcgagtcgagtcgagtcgatagtgtacccattttgtaccgtaccgttcagatcagagttccatgagatcccataaaattcgaataaaagttgctgcatcagttcaaaaaaaaaaaaaaaaaaaa

SEQ ID NO: 4878 - protein, 305 aa, Panicum virgatum
  misc_feature: Ceres CLONE 1811776
  misc_feature (1)..(305): SWISSPROT Homolog: EC 1.13.99.1 Inositol oxygenase 1
  misc_feature (1)..(305): SWISSPROT Homolog: EC 1.13.99.1 Inositol oxygenase 4
MTITIEQPQLDAVAERKAPAGGDPAELVLDGGFVVPDANAFGNTFRDYNAESERKKTVEEFYRVNHIRQTHEFVSRMRAEYGRLDRTEMGIWDCIELLNEFIDDSDPDLDMPQIEHLLQTAEAIRKDYPDQDWLHLTGLIHDLGKVLLHPSFGELPQWAVVGDTFPVGCAFDECNVHFKYFKENPDYHNPKFNTKFGVYSEGCGLDNVLMSWGHDDYMYLVAKENMTTLPSAGLFIIRYHSFYPLHKHGAYTHLMNEEDKENLKWLHVFNKYDLYSKSNVRIDVEKVKPYYMSLIDKYFPAKLRW

SEQ ID NO: 4879 - DNA, 1634 bp, Panicum virgatum
  misc_feature: Ceres CLONE 1811778
  misc_feature: Encodes the peptide sequence at SEQ ID NO. 4880
accaaatccgagaaacggttgtaaccagccgaaaccctaaccctgctccccaaatcgtcccatcaaaccctagccataaaacggctcaatgctgtgagaaccaacatacgcatggctctggacagcccggccgagcgacgggacgaggtggtccaggtggcgatggggaatgggaacggcgtggcgccgctgcaaccgttgcggccggccggccggcctgcggcggcgacggcaccatacctggaccggcggctacggctgaaccccaacgcggagcacaagccgcaggactacagcgatgtgcgcggcgagtacgcgccggccgtgtacagcgcactcgaacggcatctcccaccgagcctcctcgatgccgaccgcgacgtcaagctacacttcatgcgagacattctcgcgcgctactggccccagggagagcgcaacaaggtgcaaaggcacaaagaatacaggcagaggatactccacctttacaagcctcttcatgaagaattatacaatatgcatccttccacattcttcttaccaacattccttgaagcagttaggagcaattcagaagaaagctttagaagctttatgactgaaccaattcctggtgtttattcgtttgctatgttgcagccaactttctgcgagatgttattggaggaggtagagaactttgaaaaatgggtccatgcaatgaaatttaagataatgaggccaaatacaatgaacaagtatggtgctgtccttgatgattttggtctggaagctatgttgaatcagttcatggaacagttcgtagctccaatttctagagttttttatcctgaggttggtggtggaacattggactcacatcatgcttttgttgttgaatatggaaaagacagggatgttgaactaggttttcatgttgatgattcagaagttacgttgaatgtttgccttggcaaacaattctctggtggtgaactatatttccgaggcattcggtgtgagaatcatgtgaattcagagacacaacatgaggaaatgtatgattacactcatattcctggacaggctgtactccaccgtggtcgacataggcatggtgctcgagctatatcatctggactcagaatcaatctgcttttgtggtgccggagctctgtgttcagggagatgaagaaatatcagaaggattttcccacctggtgtggtgagtgccagcgcgaaaagaggggaaggcagagtcagtgtgttaaagcaaccaagatggcgtttctcaggggcgctggaggcgcaacgatttaatttgtacctaaggcatgtattttatacaaatttgtatcatactaaactttgttcatcatttgggacttgagtggtcactttagacttggagtcaacagtcagctttctgttagactgctagactctgcgatcaccggtgcatgtaaatgtaaacttattgtgatcaagtctggctgaagaaagtgacataacaggtgataatctggtagtgtagcaagaaatgctacataattcaatttctgtggcatcgcagcacacattattatgctataaattggaatgtcattaactaggcatggttatctggtgccacggaaaaaaaaaaaaaaaaaaaa

SEQ ID NO: 4880 - protein, 395 aa, Panicum virgatum
  misc_feature: Ceres CLONE 1811778
  misc_feature (1)..(100): Pfam Name: 2OG-FeII_Oxy Pfam Description: 2OG-Fe(II) oxygenase superfamily
MALDSPAERRDEVVQVAMGNGNGVAPLQPLRPAGRPAAATAPYLDRRLRLNPNAEHKPQDYSDVRGEYAPAVYSALERHLPPSLLDADRDVKLHFMRDILARYWPQGERNKVQRHKEYRQRILHLYKPLHEELYNMHPSTFFLPTFLEAVRSNSEESFRSFMTEPIPGVYSFAMLQPTFCEMLLEEVENFEKWVHAMKFKIMRPNTMNKYGAVLDDFGLEAMLNQFMEQFVAPISRVFYPEVGGGTLDSHHAFVVEYGKDRDVELGFHVDDSEVTLNVCLGKQFSGGELYFRGIRCENHVNSETQHEEMYDYTHIPGQAVLHRGRHRHGARAISSGLRINLLLWCRSSVFREMKKYQKDFPTWCGECQREKRGRQSQCVKATKMAFLRGAGGATI

SEQ ID NO: 4881 - DNA, 1434 bp, Panicum virgatum
  misc_feature: Ceres CLONE 1811814
  misc_feature: Encodes the peptide sequence at SEQ ID NO. 4882
gggagaaaaaaaaagattccacccacctccaaccctagccaatccacctccccaccaagcatgacgcgggacggcgtgcctccggcggcgccgcctcccccggcggcggccggagccggcggcgggggcgacgggcccaggcggtgctcgcagtgcgggcaccacgggcacaacgcgcgcacctgcaccgcgcggcccgtcaagctcttcggcgtgcgcatcggggacaggcccatgcccatccggaagagcgccagcatggggaacctcgcgcagctcgcggcggaggggggcggcggcggcggcgggagggaggagggctacggctccgacggggagcgcccgcacaagaagcgaggtgaggcatggacagaagatgagcacaaaaaatttctacttgggttgaataagctagggaagggtgcttggcgtggtatttcccgtaattacgttatctcgaggactcctactcaagttgctagccatgcacagaagtatttcaatcgccaaacaaatgtgcatagaagaaagaggagatcaagcctcttagatatggtgattgatgattcttctgatcagctgccgctctcacgttcatcttcacaagaagtagaacaagatgatccacagtctgttgcggcccttcctgcccctgtggtctctcctgctgatgtggcacctcctcctgtgtctgtggaagcacctgcttcagttccgctgccagtccaagttccagttccagtcacgacacctcagcctatggaacaggactcagttgcctcaagttcaagtgctggacaagcaggggtggtgatgccagaagccgtgccccccaatctttatccaatgatgattcctcctccatactaccaccctgcatttgttccagtaccatgctacggttatgttccttttaactatggggggccaccaggtgtagcacaagttccacatgaggttgtcaaacccgtggcagtgcactcaacgcccccgttgaacgtcaaagatctttataatatgtcagaactgagtctgaagggtgatgacccaaatgcaaacagtgggatgcctgcttccccgttgcctccaaagccgattggcagacctgagaggcaatctgctttccatggcaaagggcctgctggtgggtcgtcagggggactaatttttgcagtcaagtgacttgattctgctcctaaacatccattgatgtgtatgtaatacttagaagatagccaaatcataatagcatatgctgctaaaatggtgttgtggtttcttgcaaagtagctatactgcacattttagctttcgagtttgcaagtcatgatctgtgggtaaatatattgttaaatagtttgtcttaatgtagcagtattcttctattttaatcaatttgccccaatttgtcatcaaaaaaaaaaaaaaaaaaaa

SEQ ID NO: 4882 - protein, 373 aa, Panicum virgatum
  misc_feature: Ceres CLONE 1811814
  misc_feature (1)..(48): Pfam Name: Myb_DNA-binding Pfam Description: Myb-like DNA-binding domain
  misc_feature: The sequence is a functional homolog of  SEQ ID NO 1045 in the  11/479,226 US patent application
  misc_feature: The sequence is a functional homolog of  SEQ ID NO 452 in the  10/412,699 US patent application
  misc_feature: Useful for making plants with modulated growth and phenotype characteristics
MTRDGVPPAAPPPPAAAGAGGGGDGPRRCSQCGHHGHNARTCTARPVKLFGVRIGDRPMPIRKSASMGNLAQLAAEGGGGGGGREEGYGSDGERPHKKRGEAWTEDEHKKFLLGLNKLGKGAWRGISRNYVISRTPTQVASHAQKYFNRQTNVHRRKRRSSLLDMVIDDSSDQLPLSRSSSQEVEQDDPQSVAALPAPVVSPADVAPPPVSVEAPASVPLPVQVPVPVTTPQPMEQDSVASSSSAGQAGVVMPEAVPPNLYPMMIPPPYYHPAFVPVPCYGYVPFNYGGPPGVAQVPHEVVKPVAVHSTPPLNVKDLYNMSELSLKGDDPNANSGMPASPLPPKPIGRPERQSAFHGKGPAGGSSGGLIFAVK

SEQ ID NO: 4883 - DNA, 1568 bp, Panicum virgatum
  misc_feature: Ceres CLONE 1811911
  misc_feature: Encodes the peptide sequence at SEQ ID NO. 4884
agcaaacccgacgcgaaagcaaccgccccgccgaaaaggacgcgagcccaccccaccccaccgcaccccacccacccgagatccatggccggcggcgacgtcgaggccgctgccgccgcggcgccgctgctgcccccgccggcgtcggacgagccctccgcggcgccggcccccgccgaccgcctcggcgtcggctacctcgtcttcttcaccctgggcgcgggcttcctgctcccctggaacgccttcatcaccgccgtcgactacttcgccttcctctacccgggcgcccccgtcgatcgcgtcttctccgtcgcctacatgctctcctgcctcctgcccctgctcctcatcgtgctctgcttccccaagtccagcgcccccgcccgcatcaacaccggcctcgcgctcttcacgctcgcgctcctcctcgtccccgccatggacgccgcctacgtcaggggcaggcccggcctctacggcgccttcgacgtcaccgtcggggccaccgtcctctgtggggtcgccgacgccctcgtgcagggaggggtcatcggcttcgcaggggagctgcccgagaggtacatgcaggccgtcgtcgccggaaccgccgcctcaggtgtgcttgtctcagcaatgagagtctttaccaaggcactctacccacaagacacacacgggctaaggcaaagcgcaatcctctacttcatcgtcggcattgtggtcatgatcatgtgcattgtgtgctataatgtggctgacaggcttccagtcgttgtgtactacaagaatatcaagaagagggctcagaaggcagaggttggcggtggcatgacaggtcctgcctggagatcaactttgtggagcatcgttgggacagtgaagtggtatggaataggagtgatcctcatctacgcggttacactctccatattcccgggatacatcacagaggacgtgcactctgagacactcaaggactggtatcccatcatcctcatcagtgcctacaacgtgttcgacctcgttggcaaggccctgccggctgtttacctcctccagaatgccaacatcgcggtcgcaggttccttcgctaggcttctgttctaccccctcttctatggctgcctgcacggccccaacttcttccgcaccgagatcccagtcacaatactgacatgcctgctgggcctcaccaacgggtacctgacctccatcctcatgatcctcgcgcccaaggccgtgcccatccaccactcggagaccgctgggatcgtcatagtgctgttccttgtggttggtcttgtcatcggttcgtttgtatcttggttctgggtcatctgataggggttcctctgtgtattcatgccaatgtatcatagcaccatgttcaagcttcctgcttgctgctatttcatttgccaacccaatggccaagggtaccagtaattcgttagtgtagcccaggtgaaagactgggcaaatgtgtgtaatttagattctatggaaggcagccaaatgttcatatcaacacaaaccttggctcctatgaagttattttcatctcc

SEQ ID NO: 4884 - protein, 419 aa, Panicum virgatum
  misc_feature: Ceres CLONE 1811911
  misc_feature (1)..(281): Pfam Name: Nucleoside_tran Pfam Description: Nucleoside transporter
MAGGDVEAAAAAAPLLPPPASDEPSAAPAPADRLGVGYLVFFTLGAGFLLPWNAFITAVDYFAFLYPGAPVDRVFSVAYMLSCLLPLLLIVLCFPKSSAPARINTGLALFTLALLLVPAMDAAYVRGRPGLYGAFDVTVGATVLCGVADALVQGGVIGFAGELPERYMQAVVAGTAASGVLVSAMRVFTKALYPQDTHGLRQSAILYFIVGIVVMIMCIVCYNVADRLPVVVYYKNIKKRAQKAEVGGGMTGPAWRSTLWSIVGTVKWYGIGVILIYAVTLSIFPGYITEDVHSETLKDWYPIILISAYNVFDLVGKALPAVYLLQNANIAVAGSFARLLFYPLFYGCLHGPNFFRTEIPVTILTCLLGLTNGYLTSILMILAPKAVPIHHSETAGIVIVLFLVVGLVIGSFVSWFWVI

SEQ ID NO: 4885 - DNA, 2217 bp, Panicum virgatum
  misc_feature: Ceres CLONE 1811914
  misc_feature: Encodes the peptide sequence at SEQ ID NO. 4886
gtgagcttagcagagaaatcaaatccccaaacacacacccaaacccccgggccgggcaactgctctgctcctcctccgcaccgcggggggaagggagggaggtcgagcaccgacgaggaccccccagcaccgccgcccctatggccatggagttccgccccagggtcccgccgccgcacgcgggggcggccaccgcagggcaccacccgcggcgccgggcggcggccgggggcgagggggagcgggagcgggtgcgggtgcaggccggggacgcgctgccgctcccgatccggcacaccaacctcatcttctcggccctcttcgccgcctcgctcgcgtacctgatgcggcgctggcgggagaagatccgcgcctccacgcccctccacgtcgtctccctcgccgaaatcttcgccatctgcggcctcgtcgcctcgctcatctacctcctcagcttcttcggcatcgccttcgtgcagtccgtcgtctccaacagcgacgacgaggaggactacctcatcgacgcccgccacgcgccggcgccggcgccgacggccccggccccgtgcgcgctactggggaaccccgccgccgcgccggagaaaatgccggaggacgacgaggacatcgtggccgcggtcgtggccgggacgatcccgtcctacgtgctggagaccagtttgggggactgccgccgggccgccgggatccggcgggaggcgctgcggcggatcacggggagggagatggacggcctcccgctcgacgggttcgactacgcgtccgccctcgggcagtgcatcgagcagccggtgggctacgtgcagctgcccgtcggcgtcgctggcccgctcctgctcgacggtcgccggctctacgtgccaatggcgaccaccgagagctgcctcgtcgccagcacaaaccgagggttcaaggccattgccgagtccggcggcgcctccagcgtcatcctcagggacgggatgacgcgagcaccggccgcccggttcccgtctgcccgccgcgccgctgagctcaagggcttcttggagaatcccgccaactttgacaccctggctacagtgtttaacaggtcgagcagatttggtagactgcagggagtgaagtgcgcgatggcagggaggaacctttacatgaggttcacctgcagcacaggtgatgcaatggggatgaacatggtctccaaatgcgtccagaacgtgctggactacctccaggatgacttccctgatatggatgttatcagcatatcaggtaacttctgttctgacaagaagtcagctgctataaactggattgaagggcgtggaaagtctgtggtttgtgaggcagtaatcaaggaagaagttgtgaaaaaggttctcaagactaacgtgcaggcactagttgaattgaacgtgatcaaaaaccttgctggctcagctgttgctggagctcttgggggtttcaatgcccatgcaagcaacattgtgacagccatcttcattgcaactggtcaggaccctgcacagaatgtggagagttcccagtgcatgacaatgttggaagctataaatgatggcaaagatctccacatctctgttaccatgccgtctattgaggtgggcacgattggaggaggcacgcagctggcctcacagtctgcctgcttggacctactcggcgtcaaaggcccgaacagggaatccccggggtcgaacgcgaggcttctggccacggtggttgctggtgcggtcctcgctggggagctgtccctcatctccgctcaggccgctggccatctggtccagagccacatgaaatacaacagatccagcagagacatatccaaggctgcagaggaagcagacagacccaaaaaatgctgaatactgcctatttgttttataccccttgggaaaatggaagacaaagggtttcgtaggttgattccttgtggcatgggcaggcctgcaggagggttaaacggaagaaaacccttcaggtaaaagcgaagattcactcgacttgtcatattaccaggccgtgaaagctctaggtttcaaaacctcatggatttggagaacgaggcattttattattcgttggtgttgtagctgttcgtctcctgtcgttgatccccccccccccccccctcgttctatgaagcttgttttgcccgtcccctgcgactttgaaaaaaaaaaaaaaaaaaaa

SEQ ID NO: 4886 - protein, 582 aa, Panicum virgatum
  misc_feature: Ceres CLONE 1811914
  misc_feature (15)..(581): SWISSPROT Homolog: EC 1.1.1.34 3-hydroxy-3-methylglutaryl-coenzyme A reductase
  misc_feature (39)..(571): SWISSPROT Homolog: EC 1.1.1.34 3-hydroxy-3-methylglutaryl-coenzyme A reductase 3
MAMEFRPRVPPPHAGAATAGHHPRRRAAAGGEGERERVRVQAGDALPLPIRHTNLIFSALFAASLAYLMRRWREKIRASTPLHVVSLAEIFAICGLVASLIYLLSFFGIAFVQSVVSNSDDEEDYLIDARHAPAPAPTAPAPCALLGNPAAAPEKMPEDDEDIVAAVVAGTIPSYVLETSLGDCRRAAGIRREALRRITGREMDGLPLDGFDYASALGQCIEQPVGYVQLPVGVAGPLLLDGRRLYVPMATTESCLVASTNRGFKAIAESGGASSVILRDGMTRAPAARFPSARRAAELKGFLENPANFDTLATVFNRSSRFGRLQGVKCAMAGRNLYMRFTCSTGDAMGMNMVSKCVQNVLDYLQDDFPDMDVISISGNFCSDKKSAAINWIEGRGKSVVCEAVIKEEVVKKVLKTNVQALVELNVIKNLAGSAVAGALGGFNAHASNIVTAIFIATGQDPAQNVESSQCMTMLEAINDGKDLHISVTMPSIEVGTIGGGTQLASQSACLDLLGVKGPNRESPGSNARLLATVVAGAVLAGELSLISAQAAGHLVQSHMKYNRSSRDISKAAEEADRPKKC

SEQ ID NO: 4887 - DNA, 2231 bp, Panicum virgatum
  misc_feature: Ceres CLONE 1811971
  misc_feature: Encodes the peptide sequence at SEQ ID NO. 4888
agtgagcatgccgcgcgctggtgcccttctcccgctccgccccgccgccctttctcgtcgggcctcggcgcctcgccggtgcgcgcattcgtgtgcaaggagcggcgactgagctcagctccggttcgctatcctgagcggacgctgaccgcaccgccgccctctgtccatcgctgctccgagaatacatgaagtacaaggatccaaagcagcctatcaacacaagaatcaaggatcttcttggtaggatgacccttgctgaaaaaattggccaaatgacacagatagaacggcaggttgcatctgcagatgtcatgaaaaagtacttcataggtagcatcttaagtggtggtggaagtgttcctgctccccaggccagtccatcaatttgggttaacatggtaaatgaattccagagaggtgccttatcaacacgtctaggaattcctatgatttatgggattgatgctgttcacggtaataacaatgtctacaacgccaccttgttccctcacaacatcgggcttggagctacaagggatcctgacctgtaagaaggattggtgtagcaactgctcttgaagtgcgggcaacaggcattcaatatacttttgctccatgtattgcgcttggtttaggtttgcagagatccaagatgggggcgatgttatgagagctacagtgaagatcacacgattgtccagcagatgacagatattatccttggcttgcagggagagatcccagtcaatcataccaagggtgttccatatgtagccggaaaggataaagttgctgcttgtgctaaacactttgttggtgatggtgggactcataatggaataaatgagaataacactatcattgatgaacatggactgctaagcattcacatgccaccatattatgactctatcataaagggtgttgcaactattatggtgtcatactcaagcttgaatggtgtaaaaatgcatgccaaccatgagctagtcactggctacctgaaatccaaactacattttagaggttttgtgatatcagactggctaggaatagatcgtatcacctcacctcctggtgcaaactatacttattctgtgcaagctggaataaatgcggggattgacatggtcatggttccagacaattacactgaatacattgatgatctgacatctcttgtccacaagggtattgtcaatatgagcagagttgatgatgccgtgaggcgtatccttcgagtcaaatttacaatgggcctctttgagaacccattagctgaacttagctttgcaaatcagcttggaaagaaggagcatagggaattggccagagaagctgtcaggaaatcacttgttctcttgaaaaatggaaattcttccaatcagcaattcttacctcttccaaagaaagctagaaggatccttgtagctggaagtcatgctagtaacttgggctaccagtgtggaggatggtcaattcaatggatggggggcaccggggatatcacgacggggacaacaattcttgatgccataaagtccactgttgccgactcaacgcatgtcctctactctgagaatcctgacgacagtttcatgaagcataatgatttctcattcgctatcattgttgttggggagccaccttattctgaaacagtaggtgacagcactgacctcactatgctagaccctggtccagacacgatcagaactgtgtgctctgcagttaaatgtgtggtggttatcgtctctggtcgtcctgttgtgattgaaccatatgttccacttatggaagcgcttgttgctgcttggctacctggcacggaaggtcagggtgtcgctgatgtacttttcggggactatggtttcactggaaagctcccccgtacctggttcaagtctgttgaccagctgcccatgaatgtgggagatccgcactatgatccactctatcctttcggctttggtttgacaataaattcatcattgccagggttttctggtgttaacaatctgggagatacgaagcaaagagtgatttatgttgcgctgtgttctctactgtcattgatactgatcaatgatttgggtataggcgtatttcaacacccagctgcccgtatgtagtctttgtatgattattaaccatgtctaatgttgccttggttgatgatacctctgcaaaatgcggttgctgaccattaatcagtctattatttcatc

SEQ ID NO: 4888 - protein, 475 aa, Panicum virgatum
  misc_feature: Ceres CLONE 1811971
  misc_feature (94)..(238): Pfam Name: Glyco_hydro_3 Pfam Description: Glycosyl hydrolase family 3 N terminal domain
  misc_feature (1)..(212): Pfam Name: Glyco_hydro_3_C Pfam Description: Glycosyl hydrolase family 3 C terminal domain
MTDIILGLQGEIPVNHTKGVPYVAGKDKVAACAKHFVGDGGTHNGINENNTIIDEHGLLSIHMPPYYDSIIKGVATIMVSYSSLNGVKMHANHELVTGYLKSKLHFRGFVISDWLGIDRITSPPGANYTYSVQAGINAGIDMVMVPDNYTEYIDDLTSLVHKGIVNMSRVDDAVRRILRVKFTMGLFENPLAELSFANQLGKKEHRELAREAVRKSLVLLKNGNSSNQQFLPLPKKARRILVAGSHASNLGYQCGGWSIQWMGGTGDITTGTTILDAIKSTVADSTHVLYSENPDDSFMKHNDFSFAIIVVGEPPYSETVGDSTDLTMLDPGPDTIRTVCSAVKCVVVIVSGRPVVIEPYVPLMEALVAAWLPGTEGQGVADVLFGDYGFTGKLPRTWFKSVDQLPMNVGDPHYDPLYPFGFGLTINSSLPGFSGVNNLGDTKQRVIYVALCSLLSLILINDLGIGVFQHPAARM

SEQ ID NO: 4889 - DNA, 1738 bp, Panicum virgatum
  misc_feature: Ceres CLONE 1811981
  misc_feature: Encodes the peptide sequence at SEQ ID NO. 4890
aatcctactcgtaattcgtcttgtcctaggctcctagctatagattatagctcccgggaacttgttagctaccgcggtagtctcggcgttggtcagggccaaatcagcagaaggttcgacgatggcggcgccggcgctggtgctcctgccggagtggggctccggccacctcatgtccatgctcgagtcctgcaagcgcgtgctcctcagcagcggcaaggccttctccatcacgctgttcgtcatgcgcccgcccacggccgaggccacctccgaggtggaggcgcacgcgcgccgcgaggccgcgtcggggctcgacatccgcttccaccgcctccccgccgtggagccccccgcggacgccgtcggggtcgaggagttcatcgcgcggtacatcggcctccacgcgccgcacgtccgggacgccctcgccggcatggcggggcccgtcgccgcgctcgtgctcgacatgttcgccgcgccgctggtcgacgtggcgcgggacctcggggtgccctcctacgtgttcatgtcgtccacgggcgccatgctcgcgttcatgctgcacctgcccgtgctgcacgaggcggtcgccgcggagttggacgaggtggaggggggcgtggaggtgccgggcctgccgccgctgccgccggcgtccgtgccgtgccccgtggtggacaagaagagccccaactacacgtggttcgttcgcctcggcgaccgcttcatggacgccacgggcatcatcgccaacaccgctgaggggctcgagccggggcccctcgcggccgtcgccgcgggccggagcgtgccggggcgccccgcgccgccggtgtacccgatcggccccgtgctgtcgctcggcgaccgctcgccgtcgcacgagtgcgtcgcgtggctggacgcgcagccgccggcgtcggtggtgttcctctgcttcgggagcatgggctggttcgagccggcgcaggtggcggagatcaccgctgcgctcgagcggtgcggccaccgcttcctgtgggtcctgcgggggccgccttcgtccgcgacgggcgccggcgccccggacgggtcggagcacccgacggacgcgaacctcgacgagctcctcccggatgggttcgtggagaggaccaagggcaagggcctcgtgtggccgacgtgggcgccgcagaaggacatcctcgcgcacgccgccgtgggcgggttcgtgacgcacggcggctggaactcggtgctagagagcctgtggcacggcgtgccgatggcgccgtggccgctgtacgcggagcagcacctgaacgcgttcgagctggtggctgacatgggcgtggccgtgccgctgcgggtggacaggaagcgggacaacttcgtggaggcggccgagctggagcgcgcggtgcggtcgctgatgggcggcgagggagaggaggggaggagggcgagggagaaggccgcagagatgaaggccgtgtgccgggacgccgtggcggagggcgggtcgtcgcacgccgcgctgcagaggctcgccgaggcgctccacgacggcgcgtctatcccgaagcatagtgaagcccagcagcgtgcgtagctgggcagcctgtgctctgctgttgcgttgtcgcgatggtagatgccatggcagagctgctgcttcaatcttgtgatttgggttcgaaacgaaataaaacgctttttttctctgtcaaacctttaaaaaaaaaaaaaaaaaaaa

SEQ ID NO: 4890 - protein, 490 aa, Panicum virgatum
  misc_feature: Ceres CLONE 1811981
  misc_feature (2)..(144): Pfam Name: UDPGT Pfam Description: UDP-glucoronosyl and UDP-glucosyl transferase
MAAPALVLLPEWGSGHLMSMLESCKRVLLSSGKAFSITLFVMRPPTAEATSEVEAHARREAASGLDIRFHRLPAVEPPADAVGVEEFIARYIGLHAPHVRDALAGMAGPVAALVLDMFAAPLVDVARDLGVPSYVFMSSTGAMLAFMLHLPVLHEAVAAELDEVEGGVEVPGLPPLPPASVPCPVVDKKSPNYTWFVRLGDRFMDATGIIANTAEGLEPGPLAAVAAGRSVPGRPAPPVYPIGPVLSLGDRSPSHECVAWLDAQPPASVVFLCFGSMGWFEPAQVAEITAALERCGHRFLWVLRGPPSSATGAGAPDGSEHPTDANLDELLPDGFVERTKGKGLVWPTWAPQKDILAHAAVGGFVTHGGWNSVLESLWHGVPMAPWPLYAEQHLNAFELVADMGVAVPLRVDRKRDNFVEAAELERAVRSLMGGEGEEGRRAREKAAEMKAVCRDAVAEGGSSHAALQRLAEALHDGASIPKHSEAQQRA

SEQ ID NO: 4891 - DNA, 1855 bp, Panicum virgatum
  misc_feature: Ceres CLONE 1811995
  misc_feature: Encodes the peptide sequence at SEQ ID NO. 4892
atttgtcacgccgcaattcctgtcacgcacgcggtaggagctagcgcacctactggctttctcttgggatcgctgctgcaccgggaggaacgccgccgcgcgtgtcggcgctcggcggcacatgagcggctcgaaggcggcgcccggcgccgccgtgggcggcaaggcggcgcgcgcctgcgacagctgcctgcggcggcgcgcgcggtggtactgcgcggccgacgacgccttcctgtgccagggctgcgacacgtcggtgcactcggccaacccgctcgccaggcgccacgagcgcctccgcctgcgcccgacgtcgccgccgcgtcacgcggcgtccacatcggcgtcggcgtcggcatcgaagacgcgccagcaggtcacgccggggtggtccaagcgcaaggcgcgcaccaggaggccgaacgtcaagagcgtcgggcagctgctgtcgaggaagctcatcgtcgtgccggaggtgaccgtcgagtcgtcgtcgaatgagcggaaggccgaggaagaggaggcggaggaggagcagctgctgtaccgcgtgccgaatttcgaccgcgccctcgctgagctctgctcgccgctgccaatcgatgacccggcggccggagccccgtgctccagggaggacgtcgacggcaccgtggagcacacaaagaccccggtggttgcagaatcacccgtgcagcagctcccggacagctttgcgggcttcggcccgacggacgccgagctcagagagttcgcggcggacatggaagcccttctcggccaaggtctcgacgacggcaacgagcttgacgaatcgttctacatggagagcctaggactaatggcgccggcggaagacggcgggcgggtaaagatggagcccggtagcagcgtaatctcccacatcgagggttctctcgctcgtggccctgcggagctgaagccggaggaatcggcggaggtgctggacacagacttgcactgcagctcgcccacggtgatagatcacgacgaggacagcttcgaacggaaggcatcggcaagcagcggcgtcgccgcggatgcgcagttcctgaagaggagcctggatctcagactcaactacgaggccatcatcgagagctgggggagctcgccgtggaccgacggccagcgtccgaacgtccagctcgacgacttctggccccacgcccaccacccgggcgtgtggatggccgggggaggacggctgggtggggaggcgttgacgccgcggctggggatgatgggcggcgggcgggaggcgcgggtgtcgcggtaccgggagaagcggcggacgaggctgttcgccaaaaagatacggtacgaggtgcggaagctgaacgcggagaagcggccgcggatgaagggccggttcgtcaagcggccggccgccgccgccgccccatgcgccgtcacctagctagctgatgatgcgctggccggtcaggccgcgcccgtgttgccgtgcgtgccgaggtcgtcgcacttacagactgcagcacgcaggtcttgcgaggcatcacgggctcggcatgaaattacgggttcgtcagaatttgtcgaagctcctttagttagttggttcttcgttcacaacttgtgtcgatctctcccctcaatcgtttcggcatccgtgattgagggttgagacgaaggagagtgatgaacatttgtacattgctgtccacgtacccggaccccttttctttcttatgatagatagcagctcgcaaaacaaacacaaagaacacgcgtgtaaattacatgcatattgtaattaataagcaaaatgtgtacacttgcagcagcctaaaaaaaaaaaaaaaaaaaa

SEQ ID NO: 4892 - protein, 440 aa, Panicum virgatum
  misc_feature: Ceres CLONE 1811995
  misc_feature (1)..(48): Pfam Name: zf-B_box Pfam Description: B-box zinc finger
  misc_feature: The sequence is a functional homolog of  SEQ ID NO 172 in the  10/225,068 US patent application
  misc_feature: The sequence is a functional homolog of  SEQ ID NO 250 in the  10/374,780 US patent application
  misc_feature: The sequence is a functional homolog of  SEQ ID NO 274 in the  10/225,066 US patent application
  misc_feature: The sequence is a functional homolog of  SEQ ID NO 530 in the  11/435,388 US patent application
  misc_feature: The sequence is a functional homolog of  SEQ ID NO 794 in the  10/412,699 US patent application
  misc_feature: Useful for making plants with modulated growth and phenotype characteristics
MSGSKAAPGAAVGGKAARACDSCLRRRARWYCAADDAFLCQGCDTSVHSANPLARRHERLRLRPTSPPRHAASTSASASASKTRQQVTPGWSKRKARTRRPNVKSVGQLLSRKLIVVPEVTVESSSNERKAEEEEAEEEQLLYRVPNFDRALAELCSPLPIDDPAAGAPCSREDVDGTVEHTKTPVVAESPVQQLPDSFAGFGPTDAELREFAADMEALLGQGLDDGNELDESFYMESLGLMAPAEDGGRVKMEPGSSVISHIEGSLARGPAELKPEESAEVLDTDLHCSSPTVIDHDEDSFERKASASSGVAADAQFLKRSLDLRLNYEAIIESWGSSPWTDGQRPNVQLDDFWPHAHHPGVWMAGGGRLGGEALTPRLGMMGGGREARVSRYREKRRTRLFAKKIRYEVRKLNAEKRPRMKGRFVKRPAAAAAPCAVT

SEQ ID NO: 4893 - DNA, 1118 bp, Panicum virgatum
  misc_feature: Ceres CLONE 1811996
  misc_feature: Encodes the peptide sequence at SEQ ID NO. 4894
acacggcggccgtgccagtggcgcacgaggggggagatgattaaaaatgccgtggcctccctgatggtgcgcctccacctcctgccgccgccccgcgccgcgcccgcctccacctaccaccaccaccaacgcgcgctccgcctcccgcggccctcatcggcctcgctgcgccccgccgccgcctccatgtcgacgacggcggagcaggcggtcgccgaccagaagcgcgcgctgcgcaccgaggtgcgcagggcgctcaaggcactctcccccgaccagcgcgccagcgaagatctggccattcaaactacaattttgaactcctcttggttcaaagcaagcaaacggttgtgtgcttatataagctgctatcagttgcgagaagtcgatacatcaaaaatactagcagagtgtctaccatcaagtcctggacaagaggaactggcaaaggatctttatgttcctcgagtggaggataagaaccgcaatatgcggatgctcaaaatcaccaccatggatgacttggtcaaaaattcaatgaacattctggaaccatcacccgtggatgctagtggcaacgatcgtgaagatgtattgtcagcctcttcccctgttgacctttttctattgcctggacaagcgtttgacagaactggtcgaagactgggacgtggtggagggtactatgacacattcttgctgaaataccaaaaacttgcaaaagagaaagggtggaatcagcccctcttagttgctctttcatactcggtgcaaattatggaggaaggtctcatcccagtcaactcaactgatatccctattgatgctctggtctcagcttctggtattattccaataagccctgcagcactggagaggatgtaatgaagctgattggtttcttgttatgctttgacaacatgccctctttcagtattttgtgttccctggttgccctaatgatactgataaatcagcggataagggaatctgtcctctttcttgtggctttctgctgtatcattttataataatatagacacttgatttctattccttatttcagctgattaatgtaaattctccttttgaacagtcaaaaaaaaaaaaaaaaaaaa

SEQ ID NO: 4894 - protein, 282 aa, Panicum virgatum
  misc_feature: Ceres CLONE 1811996
  misc_feature (1)..(205): Pfam Name: 5-FTHF_cyc-lig Pfam Description: 5-formyltetrahydrofolate cyclo-ligase family
MIKNAVASLMVRLHLLPPPRAAPASTYHHHQRALRLPRPSSASLRPAAASMSTTAEQAVADQKRALRTEVRRALKALSPDQRASEDLAIQTTILNSSWFKASKRLCAYISCYQLREVDTSKILAECLPSSPGQEELAKDLYVPRVEDKNRNMRMLKITTMDDLVKNSMNILEPSPVDASGNDREDVLSASSPVDLFLLPGQAFDRTGRRLGRGGGYYDTFLLKYQKLAKEKGWNQPLLVALSYSVQIMEEGLIPVNSTDIPIDALVSASGIIPISPAALERM

SEQ ID NO: 4895 - DNA, 3086 bp, Panicum virgatum
  misc_feature: Ceres CLONE 1811998
  misc_feature: Encodes the peptide sequence at SEQ ID NO. 4896
atcagacgcagccgcttccctctgaaacagctgcagcagggttttaggggtagcttggtagaggcttagctgatcgattctgtcgacgaccctcgatcgtataccttccttctcgccggggtcaccgccgacgcggctttgcttcccggcgaggctttgccgcgatcccccgctgcaggcagcaagcgcagcagggccacggccatcgtcggtcgagcatacgcttccctgcctgggcaaaagatgttcttgcatacgtgctgggcttctagctaggtgtcatataagtgcctctcgccattgccactgagacgaccttgtgctgcggcctgcagtagacgagcttcagaagtttttacacctgtcgatcggagcagcagttcaagaggacaaggatgagcgggcacggcggcggcggcgacccgcaccacgaggacttccagctcaaggacacgaacccgctgctgggcgagcaatggcccaagggcgcggcgggccccgcgggcggcagcgggctcgccgggtggctgggcgtggacaagccgtccagcacctacgacctcgtggagcagatgttcttcctctacgtgcgcgtcgtcaaggccaaggacctgccgcccaaccccatcaccggcgcgcccatggacccctacgtcgaggtccggctcggcaactacaagggcaccacgcggcacttcgaccggcgcgccaaccccgagtgggaccaggtcttcgccttctccaagtcccgcgtccagtccaacgccctcgaggtcttcctcagggaccgcgagatgctcggccgcgacgactacgtcggcaaggtcaccttcgacgtcgccgaggtgcccacgagggtgccgcccgacagcccgctcgcgccgcagtggtaccgcctcgaggaccggcgcggcgagggcggcaaggtgcgcggcgagctcatgctggcggtctggatcgggacgcaggccgacgaggcgttcccggaggcctggcactcggacgccgccgccgtgcgcggcgagggcgtcgccagcgtgcggtccaaggcgtacgtgtcgcccaagctctggtacctccgcgtcaacgtgatcgaggcgcaggacgtgcagccgcagcaggcccgcgggggccgcgcgccggaggtgttcgtcaaggcgcaggtggggaaccagatcctcaagacctccgccgtgccggcgccgacgctgaacccgcggtggaacgaggacctactgttcgtcgtcgccgagccgttcgaggagcagctggtgctcatggtggaggaccgggtggcccccggcaacgacgacctcctcggccgcgtcgcgctgccgctcaagctcttcgagaagcggctggaccaccggccgttcgtgcagtcgcggtggttcgacctcgagaagttcggcgtcggcgccggcatcgagggcgagacgcggcgggagctccggttcgccagccgcgtgcacgtgcgtgcctgcctggagggcgcctaccacgtgatggacgagtccaccatgtacatcagcgacacccgccccacggcgcggcagctctggaagccgcccgtcggcgtgctcgaggtcggcatcctcggcgccgccgggctgcagcccatgaagacccgcgacggccgcggcgccaccgacgcctactgcgtcgccaagtacggtcagaagtgggtgcgcacgcgcaccatgatcggcaccttcaaccccacctggaacgagcagtacacctgggaggtgttcgacccctgcaccgtcatcaccatcggcgtcttcgacaactgccacctcggcaacaatggtggccaacagcagccggcgcgcgacggccgcatcggcaagatccgcatccggctctccacgctggagaccgaccgcgtgtacacccacgcctaccccctcatcgccctccacaagtcgggggtgaagaagatgggcgagctccggctcgccgtgcgcttcacctgcctctccctcgtcagcatgctccacctctacacgcagccgctgctgccccggatgcactacctgcacccgttcacggtgacgcagctcgacgcgctccggtaccaggccatgggcatcgtggcggcgcggctgggccgcgcggagccgccgctccggcgcgaggtggtggagtacatgctcgacgtggagtcccacatgtggagcatgcggcggagcaaggccaacttcttccgcgccgtctccctcttctcggggctcgccgcggcggcgcggtggttcggcgacgtgtgccagtggcggaacgtggcgacgacggcgctggtgcacgtgctgctactcatcctggtgtggtacccggagctgatcctccccacggtgttcctctacatgttcctgatcgggctgtggggctaccggcggcggccgcgccacccgccgcacatggacacgaagctgtcgtgggcggaggcggcgcacccggacgagctggacgaggagatggacacgttcccgacgtcgcggccgcagaacgtggtgtacatgcggtacgaccggctgcggagcgtggcggggcggatccagacggtggtcggcgacatggccacgcagggggagcggctgcagtcgctgctcagctggcgcgacccgagggcgacctgcctcttcgtcgtcttctgcctcctcgccgcggtggtgctctacgtcacgccgttccgggtggtggcgctcgtcgccgggctctacgtgctccgccaccccaggttccggagcaggctgcccgccgtgcccagcaacttcttccgccgcctgccgtcgcgcgccgacagcatgctctgatgagtctcaaggatgcatgaccccatccagtcctctccctcctgctctgaatctcaagcatgcatgctctgttcgatcgtcttcagtcaagaaagaaaatgtttccttcattccgtttgctttccttttgaatgaatttcttttttctagtgtgcaaggtgttaagtaagtttgggcaccttgagatttgaaaaagttcaggtgtaactatgttcgtctgatgaaaaacttgggcgtgatgctatgctccaaaaaaaaaaaaaaaaaaaa

SEQ ID NO: 4896 - protein, 806 aa, Panicum virgatum
  misc_feature: Ceres CLONE 1811998
  misc_feature (1)..(156): Pfam Name: PRT_C Pfam Description: Plant phosphoribosyltransferase C-terminal
MSGHGGGGDPHHEDFQLKDTNPLLGEQWPKGAAGPAGGSGLAGWLGVDKPSSTYDLVEQMFFLYVRVVKAKDLPPNPITGAPMDPYVEVRLGNYKGTTRHFDRRANPEWDQVFAFSKSRVQSNALEVFLRDREMLGRDDYVGKVTFDVAEVPTRVPPDSPLAPQWYRLEDRRGEGGKVRGELMLAVWIGTQADEAFPEAWHSDAAAVRGEGVASVRSKAYVSPKLWYLRVNVIEAQDVQPQQARGGRAPEVFVKAQVGNQILKTSAVPAPTLNPRWNEDLLFVVAEPFEEQLVLMVEDRVAPGNDDLLGRVALPLKLFEKRLDHRPFVQSRWFDLEKFGVGAGIEGETRRELRFASRVHVRACLEGAYHVMDESTMYISDTRPTARQLWKPPVGVLEVGILGAAGLQPMKTRDGRGATDAYCVAKYGQKWVRTRTMIGTFNPTWNEQYTWEVFDPCTVITIGVFDNCHLGNNGGQQQPARDGRIGKIRIRLSTLETDRVYTHAYPLIALHKSGVKKMGELRLAVRFTCLSLVSMLHLYTQPLLPRMHYLHPFTVTQLDALRYQAMGIVAARLGRAEPPLRREVVEYMLDVESHMWSMRRSKANFFRAVSLFSGLAAAARWFGDVCQWRNVATTALVHVLLLILVWYPELILPTVFLYMFLIGLWGYRRRPRHPPHMDTKLSWAEAAHPDELDEEMDTFPTSRPQNVVYMRYDRLRSVAGRIQTVVGDMATQGERLQSLLSWRDPRATCLFVVFCLLAAVVLYVTPFRVVALVAGLYVLRHPRFRSRLPAVPSNFFRRLPSRADSML

SEQ ID NO: 4897 - DNA, 2190 bp, Panicum virgatum
  misc_feature: Ceres CLONE 1812132
  misc_feature: Encodes the peptide sequence at SEQ ID NO. 4898
accgccctctcgctcgctctcctctcttcctcgcaccaccaccaccaccctcctctctttctctttccctctcctctcctcgcctcggcctcccaaaaaaaggcaccgcgccacaaggagggagggggaggacgcacggcccgcccgcctgctcgcacaccggattcggcaccgcggcggtggttgcggcggcggcggcctggcctggggctccagcgcgggagatgtcgtcgcggtcggggtccgtgggcggcgggagcgtcggcggcgggagcagcgcggggggaggcgccgcggtgccgctggccgtactgctgcggcgggaggtggccagcgagcgcaccgcgtcggagcgcccggagctgcacgcggggctcttcagccaggcgaagaagggcgaggacttcaccttcctcaagcccgactgcgagcgcctcccgggcgtcccgtcctcctcattctccgccttcggcctgtttgacgggcacaacggcaatggagccgcgattttcaccaaggagaatctcttgaacaacatcctgagcgcggtccctgctgatctcaacagggaagactggcttgctgcgctcccaagatcgctggtcgctgcattcgtcaaaaccgataaggatttcatgacaaaagcacgttcttcagggacaactgtgacatttgtcataatagatggattggtcattactgtcgcatcagttggcgattcccgttgtgtactagaagctgaaggctcaatttatcatttatcttctgatcatcgatttgatgcaagtaaagaggaggttgaccgtgtaacagaatctggaggtgatgtcggaaggctaaatgttgttggtggtgccgagattggaccccttaggtgttggcctggaggtttgtgcttatcaaggtcaattggagatcaagatgttggccaatttatcgtcccagttcctctcgtgaagcaagtaaagctatctactgcgggaggccgacttattattgcaagtgatggtgtttgggatgtcttgtctccagaagtagcttttaactgttcacgtgaacttcctccagagcctgcagctgaacaaatcgttaaaacagctgtgcaatcaaaaggactgcgggatgataccacttgtattgttgttgatataatagcagaaaaaaataattcctccatgccacttcctaaaaagcaaccaggaattggcgtcttcaaaaatatgttctgcaagaaaaaatcacccgactcgtcgtcccatgcggatagagaatatatgtatccagatattgtagaggaaatatttgaggatggatgcgcacttctttctagacggttggattctgagtatcctgttcgaaatatgttcaagcttttcatatgtgccatttgtcaagtagagttgaagccaaaccaagggatatctgtacatgaagattcatcacaacctgggagcttacgtcgctgggatggtccattcctttgccagagctgtcaagaaaagaaagaagcaatggagggaaagcgtcgttcacgagattcatcaaaaaactgtgaatagttgtcatgtaggagtgatcaggtaactactgaccaacactgccccagcgccacagattttgcagcatttccttctgttgtggcacttccttgatcacatggaatgtctgggagttctgatctagagctagagtgaagtattgaattttcatgtggaggtggctgccgttggatagttctcatcccaagtgagaagcatgccttgtcctacagcaaggttcttgcccatgaatgtaggcagctttactctccctttgaccttgatagcacatacagattgaaggtgacagaatgtcgtggctcgtgggatgtctattttaaggtcaattgctgcaatgcaaatcactcattgtatagggctctgacgaatagctacggcattgtgattctgaaataggacataggtgagcccatcccatcgatttttcacccctggccttactttagggtcgagtattatcggtccctgtttaggtccagcctttgctgacaccaatgtaattagcatctaaagaaatcatttgaaacagctgtgattcatcagcaagacatcttggttatcatgtacaatgtacagaatcttgctaacaaagacagatctgtttttctgccaaaaaaaaaaaaaaaaaaaa

SEQ ID NO: 4898 - protein, 444 aa, Panicum virgatum
  misc_feature: Ceres CLONE 1812132
  misc_feature (1)..(252): Pfam Name: PP2C Pfam Description: Protein phosphatase 2C
MSSRSGSVGGGSVGGGSSAGGGAAVPLAVLLRREVASERTASERPELHAGLFSQAKKGEDFTFLKPDCERLPGVPSSSFSAFGLFDGHNGNGAAIFTKENLLNNILSAVPADLNREDWLAALPRSLVAAFVKTDKDFMTKARSSGTTVTFVIIDGLVITVASVGDSRCVLEAEGSIYHLSSDHRFDASKEEVDRVTESGGDVGRLNVVGGAEIGPLRCWPGGLCLSRSIGDQDVGQFIVPVPLVKQVKLSTAGGRLIIASDGVWDVLSPEVAFNCSRELPPEPAAEQIVKTAVQSKGLRDDTTCIVVDIIAEKNNSSMPLPKKQPGIGVFKNMFCKKKSPDSSSHADREYMYPDIVEEIFEDGCALLSRRLDSEYPVRNMFKLFICAICQVELKPNQGISVHEDSSQPGSLRRWDGPFLCQSCQEKKEAMEGKRRSRDSSKNCE

SEQ ID NO: 4899 - DNA, 1816 bp, Panicum virgatum
  misc_feature: Ceres CLONE 1812134
  misc_feature: Encodes the peptide sequence at SEQ ID NO. 4900
acctctttcctcgccctcccgctttctctccccaattctccctcacctcgccgccttccccttgaccgccaccgttgacctcgtcttccggcgaggtagctcgccggaagaccccccgcctcgacctccccgacgcagcctcagaccctgcagccctccggaatggtcgccggcttctaactcgccagcgcctgggtctccgcttgcttcctcgacagccccatccgcctcctctcgctcccgctacggctcttctgcctgctcgccatggcgatccgcatcaccgtgtcctactccggctacgtggcgcagaacctcgccgcctcgctcggacaccgcttctcctcggcctcggcctccgccaccgggggccgcctcctccacgacggcgcctggcgccccttctgcatcttcacctccacccgccagcccgagcagcaccacagcggcggcggcggcggcgaccgccatgacggcggagaccacaaccaccccaagccccaggcgatcgccgccggagctcactcgctgctgctcacgcgggcgtgcctgacgtccaagtcgccgccgccgtctcttgccgttgggctgctgtcggttctcacgcaagggaccgggccgacggctgggatcaccggatcggcggcgtctctgtcaggctcgtcgtcgatttccctcgggttcaaccccacgtccttcctcctgttcctgcagacgtcgaagtggctcccctgcagcgaccttgccacctcgtcgtcttcggcgccctcttcccctccccgttcgccggcgccttcggtcccttccaagaaggcgttgattggtggtgccagttccagtgctggctcgtctggtcctccgggaattgcgacgagcagtggtgctagtgcagcgatgagcaggagcaagagcaactggttgtcgaggtggatgagctcctgctccgatgacgccaagacggcgtttgcagctgtgaccgtgccactcctctacggctcgtccctggccgagccgaggtccatcccgtccaagtccatgtacccgaccttcgacgtcggcgatcggattcttgccgagaaggtctcgtacatattccgggaaccggaaattttggacatcgtaatcttccgggctcccccagctcttcaggcttacggctacagctcaggggatgttttcatcaagagagttgtggccaagggaggagactacgtcgaagtgcgcgatggcaagctattggttaacggagtagttcaggatgaggattttgtgctggagccacacaactacgaattgggaccagtgcttctgccggaaggtcatgtgttcgtgctgggagacaaccgcaactacagcttcgattcccacatctggggtccgctcccagtaaggaacatcgtcgggagatctctgctccggtactggccgccgtccaagataaccgacacaatccacgactaccagcccgatgcagcgcgccacgcggtgccgtcctgatacctagtttgctccggcgacgctggagagcccatgtctacaataacatcccatggagctcgagcaagcaccagttctttttgtttctctcggaataattgtttccccgagtgttgtctgtaaattccctttcgctgactgattggtttattgcccattggcccgtgcttgtttagagcacatgtcaaaagtgtaacgccttgcaattcgcaagctagaaatgctaagtacctatatatatgtaagttaagtatataacttttactgaaaggagcatttaagctccgcgtttcttgcagaaaaaaaaaaaaaaaaaaaa

SEQ ID NO: 4900 - protein, 409 aa, Panicum virgatum
  misc_feature: Ceres CLONE 1812134
  misc_feature (1)..(78): Pfam Name: Peptidase_S24 Pfam Description: Peptidase S24-like
MAIRITVSYSGYVAQNLAASLGHRFSSASASATGGRLLHDGAWRPFCIFTSTRQPEQHHSGGGGGDRHDGGDHNHPKPQAIAAGAHSLLLTRACLTSKSPPPSLAVGLLSVLTQGTGPTAGITGSAASLSGSSSISLGFNPTSFLLFLQTSKWLPCSDLATSSSSAPSSPPRSPAPSVPSKKALIGGASSSAGSSGPPGIATSSGASAAMSRSKSNWLSRWMSSCSDDAKTAFAAVTVPLLYGSSLAEPRSIPSKSMYPTFDVGDRILAEKVSYIFREPEILDIVIFRAPPALQAYGYSSGDVFIKRVVAKGGDYVEVRDGKLLVNGVVQDEDFVLEPHNYELGPVLLPEGHVFVLGDNRNYSFDSHIWGPLPVRNIVGRSLLRYWPPSKITDTIHDYQPDAARHAVPS

SEQ ID NO: 4901 - DNA, 2054 bp, Panicum virgatum
  misc_feature: Ceres CLONE 1812245
  misc_feature: Encodes the peptide sequence at SEQ ID NO. 4902
actcatcggtcatcgccctcgctcctgctgggctgctccccttcccttcccttcccttcccttccccatcggatcgaattcgattcggaggaacaacccgtcaaatcaaatcaaatcaaaccggcgagccgcgggcggatgggatcgccggcgccagagggggagggccaggggcccgtggtcatccacgcgtggtcggcgccgcgctccctcagcaccagcctcatgtactccttcgcccagagggacgacatggaggtgcttgacgagcctctctacgccaatttcctgcgtgtcaccggcctcgacaggccctaccgcgaggatcttctgtcaaaaatggagcaggacctcgatggaaataaggttgtcaaagaagtgatatttggcccgggggagaaaacatatcgttactgcaagcacatctcaaagcaacgcctcccaaacctgtctagcgacctgatgaagaagggaaaacatttcatattgatacgcaaccctctaaatatactgccatctttagataaagtcattccaccatccttcttggagcttggtataggcgaacttgtctcaatatacagtgaattatgtgaacttgggaaggcaccgcctgtgatagatgcagatgatctgcaacaggaacctgaggctgtcttgaggggactctgtgaggatctgggcattcctttccagccacaaatgttgaaatgggaagctggcccaaaggaatttgatggtatatgggccccctggtggtataggagtgtgcacaaatctacaggtttctctaagtcccgccaatatcctttgactttcccatctgcattttatgatctccttgagcaaagcttgcctttttacaacatgctgaagcgtcaagtaaggagaacagtaggatctcatcaaccactattgcctgatcctcctctgcctgtccctgcgaataaaaaaattcttgtttgggttggagatgaacttttgccacgtgacagtgcaaaggtttcagtgtttgattcagttgtacaaggaggagatgctgtttgggaaggtttacgtatatatgatggaaaagtattcaaactagatgaacatttggatagattgtttgattcagcaaaagctatggccttcagcaatgtgcccactcgtgactggattaaggatgccatttttaagactctgattgcaaatggaatgtttgataatgctcatataaggctcacactcacccgtgggaaaaaggtaacatctggaatgagtccagctttcaatctttatgggtgcgccctgattgtgcttgcagagtggaaaccaccagtttacgataactcacatgggataaagttggtaactgccaccacacgacgaaattctcccaatagtatagattccaagatacatcacaacaatcttattaacaatattctggcaaagatagaaggtaattttgcccaggctgaggatgccattatgctagacaaggatggttttgtatcagagacaaatgcaacaaacattttcatggttaagaagggaactgtattgactcctcatgctgactattgccttccaggaattacacgcgtgactgtcatggatcttgtggtaaaagaaaatttcgtattacatgaacgacgcatcagtctgtcagaatttcatgctgcagatgaggtgtggactaccggaacaatgggtgaaattacaccggttgtaatgattgacgggcgtgaaattggtgatgggaaaataggtccagtcacaagacaaatccagaaggcatacaaaatcctgacagcagggcaaggggtaccaatacccagaaacgatgtggcataatcgtcactggggcagtccttatctagttatctaccatgaggaccaaccctcagggagcctgatggcattcatctagaacaccaataaagtaataactgccatatggcgaattggcgatgcaccagcaccatgcgtcattgttgtaccaaacaggatactgtgtattattatctacagctgaagatcatgttattcaaaaaaaaaaaaaaaaaaaa

SEQ ID NO: 4902 - protein, 566 aa, Panicum virgatum
  misc_feature: Ceres CLONE 1812245
  misc_feature (1)..(273): Pfam Name: Aminotran_4 Pfam Description: Aminotransferase class IV
MGSPAPEGEGQGPVVIHAWSAPRSLSTSLMYSFAQRDDMEVLDEPLYANFLRVTGLDRPYREDLLSKMEQDLDGNKVVKEVIFGPGEKTYRYCKHISKQRLPNLSSDLMKKGKHFILIRNPLNILPSLDKVIPPSFLELGIGELVSIYSELCELGKAPPVIDADDLQQEPEAVLRGLCEDLGIPFQPQMLKWEAGPKEFDGIWAPWWYRSVHKSTGFSKSRQYPLTFPSAFYDLLEQSLPFYNMLKRQVRRTVGSHQPLLPDPPLPVPANKKILVWVGDELLPRDSAKVSVFDSVVQGGDAVWEGLRIYDGKVFKLDEHLDRLFDSAKAMAFSNVPTRDWIKDAIFKTLIANGMFDNAHIRLTLTRGKKVTSGMSPAFNLYGCALIVLAEWKPPVYDNSHGIKLVTATTRRNSPNSIDSKIHHNNLINNILAKIEGNFAQAEDAIMLDKDGFVSETNATNIFMVKKGTVLTPHADYCLPGITRVTVMDLVVKENFVLHERRISLSEFHAADEVWTTGTMGEITPVVMIDGREIGDGKIGPVTRQIQKAYKILTAGQGVPIPRNDVA

SEQ ID NO: 4903 - DNA, 1615 bp, Panicum virgatum
  misc_feature: Ceres CLONE 1812252
  misc_feature: Encodes the peptide sequence at SEQ ID NO. 4904
cctaatccctcctgaatcgctccccgcctccatctcgcgctcgattcgaatccgaagcctcctcgcttgctgctgctgctgctgcaatggaggacacagctgtcgaggaggccgaggtgagcggcgccgcagagttcgcgccggcgcttatcgctgcccacccccacggaaactccgtcgccgtcgccatcgggcccgagctccgcgtgtttgatctcaaggctggttctccagttttgttgtcacatgattgtggtagccgttcccattcagacgctataagagctatttgctttagtctgagtggtgctttatttgcatccgctggtgatgacaaacttgtgaaggtttggaagactgattcatggcgctgcatccggactataacatcggagaagagggtcagtgcagttgctattagcaacgatgacctgtatataacctttgcagataaattcggtgttgtttggttagtcactttgggggaagatggtacagagcaggtttcagttgataacaaacctgtgtcaattcttggtcactactgtagtatcatcactagtatgaagttttcgccagatgggaggttcattgctactgctgatagggacttcaaaatacgagttacattattcccaaagaatcctctaaagggggcccacgaaatacagagcttttgccttggacatacagactttgtgtcatgcatcgccttcacaagcatgtctgaaaatcagagctttcttatatcaggaggaggtgattcaactgttcgcctgtgggactacataaatggatgtctccttgatacatgccaagtcagagacaagatgggagaactcttagagccaaatgaaacagatgatagcagtctagccattgcagatatatgtctgagtaatgatggttcattggttgctgtagctattcaaagtttcaatggtgtaatgcttttagcatgcgatgtagtagaaaagaagttatctttcctaaaggtgattacaatggaaaagagctatattcctactagcttagcatccaacttctcatcagaactcctatggattgtcatgggcgcatcaaacatgcccaaccaggcttcctcccagttattaacccgtttaaggatcattccctgcttccaaaaggatctaatatcatctgataacagtcctgcagtgcttgaagatagtgcaataccgcatggtgagaagctccttttggcgctgcaaggaagcctcgacattgcgaagcaagaagaggtcttagcttcagtgctggctgcgctgaaggtttctatgcataagatgctggtgaagaagcactactcggaagagaggagggagcagaggaaaaggggcaggaacgacaagaagatcaagaactagctcgatctctggttttcaagatccaacaagacaatagcagagttcccttgtaatgccgtgctctgtaccattagctcgatctctggttttcaagatccaacaagacaatagcagagttcccttgtaatgccgtgctctgtaccattactagtttgaaacacaggaattggatcaacaactgtgagtaaatttgtcggcggctttcttaaaaaaaaaaaaaaaaaaaa

SEQ ID NO: 4904 - protein, 433 aa, Panicum virgatum
  misc_feature: Ceres CLONE 1812252
  misc_feature: Great-hit functional homolog of the protein sequence given in SEQ ID NO 9280
  misc_feature: Useful for making plants with altered protein content
MEDTAVEEAEVSGAAEFAPALIAAHPHGNSVAVAIGPELRVFDLKAGSPVLLSHDCGSRSHSDAIRAICFSLSGALFASAGDDKLVKVWKTDSWRCIRTITSEKRVSAVAISNDDLYITFADKFGVVWLVTLGEDGTEQVSVDNKPVSILGHYCSIITSMKFSPDGRFIATADRDFKIRVTLFPKNPLKGAHEIQSFCLGHTDFVSCIAFTSMSENQSFLISGGGDSTVRLWDYINGCLLDTCQVRDKMGELLEPNETDDSSLAIADICLSNDGSLVAVAIQSFNGVMLLACDVVEKKLSFLKVITMEKSYIPTSLASNFSSELLWIVMGASNMPNQASSQLLTRLRIIPCFQKDLISSDNSPAVLEDSAIPHGEKLLLALQGSLDIAKQEEVLASVLAALKVSMHKMLVKKHYSEERREQRKRGRNDKKIKN

SEQ ID NO: 4905 - DNA, 1738 bp, Panicum virgatum
  misc_feature: Ceres CLONE 1812273
  misc_feature: Encodes the peptide sequence at SEQ ID NO. 4906
ttattacaggacgggaaaggcagctgctgctgcagccagcaccgcaggagccgcctaggaggccttgccccgcccgtctcctcctccctccgccatcacatcatcacaggcccagcagcagccatggccgcgcagcagcagcagcagcaggagctgcgctacctctccgggctgggcaacaccttctcgtcggaggcggtgccggggtctctccccgtcggccagaacagcccgctggtgtgcccgcggggcctctacgccgagcagctctccggcacctccttcaccaccccgcgggcccagaacctgcgcacgtggctctaccggatcaagccatcggtgacccacgagcccttccacccccgcagccccgcccacgcccgcctcgtcggggagttcgaccgctccaccgccgccgccacgcccacgcagctgcgctggaggccgcccgaggtgcccctggacccgcccctcgacttcatcgacggcctctacaccgtctgcggcgccgggagctccttcctccggcacggatacgccgtccacatgtacgctgctagcaagtccatggacggatgcgccttctgcaacgcggatggtgatttcctcattgttccccagcaaggaaggttgttgatcacaaccgaatgtggaaagatgctagtttcacctggcgaaattgttgtgattcctcaaggcttccgctttgccatcgacttgcctgatggcccctcacgaggctatgtttctgagattttcggcacccactttcagctccctgatcttggcccaatcggtgccaatggtttggcttcaccaagggatttcctttcccccacagcatggttcgagcaggtccaccgccctggatacacaatagtgcacaagtatggtggtgaactattcactgccacgcaggatttttctccgttcaatgtggttgcatggcatgggaattatgtcccatacaagtatgatttgagtaggttctgcccatttaatacggtcctatttgatcatggtgatccttcagtcaacacagtccttactgcgccaactgataagcctggcgtcgcattacttgactttgtaatattcccaccaaggtggttggttgctgaaaatacgttccgtcctccatactaccatcgcaactgcatgagtgagttcatgggcctgatttatgggatatacgaggccaaggctgatggttttctccccggaggtgctagccttcacagctgcatgacaccacatggaccagacaccaagacatacgaagcgacgatcagccgtgctgatgccaatgagccattcaggctcagcggtacgttggcgttcatgttcgagtcttcgctcatccctcgtgtgtgcaggtgggctcttgattcgccgtgccgagaccttgattactaccaatgctggattggattgaagtcgcacttctcacatgacactggagccacagcgagcgagcctgctgcaagtgcggatgagaaagattagctagccagccagccagcttatactatcccgtagtcgtgttgtgtaaaaggcagaataatctgtatgtaataataagatgcagtctgtagaatagaatataacagaagcaagcagttagcatctgcaggtaggtaggtaggtaggtagattgcacataagaatgattgatgttttatgtctgatgaagtaagcaaggaagcaagcattgggtcaaaaaaaaaaaaaaaaaaaa

SEQ ID NO: 4906 - protein, 460 aa, Panicum virgatum
  misc_feature: Ceres CLONE 1812273
  misc_feature (1)..(432): Pfam Name: HgmA Pfam Description: homogentisate 1,2-dioxygenase
  misc_feature (1)..(455): SWISSPROT Homolog: EC 1.13.11.5 Homogentisate 1,2-dioxygenase
  misc_feature (2)..(452): SWISSPROT Homolog: EC 1.13.11.5 Homogentisate 1,2-dioxygenase
MAAQQQQQQELRYLSGLGNTFSSEAVPGSLPVGQNSPLVCPRGLYAEQLSGTSFTTPRAQNLRTWLYRIKPSVTHEPFHPRSPAHARLVGEFDRSTAAATPTQLRWRPPEVPLDPPLDFIDGLYTVCGAGSSFLRHGYAVHMYAASKSMDGCAFCNADGDFLIVPQQGRLLITTECGKMLVSPGEIVVIPQGFRFAIDLPDGPSRGYVSEIFGTHFQLPDLGPIGANGLASPRDFLSPTAWFEQVHRPGYTIVHKYGGELFTATQDFSPFNVVAWHGNYVPYKYDLSRFCPFNTVLFDHGDPSVNTVLTAPTDKPGVALLDFVIFPPRWLVAENTFRPPYYHRNCMSEFMGLIYGIYEAKADGFLPGGASLHSCMTPHGPDTKTYEATISRADANEPFRLSGTLAFMFESSLIPRVCRWALDSPCRDLDYYQCWIGLKSHFSHDTGATASEPAASADEKD

SEQ ID NO: 4907 - DNA, 1531 bp, Panicum virgatum
  misc_feature: Ceres CLONE 1812284
  misc_feature: Encodes the peptide sequence at SEQ ID NO. 4908
agtgttagctccgcaccacgcgcggagagggcagcagtggccgcggctgcgattaacgccagacagataggtggtagaggaagaaagggggagaggggaagggccagcgagagctagctgagagggcagctgcaagtgtatagcttgtaggcaatgaggtcgagggcgccgtcgttgcggcgaagcgtggttgcggcggccgtagtggcgctgacggcggcgtggtgcgcggcggcgcagctgagccagagctactacgcgtcgacgtgccccaacgtggacaccctggtccgcggcgccgtcacccagaagctgcaggagaccttcaacgccgcgccgggcacgctgcgcctcttcttccacgactgcttcgtcaggggctgcgacgcgtcggtgctgctgtcgggccccgacgacgagcacagcgcgggcgccgacacgacgctgtccccggacgcgctggacctcatcacccgcgccaaggccgccgtcgacgccgacccgcgctgcgccaacaaggtctcctgcgccgacatcctcgcgctcgccgcccgcgacgtcgtctcgcagacgggcgggccgtactacccggtggagctgggccggctggacggcaaggtgggcacgcgcgccgtggtgaagcacagcctccccggcgccggcttcgacctcgaccagctcaacaagctcttcgccgccaacggcctcacccagaccgacatgatcgcgctctcaggtgggcacacgatcggcgtgacgcactgcgacaagttcgtgcggcgactgtacccgttcaagggcggcgccggcgccggcggcggcccgccgatgaacctctacttcctgcggcagatgcggcagacgtgcccgctcaactacagcccgtcggcgttcgcgatgctggacgccgtgtcgccccgcaagttcgacaacggctactaccagacgctgcagcagatgaagggcctgctggcctccgaccaggcgctcttcgccgaccgccgctcccgcgccaccgtcaactacttcgccgccaaccagaccgccttcttcgacgccttcgtcgccgccatggccaagctcggccgcgtcggggtcaagaccggctccgacggcgagatccgccgggtctgcaccaaggtcaactagctacctacctgcagctggatcgatcttcaccgccgtacatcactggctatactagaaaggttgtctgagaagaatgcccaccatgtccatgtccatgccgagtcccaagagtccatgatcacagtcacagtgtattaattcgttaatccgccgattctttcctcgattgtgtatgtagtaaaaatcatgtaacaagaagaggtagccccatacagtacggtcttagaataaatattttcagctcatggcctacccaccatgtgaatgtgataggaaaagaaggtactactatacttaccacatcgatgtaaatgccccaattggtccggttagttgatcaagtatatgcccaccttccttttaaaaaaaaaaaaaaaaaaaa

SEQ ID NO: 4908 - protein, 331 aa, Panicum virgatum
  misc_feature: Ceres CLONE 1812284
  misc_feature (1)..(249): Pfam Name: peroxidase Pfam Description: Peroxidase
  misc_feature (11)..(331): SWISSPROT Homolog: EC 1.11.1.7 Peroxidase 16 precursor
  misc_feature (25)..(331): SWISSPROT Homolog: EC 1.11.1.7 Peroxidase 45 precursor
MRSRAPSLRRSVVAAAVVALTAAWCAAAQLSQSYYASTCPNVDTLVRGAVTQKLQETFNAAPGTLRLFFHDCFVRGCDASVLLSGPDDEHSAGADTTLSPDALDLITRAKAAVDADPRCANKVSCADILALAARDVVSQTGGPYYPVELGRLDGKVGTRAVVKHSLPGAGFDLDQLNKLFAANGLTQTDMIALSGGHTIGVTHCDKFVRRLYPFKGGAGAGGGPPMNLYFLRQMRQTCPLNYSPSAFAMLDAVSPRKFDNGYYQTLQQMKGLLASDQALFADRRSRATVNYFAANQTAFFDAFVAAMAKLGRVGVKTGSDGEIRRVCTKVN

SEQ ID NO: 4909 - DNA, 2733 bp, Panicum virgatum
  misc_feature: Ceres CLONE 1812295
  misc_feature: Encodes the peptide sequence at SEQ ID NO. 4910
aatccccattcctcccccaacccccttccctccttcgccctcgaggctttgggctcgtccatctccggccaaatctggaagcagcgacggcaccccgaggccgtcgcacccccgcgctccttgtcccggcacccgacgctttcctcccgcagcccgatccggagcggagcggctaccgctgtccaaatcgagccacctgcgcccgtcgggggagaagcagggtgcgcatccagcctctccgctgagccgttcaaaaggatccattttctctcccgtcggcggcgtgggagggagccggtgaggggattgcgaagctagaagcccaaaacgccgactgccgagccaccgcgcacgctactgcaggcagataaagacgatggatgtggtgtttgtctccctttgccgtatgtgaagacccgctgtgtaggtgacatcaagatatggtgatgcggaagaggtcggattatggatcccgtggccgccgagtcgcaaccatgccacgtgttccaaattcagctcgggggaaacgcaccaccaggaaaaagaaagatgagatgtgcgcatttgatttgcttgccaccgttgcaggaacattattggcagatcaggacaattcagccaatgctcctaatactagtggtgcagcaaaagctaaaaacgagaaagcagctaaagaagaaccacatgatgaaattccgcccctaaaaaacacggttatggagaaagattgctgcagtggatgtgtagtgggttctggtggtatctgttcctttcctaggcaagctaacaactgcttggcagaaaactcgtcgacaagaaacgaagctggatcaatattagagtcactaacagtgaaatcaaatatgttagttagggattcgttggttagttgtacaagaccatgtgaaactagccgtggtcttggcataattcctgagtttggagctcatggaatatgccatccaggatcctcaggttcagcagaagctgaacaagtgcaccaggctgaatctaatgtggtcaggagacaagcagatgggcatgctccggctcttcatagtttgtttaactccgtggatctggatggtagacctcctgctttggttagctctgacagtagctcgtgtgttcctctgtgcagccatgacaaggaacatcaaacctcttccttgtgtcggggtgaagtgcagtatactgcagacaaagacgatgatgaaaattcttctgggtgcacggatccaagcaccataggggataagggttacaagccacaatatctaggtaaccataggataaggaaattgcttgcctcgaaggtaaggaaggcagcacgtaataagatatgtggaggtattcgatcaaaaaagatttgtggagggatgtccaacaaaggtagcaagttaaatttatgcagcaaaaaaatacctgccacacgtcaaaaggggcaaaggacgatattcaagaagaaaaaactagcgcatcgtgcaacgtcatttgctaaacaaatgccaactgaagccagcgcgacatctatggaaggtcgaaataaatcatgcggatctgacgattaccatgttaagctaagaataaagtcattcaacatcccagaattgttcatcaatgtccctgaaaatgcaaccattggttcattgaagagaactgttatggatgtcgtcaatagtataatgcaaggaggtctacgcgttggtgttcttcttcaaggaaaggatatccaagatgacaacaagacacttcgtcaagctgggatatgccatgataaaaaactaaataacatagactttacactggaatgtgaaagtgggcaagattctccctctcgagtcttaatacctgaacagatggatttactcagtgcagatgttgtggagccattagctaggatgaagtgcgaagagcattttcctgagactggtggcgatgacacccagcagcgaatacctccttaccgaagccgctctctctctgatctgtattctgttgttcatcctgttgagatggcttcacaagatacatcagcaagttcccaagccattgtccctgttgcaccttcagaagatggtgctctagctattgtgcctctttgtaagcccaggccgtctgacatcggtctaaggcgcactaggaggcccttcactgttggcgaggttgaggcgctggtggaagctgtcgaactgattgggactggaaggtggagagctgtgaaaatgcatgcatttgaccatgtggaccacaggacatatgttgatcttaaggacaagtggaagaccttagttcacactgcaagtatatccccacaacaacgaagaggcgagccagtcccacaagaactcctggaccgcgtgctcacagcgcaggcctactggtcccagcagcaggcaaagctccaggacaagcctcgtggcaaggctgcgcttcctgagatctgccctgcctaggaatggaagcggtcgttgttgtaaatactgttcctaatagaaacaaggtagaagggatgtccaaagaaatcagactaatttgcgtgctattgcaaacttacaacattgctttgctttttcgtgctctgttgtttggtctctgttcaagccaggggttgtatctcctgctctatgggtaaataagggagagagccttgtttggcacttgtaaatgctgtcacagactgttgctatgtttcataaagaaaacctttgacaaaaaaaaaaaaaaaaaaaa

SEQ ID NO: 4910 - protein, 671 aa, Panicum virgatum
  misc_feature: Ceres CLONE 1812295
  misc_feature (1)..(51): Pfam Name: Myb_DNA-binding Pfam Description: Myb-like DNA-binding domain
MVMRKRSDYGSRGRRVATMPRVPNSARGKRTTRKKKDEMCAFDLLATVAGTLLADQDNSANAPNTSGAAKAKNEKAAKEEPHDEIPPLKNTVMEKDCCSGCVVGSGGICSFPRQANNCLAENSSTRNEAGSILESLTVKSNMLVRDSLVSCTRPCETSRGLGIIPEFGAHGICHPGSSGSAEAEQVHQAESNVVRRQADGHAPALHSLFNSVDLDGRPPALVSSDSSSCVPLCSHDKEHQTSSLCRGEVQYTADKDDDENSSGCTDPSTIGDKGYKPQYLGNHRIRKLLASKVRKAARNKICGGIRSKKICGGMSNKGSKLNLCSKKIPATRQKGQRTIFKKKKLAHRATSFAKQMPTEASATSMEGRNKSCGSDDYHVKLRIKSFNIPELFINVPENATIGSLKRTVMDVVNSIMQGGLRVGVLLQGKDIQDDNKTLRQAGICHDKKLNNIDFTLECESGQDSPSRVLIPEQMDLLSADVVEPLARMKCEEHFPETGGDDTQQRIPPYRSRSLSDLYSVVHPVEMASQDTSASSQAIVPVAPSEDGALAIVPLCKPRPSDIGLRRTRRPFTVGEVEALVEAVELIGTGRWRAVKMHAFDHVDHRTYVDLKDKWKTLVHTASISPQQRRGEPVPQELLDRVLTAQAYWSQQQAKLQDKPRGKAALPEICPA

SEQ ID NO: 4911 - DNA, 1699 bp, Panicum virgatum
  misc_feature: Ceres CLONE 1812355
  misc_feature: Encodes the peptide sequence at SEQ ID NO. 4912
atggattcatccatggggcggagctccgtgagtcttctggttgggctcctggtgctgcggttcaacaggtgcttggcggtggacggcggaggcggggcgtttccgctggtggtgagcacctggccgttccgggaggcggtcagggcggcgtgggatgtggtctcggccggtgacggagggggttcggccgtggacgctgtcgtcgccggctgctccgcctgcgaggtgctccgctgcgatgggacagttggtcctggtggaagtccagatgagaatggtgaaactacgctagatgctcttatcatgaatggggtaacagttggtttgcctacttgccaaattacatattgatattttgtttcagcattcatagtggatgtgatacaccacactatttttgcttaaggaaactggcaggcaacaatggaaattggagctgtggctgccatgagatatgttaaggatggaattaaggcagcaaagttggtaatggagcacagcttgcatactctgcttgttggcgagaaggcaacagactttgcaatttcaatgggccttccaggaccaattaatctaagttctccagagtcacttgagaaatgggcaaactggagacagaatcactgccaacccaacttctggaaaaatgttgctcctgccggtagctgtggcccatatcgtcctatcaatttagcacgagcttcggactctgtaaagcatgaggtagaacagaatcaaggaggtgtttgccaggagtggttccaaagtgatagtttactggagccaataaactcccatttgaagtttattgatcaccacaaccatgacactatctctatggcggtgattgacaagatgggtcatatagctgttgggacatcaaccaatggtgctacatttaaaattccaggaagggtcggtgatggaccaataccaggatcttcttcatatggtgatgatgaggtcggagcttgtggagcatctggcgatggtgatattatgatgcgcttccttccatgttatcaagtggtcgagagcatgagacgaggaatggaacctcgggacgccgccatggatgctatatcaagaattgccagcaaattcccaaatttcgttggtgctgtatttgcagtcaacaagaaaggagtgcatgctggggcatgccgtggttggacattccagtactcggtaaggaattccagcatgcatgacgtggaggtcattacagtatatccttagcggtggcggttcctggaaatcaaaagctcgcttcgtcggcattcagagtatttcactcgtggtgatggacattattttcttcattgatgctcactgatgatgtagcaatgttctgtgttgattgttccgatagtattgttaagccgattgttctgaaactgggaccttattatatgtagcgcattgaccctagttgtgttttaaagtcattgaaaggaggcctccaaacccctcttccattggatctgccctgtttcagagtttgattatagaaaagttagaattgcatatagtcaacttcatcacccagaccggctatcatgtattcatgtttaatgtaatagttgggccgtgtttagttccaaaaatcaaaattccaaaaaaaaattctggcacctgtatggagacataaatctagatgaaataaaaaacacattgcgaaaaaaaaaaaaaaaaaaaa

SEQ ID NO: 4912 - protein, 271 aa, Panicum virgatum
  misc_feature: Ceres CLONE 1812355
  misc_feature (93)..(359): Pfam Name: Asparaginase_2 Pfam Description: Asparaginase
MEIGAVAAMRYVKDGIKAAKLVMEHSLHTLLVGEKATDFAISMGLPGPINLSSPESLEKWANWRQNHCQPNFWKNVAPAGSCGPYRPINLARASDSVKHEVEQNQGGVCQEWFQSDSLLEPINSHLKFIDHHNHDTISMAVIDKMGHIAVGTSTNGATFKIPGRVGDGPIPGSSSYGDDEVGACGASGDGDIMMRFLPCYQVVESMRRGMEPRDAAMDAISRIASKFPNFVGAVFAVNKKGVHAGACRGWTFQYSVRNSSMHDVEVITVYP

SEQ ID NO: 4913 - DNA, 1261 bp, Panicum virgatum
  misc_feature: Ceres CLONE 1812400
  misc_feature: Encodes the peptide sequence at SEQ ID NO. 4914
acgggtgcagtgcggacgagcgtaaagacctagtagcatggcgtccatggcagcgctgctggccctgttcctgctcgcggcgttcgcagtgagcggcggcgtccaggcgcagccgcttgtgccggcggtcatctccttcggcgactcgaccgtcgacgtcggcaacaacaactacctcccccgcgcggtgttcaaggccaactacgcgccgtacggggagagcttcgcaggccacgagcccaccggccggttctccgacggcaagatcgtcaccgacatcaccgctgacacgctgggcttcgagagctacgcgccgccgtacctcagcccgcaggcgtcggggaagaacctgctcatcggcgccaacttcgcctcggcggcgtccagctaccacgacgacacggcggccatgtatgacgcgatcacgctgacccagcagctcgagtactacaaggagtaccagtccaagctgaccgcggtggccgggcgcggcacggcgcgctccatcctctccggcgcgctgtacgtcgtcagcaccggcaccggcgacttcctccagaactactaccacaacgcctccctgtcccgccgctacaacgtcccccggtactgcgacctcctcatcggcatcttctccgacttggccgagaagttgtataagctgggggcgcggcggatcggcgtcacgtccatgccgccactggggtgcttcccggcgtccatcaggctgtacggcaagggccgcagcgcgtgcgtggctaggctcaaccgcgacgccgacaccttcaacaggaagctgaacgccaccgtcaaggtgctcaaggggcggcacgccgacctcaagatagccatcttcgatatctacacgcccctccggaagcttgccgaagcgccggtggagcaaggcttcgctaacgcgagggggacgtgctgccggacgggcacggcgaagacgagggtgtacctctgcaaccccacgacagccgggacgtgccggaacgccagcagctacgttttcttcgatggcgtccacccgtcggaggctgccaacgtctttatggcggagtccatggtcgaagccggcatcgacctggtcacctagtaatggcgtcaataaacaagagcgctatatagcagctgcaggtgctgcaaaacaaggcaggccatatccatgcatgtgttgctgcttatcggtttcctgttccgtccgggaaaaaactgcagtatactgttaatctgttaaaaaaaaaaaaaaaaaaaa

SEQ ID NO: 4914 - protein, 354 aa, Panicum virgatum
  misc_feature: Ceres CLONE 1812400
  misc_feature (1)..(314): Pfam Name: Lipase_GDSL Pfam Description: GDSL-like Lipase/Acylhydrolase
MASMAALLALFLLAAFAVSGGVQAQPLVPAVISFGDSTVDVGNNNYLPRAVFKANYAPYGESFAGHEPTGRFSDGKIVTDITADTLGFESYAPPYLSPQASGKNLLIGANFASAASSYHDDTAAMYDAITLTQQLEYYKEYQSKLTAVAGRGTARSILSGALYVVSTGTGDFLQNYYHNASLSRRYNVPRYCDLLIGIFSDLAEKLYKLGARRIGVTSMPPLGCFPASIRLYGKGRSACVARLNRDADTFNRKLNATVKVLKGRHADLKIAIFDIYTPLRKLAEAPVEQGFANARGTCCRTGTAKTRVYLCNPTTAGTCRNASSYVFFDGVHPSEAANVFMAESMVEAGIDLVT

SEQ ID NO: 4915 - DNA, 2008 bp, Panicum virgatum
  misc_feature: Ceres CLONE 1812406
  misc_feature: Encodes the peptide sequence at SEQ ID NO. 4916
agtcctcctctccattttctcctcctcccatttttacgtttaggcccctgggggagcagggaatccggccccggtccctctccccggctctcccgcctcgcagctccgatcgaggctgcagcgtcgggcatgggaaatcagtgccaaaatgggacctatggaaacaagtacagcagttacaaccgatatcagaatgagtgtttggcttcaaggtacaatgatggggacgatactgaggattgcttctcaggatcatctaggtccagtatcgccgatcttatgcagcaagggctgagacgaacgttaacatccatctccgtccttggtcaaaagactcctaatgttacagagcattatacccttggccggaaacttggagatggcaaatatgggacaacccacctctgcactgagatcagcactgggtgtcagtatgcatgcaagtccatcctgaagaagaagtttgtcaacatgcaagatattgaggatgtgcgccgcgagatccagataatgcactatctttcaggacaaaagaatatagtcaccatcaaggatgcatacgaggatgcagaggccgtgcacatcgtcatggagctctgtgaaggtggtgagctatatcaccggattattaaggggaattacagtgagcagaaggctgcagagcttatgaaaattattgttggaatcatagagaactgccattcacttggggtcatgcaccgggatctcaagcctgaaaacttccttttacaggataaagatgatgacttgtcgataaaagtaatcgactttggtctctctgtgttcttcaaaccaggagaggttttcactgaagtagtgggaagcccatattacatagctccagaggtactgcagaaccattatggaccagaggctgacatatggacagctggagtgatactctatgtattgctaagtggagtgccaccattttgggcagatacacggagaggagtatatgacaaaattcaggttgggcattttgatttagaatcagaacagtggcagaggatatcaaacagcgcaaaggatcttataagaaaaatgctctgcccttgcccgtcagagcgattaaaagcccatgaagttctaaagcatccctggatatgtgataatggagtggctactgatcaaactggagatctaactgtttctcgtcccaacaatttatctgcaacgaataagttaaagaaattagctcggcaggttattggtgagcatatttcagagcaggagactgctaggttaagagaaatgttcaaggcaatggacaccgaaaacagaggcatgattagtttgggtgagcttaaagaagggttgagaagatgctgctcagtgtttaatcgtactgaaatcaatggtttaatggatgcgcctgagagcaacaacaccatcagtatccattgggaggagtttattgctgccacagtaccccttggtaaaatagaacacaaagaacacttgatgcctgcctttacatactttgacaaagatggaagtggttatatcactgtcgacaagcttcaaaagcctcaagtggaacaaaacatggaagatgctttccttgaagacataattttggaggttaatcaaaacaatgatggccagaccaactattctgagtttgccacaatgatgcaaagcaacaactctggacttgggtggcaaacaatggaaagcagcttgaatgtacccctgagggaggcacctgaagtttactgattttctgctgcgcaaagataccgttctcttcagctcgtcatggggttcctcactaccctttggcaaagctatgtgaatccaggagaagagaacacagtctgaatagtggggcagtggtcaaagactggctaataatgtctataacatactggtagtagtataggcgtgtgttctatgagaacaaatctgtggttgtcatatatgtatcagtgattggtttgtttggttgctaccctgctatctaataatagatttaatagtatgt

SEQ ID NO: 4916 - protein, 537 aa, Panicum virgatum
  misc_feature: Ceres CLONE 1812406
  misc_feature (1)..(537): SWISSPROT Homolog: EC 2.7.11.1 Calcium-dependent protein kinase, isoform 1
  misc_feature (1)..(537): SWISSPROT Homolog: EC 2.7.11.1 Calcium-dependent protein kinase, isoform 11
MGNQCQNGTYGNKYSSYNRYQNECLASRYNDGDDTEDCFSGSSRSSIADLMQQGLRRTLTSISVLGQKTPNVTEHYTLGRKLGDGKYGTTHLCTEISTGCQYACKSILKKKFVNMQDIEDVRREIQIMHYLSGQKNIVTIKDAYEDAEAVHIVMELCEGGELYHRIIKGNYSEQKAAELMKIIVGIIENCHSLGVMHRDLKPENFLLQDKDDDLSIKVIDFGLSVFFKPGEVFTEVVGSPYYIAPEVLQNHYGPEADIWTAGVILYVLLSGVPPFWADTRRGVYDKIQVGHFDLESEQWQRISNSAKDLIRKMLCPCPSERLKAHEVLKHPWICDNGVATDQTGDLTVSRPNNLSATNKLKKLARQVIGEHISEQETARLREMFKAMDTENRGMISLGELKEGLRRCCSVFNRTEINGLMDAPESNNTISIHWEEFIAATVPLGKIEHKEHLMPAFTYFDKDGSGYITVDKLQKPQVEQNMEDAFLEDIILEVNQNNDGQTNYSEFATMMQSNNSGLGWQTMESSLNVPLREAPEVY

SEQ ID NO: 4917 - DNA, 2200 bp, Panicum virgatum
  misc_feature: Ceres CLONE 1812425
  misc_feature: Encodes the peptide sequence at SEQ ID NO. 4918
ccccaaatccaccgctccgtccaagcggcctagccctaaccccaacctcgcccggcgatggccgccaccgcggccgcctcggtggcggtggcggcgaattccgacgaggacgacaactacgaggagtacatcccggtggccaagcgccgggccatggaggcggagcgcctccgccagctccgcctctccaagccggcgccgtcatccgccgcagcctcctccctcccgctgccgcctcccccgcccctgccgccggcgccgcagccctccgcccccgacgccgccgccaagcccagcctcctcgtcaaggccacgcagctcaagcgcgcggccccggaggtgaccgccacggagcagcgcatccagcaggagaaggaggtgatcgacaacctctccgacggcaagtccctcaggtccgtccgcgagatcgccaagggcatcgtctacaaggatccgatcgagaccgggtggaagccgcccctccgcctccgccgcatgccgctcgccaaggccaacgagctccgccgcaagtggcacatcatcgtcgacggcaacgacgtaccgccgcccgcgcgggacttccgcgacctccgcctcccggagcccatgctccggaagctgcgcgagaggggcatcgtccagcccacgcccatccaggtgcaggggctgcccgtggttctctccgggcgcgacatgatcggcatcgccttcacggggtcggggaagactctggtgttcgtgctgccgcttatcatggtggcgctgcaggaggagatattgatgccgattgtgcctggggagggcccgtttgggatgatcatctgcccatcacgggagctggccaagcagacctatgacgtgattgaggagttcctccttccacttaaggacgctgggtacccggagataaggcctctgctttgcattgggggtgtggatatgaggacgcagctggatgtgttgaagaagggcgtgcacattgtggtggcaacgcctggccggctcaaggatttgcttgccaagaaaaagatgaatctcgataactgcaggtacttaaccttagatgaagcagataggctggttgatttgggatttgaggatgacatcaaggaggtttttgaccatttcaagtatcaaaggcagacccttcttttttctgctactatgccccagaagattcaaaattttgcgaagaatgcccttgtgaaaccagttactgtcaatgtggggagagctggagcagcaaatcttgatgtcattcaagaagtcgagtatgtcaaggaagatgccagaattatatacctccttgaatgcctccaaaagactccaccgcctgttctcatcttctgtgaaaacaaggctgatgtcgactacattcatgagtaccttcttctaaagggagtggaggctgttgcgatccatggaggaaaagatcaagaggaaagacagaatgcaattgactccttcaagtctgggaagaaggatgttctggtggctactgatgttgcatcaaagggtcttgatttccctgacatccagcatgtcatcaactacgacatgcctgctgaaatagagaactatgtccaccgaatcggtcgaacaggtcgatgtggtaagactggcatagcaactaccttcatcaacaagaaccaaaccgagaccacgcttctcgatctcaagcacctgctgaaggaggcaaagcagaggattccaccggtgttggcagagctcaatgacccattggaggatgaggaaataattgccaaggagagtggtgtcaagggatgtgcatattgtggtgggcttggtcatcgtgttggtgactgtccgaagcttgagcaccagaagtccatggcaattgcaggctcgaggaaagactactttggtggcgggggctacagaggagaaatatgattgctctaggttggtgcttgtgtatggtacttagaagctaagatgtggcaactcgagctcaatcatgttatccatataaagctagcctgcctcaccattgagggaagacagtttgcacgaccaaatttacgatatgctggatatcatgctgcttgctaggcaggataagcttgtagaagaagataaccctcttgtaaaatgtaactggaagagaactgttttgtggcatatgtttcttaaagtaatttctttatatgcaccagttcaaaaaaaaaaaaaaaaaaaa

SEQ ID NO: 4918 - protein, 618 aa, Panicum virgatum
  misc_feature: Ceres CLONE 1812425
  misc_feature (1)..(77): Pfam Name: Helicase_C Pfam Description: Helicase conserved C-terminal domain
  misc_feature (1)..(181): Pfam Name: DEAD Pfam Description: DEAD/DEAH box helicase
MAATAAASVAVAANSDEDDNYEEYIPVAKRRAMEAERLRQLRLSKPAPSSAAASSLPLPPPPPLPPAPQPSAPDAAAKPSLLVKATQLKRAAPEVTATEQRIQQEKEVIDNLSDGKSLRSVREIAKGIVYKDPIETGWKPPLRLRRMPLAKANELRRKWHIIVDGNDVPPPARDFRDLRLPEPMLRKLRERGIVQPTPIQVQGLPVVLSGRDMIGIAFTGSGKTLVFVLPLIMVALQEEILMPIVPGEGPFGMIICPSRELAKQTYDVIEEFLLPLKDAGYPEIRPLLCIGGVDMRTQLDVLKKGVHIVVATPGRLKDLLAKKKMNLDNCRYLTLDEADRLVDLGFEDDIKEVFDHFKYQRQTLLFSATMPQKIQNFAKNALVKPVTVNVGRAGAANLDVIQEVEYVKEDARIIYLLECLQKTPPPVLIFCENKADVDYIHEYLLLKGVEAVAIHGGKDQEERQNAIDSFKSGKKDVLVATDVASKGLDFPDIQHVINYDMPAEIENYVHRIGRTGRCGKTGIATTFINKNQTETTLLDLKHLLKEAKQRIPPVLAELNDPLEDEEIIAKESGVKGCAYCGGLGHRVGDCPKLEHQKSMAIAGSRKDYFGGGGYRGEI

SEQ ID NO: 4919 - DNA, 2588 bp, Panicum virgatum
  misc_feature: Ceres CLONE 1812522
  misc_feature: Encodes the peptide sequence at SEQ ID NO. 4920
aacggcactgacgcacgagaccggcctccatggcgacggccaccgcgctctccacctctctcccgcacctcccgccccgccgcgtcacgtcattcccctccgccgccgtatccctcccatcccgggcctctcggctgcgggagtcacgccgcgcggccgcggccccgacagcctccgaggtcctcgactccaccaacggcgccgtccccgccgcggcaaagagcgccgcggcgcgcgggtacgggagggagtacttccccttggctgccgtcgtcgggcaggatgctatcaaaactgctctgctgcttgaggcgattgatcgtgagattggaggcattgccatctcagggaagcgtggaacagcaaagacagtgatggctcgtggcttgcatgctatgcttccacccatcgaaatggttgttggctccatagcaaatgctgaccctaacttcccagatgaatgggaggatggtctagctgatcgacttcaatatgatgctgatggtaatgtcaaaaccgagattgtcaaaacaccttttgtgcagatcccacttggtgtgacggaggataggcttattggatcagttgatgttgaagcatctgtgagatcagggactaccgtgtttcaacctggccttcttgctgaagctcatagaggtgttctttatgttgatgagataaatctattggatgatggcataagcaatctacttctgaatgttttgacggagggagttaacattgtggaaagagagggcattagctttcgtcatccctgcaaaccacttctaattgctacttacaacccggaggaaggatctgtacgtgaacacttacttgatcgtattgcaattaatttaagtgctgatcttccaatgagttttgatgatcgtgttgcagctgtggatattgcaacacagtttcaggagtctagcaaagaggttttcaaaatggtggaagaagagactgaagttgcaaaaactcagataattttggcgagagagtatctgaaggatgtcaatattagcacagagcagctcaaatatcttgtcatggaagctatacgaggtggttgtcaggggcaccgtgctgagttgtatgctgctcgagtggcaaaatgccttgctgctatggaaggacgtgaaaaagtatttgtggatgacctcaagaaagctgtagagttagtcattctacctcgctcaatcctagctgataacccacaagatcaacagcaagaacaaccaccccaaccaccacccccaccccctccagaaaaccaagattcttcagaagaccaagatgaggaagaagaggacgatcaagaggatgacgaggaagaaaatgaacaacaagatcagcagatacctgaggagttcatatttgatgctgaaggtggtttagtagatgataagctccttttctttgctcagcaagcgcaaagacggcgaggaaaagctgggcgagcaaagaatgtcatattctcagaagataggggtcgatacataaagcctatgcttccaaagggtccagtaaggagattagctgttgatgccacgcttagagcagctgcaccgtaccaaaaactgcgcaaagcgaaagaaagcgacaaggcaagaaaggtttttgttgaaaagactgacatgagagccaaaagaatggctcggaaagcaggtgctctggtcatatttgtcgtggatgctagtggtagcatggctctgaatcgtatgcagaatgcaaaaggtgcagcattgaagttgcttgcagaaagctacaccagccgagatcaggtttcaattattccttttcgtggagattatgctgaggttttgctaccgccatcaagatctatagcaatggcccggaaacgtcttgagaagctaccatgtggtggtggttctcccttagctcatggcctcagtacagctgtcagagtgggtctgaatgctgagaagagtggggatgtcggacgtatcatgattgttgcaatcaccgatggaagagctaatgtatcactgaagaggtccactgatccagaagctgctgctgcttcagatgcaccaagaccttcttctaaagaattgaaggatgggatacttgaagtggctggcaaaatatacaaggcaggaatgtcgcttcttgtcattgacactgagaacaagtttgtatcgaccggatttgccaaggaaattgcgagggttgcccaaggtaaatactattacctgcccaacgcttcagatgctgtgatttctgctgccaccaagaccgctctgacagacttgaagggttcatgattttggagcatgagcaaccgttcaagcaccttctgatgagcagcgaacctgcgtttgtgcagtaattgtgtagctgtcttcaaggcttggtgggcgttttggctctcgtcttgtgacaaattttggtgtaggtctctagtctctaccatgagaacagaaaaaaaaattctgagcatgacattgcataagatcgaatgtcctcttctctccaatgtttggcaatattgtaaattggtcacttttttgacgagaaatcggtcgcttttgtgttgggtagaaaaaaaaaaaaaaaaaaaa

SEQ ID NO: 4920 - protein, 753 aa, Panicum virgatum
  misc_feature: Ceres CLONE 1812522
  misc_feature (1)..(211): Pfam Name: Mg_chelatase Pfam Description: Magnesium chelatase, subunit ChlI
  misc_feature (2)..(753): SWISSPROT Homolog: EC 6.6.1.1 Magnesium-chelatase subunit chlD, chloroplast precursor
  misc_feature (3)..(753): SWISSPROT Homolog: EC 6.6.1.1 Magnesium-chelatase subunit chlD, chloroplast precursor
MATATALSTSLPHLPPRRVTSFPSAAVSLPSRASRLRESRRAAAAPTASEVLDSTNGAVPAAAKSAAARGYGREYFPLAAVVGQDAIKTALLLEAIDREIGGIAISGKRGTAKTVMARGLHAMLPPIEMVVGSIANADPNFPDEWEDGLADRLQYDADGNVKTEIVKTPFVQIPLGVTEDRLIGSVDVEASVRSGTTVFQPGLLAEAHRGVLYVDEINLLDDGISNLLLNVLTEGVNIVEREGISFRHPCKPLLIATYNPEEGSVREHLLDRIAINLSADLPMSFDDRVAAVDIATQFQESSKEVFKMVEEETEVAKTQIILAREYLKDVNISTEQLKYLVMEAIRGGCQGHRAELYAARVAKCLAAMEGREKVFVDDLKKAVELVILPRSILADNPQDQQQEQPPQPPPPPPPENQDSSEDQDEEEEDDQEDDEEENEQQDQQIPEEFIFDAEGGLVDDKLLFFAQQAQRRRGKAGRAKNVIFSEDRGRYIKPMLPKGPVRRLAVDATLRAAAPYQKLRKAKESDKARKVFVEKTDMRAKRMARKAGALVIFVVDASGSMALNRMQNAKGAALKLLAESYTSRDQVSIIPFRGDYAEVLLPPSRSIAMARKRLEKLPCGGGSPLAHGLSTAVRVGLNAEKSGDVGRIMIVAITDGRANVSLKRSTDPEAAAASDAPRPSSKELKDGILEVAGKIYKAGMSLLVIDTENKFVSTGFAKEIARVAQGKYYYLPNASDAVISAATKTALTDLKGS

SEQ ID NO: 4921 - DNA, 1141 bp, Panicum virgatum
  misc_feature: Ceres CLONE 1812540
  misc_feature: Encodes the peptide sequence at SEQ ID NO. 4922
acactagcagcagccttggaaaaggagagcgtgcgcaactgcgagagcgacagagagacaggaaatggcgagcgctcagtgctgcgataaccctccggcgctgaaccccgccggcggggagggcaaggtcgtcgacagcttcggcgggctcaaggcctacctcgtgggctccgatgagtccaaggccgccgtcatcctcatctccgacatcttcgggttcgaatcgccgaatctgaggaaaatagcagacaaggttgctttgtccggttactttgttgtggtaccagatttcctacatggggatccttacacacctgagaatgctgagaggcctcgacctgtgtggataaaatcacatgctccgaaaaaagggtttgaagaggcaaaaccagttattgctgctctaaaggagaagggagtatctgctgttggggctgcaggttactgctggggcggaattgttgttgtggagttggcaaaagttcatgagatccaggctgctgtagtattgcaccctgggcctattacaattgatgatattaaagaggtcaagtgcccgatttcgatacttggagctgagatcgatcatgtttctccaccagaattaatcaagcaattcgagcaggtcctttcagcaaactcaggatttgctcacttcgtaaagattttccctggtgtggcacatgggtggagcgtgagatacagccatgatgatgcggctgccgtggcgagtgctgaggaagcgatgggggacacaatcaactggttcaacaagaacctgaaatgaaccctgaagccgcagctttaattgcaatatgtcattcctactcatcgctgcaaatattcttggttttcttctgctgtccaagacctgcatcttcagttgatttggtgtcttgcgctgttttctagttgtatattgtatactttagcacaggctggttcagctgaatgcctgaatctgtgatagaactagcacgctagtatattacatgtatacctgtatgtaacgaatgtgctctatgtttcagtccaatcagtgaatctggttgatttaagttgagggatcagaaaaatgtatttggatgaatctgaagtaaaaatatattgtagttatggtgaaaaaaaaaaaaaaaaaaaa

SEQ ID NO: 4922 - protein, 240 aa, Panicum virgatum
  misc_feature: Ceres CLONE 1812540
  misc_feature (1)..(211): Pfam Name: DLH Pfam Description: Dienelactone hydrolase family
MASAQCCDNPPALNPAGGEGKVVDSFGGLKAYLVGSDESKAAVILISDIFGFESPNLRKIADKVALSGYFVVVPDFLHGDPYTPENAERPRPVWIKSHAPKKGFEEAKPVIAALKEKGVSAVGAAGYCWGGIVVVELAKVHEIQAAVVLHPGPITIDDIKEVKCPISILGAEIDHVSPPELIKQFEQVLSANSGFAHFVKIFPGVAHGWSVRYSHDDAAAVASAEEAMGDTINWFNKNLK

SEQ ID NO: 4923 - DNA, 1637 bp, Panicum virgatum
  misc_feature: Ceres CLONE 1812587
  misc_feature: Encodes the peptide sequence at SEQ ID NO. 4924
aataattgagattcctctctgtctgttccttcccacctgctgctataatcattgttattgttagccagtgcgagtaatacatgtgcatttgatgttgtccttgtttactagtagttaatagctgttaaggtttaagcccagtagctcacgcacccttccaccaacaaaatacttgtagctgccactttccgcatctgcctgctgggaagtgggaagaagagggatagtctcccaatcccagctctgcctccagttactcttgccagtctccctacacactgtcactagacctgttggtgttcagaattcccaggcctcgactgccatggtccagatgtctctgcagaggagcatagccatatctcctcatcgctccttatctgaatcgctgcatcgtgtgggtggtgcaagaagaagatgggcatcttgtagatcccagacttcaagctttgcttatagtgcgagattgtctccgatagttctcaagactgacagtgacattgatccctctgaaccaaagaatttggatctgagctcctcagcttcaagaagcggaccttacagtgcagcttgtcatccatcaggcactgctggagtaatgggagcatcttccacttcctctctcagatttttagaaaaatttgtgtgttggagtagcagagatggagaagaggcacctccattcgtcatctataatgatccactcgtcaagaaagagctgttggcatctggaaaccagctcacttctgactctagtattgctcttgggaagttaaggcagaagaggctcttcttggagcaatctggagcatgttgcattgttatgccatgccagttcttacatgcctggcatgatgagatttcacagggttgctctgttcctttcctccatgttggtgattgtgttgcaaatgaactcaatgcagcaaacttgaaacctgttgagtatggaggtaatgtttgtgtaggagttctggctaccgatgatacactggctagaaagtgctacttagacaagcttgagagacagggttttgaggtgctatgtccagataaagcttccatgcagcacacggtgttaccatcagtggatgcatttaggaagggggacatggaaggtgcaagaaatctactgcgagtgtcactccaagttcttcttgtgagagctgtcaatacagtaatccttgcgtctgaagaccttgtaggcatcttgcctgacgacgaccctctgctcaagaaatgtatagacccaatggacgccctggtccgagaggccattgtatgcacaagaatacctcggccatgatatgcctcggattactctggttcttgtgtaggtccccaacagtagccctttgcacattgacttcctgtgagcacatttgtagattttaagatagaaagggctcatctcgtcatatcattgatggttgaacacactgtgcattttgatctgtggtacccttctgttttgcaagttgcaaccaagtcaacagagatggtgatgaccccacccgcgagcccagatatgtgaaacaattttgtgtcttggctgctccatacagaagaattccaaacaagaatataggaatcaaatagctgatgtgatgtttctcgaaaaaaaaaaaaaaaaaaaa

SEQ ID NO: 4924 - protein, 326 aa, Panicum virgatum
  misc_feature: Ceres CLONE 1812587
  misc_feature (1)..(239): Pfam Name: Asp_Glu_race Pfam Description: Asp/Glu/Hydantoin racemase
MVQMSLQRSIAISPHRSLSESLHRVGGARRRWASCRSQTSSFAYSARLSPIVLKTDSDIDPSEPKNLDLSSSASRSGPYSAACHPSGTAGVMGASSTSSLRFLEKFVCWSSRDGEEAPPFVIYNDPLVKKELLASGNQLTSDSSIALGKLRQKRLFLEQSGACCIVMPCQFLHAWHDEISQGCSVPFLHVGDCVANELNAANLKPVEYGGNVCVGVLATDDTLARKCYLDKLERQGFEVLCPDKASMQHTVLPSVDAFRKGDMEGARNLLRVSLQVLLVRAVNTVILASEDLVGILPDDDPLLKKCIDPMDALVREAIVCTRIPRP

SEQ ID NO: 4925 - DNA, 1681 bp, Panicum virgatum
  misc_feature: Ceres CLONE 1812589
  misc_feature: Encodes the peptide sequence at SEQ ID NO. 4926
gaacgaaccagcacaagaatatcccctcgatccatcgtcttcctcctccgtcctgcttcgccccctccccttccctccccctcccctcttctcttcctcgtctcgcctcctatccatctattccaagccaacaccaccccacttccttacaagaatcttccccaagaaccttgtacaacaagagagaggtgccttcgttggtgtacgacgatgaatcactgggtggaggagtttctcgtatcggattgatcaatctccactgctaaaaacaagggaggcgcggccggttttgtttggttcctccccagccaatcctttactccccttccatggaggacggcaagatggggaatgccaccaccatccgcgcggtgctcgccatcctccagtggtggagcttcaacgtcacggtcatcatcatcaacaagtggatcttccagaaattggagttcaaatttcctctgactgtgtcgtgcgtccacttcatatgctcttctattggagcatatatcgcaatcaaagtgctgaaaacaaagccgttgatcgaggttgcctcggaggatcgatggagaaggatattcccaatgtcatttgtattctgcataaacatcgtgttggggaatgtcagcctgcgctacattccagtctccttcatgcagacaataaaatctttcactcctgcaacaacagtgattcttcagtggttggtctggaggaaatacttcgagtggcgcatctgggcttctttgatcccaatagtgggagggattctgctgacttccataaccgagctgagctttaacatgtttggcttttgtgctgccatggtgggctgcctggccacatccacaaagaccatcctggcagagtccctgctccatggatacaagtttgatagcatcaacacggtgtactacatggcaccatttgcgacgatgatcctgttgattccagcaatcgtgcttgaaggcagcggcgtggtgagctggctctacacctacgactccgtggcccctgcgctggtgatcatcatcacgtcgggggtgatggccttctgcctaaacttctccatcttctacgtgatccactcaacgacggccgtgaccttcaacgtggccggcaacctcaaggtggcggtggcggtgctggtgtcgtggatgatcttccggaaccccatctcagggatgaatgctgtcggctgtgccatcaccctcgttggctgcaccttctatggctatgtgaggcacctcatctcgcagcaggccaccgccacgccgggcccgtgcactcccagaggccgcatggagatgctgccgctcaccggcgagaagcaaggcgacaagatttagcagcagttacccccatcttcttcataccggcgtcgatatcattaggaaggaataaaccagcatatatatacatctgatctaacagccgtttcagcatggatcatcaggagatttttggcatatagaaccactataccagaggagcgaaagggcactagttccagtcgagttggtgtagagctttgtaaaagagttgctgttttttttttttttttttgctcatgctagcatctttgtctgtctttgttttttggtcttgatgacgatgatacatacatttggtaaccaggttttgttgctgtcattgctgttaaaaaaaaaaaaaaaaaaaa

SEQ ID NO: 4926 - protein, 339 aa, Panicum virgatum
  misc_feature: Ceres CLONE 1812589
  misc_feature (1)..(143): Pfam Name: TPT Pfam Description: Triose-phosphate Transporter family
MEDGKMGNATTIRAVLAILQWWSFNVTVIIINKWIFQKLEFKFPLTVSCVHFICSSIGAYIAIKVLKTKPLIEVASEDRWRRIFPMSFVFCINIVLGNVSLRYIPVSFMQTIKSFTPATTVILQWLVWRKYFEWRIWASLIPIVGGILLTSITELSFNMFGFCAAMVGCLATSTKTILAESLLHGYKFDSINTVYYMAPFATMILLIPAIVLEGSGVVSWLYTYDSVAPALVIIITSGVMAFCLNFSIFYVIHSTTAVTFNVAGNLKVAVAVLVSWMIFRNPISGMNAVGCAITLVGCTFYGYVRHLISQQATATPGPCTPRGRMEMLPLTGEKQGDKI

SEQ ID NO: 4927 - DNA, 1482 bp, Panicum virgatum
  misc_feature: Ceres CLONE 1812600
  misc_feature: Encodes the peptide sequence at SEQ ID NO. 4928
  misc_feature (57)..(57): n is a, c, t, g, unknown, or other
agcacagagagagaagacataccttacctccaggctccaggagcggagacagtgggncggagagctccatcgctgcaccactacttcactggagatccgcccactcccatggaggagatcacccaccactttggagttggcgcaagcggcggacacggctacggccacggccagcaccaccaccaccacaaccacccgtggggatcctccctcagcgccgtcgtcgcgccgccgccgcagccaccgccgagcgcggggctgccactcaccctgaacacggctgccaccgtacacagcggcgccagcgacggcaacccggtgctgcagcttgccaacggcggcagcctcctcgacgcgtgcatcaaggcgaaggagccctcgtcgtcgtcgctctacgccggcgacgtcgaggccatcaaggccaagatcatctcccacccgcactactactcgctcctcgcagcctacctcgagtgccagaaggttggggcgccgccggaggtgtcggcgaggctgacggcgatggcgcaggagctggaagcccggcagcgcacggcgctcggcgggctcggcgccgcgacggaaccggaactggatcagttcatggaggcataccatgagatgctggtgaagttcagggaggagctgacgaggccgctgcaggaggcgatggagttcatgcggagggtggagtcgcagctcagctcgctctccatctccggcagatcgctgcgcaatatcctttcctctggctcttcggaggaggatcaagaaggtagtggaggagagacagagctcgatgcacatggtgtagaccaagagctcaagcaccaccttctgaagaagtacagtggctatctgagttctctcaagcaagaactgtcaaagaagaagaagaaaggaaagctccctaaggaggctcgccagcagctccttagctggtgggatctgcactacaaatggccttacccctcagagactcagaaggtggcgcttgcagagtcgactgggctggacctgaagcagatcaacaattggttcatcaaccagcggaagcggcactggaaaccatctgaggaaatgcaccacctgatgatggacgggtaccacccaactggggccttctacatggacgggcacttcatcaacgatggcgggctgtaccggctcggctagcgccactatcgccatttcacaccagctaaacactaatggttccaagtgtcagaagtactgaagacttggctagctatctaatgttgtgtgccgcatgcatgagctgtaaggaggccatgcttaactattttgttgcaggtgctactatatctgtgccctctatgcttacatgcatgaacattgctttaggtcgtactccacattgtggtggtgtgcttttgcttttgtggttgtatgcgtgacctgacagatggataactgattgctacatgtttgaataatttgcacgatctagctcgtttgtct

SEQ ID NO: 4928 - protein, 355 aa, Panicum virgatum
  misc_feature: Ceres CLONE 1812600
  misc_feature: Great-hit functional homolog of the protein sequence given in SEQ ID NO 9329
  misc_feature: Great-hit functional homolog of the protein sequence given in SEQ ID NO 9639
  misc_feature (1)..(60): Pfam Name: Homeobox Pfam Description: Homeobox domain
  misc_feature: Useful for biocontainment applications
  misc_feature: Useful for making plants with altered Lignin content
  misc_feature: Useful for making plants with modulated biomass
  misc_feature: The plant is abnormally small.
  misc_feature: The plant produces a reduced number of seeds.
MEEITHHFGVGASGGHGYGHGQHHHHHNHPWGSSLSAVVAPPPQPPPSAGLPLTLNTAATVHSGASDGNPVLQLANGGSLLDACIKAKEPSSSSLYAGDVEAIKAKIISHPHYYSLLAAYLECQKVGAPPEVSARLTAMAQELEARQRTALGGLGAATEPELDQFMEAYHEMLVKFREELTRPLQEAMEFMRRVESQLSSLSISGRSLRNILSSGSSEEDQEGSGGETELDAHGVDQELKHHLLKKYSGYLSSLKQELSKKKKKGKLPKEARQQLLSWWDLHYKWPYPSETQKVALAESTGLDLKQINNWFINQRKRHWKPSEEMHHLMMDGYHPTGAFYMDGHFINDGGLYRLG

SEQ ID NO: 4929 - DNA, 1790 bp, Panicum virgatum
  misc_feature: Ceres CLONE 1812661
  misc_feature: Encodes the peptide sequence at SEQ ID NO. 4930
gccggcgatccgagaacaatccgttgtccgagttggcatctttggccaaacccaaaccagtatcattgcccaatcacagatctctccccctctctctaatctcactttctcgccttctccctctcatctcccactacctgctcctgctgctttgcttgtgcgctgcgagaggagagaagagacgggatgaaggaggagatggtggtgggcttgtcggcgccggggcccgtggggaggtggggcgccgcgccgccgcaggcgctgctggagaggatgaaggactacgaccaggaaggcgccttcgcgctctgggacgatctctcgcccgaggaccgggagctcctcgtccgggacatcgagagtatagatctttcaaggatcgatcggatcattcgacgctcacttggatcacaaggcatgccgcttccggccgtggagcccgtgccagaatccagtgtctccaaggtggaggacaggtctccagaggacaaagaaagatggtggaagaaggggctgaaagccatctccgaggggaagctggccgttgtccttttagccggtggtcagggcactcgacttggaagctcagatcctaagggatgtttcaatattgggcttccatctggaaagtcacttttccaactccaagctgaacggattttgtgcgttcaaaagctggctgctcaatctagtgaaagtccaagtaacactatgccgatccactggtatataatgacaagcccttttacggatgctgccactcgcaaattctttgaaacccgtagatattttggcttagacgttgatcaagtgacattttttcaacaaggcacacttccatgtgtttccgctgatggtagatttattatggagacaccatatagggtagcgaaggctcctgatggcaatggtggagtatatgctgctctgaagtccaaaaagttgatggaagatatggctgcacgaggtgtgaaatatgttgattgctatggagttgacaacgcactggttcgtgttgcagatccgacattcctagggtacttcattgacaaaggtgtatccgctgctgctaaagtggttaggaaggcctatccacaagagaacgttggggtattcgttcaacgaggtcgcggtggacctctctctgtagttgagtacagtgaaatggatgcagctatgactactgaaattaatcaatcaacagggcgcctccgttattgttggagcaatatctgcctgcatatgttcactttggactttttgaaccaagtggcaaacagtcttgaaaaggacagtgtatatcatctagctgagaagaagattccttccatccatgggtatacaacaggcctgaagcttgaacagtttatattcgatgctttcacttactccccatctacagcactttttgaggtcatgcgggaagaggaattcgcaccagtaaagaatgccaacggcgcaacatatgacactcctgatagcgcaaaactcatgctgctccgtctccatagcagatgggttgtcgctgctggcggcttcttgacgcattctgtgcccttgtatatgacaggcgttgaagtttctccactttcctcctacgctggagagaacctggaagctatatgccgtgggcgaacattccatgcgccgagcgagatatcattttagatagggctgttcatgacggcaagagctgtgtaactgcaaaacgaatgtaagggattgattgcaggatgtgcatgtttcatttctaggcatgtggatgatccgaaaaaaaaaaaaaaaaaaaa

SEQ ID NO: 4930 - protein, 493 aa, Panicum virgatum
  misc_feature: Ceres CLONE 1812661
  misc_feature (1)..(427): Pfam Name: UDPGP Pfam Description: UTP--glucose-1-phosphate uridylyltransferase
MKEEMVVGLSAPGPVGRWGAAPPQALLERMKDYDQEGAFALWDDLSPEDRELLVRDIESIDLSRIDRIIRRSLGSQGMPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTMPIHWYIMTSPFTDAATRKFFETRRYFGLDVDQVTFFQQGTLPCVSADGRFIMETPYRVAKAPDGNGGVYAALKSKKLMEDMAARGVKYVDCYGVDNALVRVADPTFLGYFIDKGVSAAAKVVRKAYPQENVGVFVQRGRGGPLSVVEYSEMDAAMTTEINQSTGRLRYCWSNICLHMFTLDFLNQVANSLEKDSVYHLAEKKIPSIHGYTTGLKLEQFIFDAFTYSPSTALFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 4931 - DNA, 1967 bp, Panicum virgatum
  misc_feature: Ceres CLONE 1812681
  misc_feature: Encodes the peptide sequence at SEQ ID NO. 4932
atcgcccatccatcccatctctcatccatcaatccgcttcggcttctctctctctctagtctcttccggtccaagtcctaggaataacacagcgcaacaactcgcaccaccaccaccactaccagctgcgcagtagctaccagctgctcgctcacgctcagcagcgtgctgcggcttggcttgggcggctctcttcgatctgcgactcgaggaggcgtgagggcgtcgcaagaacgaagcggcagcaccctgcgcccgatcgatcaagcacgcatcatgttcccggcggccgaggtgtcggcgctcgcggcggggcggcagggcgagcgcggcgtgctgccgcccttcttcatgggctccatctggcccacggccgccgacggcgctggcgctggcgccgccgactccgaggaggacgaggccgccgcggcggctgcggcggccgccgcccacgaccgcgcgctcgccgcgtcgcgcaaccaccgcgaggccgagaagcgccggcgcgagcggatcaagtcgcacctcgaccgcctccgaaacgtcctctcctgcgaccccaagatagacaaggcgtcgctgctggcgaaggcagtggagagggtgcgggacctgaagcagcgggtggccggagtcggggaggcggcgccggcgcacctgttccccacgaagcacgacgagatcgtggtgctcgcgtcgggcggcggcgccgtgttcgaggcctcggtctgctgcgacgaccgctccgacctcctgccggagctcatcgagacgctgcgcgcgctccgcctccgcacgctccgcgccgagatggccaccctcggcggccgcgtccgcaacgtgctcgtcctggcgcgcgacgtcgacggcggcggcgttgcgggagacgatgacgggtatggccgcactgactcggcggactccgttgagagcaacggcggcggcgacttcatcaaggaggccctgagggctctggtggagaggccgggagctggaggcggcgaccgaccaaagaggcgacgtgtctcggacacgaacatgcaagcggcagcctagcacgccggaggccggccggccggctgatgatcattcggccatagctcgatcaaatagctaattgcatgctcatgtcatggtactagctccatctccatgtttagttttgtgtgcttgtgctaatataatgagttgctaggtctcttcttctccctcatgcatgcatggctcttcttgagatgccattaggaagaaaaaaatatactagctagtatggtggtactgctagggtttgcttgagcttgagaatcaatgttgttccaaatccattgcaaacccagcccatgaataacaagagtagtgatcaggcagcacaaatataatgcaaaactgcaggacttgcttgttagttgttacctacccaacaagtagttattaagcacaatatatatattttggaagcttaataataagatcacaagtttctttttccattcacaatcaagttcaagcaacatctgcacatgtccatttttgcattctggatcaggttgtgcagctatatatccaagcatgccaaaagtcctgttcaccattcaagatgtttgtacgaaactcattcaagctctagcctctagatagcttcatgcctcactactcttgtgactggaacactggaacttggaacggatgatctggagggtgcatgtcatgtctgaatggtgaagatgggaggagccaggagcagccaatgattgctttgtgggtgcagggcacagtgaggcatcatgcagtgagcgctctcatgacagtacatgcatgcatgcatggcgccttgcatgctaatatatgctaggagatggatgatgtggaggagttagttgtatatgctgccactgtgtgtgtctggggaaagggggaaattgaagaaggtggtgagcttttgtttagaaaaaaaaaaaaaaaaaaaa

SEQ ID NO: 4932 - protein, 259 aa, Panicum virgatum
  misc_feature: Ceres CLONE 1812681
  misc_feature: Great-hit functional homolog of the protein sequence given in SEQ ID NO 9270
  misc_feature (1)..(50): Pfam Name: HLH Pfam Description: Helix-loop-helix DNA-binding domain
  misc_feature: Useful for making plants with modulated flowering time
  misc_feature: The plant flowers significantly late compared to wild-type.
MFPAAEVSALAAGRQGERGVLPPFFMGSIWPTAADGAGAGAADSEEDEAAAAAAAAAAHDRALAASRNHREAEKRRRERIKSHLDRLRNVLSCDPKIDKASLLAKAVERVRDLKQRVAGVGEAAPAHLFPTKHDEIVVLASGGGAVFEASVCCDDRSDLLPELIETLRALRLRTLRAEMATLGGRVRNVLVLARDVDGGGVAGDDDGYGRTDSADSVESNGGGDFIKEALRALVERPGAGGGDRPKRRRVSDTNMQAAA

SEQ ID NO: 4933 - DNA, 1127 bp, Panicum virgatum
  misc_feature: Ceres CLONE 1812687
  misc_feature: Encodes the peptide sequence at SEQ ID NO. 4934
gacgcagtcgtacggtcgcgtgctcgtgttactcgtgcgagcgttgtcagtgtgtgtcgagagctctgcgcgcggatccaggcgggactgtgccgccgccgcgatgccgatctgcgcgccgtcgtcggactcctcggcctcgtcggcctccggcggccgcgggtggatagtccacgggctggcgctcggcgcggcggcggcggcggccgcggccgcggcgtacctgtaccgccggccgagcgggttccgcagccgcgcggtgggcatcatacccgcgcgcttcgcctcctcgcgcttcgagggcaagccgctcgcgcacatcctcggcaagcccatgatccagagaacatgggaaagagttatgttagcttcttccttggaccatgttgttgtggcaacagatgatgagagaattgcagattgttgtcgaggatttggagctgatgttataatgacatcagaatcatgcagaaatggatctgagcgctgctgtgaggcacttcaaaagcttgggaaacgttatgatattgttgtcaatattcaaggagatgaacctcttattgaaccagagataatagatggtgtcgttatggcattgcagcaagctcctgatgcagtgttcagcacagctgttacttcactgaagcctgaagatgcatctgacacgaatcgagtgaagtgtgttgtggataatcagggctacgcaatctacttttcaagagggctgataccatcgaacaagtcagggaaagtcaatcctaaatatccgtatcttctccatcttggaatctcgggctttgattcgaagttcttgatgatctatccagaacttccactgacacctttacaacttgaagaggacctagagcaactcaaagttcttgaaaatggctataggatgaaggtgatcaaagtggaccacgatgctcatggtgtagatgcacctgaggatgttgagaaaatcgaagaactgatgcgagcgagaaacattcagtagaaaattaagagtatgtgctttgcattgccatcgcccttcggagtaggttcactgtgagactttggctgtgctacattttctgcagagctgttcagttagctgttttttccaaaaaaaaaaaaaaaaaaaa

SEQ ID NO: 4934 - protein, 297 aa, Panicum virgatum
  misc_feature: Ceres CLONE 1812687
  misc_feature (1)..(216): Pfam Name: CTP_transf_3 Pfam Description: Cytidylyltransferase
MPICAPSSDSSASSASGGRGWIVHGLALGAAAAAAAAAAYLYRRPSGFRSRAVGIIPARFASSRFEGKPLAHILGKPMIQRTWERVMLASSLDHVVVATDDERIADCCRGFGADVIMTSESCRNGSERCCEALQKLGKRYDIVVNIQGDEPLIEPEIIDGVVMALQQAPDAVFSTAVTSLKPEDASDTNRVKCVVDNQGYAIYFSRGLIPSNKSGKVNPKYPYLLHLGISGFDSKFLMIYPELPLTPLQLEEDLEQLKVLENGYRMKVIKVDHDAHGVDAPEDVEKIEELMRARNIQ

SEQ ID NO: 4935 - DNA, 2374 bp, Panicum virgatum
  misc_feature: Ceres CLONE 1812698
  misc_feature: Encodes the peptide sequence at SEQ ID NO. 4936
ctgtttccttcgaggggaagggagaggaggggggaggattccttcgagaggagggctgtgatcgagatcgatgccaaggagctggtcgtaggattcgctgctgctgctgctgctgcgcgcgcgcgcggcggcgatggacttcccggagctcgcgaagctggccttcgcgagggtgcagcagatggagccgcagaacgtcggcaagatcctcggctgcatcctcctcagggagcccgacgaggacgagatggtgcagctcgcctacggcaacgacgccgccgtgcacgccaggatcagcgacgccaaggccacgctcgccgccttctacgcgcgctgctccgcgccgcaccaccaccaccaccagatcggggccgcgcacagggccgcagccgccgccgcagcatctgccgggtaccacccggccgccgcctccgccgccggggtgcgccaccacttctcccccgcggccgccgccttcggcatccagtactggccggagcccgcgccggtgcccaaggcgcagccggagttcgggctcgtggacgccgccgccgccgccgagggccactactctctgcagcagcagcagcagcagcagaaccacaacggcctcgacgaccaccaccactacgccgccgccggagggtactactacgccgccgccgaggacgcgttccacagcaatggcggcgccggcgggggcctgccgccgagggctacggctcgccgggcgaacggcgtgacgacgcggcgcgcctgccactacttcatcaagggcgtgtgcaagaacggccagaactgccccttctcgcaccaccacgcctactccgacgggtttgccgacgacaccagccaccacaacggcggcggcggcacgcctggcgcgctggagaaacttgaaatggagatcaccgagctgctcaactcgcggcacggccagcctctgtccatcgcgtctctgcccacgctctacggcgagaggtatgggaagggcctccaggccgagggctacctcaccgagagccagcgccatggcaaggccggctacagcctcaccaagctgctctctcgcctcaacaagatcagggtcatcgagaggccgcatgggcagcactcggtggttctcgctgaggacgcccccagatacacggaattcaggggcgagagaggaggaggtgacatgggctccgtcccggccagctcgcaccagatatacctcaccttccctgccgagagtaccttccaggaggaagacgttgccacttacttcgggcagtatggtcccgtgagcgacgtgaggatcccgtgccaggagaggcgcatgttcggcttcgtgagcttccagaatccggagacagtgagcaccatcctcatgaggcgcaaccctcacttcatctgcggggcaagggtcctcgttaaaccctacagggagaaatccaggtgcttggaacggacgtacacggacaggatcaagccgctgcactactaccctactcgcttcttcgacattgacccggacttttatcctgctttctcgatcatctctccagatgaatttgaagcttcaagcaggatcgtgaggaagcaactggcggagaagcgcgagaggctgatggagctcgagaggaagcgcttcgcagcgatgaggctcgaaccgctgccgcatcagtttgcttacttcgactgcagcattgaggacggaaatcccctcaactgcctcccagcagattccaaagatgtcgacctgatggaccgtcccctcaatgtgccggactccttggagattgtatccaccagccaagctccgcaaacgcaggcaagcaacaactacgatgacaaagagagcaccgaaatcgaactcctcccggaaagtccatttgcatcggcggcgcccgctggaaacagcatatcctcaatcatataatgggaaggaaaagggagaccagagaaagcatcctggaccctcaatcagtttcgtttggtatcatctcaataatatataaggtctaaagggatgagtgcgtttttacacaggagaccaaaaaaaaataaacagtttttgtagatagagaaagggatcggagaagaagtctcactgttcttaattaggaatcacaggacaaagagagcacgtgttcattttatactttagaagcgggatggaaaaaagcagtagtagcatgcaggttgaggacagagaaacaaaagccacactggtaagttttatacaagtgtgtagtctgactatatataagttatacgaaataatgtgacatgatagttgttgtaataagacattatgatacatgcaaattggtgctctagctaccatttgtttccaaagattatgaaccaaaaaaaaaaaaaaaaaaaa

SEQ ID NO: 4936 - protein, 596 aa, Panicum virgatum
  misc_feature: Ceres CLONE 1812698
  misc_feature (1)..(25): Pfam Name: zf-CCCH Pfam Description: Zinc finger C-x8-C-x5-C-x3-H type (and similar)
MDFPELAKLAFARVQQMEPQNVGKILGCILLREPDEDEMVQLAYGNDAAVHARISDAKATLAAFYARCSAPHHHHHQIGAAHRAAAAAAASAGYHPAAASAAGVRHHFSPAAAAFGIQYWPEPAPVPKAQPEFGLVDAAAAAEGHYSLQQQQQQQNHNGLDDHHHYAAAGGYYYAAAEDAFHSNGGAGGGLPPRATARRANGVTTRRACHYFIKGVCKNGQNCPFSHHHAYSDGFADDTSHHNGGGGTPGALEKLEMEITELLNSRHGQPLSIASLPTLYGERYGKGLQAEGYLTESQRHGKAGYSLTKLLSRLNKIRVIERPHGQHSVVLAEDAPRYTEFRGERGGGDMGSVPASSHQIYLTFPAESTFQEEDVATYFGQYGPVSDVRIPCQERRMFGFVSFQNPETVSTILMRRNPHFICGARVLVKPYREKSRCLERTYTDRIKPLHYYPTRFFDIDPDFYPAFSIISPDEFEASSRIVRKQLAEKRERLMELERKRFAAMRLEPLPHQFAYFDCSIEDGNPLNCLPADSKDVDLMDRPLNVPDSLEIVSTSQAPQTQASNNYDDKESTEIELLPESPFASAAPAGNSISSII

SEQ ID NO: 4937 - DNA, 1943 bp, Panicum virgatum
  misc_feature: Ceres CLONE 1812734
  misc_feature: Encodes the peptide sequence at SEQ ID NO. 4938
attccccgcccgcacaccaccacccacctcccaaatactagtccgccgatccagtcatctttcccggcgcgcttcccggcggcagcggcagcggcagcggcagccatggctcgcggcggggacaacctgcaggtgctgagcgcgctggacgcggccaagacgcagtggtaccacttcacggccatcatcgtcgccggcatgggcttcttcaccgacgcctacgacctcttctgcatctccctcgtcaccaagctgctgggccgcatctactacaccgacaccgccaagcccgacccgggctcgctcccgcccaacgtcgccgccgccgtcaacggcgtcgccttctgcggcacgctcgccgggcagctcttcttcggctggctcggcgacaagctcggccgcaagagcgtctacgggatgacgctcatgctcatggtcatctgctccatcgcctcggggctctccttcggccacacgcccacgggggtcatggccacgctctgcttcttccgcttctggctgggcttcggcatcggcggcgactacccgctctccgccaccatcatgtccgagtacgccaacaagcgcacccgcggcgccttcatcgccgccgtcttcgccatgcagggcttcggcatcctcgccggcggcattgtcacgctcatcatctccgccgccttccgcgccgggtacccggccccggcgtaccaggacaacgccgccgcctccaccgtctcgcaggccgacttggtgtggcgcatcatcctcatgctcggcgccgcgcccgcggtgctcacctactactggcggatgaagatgcccgagacggcgcgctacaccgcgctcgtcgccaagaacgccaagcaggccgccgccgacatgtccaaggtgctccacacggagatcgtcgacgagcaggagaagctcgacgacatggtcggcgccgcgggcaacaacttcggcctcttctcccgcgagtttgcgcgccgccacgggctccacctcctcggcacggccagcacctggttcctcctcgacatcgccttctacagccagaacctgttccagaaggacatcttcaccagcatcaactggatccccaaggccaagaccatgagcgcgctggaggaggtcttccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccaccaagggcaaccacatcggcttcgtcgtcatgtacgccctcaccttcttcttcgccaacttcgggcccaacagcaccaccttcatcgtccccgccgagatcttcccggcgcggctgcggtccacgtgccacggcatctccgccgccgcggggaaggccggcgccatcatcggggccttcgggttcctgtacgcggcgcagaaccaggacaagaccaagaccgaccacgggtaccccgcgggcatcggcgtccgcaactcgctcttcgtgctcgccggggtcaacgtgctcggcttcttcctcaccttcctcgtgccggagtccaaggggaagtcgctcgaggagatgtccggcgaggccgaagacagcggcgaggaggcggccggcggcggccgcgccgtgcggccgtccgagacccagatggtgtagaacgaatgtgactggtggagatacgtgtaggccggttcacttgttctcgtttccctatgttgtgcttgtgcaagtcagtcaaagagtaggtacgtggcggtacatgtgcatctgtcttatttttatctatctatatactgtacaaaagaggaaatatcaaagtacacaaacacagtggtgaacaagcacaaaaaaaaaaaaaaaaaaaa

SEQ ID NO: 4938 - protein, 542 aa, Panicum virgatum
  misc_feature: Ceres CLONE 1812734
  misc_feature: Great-hit functional homolog of the protein sequence given in SEQ ID NO 9539
  misc_feature: Great-hit functional homolog of the protein sequence given in SEQ ID NO 9545
  misc_feature: Great-hit functional homolog of the protein sequence given in SEQ ID NO 9551
  misc_feature: Great-hit functional homolog of the protein sequence given in SEQ ID NO 9557
  misc_feature: Useful for making plants with modulated phosphate use efficiency
MARGGDNLQVLSALDAAKTQWYHFTAIIVAGMGFFTDAYDLFCISLVTKLLGRIYYTDTAKPDPGSLPPNVAAAVNGVAFCGTLAGQLFFGWLGDKLGRKSVYGMTLMLMVICSIASGLSFGHTPTGVMATLCFFRFWLGFGIGGDYPLSATIMSEYANKRTRGAFIAAVFAMQGFGILAGGIVTLIISAAFRAGYPAPAYQDNAAASTVSQADLVWRIILMLGAAPAVLTYYWRMKMPETARYTALVAKNAKQAAADMSKVLHTEIVDEQEKLDDMVGAAGNNFGLFSREFARRHGLHLLGTASTWFLLDIAFYSQNLFQKDIFTSINWIPKAKTMSALEEVFRISRAQTLIALCGTVPGYWFTVALIDVVGRFAIQLLGFFMMTVFMLGLAIPYHHWTTKGNHIGFVVMYALTFFFANFGPNSTTFIVPAEIFPARLRSTCHGISAAAGKAGAIIGAFGFLYAAQNQDKTKTDHGYPAGIGVRNSLFVLAGVNVLGFFLTFLVPESKGKSLEEMSGEAEDSGEEAAGGGRAVRPSETQMV

SEQ ID NO: 4939 - DNA, 2020 bp, Panicum virgatum
  misc_feature: Ceres CLONE 1812742
  misc_feature: Encodes the peptide sequence at SEQ ID NO. 4940
gtcctcgctcccgcttcctccgcagctggactcgtgctcaaactcgcaaatcccaaggcccgccgctcccaccaggccgccgcctctagggttttcggattaggtttctagaacattccgccgccgccgccgccgccgcctacgcctcatgcacgcgccgccgctggtcgcgctcgccgggggcgccgcctcgccgccgccatggctggcctcgccccgggctgccatcctcgccgcgccggcgaggctcctccggtcccgccgcggggcgctccggctggaagccaaggccgcgtggagggcggccgggggcgggcggggcccgcgggtcccggccaagggcgccgtgctcgcctcctacatgggtgccgaggaggtggtgggaccctcgccgctgctcgacgaggaaggtctcgacgatgaagtgctcattttacacatcagaaaggaagtggaggagggaaatctgcctgcagatgttgctagcagcctggaggagctctattacaattacaagaatgctgttctgaaaactggtgatccaaatgcatatgagatcatgctttcaaatatgatggctttatttgatcgggtcatgctggatgtacagaatccatttacctttccaccgtatcacaaagctatccgagaaccattcgattattacatgtttggtcagaattacattaggccactggtagactttaggaactcctacgttggcaacatttcccttttccatgacatggaagagaaactccgccagggccacaatgttgttttgatgtcaaaccatcagacagaagcagatccagcaattatcgccttgctgcttgaaaaaagcaatccatggattagtgaaaacatagtttatgttgcgggcgatagggttgttactgatccactttgcaagccatttagcatgggaaggaacctgatttgcgtgtactcaaaaaagcatatgaatgattaccctgagctagttgagaagaagaggagatcaaatactagaagtctcaaggaaatggccttgcttttacgcggtggttcacagttgatttggattgcgccaagtggtggtagagaccggccagacccttcgacaggagaatggtacccggcgccattcaattcatcctcagtggataacatgaggaggcttctggagcatgctggtgttccagggcacatatatccactatcattgctgtgctatgaggttatgcctccaccacaacaggtggagaaagagattggtgagcaaagggtgatatccttccatggagtaggcatatcagtaactgaagaaataaagtatggggatattactgctcataccaagaatgctgatgagggaagggagctattcacagatactttgtacagctcagttgttaatcagtacaacgtgctcaagtctgctatctttagagattgtggagcagatgcatcaaacactgccatctcactatcgcaaccatggctatgaatgtctaattccatagtgaagttacctttttactttttcagaagatcagatggaggggccattgtacaattttgcttggagaaattcttgaactttaaactttgacatcaccgcactttattaatcatggaggtgcccgttactgtcctgcagatcctgtcaagggtgatcggtggctctgcacacatggatcccagtgcaagtcaatcgatctagtgcaagtattgttgcctgaggttaaacagtgacatgctggttggacaccaaaggatccatcaggttgcatgcgtcaaaccagcttgtcgatgagcaagtggatttgtgctgttgacgtcataatttttttcctttctgtttcgtgtacatagcttttgattctttctggcttcacattcggagataaaaagcgtaacatgctcttcagtcagtttctctgtgtagccctgaaatccatggatgtaacccgtctctttcgcactcattgatgtctggataaagaggcagcatattccgtgttccgattacgtgttc

SEQ ID NO: 4940 - protein, 446 aa, Panicum virgatum
  misc_feature: Ceres CLONE 1812742
  misc_feature (1)..(160): Pfam Name: Acyltransferase Pfam Description: Acyltransferase
  misc_feature (91)..(445): SWISSPROT Homolog: EC 2.3.1.15 Glycerol-3-phosphate acyltransferase, chloroplast precursor
  misc_feature (91)..(446): SWISSPROT Homolog: EC 2.3.1.15 Glycerol-3-phosphate acyltransferase, chloroplast precursor
MHAPPLVALAGGAASPPPWLASPRAAILAAPARLLRSRRGALRLEAKAAWRAAGGGRGPRVPAKGAVLASYMGAEEVVGPSPLLDEEGLDDEVLILHIRKEVEEGNLPADVASSLEELYYNYKNAVLKTGDPNAYEIMLSNMMALFDRVMLDVQNPFTFPPYHKAIREPFDYYMFGQNYIRPLVDFRNSYVGNISLFHDMEEKLRQGHNVVLMSNHQTEADPAIIALLLEKSNPWISENIVYVAGDRVVTDPLCKPFSMGRNLICVYSKKHMNDYPELVEKKRRSNTRSLKEMALLLRGGSQLIWIAPSGGRDRPDPSTGEWYPAPFNSSSVDNMRRLLEHAGVPGHIYPLSLLCYEVMPPPQQVEKEIGEQRVISFHGVGISVTEEIKYGDITAHTKNADEGRELFTDTLYSSVVNQYNVLKSAIFRDCGADASNTAISLSQPWL

SEQ ID NO: 4941 - DNA, 1569 bp, Panicum virgatum
  misc_feature: Ceres CLONE 1812781
  misc_feature: Encodes the peptide sequence at SEQ ID NO. 4942
acacattatcctctcctcctcatccacgccgagagcataaacaagcagctcaaccagatcagaaccagagcccctcggcagagcccatcccctctgcacatctcgctctccctccgccgcgcagtcctccgaccctcctctctagcctgccggagatggtgtcgctgaggtgcaccaccgcgcaccactccctcctcggctcgccgacctgcctcgcgggcccgcgccggcgggcgcgccccgtcgtgcgcgccgccgtcgccgtcgaggccgccgcgcaggccaaggtctccctcatccggattgggacgcgtggaagtcctcttgctcttgcacaagcctatgaaactcgagacaaactgaaagctgcacactctgagttggctgaggagggggctattgagattgtcatcataaagaccactggggacattgtgttggacaaacctcttgcagatattggaggaaagggtttattcaccaaggagatagatgaagcactcttgaatggaacgattgacattgcggttcactcaatgaaagatgtcccaacatatcttcctgaaggaacaatattgccctgtaacctcccacgagaggatgtcagagatgcattcataagcttgactgcaaattcgcttggagagcttcctgctggtagtattgtcggaagtgcttccctgcggagacaatctcagattctacgtagatatccatcacttaaagtagttaacttcagaggaaatgttcagacacggttagggaaactcaaggatggaaaggtccatgctacattgttggcactggctggactaaagcggctaaatgtggcagaaaatgcaacatctttattatcagtggatgaaatgcttccagcagttgcccaaggtgctattggaatagcttgccgtagcaatgatgacaaaatgatggagtatttgtcctcattgaaccatgaagataccagattatctgttgcatgtgaaagagaattcttggcggtccttgatggtaactgccgaactccaattgcggcctatgcttatcgtgataaggatgggaattgctcattccgaggtctattggcctcacctgatggatctaaagtatatgagacaacaagaagtgggccgtactcttttgatgacatggttgctatgggcaaagatgctggtcatgagctgaaggcaaaggctggccctggcttctttgatagcttgcaatgaaaagagaacgtgcactttcagttggggctcttttggttagaaacagacggcccaagtagagtgttgagagatttgtttttgttttattctttctcctagttctgctagagtggtagagccttgtaccagatgttgagctaccccattcaaatacgtaccgcctgttcttttagcactctgggttagaacatgaacgtccacggttttgtaatcccctgacttgtgtcaaaagaggtatctgcgcagctatattgcaacattgcaatctgatgtaactttgcagttagtttgttgaaaattgagttcagtatcatgattgagccaaaaaaaaaaaaaaaaaaaa

SEQ ID NO: 4942 - protein, 356 aa, Panicum virgatum
  misc_feature: Ceres CLONE 1812781
  misc_feature (1)..(217): Pfam Name: Porphobil_deam Pfam Description: Porphobilinogen deaminase, dipyromethane cofactor binding domain
  misc_feature (31)..(354): SWISSPROT Homolog: EC 2.5.1.61 Porphobilinogen deaminase, chloroplast precursor
MVSLRCTTAHHSLLGSPTCLAGPRRRARPVVRAAVAVEAAAQAKVSLIRIGTRGSPLALAQAYETRDKLKAAHSELAEEGAIEIVIIKTTGDIVLDKPLADIGGKGLFTKEIDEALLNGTIDIAVHSMKDVPTYLPEGTILPCNLPREDVRDAFISLTANSLGELPAGSIVGSASLRRQSQILRRYPSLKVVNFRGNVQTRLGKLKDGKVHATLLALAGLKRLNVAENATSLLSVDEMLPAVAQGAIGIACRSNDDKMMEYLSSLNHEDTRLSVACEREFLAVLDGNCRTPIAAYAYRDKDGNCSFRGLLASPDGSKVYETTRSGPYSFDDMVAMGKDAGHELKAKAGPGFFDSLQ

SEQ ID NO: 4943 - DNA, 1916 bp, Panicum virgatum
  misc_feature: Ceres CLONE 1812827
  misc_feature: Encodes the peptide sequence at SEQ ID NO. 4944
gaatgcctcctccccgccatccctctccttgcgccgcctcgtactcatgctccggcgcgcctcctcctgtccctgcaatgcgccgccaccccgaatcgcgccgcccttcattccttagtccggatctgcgacgagcgccgcccctgccattcccccagtagagctgtgctgccccttcttcccccaagactagagcagcgccgccagcccctgtcgcaaccttgccctcgccgagctggagtagctccgccgccagcccctcgcgcccctgccctcgtcgagctggaacagcgctgcctgcccttccgttcttttcctcccctgaacccgagtcttgtgccaatgtgccccctttttctctagattctgcgtgtcagcatccaaatcgctcaacatgaaagttgtaaaggggacattcccgtacatttttcttactatccacttctccagattcggccttgaacatattgcaaatcgaccccgaacttcacttgtttgcatcgggttcagcctgaaatttctgaactgctctctgtactagtcaactgcagagtgaagactccccggttcccctgtgcggctgtgctgtgcctccgccgtcccatcctccaggctcctccagctcccccggtggtcatggcggaccaagcccctctggttccccgcgtcaacctcggcacccagggattggaggtgtccaagctggggttcggctgcatggggctgacgggcgcctacaactccccgctggacgacgaggccggcatcgccgtcatcacgcacgccttccgccgcggggtcaccttctttgacacctccgacgtctacgggccccacgccaatgagatcctcctcggcaaggcgctgaagcagctgccgagggagaaggtgcaggtggccaccaagttcgggatacggcgtgacggtagcggcgtggccaccgtgtgcgggaagcccgaatacgtgcgcgcatgctgcgaggccagcctgcgccgcctcggcatcgactgcatcgacctctactaccagcaccgcatcgacaccaccatccccatagaggacacgattagtgagctcaagaaactggtggaagaggggaaggtcaagtacatcgggttgtcagaggcaagccccgatacgattaggcgtgcacacgctgtgcatcctatcgcagctgtccagatggagtggtctctctggtctcgagacatcgagcctgagattgtgccgctgtgcagagaattgggcattggagttgttccttatagtccaattggccgcggttttttcggcggaagaggagtgacagaacaagtgtctgctgaatctaatctgcatgggcatccaaggtttgcggcagaaaatttggagaagaacaagcaaatttatctgaaaatggaagaactggccaataagcaccagtgcagccctgctcagctagctttggcatgggttctgcatcaaggggatgatgtcgttcctataccaggaaccaccaaaatcaagaatctagatgccaacattgacgccttgaaggtgaagctgacagatgtggacctgaaagaaatcggcagccagatccgcgaagaagatgtggctggtggaagacaatacacttcctttgcacataccacctggaagtacgcagatacaccaaagaaacagagctaaataaagaacttagcaacggtcatagtatgcgattccctgcagatgtgctcagtatcacggaagatgtggctgtgtgcttgataatgtacatcagaagaagaataaagcgtcgcgctatccgaaatatgagcaaaaagtttgattttgtgtgctcttatactaagacaagactctgtattgtcagcatggaatatctgaacctataataaagttacagtatttgtgcaaaaaaaaaaaaaaaaaaa

SEQ ID NO: 4944 - protein, 344 aa, Panicum virgatum
  misc_feature: Ceres CLONE 1812827
  misc_feature (1)..(303): Pfam Name: Aldo_ket_red Pfam Description: Aldo/keto reductase family
MADQAPLVPRVNLGTQGLEVSKLGFGCMGLTGAYNSPLDDEAGIAVITHAFRRGVTFFDTSDVYGPHANEILLGKALKQLPREKVQVATKFGIRRDGSGVATVCGKPEYVRACCEASLRRLGIDCIDLYYQHRIDTTIPIEDTISELKKLVEEGKVKYIGLSEASPDTIRRAHAVHPIAAVQMEWSLWSRDIEPEIVPLCRELGIGVVPYSPIGRGFFGGRGVTEQVSAESNLHGHPRFAAENLEKNKQIYLKMEELANKHQCSPAQLALAWVLHQGDDVVPIPGTTKIKNLDANIDALKVKLTDVDLKEIGSQIREEDVAGGRQYTSFAHTTWKYADTPKKQS

SEQ ID NO: 4945 - DNA, 1407 bp, Panicum virgatum
  misc_feature: Ceres CLONE 1812846
  misc_feature: Encodes the peptide sequence at SEQ ID NO. 4946
aaaaaggcccaaacgtctaccgaaatctcatttccgacacgagcggcggatccgcgcgggtcgcgtcgacggagatgggtggcgccgtcgtggccgtgctcgccgcctccgccacacgccacagccgttccccgctagcctccttgctctacagggtggcgcgtgggctccacgacgcttcagcggccgcagcagcagcggaggaggacaaggcgggggcggggagccgccgccggcggcggaggaggagcagcagcagccttcttcttggaccggatttccccgacacctgggaccctccaacgcgttctgcagcgcgagcgccgcctccgcgggacgccggagctgcttatggttacactgcaaccattatcgatggcaagtctattgcagaggacataaggttaaatattgctgaagaagtccgtcaaatgaaaaacacagtcggacatgtgcctggtctagctgtcgtattggttggtgatagaagagattctgaatcttatgtgcgatacaaaacaaaaggttgtgtggaagttggaattaaatcattgctggcaaagttgcctggaaactgtacagaagatgaagtgatggattcagtgtcaagatttaatgaagatccttctgttcatggcatcctagtacagctacctctaccacagcatatggatgaggaaaggattttgagcgccatcagtctagagaaggatgttgatggtttccatcccttgaatgttggaaatcttgctctcagaagccgaaaacctctgtttttgccctgtgctgcaaaggcgtgcattgagttgttgctccaatctgggattgaactcatgggaaaacatgtaactgtgatcggaagaagcaaagttgttggattgcccacttccttacttttacagaggcatcatgccactgtcagtgttatccatgccttcacaacaaatccagaggcgattacccgagaatctgacattgtgatatcagctgctggagtggccaatcttgtaagtggaacttggttaaagcaaggtgcagttgtgattgatgtggggacaaatccaatcgaggatcctaccagtgattatggttatcgcctaactggtgatgtctgctttgaagaagcagtgaaggtggcttctgctataactccagttcctggcggagttggaccagtgacaattgcgatgcttcttgttaacacacttgattcagctaaacgggtttacggcctaagtaactgaaccccctgaactgtacttttgccacacttaccctttgtaaattagttgtcttttcttttctttgctctctgttttagttgtatgagggctgggatgtaccatattttttctcaataaatattgtatgcttagcagtgtgcactaaaaaaaaaaaaaaaaaaaa

SEQ ID NO: 4946 - protein, 389 aa, Panicum virgatum
  misc_feature: Ceres CLONE 1812846
  misc_feature (1)..(168): Pfam Name: THF_DHG_CYH_C Pfam Description: Tetrahydrofolate dehydrogenase/cyclohydrolase, NAD(P)-binding domain
MGGAVVAVLAASATRHSRSPLASLLYRVARGLHDASAAAAAAEEDKAGAGSRRRRRRRSSSSLLLGPDFPDTWDPPTRSAARAPPPRDAGAAYGYTATIIDGKSIAEDIRLNIAEEVRQMKNTVGHVPGLAVVLVGDRRDSESYVRYKTKGCVEVGIKSLLAKLPGNCTEDEVMDSVSRFNEDPSVHGILVQLPLPQHMDEERILSAISLEKDVDGFHPLNVGNLALRSRKPLFLPCAAKACIELLLQSGIELMGKHVTVIGRSKVVGLPTSLLLQRHHATVSVIHAFTTNPEAITRESDIVISAAGVANLVSGTWLKQGAVVIDVGTNPIEDPTSDYGYRLTGDVCFEEAVKVASAITPVPGGVGPVTIAMLLVNTLDSAKRVYGLSN

SEQ ID NO: 4947 - DNA, 2015 bp, Panicum virgatum
  misc_feature: Ceres CLONE 1812853
  misc_feature: Encodes the peptide sequence at SEQ ID NO. 4948
aacccgcactcgccccaaaccctactgctcccgctccgcttccccttcgcctcgcgcccttgcgcttccttccctacacctcgccgccgccgccgtctccggcgagatctccggggggagcaagcgagcgaggcgaggcatcagccatgtcgctccgcgtgctgaacccgaacgccgaggtgctcaacaagtcggcggcgctgcacatgaacatcaacgccgccaagggcctccaggacgtgctcaagaccaacctcggccccaagggcaccatcaagatgcttgttggtggagctggtgacctcaagctaaccaaggatgggaacaccctcttgaaggaaatgcaaattcagaacccaactgccatcatgattgcgaggacggccgtggcacaggatgataccagtggcgatggtacaacctctactgtgcttttcattggtgagctaatgaagcagtctgagcggtgcattgatgaaggtactcatccaaggtttttggttgatggctttgatgttgccaagagagcaactcttgagtttctcgagaaattcaagacaccagttgttattggtgatgaacctgacagagataccttgaaaatgatagcaagaacaactctcagaacaaagttgtatgaaggattggctgatcagttgacggatattgttgtgaatgcggttctatgcatccgcaaaccagaggaacccatcgatctttttatggtggaaataatgcacatgcgccacaaattcgatgttgacacccgcctggttgagggtctggttctggaccatggctcacggcaccctgacatgaagcgcagggcagaaaactgttacatcttgacctgcaatgtctcattagaatatgagaaaagtgaaatcaatgcaggatttttctactcaaatgcagaacaaagagagaagatggttgctgcagagagacgccaagttgacgaacgtgtcaagcggatcattgagttgaaaaacaaggtttgcgctgaaggtgacaaaaactttgtggtgatcaatcagaagggcattgaccctccatccctggatctccttgctagagcagggattattgctcttcgaagagcaaagaggaggaatatggagaggcttgtgctagcatgtggtggtgaagccgtcaattcagttgatgacttgactgaagattgtcttggctgggctgagcttgtctatgagcatgttcttggagaagaaaagtacacatttgtggagaatgtaaaaaaccctcgctcctgtactatactgattaaaggacccaatgaccacactatcgcacaaattaaggatgctgtccgtgatggtctaagatctgttaagaatacagttgaggatgaagcagttgtgctgggtgctggtgcttttgaggttgctgcaaagaagcatcttattgacaatgtgaagaaaaccgtcaaagggcgagcacaacttggggttgaagcatttgcggaagctcttcttgttatacccaagaccctagcggaaaactctggtctagatacccaagatgtcattgtttcccttcagaacgagcatgaccgtggattggtcgtgggattgaaccatcactctggggaaccaattgatccccagatggagggcatcttcgataattactccgtgaagcgccaaatcatcaactctggacctatcattgcgtcgcaattgctgctggtggatgaagtgatcagggcaggccgcaacatgaggaaaccaacttagatactctgtaaacggctagctgagatattcgttcatgtcttcatgagctgtcatgggttttgtttggcaattttaccccctttttcttctgttctgtgcttagtagtgacctgggtgatacacttggggcttcagttagtcgcccatttcacgtagcaggttgcacttgtaatatctgtgactcgtgttttgtgctggattaccgcgtgctcatatttcaacctggggtgtcgttgaggccaaaaaaaaaaaaaaaaaaaa

SEQ ID NO: 4948 - protein, 535 aa, Panicum virgatum
  misc_feature: Ceres CLONE 1812853
  misc_feature (1)..(496): Pfam Name: Cpn60_TCP1 Pfam Description: TCP-1/cpn60 chaperonin family
MSLRVLNPNAEVLNKSAALHMNINAAKGLQDVLKTNLGPKGTIKMLVGGAGDLKLTKDGNTLLKEMQIQNPTAIMIARTAVAQDDTSGDGTTSTVLFIGELMKQSERCIDEGTHPRFLVDGFDVAKRATLEFLEKFKTPVVIGDEPDRDTLKMIARTTLRTKLYEGLADQLTDIVVNAVLCIRKPEEPIDLFMVEIMHMRHKFDVDTRLVEGLVLDHGSRHPDMKRRAENCYILTCNVSLEYEKSEINAGFFYSNAEQREKMVAAERRQVDERVKRIIELKNKVCAEGDKNFVVINQKGIDPPSLDLLARAGIIALRRAKRRNMERLVLACGGEAVNSVDDLTEDCLGWAELVYEHVLGEEKYTFVENVKNPRSCTILIKGPNDHTIAQIKDAVRDGLRSVKNTVEDEAVVLGAGAFEVAAKKHLIDNVKKTVKGRAQLGVEAFAEALLVIPKTLAENSGLDTQDVIVSLQNEHDRGLVVGLNHHSGEPIDPQMEGIFDNYSVKRQIINSGPIIASQLLLVDEVIRAGRNMRKPT

SEQ ID NO: 4949 - DNA, 1512 bp, Panicum virgatum
  misc_feature: Ceres CLONE 1812854
  misc_feature: Encodes the peptide sequence at SEQ ID NO. 4950
acgcaaccagcccggaccgcactaccgccgtacggccacacggcggcgccgcggcggagtggcagactcgtagataccccgcgaaaccaggcccggaagacgccgcaaccctgctttccacgccggactccgctcgcagccggccactttcctccccgtcggccccctcggtgctcgccgtctctaaaagcaaggcggccttgtgggcgccgacgcggacgcagcagcgattccgggagagtgacagagatcggccgatcgatcgctggctagctagcttccagctgcggggacggccggggatgaagaagtgcgcgtcggagctgcagctggaggccttcatccgcagcccggatgaccacgacgtcgccgcgcaggcggcgttcgctgcgggcctgttctcccccggcgatctctccggcttcagcttcgccgactcgaacaccctcaacggaagcattcctaatcacatatggtcccataaccacaacgtgaggcatcccgcagtctccacgacaatcgagtcgcagtcatcaatctgtgcagcagcaagcccaacatcagcgaccaacctatatctgaaagagagccaaactctggggggaacaagtggttcagattccgatagcgaatcacagttggatatcgaaggcggtccatgcgagcaaagcacaaacccacaggacgtgaagagaatgcgacggatggtgtcgaatcgtgaatctgctcgtcggtcaaggaagagaaagcaagcccacttagctgatcttgagacacaggttgaccagctgcgaggcgaaaatgcttcactcttcaagcagctgacagacgccaaccagcaattcacaactgcagtcacggacaacaggatcctgaagtcagatgtcgaggccctcagagtcaaggtgaagctggcggaggacatggtggcccgcggcgccctgtcgtgcgggctgggcagcctcgggctgtcgcccgtcctgaacccgcggcagccgtgccggggccccgacgtgctgcccggcctggacttcgccggcaacgacgcgtgcttcgcggggttgtccccggcggagcaggtccagaactcgccgctgcagagcatcgccagcctcgagagcctcgagaaccggatgaccagcgaggtgacgagctgcggcggcgccggcgtcgacgtctggccgtgggacggcggcctgtccaagtgaagagaagaagccggagcgtggaacgcgcacgccgagggggggcagctactgccctgtacgcgtatcgatatgcatggtactagtatgaactgcaagtgtatggcagctgccattgcaatgtcagctggagtggtgaactgaacggacttgagtttttcagagtcctcgtctcgctcggtcggtatattgcctagtagttctgtaatacactaatactagaactgagtggcaaactagctactcatatataattatatatgctaagagactgaactccacagcataaaaaaaaaaaaaaaaaaaa

SEQ ID NO: 4950 - protein, 301 aa, Panicum virgatum
  misc_feature: Ceres CLONE 1812854
  misc_feature (1)..(60): Pfam Name: bZIP_1 Pfam Description: bZIP transcription factor
  misc_feature (1)..(55): Pfam Name: bZIP_2 Pfam Description: Basic region leucine zipper
  misc_feature: The sequence is a functional homolog of  SEQ ID NO 1112 in the  11/479,226 US patent application
  misc_feature: Useful for making plants with modulated growth and phenotype characteristics
MKKCASELQLEAFIRSPDDHDVAAQAAFAAGLFSPGDLSGFSFADSNTLNGSIPNHIWSHNHNVRHPAVSTTIESQSSICAAASPTSATNLYLKESQTLGGTSGSDSDSESQLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQPCRGPDVLPGLDFAGNDACFAGLSPAEQVQNSPLQSIASLESLENRMTSEVTSCGGAGVDVWPWDGGLSK

SEQ ID NO: 4951 - DNA, 1792 bp, Panicum virgatum
  misc_feature: Ceres CLONE 1812929
  misc_feature: Encodes the peptide sequence at SEQ ID NO. 4952
aaaaagcttccacttccagctgctgcggggcatcaccagttcaccaccacgctttgacctccagcccattgcccaatccctcaagcatccctcccccacctcccctcccctataaatctcctcctctgcctccgattcgccacctaaaggaggcgcctttccccaattccaccaccgcgaaagggaggaagggcccgctcctcggacggcgttcccgttccggccagtctactctagtcagctctcctgcggccgggcgcgatggagggcagggccggcggcggggactacattgccagcctgctgagctcggcgccgaggctcgacttcggcgtgctcggctccgtgccggcgatgctggacgccgccgcggcgggcggcgacggcggggaggactgcctggagaggttctgcggcgaccccgggttcgcgaagcgcgcggcgcggctgtccagcttcagcgggcagcgcttcgccggcgccggcgccgcggccggcctcttcgggctgccgctgccggcgcccgccgcgagcaacggcgagttcgccggctcccgggaggcgtcgtcggtgtccgacccggcgtccgcgatgaaggacgccaatgccaagaagaggaaggcgcccgccgcggccaaaggcaagggcaaggagtcctctgcccaggctggggaccagaaggatccggacgccaagaggtgcaagacggagggcgccgaggggaagaaggaggagagccccgtgaagcccaagtcggagcaggccggtagcgacagctccgtcgaggacggcgggcacaagtcggcggggaaggggaagaatgccaagccggtggagccccccaaggactacgtccatgtccgggccaggagagggcaggccactgacagccacagcctcgcagagagggtgagaagggagaggatcagccagaggatgaaggttctccaggacctggtgccaggatgcaacaaggtgattggcaaagcacttatgcttgatgaaatcataaactacgtccagtctctgcaacgacaagtcgagttcctctccatgaagcttgcaactgtgaatccacttgacttcagtaacctgcctaccctcctgcagaaggatatgttccaagcctgtggcccttcagcaagttcagtcttctcgctggaaatctccagctcaggtttccccttcagcgatcaaggagacgtcttccagtcgtttgttcagaacggcatggagaaccaatgcggcctgaacccgctggacctggccctgtcccaggccaccaacgggcagtacgcgtttcaggatggaacgcccagcacaaacctgcagcaaaggaacttctgggaggacgatctccagagcgttttccacatcgacaacgggcagagccaggaggagaacggatgtttccacggtcaattgcaagcgggccacatgaagatggagttctagtcagtcgtcgtagactaccaccaccgaccgaccaaccaacccgagggagtgatctgtacatagcagaaggaaggaactaagagcactacagcatcagtggcagcggctgagtgaagctccgagctctgaactcggaagctactcctagctaacagacagtctgtacgcaggcccttggcgacgacgaattcgtctgtcatgatcctgcctgtagggcgatgcgattcttttttctttctttttccgatattttcacgcagcgattactgtctccaagaagattgattagccgtaacaatcaccggatagttactagcaaaaaaaaaaaaaaaaaaaa

SEQ ID NO: 4952 - protein, 397 aa, Panicum virgatum
  misc_feature: Ceres CLONE 1812929
  misc_feature (1)..(51): Pfam Name: HLH Pfam Description: Helix-loop-helix DNA-binding domain
MEGRAGGGDYIASLLSSAPRLDFGVLGSVPAMLDAAAAGGDGGEDCLERFCGDPGFAKRAARLSSFSGQRFAGAGAAAGLFGLPLPAPAASNGEFAGSREASSVSDPASAMKDANAKKRKAPAAAKGKGKESSAQAGDQKDPDAKRCKTEGAEGKKEESPVKPKSEQAGSDSSVEDGGHKSAGKGKNAKPVEPPKDYVHVRARRGQATDSHSLAERVRRERISQRMKVLQDLVPGCNKVIGKALMLDEIINYVQSLQRQVEFLSMKLATVNPLDFSNLPTLLQKDMFQACGPSASSVFSLEISSSGFPFSDQGDVFQSFVQNGMENQCGLNPLDLALSQATNGQYAFQDGTPSTNLQQRNFWEDDLQSVFHIDNGQSQEENGCFHGQLQAGHMKMEF

SEQ ID NO: 4953 - DNA, 1781 bp, Panicum virgatum
  misc_feature: Ceres CLONE 1812955
  misc_feature: Encodes the peptide sequence at SEQ ID NO. 4954
gtgaaaacctcgtcaaagcattgcattgctcgaggcgggcgggcgcgcgcgtaggaccacgccggagcgagcgtgccgggcatggcggcggcgccggcggcgaagcctcacctggtgttcttcccgttccccacgcagggccacgtcaccccggcgttgcagctcgcaaggctcctccaccactgccacggcttcgacgtcaccttcgtccacaccgagcgcaaccggcggcgcctcctccgcgcgcgcggcccgagcgcgctggcgggggcgccggggttccgcttcgccgccgtccccgacggcctgcccccgtccgacgaggacgcggcgcgggacgacgctgccgcgctgctcctctccctcccgaccgtggtcccgcagttcaaggatctcgtgctgtccgagctccacgcggcgagctgccgccgcctcctcctcgtctccgacatcgaccccatccttcgtgccgcccaggagatcggcctgccctgcgtcaccttctggatcaccagtgccagctcattcatggccatgcagcaggtccagcacctcgttgccaagggtcttgtccctctcaaagatgctgagcagctgagggatggatacctggacagcacggtcatcgactcggcacccgggttgcccaagggcatgcgcctcagagacttcccgagcttcatccgcaccacggaccctgatgacgccgtgctcgccttgaccctgggctcaacggagtgctaccgcaccgtcccgtccgccgtcgtgttccacaccttcgaggagcttgagagccaggtcatcagtgccatgtcggacatcctgccgccgatctacgccatcgggccgctaccgcttctcctcagggaagttggcgccggcgccggcggtgaccatgccgccagcatatcggtgggctccagcctttccaaggaggaccgcgcgtgcctggactggctcgacggcaagcgtcccaactcggtggtgttcgcgagcttcgggagcctagtgaaactgaccggcgagcagctagtggagctcgcctgggggctagccagcagcggctacgacttcctgtgggtgatcagggccgaccagcaggtgacgggcagcgctgtcggtgcaaccgccgtcgtcctgccgccggagttcatggcggagacggaggggcggggccgcgtgacgagctggtgcccacaggaggcggtgctccggcacgaggccgtcggcgccttcctgacgcactgcgggtggaactcaatgctggagagcgtctgcgccggggtgccgatgttgtgctggccgttcgcggccgaccagcagaccaacagcaggatggcgtgcacggagtggcgcgtcggcgtggagctcagtgaggaccctgggcgggaggaggtggagacggcgatacggcaggtgatgggtgggggaagaggggaggagctgaggaggtcggtggcggagtggaagtataaggccgcgctcgcggcgcgaccaggtggctcttcctgggtaaatcttgagagggtggtcaacgaggtgcttgctctggtggacaagaaatgaatttgttgacatgatgttcttcttttctgatcattggtgtgttgctgttaatttcacctcaagaaaaagttggtctggatttgacttttttttcttacgaatatgcttataacttgctcattttcatggattgtaaataaactctattatttcgaatgttccaaagttgtaataaataaaaataaaattgtacgtaaaaaaaaaaaaaaaaaaaa

SEQ ID NO: 4954 - protein, 494 aa, Panicum virgatum
  misc_feature: Ceres CLONE 1812955
  misc_feature (1)..(124): Pfam Name: UDPGT Pfam Description: UDP-glucoronosyl and UDP-glucosyl transferase
MAAAPAAKPHLVFFPFPTQGHVTPALQLARLLHHCHGFDVTFVHTERNRRRLLRARGPSALAGAPGFRFAAVPDGLPPSDEDAARDDAAALLLSLPTVVPQFKDLVLSELHAASCRRLLLVSDIDPILRAAQEIGLPCVTFWITSASSFMAMQQVQHLVAKGLVPLKDAEQLRDGYLDSTVIDSAPGLPKGMRLRDFPSFIRTTDPDDAVLALTLGSTECYRTVPSAVVFHTFEELESQVISAMSDILPPIYAIGPLPLLLREVGAGAGGDHAASISVGSSLSKEDRACLDWLDGKRPNSVVFASFGSLVKLTGEQLVELAWGLASSGYDFLWVIRADQQVTGSAVGATAVVLPPEFMAETEGRGRVTSWCPQEAVLRHEAVGAFLTHCGWNSMLESVCAGVPMLCWPFAADQQTNSRMACTEWRVGVELSEDPGREEVETAIRQVMGGGRGEELRRSVAEWKYKAALAARPGGSSWVNLERVVNEVLALVDKK

SEQ ID NO: 4955 - DNA, 1786 bp, Panicum virgatum
  misc_feature: Ceres CLONE 1812968
  misc_feature: Encodes the peptide sequence at SEQ ID NO. 4956
gccaggctcctccccctgcaaatccacaccaccactcgttcctcttcaggaggggaagagaggggacaggcgagaggcccggcggcgtccgcccgatctgctccgaccagtgcgtgccgtcctcctcagtctcagcaaaatgggtgccggcggcaggatgacggagaaggagcgggagaagcaggagctgctcggccgtgccggcggcggcgcggcaatgcagcgctcaccggtggacaagccaccgttcacgctgggccagatcaagaaggccatcccgccgcactgcttcgagcgctccatcatcaagtccttctcctacgtggtgcacgacctcgtcatcgtggcggcgctgctctacttcgcgctggccatcatcccggcgctcccgagcccgctctacctcgccgcctggccgctctactgggtcgcgcagggctgcgtgtgcaccggcgtgtgggtcatcgcgcacgagtgcggccaccatgccttctccgactactcgctcctggacgacgtcgtcggcctggtgctgcactcgtcgctgctggtgccctacttctcgtggaagtacagccaccggcgccaccactccaacaccggctccctggagcgcgacgaggtgttcgtccccaagaagaaggacgcgctgccgtggtacaccccgtacgtgtacaacaaccccgtcggccggctgctgcacatcgtcgtgcagctcaccctggggtggccgctgtacctgaccaccaacgcgtcggggcgcccgtacccgcgcttcgcctgccactacgacccctacggcccgatctacaacgaccgggagcgcgcccagatattcgtctcggacgccggcgtcgtggccgtcgcgttcgggctgtacaagctggcagcggcgttcgggctctggtgggtggtgcgcgtctacgccgtgccgctgctgatcgtgaacgcctggctggtgctcatcacctacctgcagcacacccacccggcgctgccccactacgactcgagcgagtgggactggctgcgcggggcgctggccaccatggaccgcgactacggcatcctcaaccgcgtgttccacaacatcacggacacgcacgtcgcgcaccacctcttctccaccatgccgcactaccacgccatggaggccaccaaggcgatcaagcccatcctcggcgagtactaccagttcgaccccacgcccgtagccaaggccacctggcgcgaggccagggagtgcatctacgtcgagcccgaggcccgcaagggcgtcttctggtacaacaacaagttctagctgctgccgtgcagagccggaggtgatcgcccgtgcttgccgcaggaatgggaggaggaaatcagcaagagaagatggtaatcgccctaccaagtccccatctacctatctatcagtctttaggcaggaaacagagcatttgggcacaattgagacggcttactgcagtgccattgctagagtcaaccacaagtaggcggatttgtcactgtagtgtgtgtgtccgtggaccatggcggcgagctttgggcagttcgttccgagttgtgttttcttctccgtgttttaatttagtcgtcgccgccggtgtaggctgggccggcggcgtccggtgtggttggccgtgcctggccgcgtgcgtcgtgtgcgtcttgtcattgcgtcggcgtcgttgtcggcggctctctcgtccccccctctcgtgttgttgtaaaaccgtatccccctggtgcttttggcggaaataacagatcgtcgaacggc

SEQ ID NO: 4956 - protein, 387 aa, Panicum virgatum
  misc_feature: Ceres CLONE 1812968
  misc_feature (1)..(253): Pfam Name: FA_desaturase Pfam Description: Fatty acid desaturase
MGAGGRMTEKEREKQELLGRAGGGAAMQRSPVDKPPFTLGQIKKAIPPHCFERSIIKSFSYVVHDLVIVAALLYFALAIIPALPSPLYLAAWPLYWVAQGCVCTGVWVIAHECGHHAFSDYSLLDDVVGLVLHSSLLVPYFSWKYSHRRHHSNTGSLERDEVFVPKKKDALPWYTPYVYNNPVGRLLHIVVQLTLGWPLYLTTNASGRPYPRFACHYDPYGPIYNDRERAQIFVSDAGVVAVAFGLYKLAAAFGLWWVVRVYAVPLLIVNAWLVLITYLQHTHPALPHYDSSEWDWLRGALATMDRDYGILNRVFHNITDTHVAHHLFSTMPHYHAMEATKAIKPILGEYYQFDPTPVAKATWREARECIYVEPEARKGVFWYNNKF

SEQ ID NO: 4957 - DNA, 1680 bp, Panicum virgatum
  misc_feature: Ceres CLONE 1812969
  misc_feature: Encodes the peptide sequence at SEQ ID NO. 4958
aaagccactctctcgctcactctatttccgctctcaagtctcaccctctccctccgctcgccactagccacccaccacactcgtttctctcccccctcccagctcggctccctctgctttcccctgcgccggggccgcaggagcggcgtcatcttccgatggggaacccgcccgagctgtaccacaagatcctcaacatccccaaggacacctcgccgcaggaaatccgcgccgcgtacaagaacctcgtcaagaaatggcaccccgacaagcacccgccgtcgtccaagcccgaggccgaggcgcgcttcaaggccatcagcgaggcctacgaggcgctcctggaccagcaggagaacagggcggtgttcgggctgtgcaatgacggccgggccggcgagagggccggcggcggcggcgtcgggccgcgcatggagaggacgcgcagcgacgacttgtgcatgaggagcgcgcccggcacgccggcgagggagttcaagaaggtgtacagctccggcaactcgggcgggcggcgcgccttcgccgagttctccagctccatcatgcgcaaggcgccgccgctggagcgcaagctcgagtgcaccctcgaggagctctgccgcggctgcaagaaggaggtcaagttcacccgcgacgtcgtcaccaggaacgggtcaattgtgaagaaggaggtgtcccagacggtggtggtgaagccagggtggaagaaagggaagcaggtcgtgttcgaaggcatgggcgacgagcggccgggctgcctgcccgccgacgcgatcttcaccgtgtcggagaagaagcacccgacgttcaagcgcgtgggcaacgacctggtgctcaaggccgaggtgccgctggtgagcgcgctcacgggctggtccctgtcgttccggctcctgagcggcaagaaggtgagcctggcgttccaggacgaggtcatccgccccgggctcgagaaggtgatcaggggcgaaggcatgcccatccccgagcacaagggcggcgcgcggggcgacctcagggtgaagctcgaggtcgtcttccccaaggagctcacctgcgagcagcgcgccgggctcgccgagatcctcaaagggtcctgctgctgatccggatcggtcgatcgaccgagcttgtggtggtgccaccgtgccggcgccgggaccgacgaccgtatcaagttttctttgccgaatgtaagagctaactccaacggattgatctttcttcttcctctttctcatcatatagggaattttttttctcaatttcaacatatatggaagaagtgctccagcagattaattttttcccctttctatatggaaagggagatgcgatgtctcccctttctattggagattggagagaaattattggagattgagaaaaaataaaggagaaagagagatggaaaatcaatctgctggagtaggttttttcaatatcaatcccctatattgagaaaaagtggaaaagaaaaaagggaagatcaacctgttggagttgctcttaatactcgtatcatatcatagcgcgtgggtacataaaaaaagaaagagagacgtcgttgtacatacaggttttctatatgatactagtaaagtggcccgcgcggcatcgcgcgtgctgttgatatgataaaaaaaaaaaaaaaaaaaa

SEQ ID NO: 4958 - protein, 322 aa, Panicum virgatum
  misc_feature: Ceres CLONE 1812969
  misc_feature (2)..(124): Pfam Name: DnaJ_C Pfam Description: DnaJ C terminal region
  misc_feature (1)..(66): Pfam Name: DnaJ Pfam Description: DnaJ domain
MGNPPELYHKILNIPKDTSPQEIRAAYKNLVKKWHPDKHPPSSKPEAEARFKAISEAYEALLDQQENRAVFGLCNDGRAGERAGGGGVGPRMERTRSDDLCMRSAPGTPAREFKKVYSSGNSGGRRAFAEFSSSIMRKAPPLERKLECTLEELCRGCKKEVKFTRDVVTRNGSIVKKEVSQTVVVKPGWKKGKQVVFEGMGDERPGCLPADAIFTVSEKKHPTFKRVGNDLVLKAEVPLVSALTGWSLSFRLLSGKKVSLAFQDEVIRPGLEKVIRGEGMPIPEHKGGARGDLRVKLEVVFPKELTCEQRAGLAEILKGSCC

SEQ ID NO: 4959 - DNA, 2410 bp, Panicum virgatum
  misc_feature: Ceres CLONE 1813066
  misc_feature: Encodes the peptide sequence at SEQ ID NO. 4960
aaccgctcccgttcgcatcgcagcttccacacctcaccacctaagctcggtcggtggcgggctgcccgccgcctccttccgtctgccgctttgcttgctccacccccaccgcacgcacctcgcctcgcctccgtccaggcagagacccgggtcaagcgatccggtcgcatctccacgcgcacctcctcggcttccccgtgcgtgcggttcttggtggtgagggtgtgcgtggcggcggcctcgagttgactgctcgaggtgtgagttccgacacctgccacggcgtgcgccgccgccgttcttgcagcagggtttcgtcccgtcccgtcaggagtgtgggtgagtcggtgggcggggttcgatctgaacaaggcttgggtttttttgctaggggcgcccggttggtcagctcgcagaagaagctgagctggttgggcgtggaggttttgattgacttttgaggtgccgggggtagacaggttgcttcttgctcgctggtttcttggctctgcggctacggagcttgctgaatttcctccagaatttgtggcggagctccgtcctgaccttgcgaagattggacctttggggctgcttgctcactgtttgccttgctggagagtcttgggagcctctgttcctcttgattccttgcattactggtcatcttgtgctccgagccaactaaggaggccatcttttcccgctcggctcgttcatgtaaacggaggattgagctgatctagctggggatcttgaggcgacagagctcttgattgattgcacagtgcatgagtggcgggtgaattggtacagagggaggtaaacatggggaattgcatggacaccacggcgcgggtggatcacagcatgaacaatgctgcctacccatcaaaagtgaccagcaagacaagtttatcatctgtcccttccacgattaaaagcaactcaacccgctcaactttgactctttcgtctatgagagatcgaagtgagcttcctactcctcgaacagaaggtgaaatcttgtcatcttctaatttgaaggcattcacattcaatgatctaaaaactgcaaccaagaacttccgaccggacagtcttcttggggaaggaggatttgggcatgtctataaaggttggattgatgaacacacgcttgccccttcaaaaccgggtagtggtctggttgttgctgtcaagaagctcaaaccagaaggtttccaagggcacaaggaatggctgacagaggttgattaccttggccaacttcaccacaagaatcttgttaagctcattggttactgctcagacggtgataaccggcttctggtatatgaatttatgcccaagggaagtttggagaatcatctgttcagaagaggtgctgatcctttgtcatgggcaataaggctcaaagttgctattggtgctgctaggggtttatcatttttacatgatgctgaaaaccaagttatatatcgtgatttcaaggcatccaacattctcctcgattcggaattcaactcaaaactttcggattttggcttggcaaaagctggtccaaccggggataaaacccatgtatccacacaagtcatgggcactcatggatatgcagctccagagtatattgcaacaggccgtctctctgcgaaggcagatgtctacagctttggggtggtgttgcttgagttgctcactggaagaagagccttggacaaatcgaagccaggcatagagcagaacttagttgattgggccagacctcacttaggtgacaagcgcaggctataccgcatcatggacacaaagcttggaggccagtatccaaaaaagggtgcaaacgccattgcaagcattgccttgcaatgcatctgtggtgatgccaagatgcggcctcggatgtctcaggtgttggaagagctggagcagctgcaagatgccaaatatggttcagcgtcaccactggttgacattcgaaaggcctcacacgccataccaagatcgccaagatcaccaatgagggtccaaccttcgccacggcgctctcttggagcagcagcagcatccccattgccagaatatcgcactgcacaagtgcactaggacaagacttagaagatgcgacgtacctgtaggttgtatatttgttggttcagcaatgagcagcgttgtaacttttgcttctgatgttttggcgatcgtgtgtgccacggaaaaccactatgtcaatctatgataagttgccttgcctggttcagaaagcgtatagcgtagtggcctgtgtcgtcagtgttttgaaattcactcggctagcacgtgtaacttcctcgatctctttgtttgctgcaatggaaaatcgtaatggagttcacagtttatacagcaaaaaaaaaaaaaaaaaaaa

SEQ ID NO: 4960 - protein, 426 aa, Panicum virgatum
  misc_feature: Ceres CLONE 1813066
  misc_feature (38)..(371): SWISSPROT Homolog: EC 2.7.11.1 Protein kinase APK1B, chloroplast precursor
  misc_feature (58)..(391): SWISSPROT Homolog: EC 2.7.11.1 Protein kinase APK1A, chloroplast precursor
MGNCMDTTARVDHSMNNAAYPSKVTSKTSLSSVPSTIKSNSTRSTLTLSSMRDRSELPTPRTEGEILSSSNLKAFTFNDLKTATKNFRPDSLLGEGGFGHVYKGWIDEHTLAPSKPGSGLVVAVKKLKPEGFQGHKEWLTEVDYLGQLHHKNLVKLIGYCSDGDNRLLVYEFMPKGSLENHLFRRGADPLSWAIRLKVAIGAARGLSFLHDAENQVIYRDFKASNILLDSEFNSKLSDFGLAKAGPTGDKTHVSTQVMGTHGYAAPEYIATGRLSAKADVYSFGVVLLELLTGRRALDKSKPGIEQNLVDWARPHLGDKRRLYRIMDTKLGGQYPKKGANAIASIALQCICGDAKMRPRMSQVLEELEQLQDAKYGSASPLVDIRKASHAIPRSPRSPMRVQPSPRRSLGAAAASPLPEYRTAQVH

SEQ ID NO: 4961 - DNA, 1611 bp, Panicum virgatum
  misc_feature: Ceres CLONE 1813144
  misc_feature: Encodes the peptide sequence at SEQ ID NO. 4962
gcctcagcagtcagcagcaccaaagccaatccaagttgggttccactcgcagccggcgatggactccaccccgggcaacccggccgccggcagccgcagcagcgccatcgcgtccaggagtgcgacggctccggccccgctgaccatgccgggcggcgaaccctctgatgccctcgtgggcggcggtgccggaggagcggacggggacccccgcgtcgccctcctccgcctggctgccctcggggaccgcatggccgccgtccggggccgtatcgccgcctccatctccggcgtggcccggcccctctcctacgccgacatccaatccgtctccttggagatctcctccgccgcccagcacgtcgtcctcaacgccgcatcgctcctcgcttcctccgtccccttccccgccccgcctccacctcctaccgccgccgctccctctccggctcccttccgagagatccctgctgcggccgcctctgcccaggcccaagagcaacccctagaagctgccaagggcgacggcggctacgaggtcgtggagctcgacgccgccgagctgctcgcggagcacgtccacttctgcgagatctgcggcaagggcttccgccgcgacgccaacctcaggatgcacatgcgcgcgcacggggaccgcttcaagaccctcgacgccctctcccgccccggccaggccaagccgaagcctcccgccggcgaccgcgaggtgcggttctcctgccccttcgcgggctgcaaccggaaccgcgcgcaccgccgctttcggccgctcaaatcggcggtctgcgcgcggaaccacttccggcgcagccactgccccaagctctacgcctgcgagcgctgcgacgggaagaagcgcttcgccgtcctcgctgacctccgcagccacctgcgccactgcggcgaggaggcccagtggcgatgttcctgcggcaccacattctcgcgcaaggacaagctgttcggccatctagccctctttgaaggccacactccagccgtcaccgagccaaacaagaatgtgacagcaggacctacagagccaattcttgatgccatggaggaaggaggaattgaagaaggcaattgtgaccaggaggaggatgaggagggcggctatgatccagagttcttcaaggagtggatggaggagctcagaggtggtgccagtggctcgaattggcctggacctgcagcagctggacattagcaatgttgagagggctgtctgtgattacttgacgagggatatcagcttgcatcaagtgaccaggaggatcgaatgaagaagggctgttgtgaagaactgaaatgttgcagagtgttaatctgtaggttttatctttaccagcgtatatgcgtgcgttctgacctgtaacctgtatggtatggtgcgtctgtccctccgttgccatcctcccatcctcagtcgcttttcatgtaatcctgagagctgttaccggttaattggagtacatccgagaaatgggttatgctataccagtcgtctcctctctgttgcgtggtcatggagtaacggaggaggaggaatgataatttctctgggatcaaaaaaaaaaaaaaaaaaaa

SEQ ID NO: 4962 - protein, 390 aa, Panicum virgatum
  misc_feature: Ceres CLONE 1813144
  misc_feature (1)..(25): Pfam Name: zf-C2H2 Pfam Description: Zinc finger, C2H2 type
MDSTPGNPAAGSRSSAIASRSATAPAPLTMPGGEPSDALVGGGAGGADGDPRVALLRLAALGDRMAAVRGRIAASISGVARPLSYADIQSVSLEISSAAQHVVLNAASLLASSVPFPAPPPPPTAAAPSPAPFREIPAAAASAQAQEQPLEAAKGDGGYEVVELDAAELLAEHVHFCEICGKGFRRDANLRMHMRAHGDRFKTLDALSRPGQAKPKPPAGDREVRFSCPFAGCNRNRAHRRFRPLKSAVCARNHFRRSHCPKLYACERCDGKKRFAVLADLRSHLRHCGEEAQWRCSCGTTFSRKDKLFGHLALFEGHTPAVTEPNKNVTAGPTEPILDAMEEGGIEEGNCDQEEDEEGGYDPEFFKEWMEELRGGASGSNWPGPAAAGH

SEQ ID NO: 4963 - DNA, 3060 bp, Panicum virgatum
  misc_feature: Ceres CLONE 1813182
  misc_feature: Encodes the peptide sequence at SEQ ID NO. 4964
acaagctcaaatcagagctcacgccgcgagaaccaaccacttgcagcagatcgacctcgaccagttcggagatcccgctgctcagttgcaggaagctcctagctagtagctactgcctcttgctaattagctaggacccatcgatcgagctgtgtagggccggccggggccgaggcagccagcatgatgcacctgaacctgaagcacccactggtgctgccggggcaccagggcaatggcggcgtcggctcgtcgccggcgccggcggcgggtgccaggagcgtcggggcgtcgtcctccgcctcccggcggcacgtcatgccgaggataagctgcagcgcgacggaggagatcggcggcgccgtgtcggcggccaccgtggagaagatgctgaccgtgaaggccacggtggaggcgtcgccggccatcgggcagatgtacgccgcccgcggcctcgacgacatcggcgacctcctcggcaagacgctgctcctcgagctcgtcagctccgagctcgacccaaaaacgggcctggagaaggagcgggtgacggcgttcgcgcacaggacgctggtggagggccggtacgaggcggagttccaggtgccggcgtccttcgggccggtgggcgccgtgctggtggagaacgagcaccacagggagaccttcatccgggagatcaagctcgtcaccggcggcgacgccgtcaccttcgactgcaactcctgggtgcactccaagttcgacaacccggagaagcgcgtcttcttcaccctcaagcagtcgttcttgccgtcggagacgcccaagggcctggaggagctgaggaagaaggacctccagaccctgcgcggcgacgggcgcggcgagcgcaaggccttcgagcgcgtctacgactacgacgtgtacaacgacctcggcgaccccgaccggaaccccgcccaccagcgccccgtgctcggcggcagcgccgagtacccctacccgcgccggtgccgcaccggccgcgcccgggccagcaaggacccgcggacggagcggcgggacgggcacgtctacgtgccccgcgacgagtggttctcggaggtgaagcagctcaccttcggggcgacgacgctgcgctccgggctgcacgcgctgctcccgatgctgcggccgatgctgaccgagaaggagctccggttcccgcacttccccgccatcgacgacctctacagcgacggcctcctgctgccgccggagaccggcttcgccgccatcggcaccgtcgtcccgcgcatggtcaagatggtcgaggacaccaccgaccacgtcctccgcttcgaggtccccggaatggtggagagggaccggttctcgtggttccgggacgaggagttcgcgcggcagacgctggcggggctcaacccggtgtgcatccagctgctcaccgagttccccatcaggagcaagctcgacccggcggtgtacggcccggcggagtccgccatcaccagggaggtcctcgagaagcagatgggcggcaacctcaccgtcgaggaggcgctggtggcgaggcagctcttcatcctcgactaccacgacgtgttcctgccctacgtgcacagggtgcgggagcagcaggccgcgacactctacggctcccgcaccgtcttcttcctcaccgacctgggcaccctcatgccgctggccatcgagctcacgcggcccgcgtcgccggcgagcaagcagccgcagtggaagcgggtgttcacgcacgggcccgacgccaccgacgcctggctctggaagctggccaaggcgcacgtgctcacccacgacaccggctaccaccagctcgtcagccactggctgcgcacccactgctgcgtcgagccctacatcatcgccgccaaccggcagctcagccggctgcaccccgtctaccgcctcctgcacccgcacttccggtacaccatggagatcaacgcgctggccagggagagcctcatcaacgccgacggcatcatcgagcaggccttctggccgggcaggtactccatggagctcagctccgccgcctacggcgccacgtggcggttcgacatggaggcgctgcccaacgacctcgtcaggcgcgggctcgccgtgcgcaggggcggcgacgacggcgagctggagctcaccatcaaggactacccctacgcccacgacgggctcctggtctgggactccatcaggcggtgggcggcggactacgtcggcgtctactacaagtccgacgaagccgtcgccggcgaccccgagctgcaggcgttctgggaggaggtgcgcacggtggggcacgccgacaagaaggacgagccgtggtggcccgtgctcgacacccgccgcagactggtggagacgctcaccaccatcatgtgggtcacctccggccaccactccgccgtcaacttcgggcagtaccactacggcggctacttccccaaccgccccaccaccatccggaagaagatgccggtggaggagagccgggacgacgagatgaggaggttcatggcgcagccggaggcgacgctgctggacatgctccccacacagatgcaggccatcacggtgatgaccacgctagacatcctctccgcgcactcccccgacgaggagtacatgggcgagcacgccgagccggcgtggcaggcggagcccatggtgaaggcggcgttcgagaagttcgccggcaggatgaaggagatcgagggcatcgtcgacgagtgcaacatcaacccggagctgaggaaccgctgcggcgccgggatcgtgccgtacgagctgctcaagcccttctccaagccgggagtcaccgggaggggcatcccaaacagcatctccatttgatcatcatctgacctccgacgatgatcctaggggaaattgcatcgttgcatgtaggcgcgcggcttgtgaaataaaatgtagtactactccgtgcacgattgtacaattattgaatattgtacatgcatgtatcactgcaagagacgatttttagttacaaaataaaaaaggattatatttgcc

SEQ ID NO: 4964 - protein, 897 aa, Panicum virgatum
  misc_feature: Ceres CLONE 1813182
  misc_feature (1)..(426): Pfam Name: Lipoxygenase Pfam Description: Lipoxygenase
  misc_feature (23)..(897): SWISSPROT Homolog: EC 1.13.11.12 Lipoxygenase 7, chloroplast precursor
  misc_feature (4)..(897): SWISSPROT Homolog: EC 1.13.11.12 Lipoxygenase 2.3, chloroplast precursor
MMHLNLKHPLVLPGHQGNGGVGSSPAPAAGARSVGASSSASRRHVMPRISCSATEEIGGAVSAATVEKMLTVKATVEASPAIGQMYAARGLDDIGDLLGKTLLLELVSSELDPKTGLEKERVTAFAHRTLVEGRYEAEFQVPASFGPVGAVLVENEHHRETFIREIKLVTGGDAVTFDCNSWVHSKFDNPEKRVFFTLKQSFLPSETPKGLEELRKKDLQTLRGDGRGERKAFERVYDYDVYNDLGDPDRNPAHQRPVLGGSAEYPYPRRCRTGRARASKDPRTERRDGHVYVPRDEWFSEVKQLTFGATTLRSGLHALLPMLRPMLTEKELRFPHFPAIDDLYSDGLLLPPETGFAAIGTVVPRMVKMVEDTTDHVLRFEVPGMVERDRFSWFRDEEFARQTLAGLNPVCIQLLTEFPIRSKLDPAVYGPAESAITREVLEKQMGGNLTVEEALVARQLFILDYHDVFLPYVHRVREQQAATLYGSRTVFFLTDLGTLMPLAIELTRPASPASKQPQWKRVFTHGPDATDAWLWKLAKAHVLTHDTGYHQLVSHWLRTHCCVEPYIIAANRQLSRLHPVYRLLHPHFRYTMEINALARESLINADGIIEQAFWPGRYSMELSSAAYGATWRFDMEALPNDLVRRGLAVRRGGDDGELELTIKDYPYAHDGLLVWDSIRRWAADYVGVYYKSDEAVAGDPELQAFWEEVRTVGHADKKDEPWWPVLDTRRRLVETLTTIMWVTSGHHSAVNFGQYHYGGYFPNRPTTIRKKMPVEESRDDEMRRFMAQPEATLLDMLPTQMQAITVMTTLDILSAHSPDEEYMGEHAEPAWQAEPMVKAAFEKFAGRMKEIEGIVDECNINPELRNRCGAGIVPYELLKPFSKPGVTGRGIPNSISI

SEQ ID NO: 4965 - DNA, 1611 bp, Panicum virgatum
  misc_feature: Ceres CLONE 1813214
  misc_feature: Encodes the peptide sequence at SEQ ID NO. 4966
gcagatgcgatgccgtgtgccagcaggcgggcatggacagacgcagagcaccggcggcggtgaagccggattgctgggacgccgccgacgaccccgacaagatcggggtcttcgccgccgagcgctacttctacggggacgacgcgctgtggtgcgagcgctcgtcgtcgtcgttgtcgctgtcgtcgtccgcgttcaggacggggacgctcgagcacgcccggtccgtcgtcacggcgggcaccagctcgtcggaggcgagctggaacagccgctccgcgctgctgcccgtacccatcgagccatcggatgagaagtcgcgcggcgccggcgccgccactccggtcgccgaaacggagccttgttccggggcggagagtgggcgcgccgagcgtaggcgcgcttcttcgtcgtctaactctaacctgcggcggtggctgctcgccgtggcgggttgcgcttgcgcccgcggcgacagcgaggagtcggtgagcgccgacgaaacggaagccggcgacgacgtcctcggtgccggtggcaagaaatataacgccgaagcagagatgatcccggagctcgtgttcgaggaggccacggcagtgacggtcagggctggcagtggcagatggctcctcgaaggcgaccaaatccttgccagaatggaggcgtcttcccccattgacatcgcagggcacggccaccgccgggccgccagctcgatcgaattgcccgtgccggtggtcttgcatcccgcagcgacggcatcctccggcgagcggcggcgcgtgaaatctttggatgagttcaggccgttgggcgacggccaagggagcgcgctcggtccagcgacgcagaacgctgcttttacaatcgccgccggaaatgctccgcgcgcggccgctggcggcggagggagccctggcgccgaggacgacgacgcgactccgagcgagctcggatgcgcgtacccaccgagcgaggcgagcgtcgtctggagcgtggtcaccgcggacggcgcggcgtccggcaacttctccagcgcggcgtcgggctactactaccactacttcagctacggcgaggacagcacgttgcggcacgccgcggcgaacaacggccaccggaggaggagaagagggatcaccgtcaccggcagcagcctgctgatgacgtgcatgaacgagaagacggtcgacgccgtcgggcccgctcggtccgttaaccggccggaggtcgagccggctgccgtggcgaggctgggagctgccggcggcagccggaacggccatggtggagggtaccaggacgtgatgcgccgccggggaggtaggtaggtcggccgtaggtgttggatccgctacagccaaggacacacttcaccatctatcaaatttggttcctgcaaaccatattattccttgtgaatccatcaactgtcagtgttactgacgggtggaggcagaaaaaaatattcatgacaagggctgatgtgaaggaaaccgaagagaggacacttgtgttcgagataatttgtagaagatgacgttgtgagttaccgtattgtatctgtctatatatttgacattgttacaaaaaaaaaaaaaaaaaaaa

SEQ ID NO: 4966 - protein, 433 aa, Panicum virgatum
  misc_feature: Ceres CLONE 1813214
  misc_feature: Great-hit functional homolog of the protein sequence given in SEQ ID NO 9362
  misc_feature: Useful for making plants with modulated light quality response
MDRRRAPAAVKPDCWDAADDPDKIGVFAAERYFYGDDALWCERSSSSLSLSSSAFRTGTLEHARSVVTAGTSSSEASWNSRSALLPVPIEPSDEKSRGAGAATPVAETEPCSGAESGRAERRRASSSSNSNLRRWLLAVAGCACARGDSEESVSADETEAGDDVLGAGGKKYNAEAEMIPELVFEEATAVTVRAGSGRWLLEGDQILARMEASSPIDIAGHGHRRAASSIELPVPVVLHPAATASSGERRRVKSLDEFRPLGDGQGSALGPATQNAAFTIAAGNAPRAAAGGGGSPGAEDDDATPSELGCAYPPSEASVVWSVVTADGAASGNFSSAASGYYYHYFSYGEDSTLRHAAANNGHRRRRRGITVTGSSLLMTCMNEKTVDAVGPARSVNRPEVEPAAVARLGAAGGSRNGHGGGYQDVMRRRGGR

SEQ ID NO: 4967 - DNA, 1837 bp, Panicum virgatum
  misc_feature: Ceres CLONE 1813217
  misc_feature: Encodes the peptide sequence at SEQ ID NO. 4968
aaggtccactccacttcccggctcgatttggttctgctaaatttgacaaccgcatccaaccccatccgcctccaaaccaaagcgacaggcacgagctcgccgccgacgagcctccccgtccaacccggggaacggaagcagcgagggccgtcagcggcgatggctgcctcccctcctcgtcctctcctccgcctcctcctaaccctagccctggctctcaccgtggccgccgcgggcaagatctcggccccccgcaccccgatctcgcgcgacatctaccactccagtgattctcttctgcgtgaaatcaaggctttggtcgctcagcattcagacaaattgagtatggacactataacaacaagcaacaaaggctattctgcagatctgtttgttgttacatttaatcacgtgaaggagagtgtggataatggctcaaaggttcatatccttctgagctttggacagcatggcagagaacttgttacctctgaagttgcattacgccttctctatattttaacggagaagcgtaagattgctggtgtggatctttcatcctttgagagagtgctggagaaccttgtgatcaaagtggtcccgatggaaaatttgaatggtcgcaaacatgttgaagaaggggagctttgcgataggagaaatggaagaggagttgatcttaatagaaattggagtgtggactggggaaagaaagaaaaggactatgacccatatgaggagaatcctggtatcgctccttttagcgaacctgaggcccaaatcatgagggaactatccaggtcatttaaacctcatatttgggtgaatgtgcattctggaatggaggccttatttatgccatacgatcacaagaataccacaccaaatggagcttctgcacatttgatgcggtctgttttagagaatttgaaccatcgccatttccaagatagctgcctagttgggtctggcggtggatctgttggatatcttgcacatgggaccacgactgattacatgtatgatattgcaaaggtgccaatgccgttcacctttgagatatatggagatgagaaagcatctactgacgattgcttcaaaatgttcaatcctgttaacaagacaacattcgacagagtcatcaacaaatggtgcatggcatttctcatactttttgaggaaggcttgcgaaacttgcgagatgcccagatagtatcacgagtcacaccggacaactgggtcccaatcggaggagacgttgtcgagagaaatgtagcacagaagactgcccgtgaaaggaggaagctggaaggtcttgaccttggaatgcaggagctaagaacatactttcgtctatttatggtatctacattcttgttgatgttcatgttctgcacaaggatatcaaagaacagaaacagagactcaggtaacgtctttgatccttgaataccaagaaagcgatgattggagctcgctgctcagttgagtttcagttgatggccatctgttgcctcggatgagcaaagcgtgtgaaacatttgatgttggaacacaattacacaattctgtgcctgccacttggagttggagacgaggctgctaggatcagaattgtatcaagcagttcctgttcagattttagtaactgccagatgcaaatttggttaattgttaagagattgtacctgtaagttgtaaaaattgtccatatcagctttttttcgaagcatagttttttacattttgaaggttggtgcacccaaagctggatatgaatgctagtttcgtgacatgaatgaactgattaacgtgtcaaaaaaaaaaaaaaaaaaaa

SEQ ID NO: 4968 - protein, 429 aa, Panicum virgatum
  misc_feature: Ceres CLONE 1813217
  misc_feature (1)..(281): Pfam Name: Peptidase_M14 Pfam Description: Zinc carboxypeptidase
MAASPPRPLLRLLLTLALALTVAAAGKISAPRTPISRDIYHSSDSLLREIKALVAQHSDKLSMDTITTSNKGYSADLFVVTFNHVKESVDNGSKVHILLSFGQHGRELVTSEVALRLLYILTEKRKIAGVDLSSFERVLENLVIKVVPMENLNGRKHVEEGELCDRRNGRGVDLNRNWSVDWGKKEKDYDPYEENPGIAPFSEPEAQIMRELSRSFKPHIWVNVHSGMEALFMPYDHKNTTPNGASAHLMRSVLENLNHRHFQDSCLVGSGGGSVGYLAHGTTTDYMYDIAKVPMPFTFEIYGDEKASTDDCFKMFNPVNKTTFDRVINKWCMAFLILFEEGLRNLRDAQIVSRVTPDNWVPIGGDVVERNVAQKTARERRKLEGLDLGMQELRTYFRLFMVSTFLLMFMFCTRISKNRNRDSGNVFDP

SEQ ID NO: 4969 - DNA, 1479 bp, Panicum virgatum
  misc_feature: Ceres CLONE 1813296
  misc_feature: Encodes the peptide sequence at SEQ ID NO. 4970
acaccccacaattccagctccaagtcatcgcaccgccccgccgcatctaggtcaccacctcgccggcgccgaccatggccggggactggcaggagctgggccaggcggccgccatcggcctcctcttcgccttcctcgtcgccaagctcatctccaccgtcatcgccttcaaggaggacaacctccgcatcacgcgctctcctccggcctcccccaccgccgccgcctcccgctccacggcgcgcccggacaccccggggcccgaggagcccccgaagccctcccacggaggccacgtctccagcgacggcggcagcgacagcgactgggagggcgtggagagcaccgagctcgacgaggacttcagcgccgcctcagccttcgtcgcggcctccgctgcgtcaggcaccagcgtccccgaggaggctcagctgcggctctacgggctctacaagatcgccaccgaggggccctgcaccgcgccgcagccgtccgcgctcaagctcaaggcccgtgccaagtggaatgcttggcacaagctgggtgctatgcctacagaagaagctatgcaggagtacatcacaatagttgatgagctattccctaactgggctgccggatcgagcacgaaaaggaaagacgaagatagcatggcttctgcatcaggttcgaaggggcccatgggacctgtgtttagcagtttgatgtatgaggaagacgaaggaaacgaagcagaactcggtgacatccatgtttccgcgagggaaggagcaactgatgacatactgaagcatctgactgctagtgtggatgtcaacgcgagagatactgaaggtagaactccattgcactgggctgttgaccgtggccatctaagtgctgttgaagttcttgcaaaagcaaatgcagatctgaatgctaaggataatgaaggacaaacggcacttcactatgctgttgtttgtgaaagagaagacattgcagaattgctcgtcaagcatcacgctgatcttgagatcaaggacgaggatgggaacactgcacgtgacttgtgcccttcaagctggtcgtttatgaaccaggcaaactgacaacaccgagtgaactggatatgttgacgtctcctgccaagaaacacgctgccctatattagctgtaacctaagctcctagaacacttggttgcgtgtttttttgtgggacatctggtgtatcttctatcctgtataaagcttgggaaaatcagacgagttgtggactagatagtctacgtggtgtcctctatgaagcttgggaaatcagatgagttgttttgtcgacctcatcaattcggttgttaaaactaaagttaatgcagtatcaaatactggatgatacatgtattgctttacacagaagaattgtactgatggatttgtgctgaacaccagtggtctgttagtgaaagaaattccaattataaaaaaaaaaaaaaaaaaaa

SEQ ID NO: 4970 - protein, 338 aa, Panicum virgatum
  misc_feature: Ceres CLONE 1813296
  misc_feature: The sequence is a functional homolog of  SEQ ID NO 1840 in the  10/374,780 US patent application
  misc_feature: The sequence is a functional homolog of  SEQ ID NO 1846 in the  10/374,780 US patent application
  misc_feature: Useful for making plants with modulated growth and phenotype characteristics
MAGDWQELGQAAAIGLLFAFLVAKLISTVIAFKEDNLRITRSPPASPTAAASRSTARPDTPGPEEPPKPSHGGHVSSDGGSDSDWEGVESTELDEDFSAASAFVAASAASGTSVPEEAQLRLYGLYKIATEGPCTAPQPSALKLKARAKWNAWHKLGAMPTEEAMQEYITIVDELFPNWAAGSSTKRKDEDSMASASGSKGPMGPVFSSLMYEEDEGNEAELGDIHVSAREGATDDILKHLTASVDVNARDTEGRTPLHWAVDRGHLSAVEVLAKANADLNAKDNEGQTALHYAVVCEREDIAELLVKHHADLEIKDEDGNTARDLCPSSWSFMNQAN

SEQ ID NO: 4971 - DNA, 1304 bp, Panicum virgatum
  misc_feature: Ceres CLONE 1813334
  misc_feature: Encodes the peptide sequence at SEQ ID NO. 4972
gcccctgcttgcgccgttcttttcggggttccctgtccccgccgccgccgccgccggcacgagatggaggtcgcccccgccgccggcaagcagaagacgaagaagcacatacacctcttctactgctccgagtgcgaggagctcgcgctcaagatcgccgccagctccgacgccatcgagctccagtccatcaactggcggagcttcgatgacgggttcccgaacctgttcatcaacaaggcgcacgacatccgggggcagcacgtggcgttcctggcctccttcagctcgccggcggtgatcttcgagcagatctccgtcatcttcgcgctgcccaagctcttcatcgcctccttcacgctcgtgctgcccttcttccccacgggctccttcgagcgcgtcgaggaggaaggggacgtcgccaccgccttcaccctcgcgcgcatcctctccatggtccccaagtcgcgcggtggacctaccagcgtcgtcatctacgacatccacgcgctccaggagaggttctacttcggggacgacgtcctgccatgcttcgagacagggatcccgctcctgctgcagcgcctccgccagctcccggacgcagacaatattacaattgccttcccagatgatggggcgtggaagcggttccacaagctcttgcaacactttccaatgatagtctgtaacaaggttcgtgaaggcgacaagagaatagttcgaataaaggaaggaaatcctgaagggcgacatgttgttattgttgacgatttagtgcaatctgggggaactcttagagagtgccagaaagttctggcttcacatggtgctgcaaaagttagtgcttatgtgactcatgctgtgttccctaagcaatcatatgaacgtttcatgacatctaattctgctgggccaggtgaccagtttgcttacttctggatcacggactcatgccctcacacagtgaaagccattgggcaaagacctccatttgaggtgctgagccttgctggctcaattgcggatgctcttcagatatgagcttgcactggtagatgggcttgaattgcccatcagattgaacttgtgctaggagatgggctgctcctgtttgaccggactttacagtttctggaaaacaaataatgtggagcaagtttactgtggaaagacctgaagcttaaggttccataaacagccctgtggtgtgataataaaatcaggaattggatgttgaaatctgtgaattttttagtgttaactcagtttcaagggagcaataaaaaaaaaaaaaaaaaaaa

SEQ ID NO: 4972 - protein, 326 aa, Panicum virgatum
  misc_feature: Ceres CLONE 1813334
  misc_feature (1)..(326): SWISSPROT Homolog: EC 2.7.6.1 Ribose-phosphate pyrophosphokinase 4
  misc_feature (13)..(326): SWISSPROT Homolog: EC 2.7.6.1 Ribose-phosphate pyrophosphokinase 4
MEVAPAAGKQKTKKHIHLFYCSECEELALKIAASSDAIELQSINWRSFDDGFPNLFINKAHDIRGQHVAFLASFSSPAVIFEQISVIFALPKLFIASFTLVLPFFPTGSFERVEEEGDVATAFTLARILSMVPKSRGGPTSVVIYDIHALQERFYFGDDVLPCFETGIPLLLQRLRQLPDADNITIAFPDDGAWKRFHKLLQHFPMIVCNKVREGDKRIVRIKEGNPEGRHVVIVDDLVQSGGTLRECQKVLASHGAAKVSAYVTHAVFPKQSYERFMTSNSAGPGDQFAYFWITDSCPHTVKAIGQRPPFEVLSLAGSIADALQI

SEQ ID NO: 4973 - DNA, 1922 bp, Panicum virgatum
  misc_feature: Ceres CLONE 1813368
  misc_feature: Encodes the peptide sequence at SEQ ID NO. 4974
tcagtaaccatggcaatgccgccgtcgctacgttttctcatcctcctgctcctcgccggcacgggcggggccacggccgctgcgttcgagctggaggaggccaccatcgattccatacaccgtgccttcgccgctggcgagctcacctcccgcggcctcgtcgagctctacttgcgccgcatcgcgtcactggacccctcgctccatgccgtcatcgagctcgaccccgacggcgcgctagcatcagccgaccgcgccgatgccgccgcccgctccggctccagcgcgctcccgcagctgcacggcatcccggtgctgctcaaggacaacatcgctgcggccgggacgctgaacgcgacggccggatccatagccatggtcgggtcacgtcccgcgcgcgacgccggcgtggtcgagaggctccggaacgccggcgcagtgctcctcggcaccgccagcctcagcgagtggtgcaacttccgcggccccggcatccctgcaggatggagcccccgtggtggccagggcaagaacccgtatgtgccgtcggcaacgccgtgttcctccagcagcggctccgcgattgcggcggcagcaaacatggcagcaatcacgattgggactgagacggacggatccatcatgtgcccgtccagctacaactccgtcgtcgggataaagcccaccgtcggcctcaccagccgtgccggcgtcatcatcatatcaccaaggatggacacagttgggcccatcactagaacagtttcggatactgtgcatgtgttggaagcaattgttggctatgatgcccgagatgcagaggctactcacaaggcttcacaatatataccagaaggtggttacaggcaattcttgaacatagatggactaagagggaagaggttgggaattctcaggaaggatttctttcgatttccttctgggtctgtccaagaaatggtcttcagtgagcatttcaacattatgagtaaaatgggtgccatcttggaggacaaccttgagataccaagcatgaatgtcattaacgatgccgtgcaaagtggtgaacgtgcacttatgcttgccgaattcaagttgtcgctcaactcctacttatctgagctagccacgtcacctgttagatcattatctgacataatcaacttcaacaacaagcaccctatcaaggaaaggctggctgaatttggtcaagactacctcatacaatctcaagcaacaaatggcattggtccaactgaggagcgggccattgccagattgaacaaactgtgtaaaagaggcctcgagaaagtaatgcaagataatctactagatgcaattgtagccccaggtgcatctgctcacagcttgcttgccattggcggttatccagcaatcactgttccagctggatatgcttcaaatggtgttcctttcgccatctgctttggtgggttgaaaggatcagagccaaagctcattgagatagctttttcgtttgagcaggcaacaaaagtaaggaaatctccttcgctgcagcattccatcatttgaagataaattcagaaatgaaccagacctgtattcaactgaggaaatgtttctgctgagggaaccttttattttacgcctctcatctgggtgcagctgtagtttctcttcacgcttgtgtatgcacgccacaacccaacacaaagattattgaagggacacagcccctggcgtgaaaatgcacgctgagccaggttcgaacgcgggtggtgggcgctgcatccagcagctcaaccgtctttgaacccaggcatcttgttcattgactgttacttttgttccgaaacaagtgctgaactctttgagcccaggcatatcttgttcattgattgttcatgatatgtattttacaaaaaaaaaaaaaaaaaaaa

SEQ ID NO: 4974 - protein, 514 aa, Panicum virgatum
  misc_feature: Ceres CLONE 1813368
  misc_feature (2)..(440): Pfam Name: Amidase Pfam Description: Amidase
MAMPPSLRFLILLLLAGTGGATAAAFELEEATIDSIHRAFAAGELTSRGLVELYLRRIASLDPSLHAVIELDPDGALASADRADAAARSGSSALPQLHGIPVLLKDNIAAAGTLNATAGSIAMVGSRPARDAGVVERLRNAGAVLLGTASLSEWCNFRGPGIPAGWSPRGGQGKNPYVPSATPCSSSSGSAIAAAANMAAITIGTETDGSIMCPSSYNSVVGIKPTVGLTSRAGVIIISPRMDTVGPITRTVSDTVHVLEAIVGYDARDAEATHKASQYIPEGGYRQFLNIDGLRGKRLGILRKDFFRFPSGSVQEMVFSEHFNIMSKMGAILEDNLEIPSMNVINDAVQSGERALMLAEFKLSLNSYLSELATSPVRSLSDIINFNNKHPIKERLAEFGQDYLIQSQATNGIGPTEERAIARLNKLCKRGLEKVMQDNLLDAIVAPGASAHSLLAIGGYPAITVPAGYASNGVPFAICFGGLKGSEPKLIEIAFSFEQATKVRKSPSLQHSII

SEQ ID NO: 4975 - DNA, 1402 bp, Panicum virgatum
  misc_feature: Ceres CLONE 1813401
  misc_feature: Encodes the peptide sequence at SEQ ID NO. 4976
ggcggcgggcagtccaactccaccaccaacgctccccttgtttccaccccacaagtctgcaagagagggagagagcccgagggagccaagctagctagcactagcagcgcagcggcagcggcggcgagatggttcacccgatcgcggaggccgacgagcggagccccttcggcagcctcaccccggaggagttctacgcgcgccacggggtcacccacaccacctcctccttcgtcaacccgcggggcctccgcatcttcacccagcgctgggtgccccgcggcggcggcgtcctcggtgccgtcgccgtcgtgcacggcttcacgggcgagtccagctggatggtgcagctcacggccgtccacctcgccgcggcggggttcgccgtcgcggcgctcgaccaccagggccacggcttctccgagggcctcccgggccacatccccgacatcgccccggtgctcgacgactgcgacgccgccttcgccgccttccgcgccgactacccgcccccgcttccctgcttcctctacggggagtccctcggcggcgccatcgcgctgctgctccacctccgccgcggggacctctggcgcgacggcgccgtgctcaacggcgccatgtgcggggtcagcccgcgcttcaagccgccctggccgctcgagcacctcctcgccgccgccgccgccgtcgtgcccacctggcgcgtcgccttcacgcgcgggaacatccccgagcgctccttcaaggtggagtggaagcgccggctcgcgctcgcctcgccgcgccgcaccacggcgccgccccgcgccgccaccgcgctcgagctcctccgcgtctgccgggagctgcaggcgcgcttcgaggaggtggacctcccgctcctcgccgtgcacggcgccgacgacaccgtctgcgacccggcctgcgtcgaggagctgttcaggcgcgcggggagcaaggacaagacgctccgcgtctaccccgggatgtggcaccagatcgtcggcgagcccgaggagaacgtcgagaaggtgttcgacgaaatcatcgcatggctcaaggcgcgcgccgccaccgccgtcggcgcgcaacaacaggagtagttccggcacgcgtcctgcgtgcgcgccgcgccatggccgcgtggtccgttccacggcggattctagattccttcctcccctgctaccaccatccatccaccacggctccaggtccaacaataaacttgtgtgctgattagtgagtgaatctgttgtgcgagccgagatctcatcctatggtcccggtctaccatctgcggctgcttgagatgccgccgccattgctaccgatcatgaatcttgttgagcttttgatccttgaatttaatggatgagcaaaaaaaaaaaaaaaaaaa

SEQ ID NO: 4976 - protein, 325 aa, Panicum virgatum
  misc_feature: Ceres CLONE 1813401
  misc_feature (1)..(224): Pfam Name: Abhydrolase_1 Pfam Description: alpha/beta hydrolase fold
MVHPIAEADERSPFGSLTPEEFYARHGVTHTTSSFVNPRGLRIFTQRWVPRGGGVLGAVAVVHGFTGESSWMVQLTAVHLAAAGFAVAALDHQGHGFSEGLPGHIPDIAPVLDDCDAAFAAFRADYPPPLPCFLYGESLGGAIALLLHLRRGDLWRDGAVLNGAMCGVSPRFKPPWPLEHLLAAAAAVVPTWRVAFTRGNIPERSFKVEWKRRLALASPRRTTAPPRAATALELLRVCRELQARFEEVDLPLLAVHGADDTVCDPACVEELFRRAGSKDKTLRVYPGMWHQIVGEPEENVEKVFDEIIAWLKARAATAVGAQQQE

SEQ ID NO: 4977 - DNA, 1289 bp, Panicum virgatum
  misc_feature: Ceres CLONE 1813421
  misc_feature: Encodes the peptide sequence at SEQ ID NO. 4978
gacaccacccgcgcgtgcgccttgactcgcggccacgctctcctccaccgccgccgtgcgcgccactcactagtctcccacccgtctcgctcccctcaccaccccaccccagcgccgccagtggaggcgcccgccccagcgccgcgccgccgacctgacctgcgcgttcggccaaaccccaccgccccgagcgcgcccgcgaagggaaagccgctacaaatctcgcgcgttcccaagggcgcccgctcgctccagcgcattcccgtgccgtcgacgacgcgcgcggcggcggtagcgcttagctagagcccgcaaccccaccccggagggagcgagagggccgcccgccccatgggggacgagtcggagggcgaggcggaggagtacctcttcaaggtggtgatcatcggggacagcgcggtggggaagagcaacctgctctcgcgctacgcgcgcaacgagttcaacctccactccaaggccaccatcggggtcgagttccagacgcagagcatggacatcgacggcaaggaggtcaaggcccagatctgggacaccgcggggcaggaacgcttccgcgccgtcacctccgcctactaccggggcgcgttcggcgcgctcctcgtctacgacatctcgcgacgctccaccttcgacaacgtcggccgctggctccaggagctcaacacgcattctgacactactgttgccaagatgctggtcggcaacaaatgcgatctggataacatccgcgaagtgcccgtcgaggaaggcaaggcgctcgcagaagccgaaggcctgttcttcatggagacctcggctctggacgccaccaacgtgaagacagccttcgatatcgtcatcaaggagatctacagcaacgtgagccggaagatcctgaactcggattcttacaaggccgagctctccctgaacagggtgagcatcgacggcgactcgaaggacgatcagaagcagacgcagacgagccggttcgggtgctgctaggtggagttagaagagtacattgttgggatattgggttgggtttcactgagatatgatatgatatgagttttttttttggtttattgatattgcttgtaaactgcaatcgactgttggattgttcttgttacacctgagtgggggtgggaatagcagctgttactggggcgcgaactgcttcgcactgtttactggaagggtcgtgcaggtcgatttgccgggttttgtaaagagattttcggagaaggattttggagctccaaaaaaaaaaaaaaaaaaaa

SEQ ID NO: 4978 - protein, 218 aa, Panicum virgatum
  misc_feature: Ceres CLONE 1813421
  misc_feature: Great-hit functional homolog of the protein sequence given in SEQ ID NO 9553
  misc_feature: Useful for making plants with altered terpenoid content
MGDESEGEAEEYLFKVVIIGDSAVGKSNLLSRYARNEFNLHSKATIGVEFQTQSMDIDGKEVKAQIWDTAGQERFRAVTSAYYRGAFGALLVYDISRRSTFDNVGRWLQELNTHSDTTVAKMLVGNKCDLDNIREVPVEEGKALAEAEGLFFMETSALDATNVKTAFDIVIKEIYSNVSRKILNSDSYKAELSLNRVSIDGDSKDDQKQTQTSRFGCC

SEQ ID NO: 4979 - DNA, 1990 bp, Panicum virgatum
  misc_feature: Ceres CLONE 1813530
  misc_feature: Encodes the peptide sequence at SEQ ID NO. 4980
aacccgacccaaacccaacccgagcgagtcagcacagtcaacaacccaccatccccttcccacccgagcgattcccctcggccacccacctcccagctctcgccgtcgtcccaggggaagggtgggctcgctcaggtctcaggtgccagatggccgccgcggcggtcctggcgctgctcatggtgtcggcgctggcggggcccgcggccggcggtgacatcgtccaccacgacgacgaggcacccaagatccccggatgcaacaacgacttcatcctggtaaaagtgcaaagctgggtcaacggcaaggagggtgatgaatttgttggagttggtgctcgctttggtcccaaaattgtctccaaggagaagcacgcaaaccgaactaaactcacgctggcggaccctatggagtgctgctctcctccaaaagacaaggtttctggagatattcttttagttcaaaggggcaagtgcaaattcacaaagaaagcaaagtttgctgaagctgctggtgcttctgccatagtaatcataaaccatgtccacgaactgtacaagatggtctgtgaaaagaatgagacagatcttaacatacatatacctgcagttcttctaccaaaagatgcaggttctgctttacacacacttcttacaagcagtaacgcagtttctgtgcagctgtactctccagaccgtcctgtagttgacactgcagaggtatttctatggcttatggctgtcggtacagtcctcggtgcttcatactggtctgcatggagtgctagagaagcagttattgaacaagagaagctcctgaaggatggccatgaaggcctactgaatattgaagctggaggttctagtggcatggtagatatcaatgtggtatcagcaataatgtttgtggtggttgcgtcatgcttcttaataatgctctacaaactcatgtcttactggtttgtggagctactggtggtaatcttctgcatcggcggtgtagagggtttgcaaacatgcttggttgctctgttgtccagatggttcaagcctgctgcagaatcttttgtgaaagtaccattcattggagctgtttcacatcttactctggcagtttgtccattttgcattgcatttgctgttctatgggctgttttccgccaacttccgtatgcttggattgggcaagatattcttggtatcacactgatagttacggtcatccaaattgtcagagtacccaacctcaaggtgggttcagttcttctcagttgtgccttcctgtatgacatcttctgggtgttcgtctccaagaggtggtttcatgagagtgtgatgattgtggttgcacgtggtgataagactgatgaggatggtgtgcccatgttgctaaaaattccacgaatgtttgatccttggggtggatacagcatcattggctttggtgatatccttcttcctgggctggtagttgctttcgccctaagatacgattttgttgcaaagaagagccttcagtctggttactttttgtggtcaatggtggcctacggttccggacttctaatcacatatgttgcgctgaacctgatggatgggcatggccaacctgcccttctgtacattgtgcccttcacactaggaacgttgatcgcgctcgggtggaagagaggagagctgccgaacctgtggacgaagggagagcctgagagagtgtgtacgcatatgcatatgccgctgctgcccgcgagcccaaactagcaagtgcgtggggtagaatgcacgctgcgatgacattctgctaatacggccggtaactagtagtaattaaatatattgcccagcaatacggtcgcgtgtatttgatcgagacacttcactgatgtacgtatgtattatgtatgtatccttgtgaatttttagttcatcatgcctgtttacatgtgatggaccaagaaatcactttgctccaaaaaaaaaaaaaaaaaaaa

SEQ ID NO: 4980 - protein, 536 aa, Panicum virgatum
  misc_feature: Ceres CLONE 1813530
  misc_feature (1)..(298): Pfam Name: Peptidase_A22B Pfam Description: Signal peptide peptidase
MAAAAVLALLMVSALAGPAAGGDIVHHDDEAPKIPGCNNDFILVKVQSWVNGKEGDEFVGVGARFGPKIVSKEKHANRTKLTLADPMECCSPPKDKVSGDILLVQRGKCKFTKKAKFAEAAGASAIVIINHVHELYKMVCEKNETDLNIHIPAVLLPKDAGSALHTLLTSSNAVSVQLYSPDRPVVDTAEVFLWLMAVGTVLGASYWSAWSAREAVIEQEKLLKDGHEGLLNIEAGGSSGMVDINVVSAIMFVVVASCFLIMLYKLMSYWFVELLVVIFCIGGVEGLQTCLVALLSRWFKPAAESFVKVPFIGAVSHLTLAVCPFCIAFAVLWAVFRQLPYAWIGQDILGITLIVTVIQIVRVPNLKVGSVLLSCAFLYDIFWVFVSKRWFHESVMIVVARGDKTDEDGVPMLLKIPRMFDPWGGYSIIGFGDILLPGLVVAFALRYDFVAKKSLQSGYFLWSMVAYGSGLLITYVALNLMDGHGQPALLYIVPFTLGTLIALGWKRGELPNLWTKGEPERVCTHMHMPLLPASPN

SEQ ID NO: 4981 - DNA, 2153 bp, Panicum virgatum
  misc_feature: Ceres CLONE 1813533
  misc_feature: Encodes the peptide sequence at SEQ ID NO. 4982
accaccagtcaccacgcgcccacctcttcggctcttctccccgtctctctcttctcgcggcatccgcatccggcatcccgctcgcttctcccgcgggcccgcccctccttctaaccctagccccccgacttaagtggccctcctggcggcggcggcggcggcggatcggaggcccaggctccgccgcgggtcctccgtgctggtgagggtcgtgttcgggcgatttgttgcgctcctgctggcggaatttctgagtggtttcagtgtcatattgggactgccagcaacccatcaatttctaatcacatggatgaactttgaagatttgtttaattgattgtacataagggcatcaacttattttctgcaataaagtatgggagctaattgctgcatagctgccaaggaaagagcacaaccatgtatggctccaattgaagtttcaacatacagggtaagacactcgccatcatggagcttccggtgggacaaccgtacacacatagaggatataatggagagcactatggtgttcccaaatcaaagtagtggaaatgttcagccagaagtgaagaatggtttcattgcaccaactgaaggccattacagtggggatagccattctgatgtgttccgcagggtcaagtggcaaaaatctgataataagatggaagtatccaagctttcaaaagttgatcctggagctgatcattctactgcaaatgatttacccactgaggtacagttgctgtccagcaaagaagatggccagaggaaagaaattactggtgcaaagtcttgtaaatctcccggcatagtaactgttgcctcagatgcaaagacattgaagtcacatccttcaacaacccctgtactgcaagaagattcagaaggtccttcatcctctatgagtcattctattcgcatggacccaaattcaacaaggaaagcacttcaatcacctggtggtcaactgtatacgcagatctcagatggaagcaatccatccctcaaacctcttggcgaaaacagctctgcagaaagaaggctatcaaactccatgctttctgcctttagcaatgatatgtttgcagggcaatcgcaaggtgggacatctgataagtggtcaacttgcacaccttctgaattggtggctatatctcgaggagataggtggtctgttgataatgaactctttggctccattactagtaaaggatcattttcaaatgcttcacatctcactgccctttcccctgaccaagaggtatgcaggctatgttcaaggctattaaaggagcgatcttcatggaacggtcatgagctggcagtagttgctgttttattctgtggtcatgcataccacgcaaattgtttagatagtgttactgcagaaagtgagaaatatgacccttcttgtcctgtatgcacccatggtgagacaattacagctaaactgtttggaaagactgaactaaaggttacgaacaaggcatcaaaacatatggctgataatgatcttgatcggagctctaagcaccagaaaaaagttaagagagaacccagattggttacaagttctagcatgaaggacacatttagtcggccatttttgaggaggcatttctccactggttcacgatcaccaacaccagttttggggagtgagccaacaataaagaagggcttttggtcaaggaattggagagagtagccagcttgtcatcattgatgtgggcatgcttgctggtgtgagctcatgatcgctggtgtgagctcatgatcgagcaagaatgatttggaactggtgcaaggggttttgctgtggagctggctataccatctatatgattctgcactattcgttgaagcactcattgtgctagcacaaatgtagtgtgtaaaatgtcttttagtatgcaatgcagccaagggttgcgttcttgcagatatcagtcatagtcgcagtataatagaacagaaaaagggtatacaatttatgacgaaaggtgtcattctgggttgaaaggttgaaatccggcatgacatacaattttcgtcaaaccttccatttgtaataattattttggattataaacttaatctgaaaatcgtagcgcacagatagtttttaaaaaaaaaaaaaaaaaaaa

SEQ ID NO: 4982 - protein, 445 aa, Panicum virgatum
  misc_feature: Ceres CLONE 1813533
  misc_feature (1)..(53): Pfam Name: zf-C3HC4 Pfam Description: Zinc finger, C3HC4 type (RING finger)
MGANCCIAAKERAQPCMAPIEVSTYRVRHSPSWSFRWDNRTHIEDIMESTMVFPNQSSGNVQPEVKNGFIAPTEGHYSGDSHSDVFRRVKWQKSDNKMEVSKLSKVDPGADHSTANDLPTEVQLLSSKEDGQRKEITGAKSCKSPGIVTVASDAKTLKSHPSTTPVLQEDSEGPSSSMSHSIRMDPNSTRKALQSPGGQLYTQISDGSNPSLKPLGENSSAERRLSNSMLSAFSNDMFAGQSQGGTSDKWSTCTPSELVAISRGDRWSVDNELFGSITSKGSFSNASHLTALSPDQEVCRLCSRLLKERSSWNGHELAVVAVLFCGHAYHANCLDSVTAESEKYDPSCPVCTHGETITAKLFGKTELKVTNKASKHMADNDLDRSSKHQKKVKREPRLVTSSSMKDTFSRPFLRRHFSTGSRSPTPVLGSEPTIKKGFWSRNWRE

SEQ ID NO: 4983 - DNA, 2452 bp, Panicum virgatum
  misc_feature: Ceres CLONE 1813595
  misc_feature: Encodes the peptide sequence at SEQ ID NO. 4984
attattgagttcttcagctcacccttctctctcctctctctctgctctcgtggtgctgctctcccctgctttgaccttgctgtggcttcatccgcctttccccgccgtttcttggatttctaggatccaagaaagaaactcccttgcacacacacaaggagttcggcgatccgggcgcccgggcttgggtttcttgatccctcgcgtagctgtcggattcgcgtagccgggggcgggggagatgaccgtggaggaggtgaagctgcaggcgaaggccagcggcgggcatggggccaaggaccagttccctgtcggcatgcgcgtgctcgccgtcgacgacgaccccacctgcctcaaggtcctcgagaacctcctgcttcgctgccagtaccatgtgacaacaactgggcaggcagccactgccctgaagctgttgagggagaagaaggaccagtttgaccttgtgatcagtgatgtccacatgccggacatggatggtttcaagctcctcgagcttgtgggcctcgagatggacctcccagtcattatgttgtctgcaaatggggagacacaaacagtcatgaagggtatcacccatggagcatgtgactacctgctgaagccagtgcgtattgagcagttgcggacgatatggcagcatgtggttaggaggaagagttctgatgccaagattcatggtaatgataatgatgattctggtaaaaagttgcagttggctagtggtgaaggtgacaatggcggtgttaatcgcaacaagagaacttcacgcaagggtagggatgataatggagatgaaggtgatgattctgatgatagtaacgagaatggagactcatcgacccagaagaagccaagggttgtgtggtctgttgaattgcaccgaaagtttgtggctgctgtcaaccagcttggcattgacaaggctgttccaaagaaaatattggatctcatgaatgttgagaacatcacaagggagaatgttgcgagtcacttgcagaagtaccggctgtatctgaaaagactgagtgctgatgcaagcaggcaggctaacttaactgctgcatttggaggaaggaaccctgcttatgttaacatgggactagaagccttcaggcagtacaatgcatatgggagatatcggccagttccaacccctaaccattcacagtccaacaaccttcttgcaaggatgaactctcctgcatttgggatgcatggtttgctgcctccgcagccagttcagatcggacacacccagaataatctgagcacttccttgggcaatgtcggtgggatgaacaatggtaacctgatcaggggtgctcatatgccactgcaggatagtagcaaatgctttcctactggtccttctggcaactcttttgcaaacatatcaaatggcacaacattggttccaacaaataacttgccattacattctcttgagccaagcaaccagcaacaccttggtcggatgcactcttcttctgccgacccgtttaactcatttgttggtgagtcaccccagtttccagatcttggaagatgcaacaccacctggccaacagcagtttcatcatcgaacgttcatgaacttggtcagaaggacagcatgtcccaaccaaacctgcgtgtgaatggacccaagcttgagcctctctcaagctttacagaagcatccagtcagattcccttgcttggaaatgaaatgcagggccaagtagcatcactagcaagcaccggtctttcaatgcccttcaatcaggaagcagtgccattcgcatacggaagcagcgccaactcaagagagatgctgaataacaaccttgcacttagtaattcaggcatcaactcttcattgccgaaccttcgcatagacaattctgttgttccgaggcagacactggatggtggtaattcaggcggtggtgttcctcctctccaagatggcaggatggatcagcaggctgttagtagtcagctaaactatagcagtgatctcatggggacaagtaggctgcagaggggactcagtggtggtctggatgacattgttgtagacatgtttaggccggaccgtgcagacgacggtgtccccttcatcgacggggactgggagctggtctagcaggtttcagctccctacatcaagccttggtgtgagattttccgcatttgtgggtgtcggcggttgattggtccatgccaattgcctgctcaaagttgtttatagtagcaagtttgcatcacaaatgcctttttttttttttgcttttggcttttcagtctagcggtcaggttccagtgttacgcctgagcatcgactatgtggtatttgctaccttaactcgttggctatgtttaagtcaggtataactgtggttatcgtgatatatagcatggttatgagcaaaaaaaaaaaaaaaaaaaa

SEQ ID NO: 4984 - protein, 635 aa, Panicum virgatum
  misc_feature: Ceres CLONE 1813595
  misc_feature (1)..(51): Pfam Name: Myb_DNA-binding Pfam Description: Myb-like DNA-binding domain
  misc_feature: The sequence is a functional homolog of  SEQ ID NO 172 in the  10/666,642 US patent application
  misc_feature: The sequence is a functional homolog of  SEQ ID NO 2510 in the  10/374,780 US patent application
  misc_feature: The sequence is a functional homolog of  SEQ ID NO 686 in the  10/412,699 US patent application
  misc_feature: The sequence is a functional homolog of  SEQ ID NO 933 in the  10/666,642 US patent application
  misc_feature: The sequence is a functional homolog of  SEQ ID NO 934 in the  10/666,642 US patent application
  misc_feature: The sequence is a functional homolog of  SEQ ID NO 935 in the  10/666,642 US patent application
  misc_feature: The sequence is a functional homolog of  SEQ ID NO 936 in the  10/666,642 US patent application
  misc_feature: The sequence is a functional homolog of  SEQ ID NO 937 in the  10/666,642 US patent application
  misc_feature: The sequence is a functional homolog of  SEQ ID NO 976 in the  10/225,066 US patent application
  misc_feature: Useful for making plants with modulated growth and phenotype characteristics
MTVEEVKLQAKASGGHGAKDQFPVGMRVLAVDDDPTCLKVLENLLLRCQYHVTTTGQAATALKLLREKKDQFDLVISDVHMPDMDGFKLLELVGLEMDLPVIMLSANGETQTVMKGITHGACDYLLKPVRIEQLRTIWQHVVRRKSSDAKIHGNDNDDSGKKLQLASGEGDNGGVNRNKRTSRKGRDDNGDEGDDSDDSNENGDSSTQKKPRVVWSVELHRKFVAAVNQLGIDKAVPKKILDLMNVENITRENVASHLQKYRLYLKRLSADASRQANLTAAFGGRNPAYVNMGLEAFRQYNAYGRYRPVPTPNHSQSNNLLARMNSPAFGMHGLLPPQPVQIGHTQNNLSTSLGNVGGMNNGNLIRGAHMPLQDSSKCFPTGPSGNSFANISNGTTLVPTNNLPLHSLEPSNQQHLGRMHSSSADPFNSFVGESPQFPDLGRCNTTWPTAVSSSNVHELGQKDSMSQPNLRVNGPKLEPLSSFTEASSQIPLLGNEMQGQVASLASTGLSMPFNQEAVPFAYGSSANSREMLNNNLALSNSGINSSLPNLRIDNSVVPRQTLDGGNSGGGVPPLQDGRMDQQAVSSQLNYSSDLMGTSRLQRGLSGGLDDIVVDMFRPDRADDGVPFIDGDWELV

SEQ ID NO: 4985 - DNA, 2223 bp, Panicum virgatum
  misc_feature: Ceres CLONE 1813628
  misc_feature: Encodes the peptide sequence at SEQ ID NO. 4986
gatagcgaaggagcaccgagcacaagcagcgaggcaagcatgattggtttctcctccaccctgtcgttccgtcagagagttatctgaagtctgaacacggagcttggtgttgcgaggtagctcagggagtgatcagagcaggccttcttgttctgtgatcttcattctgggtagcgagcatgatggagctgatcgaaggagccgtgaagaaagagccggaagagaccgtggtcgaaatagacatcgaaggggaggaagccgagacggtggtgaagaggaggaggaggaagaagaagtcatgcgatccgcaccagaaccgggcgtgcgtggattgcaagaagaggtgtgctcggattcatggccgagctgcttcgtcctccccgtcgccgtcttccagcaagaccaggccgatcccggcagtgccgtccttcttcaaggtcatgatgggctacttctccgaacacatggatataccaccgccatttgccaggacaatcttggacctggcaggctccaacatttatctcgaagacgcattcggcctccggtggcgtgtgcggctgtgcttgcgcgacggcgtcctgtcgtttgagcatggatggaagaacttcgtgctggaccatgccgtcagctgtggcgagttcctggtgttcaggcagattgccagatcggtcttcactgtgcagatgtttgccccatcggctgtggaaaggctgtttctctgcgagaagaacaaaaggcagagccggaagaggaagcccaggaagaaaactagctgtccgagtagtcaaaccgagaagataagcaagaactgcaagaagaaacaacgtaccgatcaccacaatgatctgggcccgaaagaccgtcagatgcaagatcatgttttcattgacgattctgatcttccccattctgcatctgaactaaaatgttcagaaacatcagggggagtgccagaggtaggagtcacagaaccaaaagaagattctgagccccctacaaggcactctgattgtaaagctcaggaggtgttagatggagaggcggaaatagaagacgactgcagagtctttgaagaaaaagaaagcgaatgcaatgctagagttatacagcacctggtttctgacgctaccgaaattgaacatggcgatggcttgaatttgcctacaaatactgatgctattggacctcttgctatgatggatcttaatggagtgaatatagatgatatatttttgtcagctgatatatatgaatttgaaaatgatatgtgtaatccagaagcattttctgttgatctgaatgttggagggtctattactactgcccaaacttcaggtttcagttgccttgaggatacccagcaaaatcacttctcttcaattggagatgatcagcgttttgtgatgccagagacactttcatgtacagaaaataaacagatgactgatgcactaggaacaggaacaggatatgcttgtgttgcagtgaatgaaatagatatcaacgcgttgcctgctaatgagccgtcatcatttgcaaaggagaactcttctcctccagctgatcctgaagtgcattccagtgaatgtgtattaagtggttgcaacaaagacaatgatttgctctgttgcaaggacagccaagcagaacgtaaagaagcagtgaagcatgataaacagcaagatggtcaagggaataactccgtagacatcggctgtggaacctccgaatcaggtggtgttcttgcacttgcagcaagcagcagcaaattttgcattgctgtgcctgcacctgagcaaacatggcttgagcttcccactcgactaccggttataccaagaacgaagaaacagggaaggaaggttgtgatactcagggacccttgcatgagactctggcccgttgtgtaccaatgcaccccaaggttcagtggcttcatcactggttgggttgacatctgcagggagaacaacctgcacgaaggagacacctgcgagttcgagctcagcggcaactctgaactgtcattccaagtgtgcgtgccgaatttgctgtagccattgttacctagcaagttgatcatatctgtcagctgtcacatttcatgaccagccagcattctattagcagttcatgccctataatcatgtaagaagaagtagacttctgtcaacatgaaaatgctgctgctttctagttcaaaaaaaaaaaaaaaaaaaa

SEQ ID NO: 4986 - protein, 626 aa, Panicum virgatum
  misc_feature: Ceres CLONE 1813628
  misc_feature (3)..(106): Pfam Name: B3 Pfam Description: B3 DNA binding domain
MMELIEGAVKKEPEETVVEIDIEGEEAETVVKRRRRKKKSCDPHQNRACVDCKKRCARIHGRAASSSPSPSSSKTRPIPAVPSFFKVMMGYFSEHMDIPPPFARTILDLAGSNIYLEDAFGLRWRVRLCLRDGVLSFEHGWKNFVLDHAVSCGEFLVFRQIARSVFTVQMFAPSAVERLFLCEKNKRQSRKRKPRKKTSCPSSQTEKISKNCKKKQRTDHHNDLGPKDRQMQDHVFIDDSDLPHSASELKCSETSGGVPEVGVTEPKEDSEPPTRHSDCKAQEVLDGEAEIEDDCRVFEEKESECNARVIQHLVSDATEIEHGDGLNLPTNTDAIGPLAMMDLNGVNIDDIFLSADIYEFENDMCNPEAFSVDLNVGGSITTAQTSGFSCLEDTQQNHFSSIGDDQRFVMPETLSCTENKQMTDALGTGTGYACVAVNEIDINALPANEPSSFAKENSSPPADPEVHSSECVLSGCNKDNDLLCCKDSQAERKEAVKHDKQQDGQGNNSVDIGCGTSESGGVLALAASSSKFCIAVPAPEQTWLELPTRLPVIPRTKKQGRKVVILRDPCMRLWPVVYQCTPRFSGFITGWVDICRENNLHEGDTCEFELSGNSELSFQVCVPNLL

SEQ ID NO: 4987 - DNA, 2128 bp, Panicum virgatum
  misc_feature: Ceres CLONE 1813674
  misc_feature: Encodes the peptide sequence at SEQ ID NO. 4988
ctccgtttgctcgccgtcttgtccggcttccatttccgcgaggaggcgagaggaaaaggggaagacgccgccgcttctgcttccacgagaattctagcaaaagtcttctggagaataatacacctctgcgcattgtgctgcattttggtatggatgaatcttctggtagatctgctaccccagttgggtttgttaaaaggggctctggcatttccttgagaaatcaaagtaaggagaataggccaagccaatacagcaataaaccagggaagaatacaaatctcaatcctgtaaaagcccgattcactgaaaatagagagaagccaaagtatttacatgagccatttcattcatcaggatctaaggcctcatctgtaggctcttcaaaggcccctgttaggaaatatcaggatgaaaggcaaaaaaggccctttttgggagaggcagacgttgctgaaagcagtaacagaagaactgaggtcagacgtctacaaagtagcaaggaagctgttgtttatgaagatgggcatccatacacgcagaggagtacatcagaaggttcatcatcctctacattaactgatggaggcttgtcagaagaacatgatcttggagttttagagttttctgtttcttcagggagttctgcacatactgttgattctagaaatactgcattgagtgctatgcaacgtaggcaaaatgatagagaagaattgaattcaggtagacctcaaggtgcttccaattttgttcatcggcgtgttgtacctcaaagtctcaccactggtgtcaagatatcaagtgcccatggtgccaccagtacttcactgcagagacgtggcctaaaaggccttggttgcacttcaataacagatgttttaccttcaagttgttcttcatctgattctgttcataataggagggttgaagttatgaaaagtggaccttctgatgcagcaagatcttcaagatcaaagggaataagtgggcaatctaatttaggtcagccacgttctggttatcctggctatactggtcctagggctagagctgctgaacagtcagcaaggaccaatggcacaagtattcaggattctacagattcagtaaggactagacgaacttctactctccgtgccagtgagaggatgcgtgccaatgagaggatgcagggtgaaagagaggacagcgtatttgctctgcgtgagactgttacgagggttcgtcatccagaaaggggtcattttcccaccgatgacatttccccacagagattagcaagaccttttaatgcagaattgcctcatcaaatttattcatctaatcgtcaaggcttgagtagtcggacagcaaggagaagatctccttctcaccctgaagcaagtcctcaggaaatgttccatggtctatttggggagagagatggctacagacacataaacatggatggaatttcaggggtgttgctagcattggataggattgaacatgatgatgaattgacttatgagcaattgctggtgctagaaaccaatctgcttctaagtggccttggactgcatgatcagcaccaagatatgagattggatattgacaatatgtcgtatgaggaattactagctttggaagagcatattggctcagtaagtactgcccttactgaagagcaatttgccaagtgggtcaaccaaagtgtgtataaagcaaaaaaatcagatggagatgtgaacaagatcacagtagatgacgtgaatgatgtgaaatgtagcatatgtcaggaggaatacgatgaaggtgaagtgattggtaggatgcagtgtgaccatcagtaccatgtgtgctgcattcacgaatggcttaggcagaagaactggtgtccaatatgcaaagcttcagcaataccaggagacgcctgaatcttgacttttcactcgtaaatagtgtggatgtatgattaggcactgtagatgctgatgctattcactccaatttgtgaatatgatagatcctctctctaaagccctgtaacctcttgttactgcatcttttctcttcatagaacattccttgtgagatatgaattctgcttgaaagcagtatggtcaaaaaaaaaaaaaaaaaaaaa

SEQ ID NO: 4988 - protein, 589 aa, Panicum virgatum
  misc_feature: Ceres CLONE 1813674
  misc_feature (1)..(41): Pfam Name: zf-C3HC4 Pfam Description: Zinc finger, C3HC4 type (RING finger)
MDESSGRSATPVGFVKRGSGISLRNQSKENRPSQYSNKPGKNTNLNPVKARFTENREKPKYLHEPFHSSGSKASSVGSSKAPVRKYQDERQKRPFLGEADVAESSNRRTEVRRLQSSKEAVVYEDGHPYTQRSTSEGSSSSTLTDGGLSEEHDLGVLEFSVSSGSSAHTVDSRNTALSAMQRRQNDREELNSGRPQGASNFVHRRVVPQSLTTGVKISSAHGATSTSLQRRGLKGLGCTSITDVLPSSCSSSDSVHNRRVEVMKSGPSDAARSSRSKGISGQSNLGQPRSGYPGYTGPRARAAEQSARTNGTSIQDSTDSVRTRRTSTLRASERMRANERMQGEREDSVFALRETVTRVRHPERGHFPTDDISPQRLARPFNAELPHQIYSSNRQGLSSRTARRRSPSHPEASPQEMFHGLFGERDGYRHINMDGISGVLLALDRIEHDDELTYEQLLVLETNLLLSGLGLHDQHQDMRLDIDNMSYEELLALEEHIGSVSTALTEEQFAKWVNQSVYKAKKSDGDVNKITVDDVNDVKCSICQEEYDEGEVIGRMQCDHQYHVCCIHEWLRQKNWCPICKASAIPGDA

SEQ ID NO: 4989 - DNA, 2169 bp, Panicum virgatum
  misc_feature: Ceres CLONE 1813715
  misc_feature: Encodes the peptide sequence at SEQ ID NO. 4990
aacacccacccgaaggaacgcaccaaagcaaaccactcggagctcaccaccccattccgttccctgaccaaaacccccaaaccccaccccagccaagccgccaagcccaagcccccccatggcggcgccgaccccgaccaccgccgccgccacccaccaccgcatcctcctcccgtccccgcgcggcgccctcgcgcctgccttcctccgcctgccccaccgcgagcaggcccacgcccgcgcccagcgcgcgcgcctccccgcgcccctcgcggccgcggcctccaccgcatcccccgaggctccggcctcgggggccgtcccggggaagcccacggttctcgtcgccgagaagctcggcgccgcggggctcgcgctgctgcgcgagttcgccaacgtcgactgctcctacggcctctcccccgaggagctccgcgccaagatctcgctctgcgacgcgctcatcgtcaggtccgggaccaaggtcggccgcgacgtcttcgaggcctccgggggcaggctccgcgtcgtcggccgcgcgggggtcgggatcgacaacgtcgacctcgccgccgccaccgagcacggctgcctcgtcgtcaacgcgcccaccgcaaacaccgtcgccgccgcggagcatggcatcgcgctactcaccgccatggcgaggaacatcgcgcaggccgacgcgtccctcaaggctggtaaatggctgcgcaacaagtatgttggggtatctcttgtgggcaaaactcttgctattcttggattcggaaaggttgggtcagaagttgcacgtcgtgctaaaggtttaggaatgcacgtggttgcacacgatccatatgcttcagctgaccgggctcgtgcaattggagttgagctagtcagcatggaagaggccatgacaactgctgacttcatctcattgcacatgcctcttacccctgcaacaaacaagatgctcaacgatgaggccttcgctaagatgaagaagggtgttcgcattattaatgttgctcgcggtggtgtcattgatgaagaagctctagtcagggctcttgattcaggaatagtagcacaggctgctcttgatgtgttcactaaagagccaccagcacctgataacaagctggtgctgcacgagaatgttactgtcacaccgcacctgggtgccagcacagtggaagcacaggaaggagtggctattgagatagctgaagctgtcattggagctctgaaaggggagcttgcagcttctgcagtcaatgctccaatggttcctgctgaggtactgtcagagcttgcaccttttgttgtgcttgcagaaaagcttggacgccttgctgttcaattggttgctggcggtggcggtatcaagtctgttaaggtgacctatgcgtctgcacgggctcctgatgatcttgacacaagacttctccgtgcaatgatcaccaaggggttgattgaaccaatatccagtgtttttgtcaacctggtaaatgctgatttcaccgcaaagcagaggggagttcggatcactgaggagaaaatcttgttggatggctcacctgagacgcctattgaatacattcaagttcatatcgccaatgtcgagtccaaatttcccagtgccatatccgagactggagagatcactgtagaggggagggtgaaggatggtgtccctcatctaacaaaggttggagcattccaggtagatgtgagcttggaaggaagcctgatcctctgcaggcaggtcgatcagcctggcatgatcggggcagtaggaagtgtcctgggtgaggagaatgtcaatgtcagtttcatgagtgttggaagaatcgctcctcgcaagcatgctgtcatggcaatcggggttgatgaagaaccaagcaagagcacgctgacaaagattggggagattcctgcaatcgaagagtttgttttcctcaagctctaggcgccagatgtatgtttgaagttgcaagcatggtgtgcaattttgatgtagctagcaatctagaggacggatggttctcgttggaataagctttttaggggtatttttgtagtggtgctcttgaatttggtgcagtatcgatgtgtcttttgaacgtggtgtttatcaataagaagctctcttctgaataaaaaaaaaaaaaaaaaaaa

SEQ ID NO: 4990 - protein, 613 aa, Panicum virgatum
  misc_feature: Ceres CLONE 1813715
  misc_feature (1)..(310): Pfam Name: 2-Hacid_dh Pfam Description: D-isomer specific 2-hydroxyacid dehydrogenase, catalytic domain
  misc_feature (19)..(613): SWISSPROT Homolog: EC 1.1.1.95 D-3-phosphoglycerate dehydrogenase, chloroplast precursor
MAAPTPTTAAATHHRILLPSPRGALAPAFLRLPHREQAHARAQRARLPAPLAAAASTASPEAPASGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKAGKWLRNKYVGVSLVGKTLAILGFGKVGSEVARRAKGLGMHVVAHDPYASADRARAIGVELVSMEEAMTTADFISLHMPLTPATNKMLNDEAFAKMKKGVRIINVARGGVIDEEALVRALDSGIVAQAALDVFTKEPPAPDNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEEKILLDGSPETPIEYIQVHIANVESKFPSAISETGEITVEGRVKDGVPHLTKVGAFQVDVSLEGSLILCRQVDQPGMIGAVGSVLGEENVNVSFMSVGRIAPRKHAVMAIGVDEEPSKSTLTKIGEIPAIEEFVFLKL

SEQ ID NO: 4991 - DNA, 1482 bp, Panicum virgatum
  misc_feature: Ceres CLONE 1813761
  misc_feature: Encodes the peptide sequence at SEQ ID NO. 4992
ataaaaaaaaacttcccttcagatcccatccacccttttggagtctggacccttcctcatcacccctccctctattaagcaccgccgccgccgccgccgccgaccgcctgaccgccgccgctcccctcactagtcctcagagagacgttccccgagcgagtccaactccgaaaggccgcgatgaggtcgtctctgctgaaatccacgtccgagctcctccgccgcagccgcggctactcctcctctgccaacccggagcggaaggtggccatcctgggcgcggctggtggcatcgggcagccgctctcactcctcatgaagctcaacccgctcgtctcctccctctccctctacaatatcgcggggaccgtcggcgtcgctgccgacgtgtcccacatcaacacccccgccctggtgaaggggttcatgggggatgaccagctcggggaggcgctggagggatccgacgtcgttatcatccccgccggggtgcccaggaagcccggcatgaccagggatgacctcttcaacatcaacgctggcattgttaaggcgcttagcaccgccatcgccaagcactgccccaacgcacttgtcaatatgatcagcaaccctgtcaactccactgtcccgattgcagcggaggttttcaagaaggctggtacttatgatgagaagaagctgtttggtgtgaccactcttgatgttgttcgtgctaaaacattttatgctggaaaggcgggcgtgccagttactgatgtgaatgttcctgttgtcgggggccatgcgggtattactattctgccactcttctcacaggccactcctccaagcaattcattgtcccaagaagaaattgtggccctcaccaagaggacacaggacggtggaacggaggttgttgaagcgaaggctggaaagggttctgcaacattgtcaatggcatatgctggtgctgtgtttgcagatgcatgcttgaagggtctgaatggagttcctgacattgtagagtgctcgtttgtgcaatcaactgtgacggagttgcccttctttgcctccaaggtacgcctcggcaagaatggagtggaggaagtgtttggtctgggagagctctccgactttgagaagcaggggctggaaaacctcaagggcgagctcaaggcttccattgagaagggtatcaagttcgcccacaggaactaggcactttgcacggactcttaacaattcatatctcaagctgaggagatcgcttgaaatttttgtttgactgctttttctgcccctcttttgctgggaagtcgaggcgttgtgctccacaataaaaacccagcggcttagttgccaacctgaacgaaacttgtaccagaaacaaccgcaccggtcaccagtgccttttgtgctcggccaatggcttggtgagccgtgacggaaatgggaacggacttgccacttgctcgacaaaaaaaaaaaaaaaaaaaa

SEQ ID NO: 4992 - protein, 340 aa, Panicum virgatum
  misc_feature: Ceres CLONE 1813761
  misc_feature (1)..(166): Pfam Name: Ldh_1_C Pfam Description: lactate/malate dehydrogenase, alpha/beta C-terminal domain
  misc_feature (1)..(340): SWISSPROT Homolog: EC 1.1.1.37 Malate dehydrogenase, mitochondrial precursor
  misc_feature (4)..(340): SWISSPROT Homolog: EC 1.1.1.37 Malate dehydrogenase, mitochondrial precursor
MRSSLLKSTSELLRRSRGYSSSANPERKVAILGAAGGIGQPLSLLMKLNPLVSSLSLYNIAGTVGVAADVSHINTPALVKGFMGDDQLGEALEGSDVVIIPAGVPRKPGMTRDDLFNINAGIVKALSTAIAKHCPNALVNMISNPVNSTVPIAAEVFKKAGTYDEKKLFGVTTLDVVRAKTFYAGKAGVPVTDVNVPVVGGHAGITILPLFSQATPPSNSLSQEEIVALTKRTQDGGTEVVEAKAGKGSATLSMAYAGAVFADACLKGLNGVPDIVECSFVQSTVTELPFFASKVRLGKNGVEEVFGLGELSDFEKQGLENLKGELKASIEKGIKFAHRN

SEQ ID NO: 4993 - DNA, 1228 bp, Panicum virgatum
  misc_feature: Ceres CLONE 1813771
  misc_feature: Encodes the peptide sequence at SEQ ID NO. 4994
aagaaacgaccagttttggtgggtgggatcgaaggaagaagtgattgagggggaattgaatcccaagaaacccattgcttcttctgctacctcagggcagtagctctgaatctcggggctattgggaaggagaccaatggctggcaaggaaatctaccacaaggtgaaggacaaggtcaaagatgcttttagttcatcaggaccagaaacagggaaaggcaagacaaagttatcaggcaagcgagtcgagcatggttaccatctagtgaaggggaaatcaaatcatccaatggaggactatctagtggcagagtaccggcaagtgggtgaacatgatttgggtttgtttgcaatatttgatggtcaccttggacacactgttccagactttctgcggtcccatcttttcgataacatcttgagtgagccagaattcttgagtgacccgaaaactgctatccaaaaagcataccaacttaccgatgagaaaatattggagaatgcatcagagttgggaagaggaggatccacagctgttactgccatcttaataggaagtgacaagtccgtgaagctagtggttgcaaatgttggggattcacgtgcagttattagcaaaaatggtgtggcagagcagctttcagttgaccatgaaccaaacatggagcgacaaacgatcgagaaaaagggtggcttcgtatcaaacctaccaggtgatgtaccacgtgttgatgggcagctggctgttgcgagggcatttggagaccggagcttgaagaagcacctcagctctgaaccatatgtaattgacgaaactatcactgaaaattctgattttctgattctagcaagcgatggcttatggaaggtgatgtcaaaccaggaggctgtggatgagatcaaggacttcaaggacgcgcaggctgccgcgaagcacctgacggagcaggccgtgaaccggaagagcaaggacgacatctctgttatcgtcgtcaagttcctgtgctagcacaatgtcaggctgatggtctcccgattgtatgtcagtgttaaaacagtcttatgttgtcaggctgctgaccttccaaatggtgttggatattgtgtttaatcttctttcgttttggggagaccccacaaaggggatcaaggcttgtaagttgtaacatattgttgttggttaaaggctccaaataaagcatgatatcaaaaaaaaaaaaaaaaaaaa

SEQ ID NO: 4994 - protein, 290 aa, Panicum virgatum
  misc_feature: Ceres CLONE 1813771
  misc_feature (1)..(248): Pfam Name: PP2C Pfam Description: Protein phosphatase 2C
MAGKEIYHKVKDKVKDAFSSSGPETGKGKTKLSGKRVEHGYHLVKGKSNHPMEDYLVAEYRQVGEHDLGLFAIFDGHLGHTVPDFLRSHLFDNILSEPEFLSDPKTAIQKAYQLTDEKILENASELGRGGSTAVTAILIGSDKSVKLVVANVGDSRAVISKNGVAEQLSVDHEPNMERQTIEKKGGFVSNLPGDVPRVDGQLAVARAFGDRSLKKHLSSEPYVIDETITENSDFLILASDGLWKVMSNQEAVDEIKDFKDAQAAAKHLTEQAVNRKSKDDISVIVVKFLC

SEQ ID NO: 4995 - DNA, 1736 bp, Panicum virgatum
  misc_feature: Ceres CLONE 1813784
  misc_feature: Encodes the peptide sequence at SEQ ID NO. 4996
acaccacaatcggctccagataagcgccgtccgaggatggctccaccggtacccgccgacgccgtggtggaggtcgcctcggccgtcgccgagaacggaatggctcgcaaggacgccccagcgccggcgatctccgtcgtctcgaggcagacggttctgccggccgccggcgcctcgccggtcggggacctcaggctctcggtctcggacatgcccatgctgtcgtgccactacatccagaaggggctcttcttcccgcctcccggcgtggccatggccccgctggtggcggtgctagcggcggcgctctcccgcgcgctcggcgtcttccccgccctcgccggccggctcgtcacgctcgacgacggcagcatcgtgatccggtgcggcggcgacggcgcggccgtcgagttccaccacgcggtcgcgccggctctgtcgctcggcgacttcctcgtgcccggcgccgacgtgcccaccaggctcaccaacggcctgttccccatggaccgcacggtcagctacggcggccacgcccgcccgctcacgtcgttccagctcaccgtgctcggcgacggcgccgtgttcgtcggcttcgtcgccaaccacgccgtcgtcgacggcacctccttctggcacttcttcaacacgtgggcggggctgtgccgcggcgcgccggtccgcgagccggacttccgccgcaacttcttcggcgagtccaccgccgtcctgcgcttcccctgcggcgggggcccggccgtgacgttcgacgccgatgcgcccctccgcgagcgaatcctccacttcagcgccgccgcgattcgcgagctgaaggcgacggccaaccgctggaaagggacaggtcaagactccgaggttaacggcaaggccacgcatgactccaaggttcagggtggtcgcggccaaatctcgtcgttccagtccttgtgcgcgcacatatggagggcggtgaagcgcgcgcgccggctgctggctgccgacaagacgaccacgttccgcatggccgtgaactgccgccaccgtctgcacccgccgatctccccgctctacttcggcaacgccatccagagcgtggtcacgacggcgaccgtggccgagctggcgtccaacgacctgggctgggcggcggccaagctgcacgccaccgtggcggcgcacggggacggcgcgatccggcgcgccgcggccgagtgggaggccacgccgcggtgcttcccgctgggcaaccccgacggcgcggcgctcacgatggggagctcgcctcggttccccatgtacgacgggaacgacttcgggtggggccgcgcgctcgccgtgcggagcggccgcgcgaacaagttcgacggcaagatgtcggcgttcccaggccaggccggggatggcagcgtcgacgtggaggtgtgcctcgcgccggacaccatggcttgcctcctccgcgacgaggcgttcttgcagtttgtgtccacccctgcaccgtgacagagtgaagcatctgatggggatggtagtgcttgctactattttaaaggattgggagtgaccatgtgtccatatagagatgatgtgctcctgctggttccttcgtgaagcgatgtacgctagtgtggttatgactttgtgaatctgtttagatactggaaaaagatgaacgttccggcttcatctttctcgggaggaaaaataagaccacactacaaaaaaaaaaaaaaaaaaaa

SEQ ID NO: 4996 - protein, 487 aa, Panicum virgatum
  misc_feature: Ceres CLONE 1813784
  misc_feature (2)..(447): Pfam Name: Transferase Pfam Description: Transferase family
MAPPVPADAVVEVASAVAENGMARKDAPAPAISVVSRQTVLPAAGASPVGDLRLSVSDMPMLSCHYIQKGLFFPPPGVAMAPLVAVLAAALSRALGVFPALAGRLVTLDDGSIVIRCGGDGAAVEFHHAVAPALSLGDFLVPGADVPTRLTNGLFPMDRTVSYGGHARPLTSFQLTVLGDGAVFVGFVANHAVVDGTSFWHFFNTWAGLCRGAPVREPDFRRNFFGESTAVLRFPCGGGPAVTFDADAPLRERILHFSAAAIRELKATANRWKGTGQDSEVNGKATHDSKVQGGRGQISSFQSLCAHIWRAVKRARRLLAADKTTTFRMAVNCRHRLHPPISPLYFGNAIQSVVTTATVAELASNDLGWAAAKLHATVAAHGDGAIRRAAAEWEATPRCFPLGNPDGAALTMGSSPRFPMYDGNDFGWGRALAVRSGRANKFDGKMSAFPGQAGDGSVDVEVCLAPDTMACLLRDEAFLQFVSTPAP

SEQ ID NO: 4997 - DNA, 1770 bp, Panicum virgatum
  misc_feature: Ceres CLONE 1813790
  misc_feature: Encodes the peptide sequence at SEQ ID NO. 4998
atgagttgctctgtccgctcctcgccactgcaggggagaatggcactgaatcgcctcttcgtcctcttcctcggcaccgcattgcctctactcttcttcttctcccttgcagatgccggcaaggtgggggtgagctacggcaggctggggaacaacctgccgagcacggcgtcggtggtaaagctgctgaagcagagcggcatcaccacggtgaggctgtacgacgccaacccaagggtgctcaaggccctggccaacaccggcatcacggtgatggtgatgcttcccaacgaccacctcgccgccgcggccgcggacccggcgagcgcgcgccggtgggtgctccggaacgtggcggcgcattacccggccacgcggatccacggcgtggccgtggggaacgaggtgttcgaggaggcgagcaacctgacgcggcagctggtcccggccatggccaacgtgcacgccgcgctggtgaggctgggcctggacgaggccgtgaaggtgtccacgccgctcgcgttcaccgctctccaggagtcgtggccgccgtccgcgggcaggttccgggacgacatcgcgcggccggtgatgaagcccatgctcgacttcctggagcggacggggtcctacctcaccgttaacgcctacccgttcttcgcctacgtcgagcagccggacaagatctccctcgactacgccctgggaagcgccaaggccggcgtgcaagaccccgtcaccggcctcgtgtaccacagcctcctggacgcccagctcgacgccacgttcttcgccatggagaagctggggtcgtcgggggcctggcaaggaaactctcttgggagagggacaccccgtgcgcgcgcctacgtttcggagagcgggtggccttctggcgggagtcgccgatccgggagaagtttggacttggaggctgggggtggagcgggagccccggcggcgacgatcgccaacgccaaggcgtacaacaactacctcatcaaccgcgtgctgtcctgcgacacgggcaccccgtaccggcccgacgccgacatggacgtctacatcttcgccctcttcaacgagaacgacaagggctgcggagcggacgacatcgagcagcacttcggcctgttctacccgaaccggaccaaggtgtacgagttcgacttccgcggcgccgcgccgccggcgcctgcgccggcgccgtcggcgtcgagctggtgcgtggcgaacgcgtcggccggggaggcgcggctgcaggcgacgctggactgggcgtgcggccacggcgcggactgcagcgacatccagcccggcgcgccgtgcttcgagcccgacaccgtggtcgcgcacgcctcgcacgcgttcaacagctactaccagcgcagcggccgggccagcgggacgtgcgacttcgccggcgccgcctacgtcgtctaccacgcgccaaagattgggaactgcgtgctgccatcgcaggtttggattcaagaagcagcagcgaagtctgaaggatatgctgcgatctgatgttccggtttccagagaagttcagtttaaccttttaccttgtaaaactagaaagatgcatgtatacctcggcacctgcacatcagatgcttctgtactggatcttggttgattgagtttaccttcgttctcactcatttctcacgtttcaaaatctgcccatattctcgtgtttaactgtatggagtatcaaacaagtcaacagtccggggcttacaaaaaaaaaaaaaaaaaaaa

SEQ ID NO: 4998 - protein, 497 aa, Panicum virgatum
  misc_feature: Ceres CLONE 1813790
  misc_feature (1)..(253): Pfam Name: Glyco_hydro_17 Pfam Description: Glycosyl hydrolases family 17
MALNRLFVLFLGTALPLLFFFSLADAGKVGVSYGRLGNNLPSTASVVKLLKQSGITTVRLYDANPRVLKALANTGITVMVMLPNDHLAAAAADPASARRWVLRNVAAHYPATRIHGVAVGNEVFEEASNLTRQLVPAMANVHAALVRLGLDEAVKVSTPLAFTALQESWPPSAGRFRDDIARPVMKPMLDFLERTGSYLTVNAYPFFAYVEQPDKISLDYALGSAKAGVQDPVTGLVYHSLLDAQLDATFFAMEKLGSSGAWQGNSLGRGTPRARAYVSESGWPSGGSRRSGRSLDLEAGGGAGAPAATIANAKAYNNYLINRVLSCDTGTPYRPDADMDVYIFALFNENDKGCGADDIEQHFGLFYPNRTKVYEFDFRGAAPPAPAPAPSASSWCVANASAGEARLQATLDWACGHGADCSDIQPGAPCFEPDTVVAHASHAFNSYYQRSGRASGTCDFAGAAYVVYHAPKIGNCVLPSQVWIQEAAAKSEGYAAI

SEQ ID NO: 4999 - DNA, 1889 bp, Panicum virgatum
  misc_feature: Ceres CLONE 1813844
  misc_feature: Encodes the peptide sequence at SEQ ID NO. 5000
aggcgctccctatttggctatttcccctcgcaaccacctctcttctccccaaaccctaatcatccctctccctccccacctccacatcgaacccatcggatcgttcggcggcgatggacgggaaggaggagggccggatcttcgtgggcggcttgtcgtggcagacggacgagcgcaagctccaagaagcctttgaccgcttcggcaaggtcatcgacgcgcagatcatgctggagaggcacactaaccgccacaggggctttggctttgtgacattcgaagatcggcgggcagttgacagcgctatcaaagagatgcatggccaagagttaaatggtcggaaaatttcagtgaacaaggctgagcctaagatgaacacagatgacacaagatatgacaatggtggtggacgaggagagtatcgtggtggtagaggtgatggtccaccccctggtaattgctttgagtgtggtcgtcctggacattgggttcgtgattgccctagtgctggtggtggtcgttctggcagattctcttctaagttcagtggtggcaggggagaccgtttctctgggtcagacaggtttggcgatcgttacatggatgatcgttatgatggtggtcgttatgggtaccgtgaccaagtggacacaagagacaggtatgccgggggccgtgatcgttatgccaatgatcgctacccctctggtggtgatcactttggtgcagaaaggtatggaggtggcccagatcgatatgcaccaagtggttatggtagggagcgagaaagaagctatgagagggatggagttcgtggtggtggcggcggctacgataggagtgccccaagggggggtggtggaagctatgatagggatggcctgaggggtggcatgggtggtggctatgacagggatggtccacgtggtggtgtcgctgatcgttacggcggtggaggacctgcacgctatgatggaggaagttacagggagaggcctgggccttatgatcgccccagcaggggaggacgttttgatgatcgctactgatgatcgccccagcagactcaagctcttgatgttgcagtttcgtgtacctgaatgcttaatgtatctctccttggcacttttttgtctaattctgtacttcaaccgatactggctgatgttgccttctttgataagtttatctggtagactgtttttgcttgttgagatcataaatcttgccctgagctattacctcatgtttcagttgtttatggagtgcagttgtagggagttgaggttctcagtgattgctgtcattgctgatctgagtatctggtatgcaaggatgatattttcagagattgcttggcactgttggtctgaatagccggtttgcatggattgtatgttaagtgatgcttgtcactgttgttcgtacatggctgtttggggggatatatttgcagtggtctcttgtcattgttagtctgaaactctgaatatctgcaatgcaaggactactgaacacctgtcaacatgggtctcctgtcattgtcagtcggaatatctgcaatgcaaggattataacagaacagttgttaagtatccctacggtggaaatagctgaaagcaattcgaagtgccaaagttttctgttgcttttgttaccagtcctgaaaaccgctgtgtcgaaaagcaccgagccaggccattttgagtgggcatcttctacttgcctaggtagagtggtgtctgtgatgtctctgtatagcaaaccaatacaataggtagcgtcgttcctttatttcgttttcatgtcatggtttgccggtgatggcttttgtacataaccctaataatatctataaattgattcgaataaaaaaaaaaaaaaaaaaa

SEQ ID NO: 5000 - protein, 311 aa, Panicum virgatum
  misc_feature: Ceres CLONE 1813844
  misc_feature: Great-hit functional homolog of the protein sequence given in SEQ ID NO 9489
  misc_feature: The sequence is a functional homolog of  SEQ ID NO 1042 in the  10/374,780 US patent application
  misc_feature: The sequence is a functional homolog of  SEQ ID NO 852 in the  10/666,642 US patent application
  misc_feature: Useful for making plants with altered alkaloid content
  misc_feature: Useful for making plants with modulated growth and phenotype characteristics
MDGKEEGRIFVGGLSWQTDERKLQEAFDRFGKVIDAQIMLERHTNRHRGFGFVTFEDRRAVDSAIKEMHGQELNGRKISVNKAEPKMNTDDTRYDNGGGRGEYRGGRGDGPPPGNCFECGRPGHWVRDCPSAGGGRSGRFSSKFSGGRGDRFSGSDRFGDRYMDDRYDGGRYGYRDQVDTRDRYAGGRDRYANDRYPSGGDHFGAERYGGGPDRYAPSGYGRERERSYERDGVRGGGGGYDRSAPRGGGGSYDRDGLRGGMGGGYDRDGPRGGVADRYGGGGPARYDGGSYRERPGPYDRPSRGGRFDDRY

SEQ ID NO: 5001 - DNA, 1584 bp, Panicum virgatum
  misc_feature: Ceres CLONE 1813852
  misc_feature: Encodes the peptide sequence at SEQ ID NO. 5002
ctagttgcccacggcccaacgaataattcaccttttctccctagatagagctccactaccccacgccgccgccgccgcccgagcacccgcgtccccgcccgcccgagatggcatctccggcgctcaaggacgccgtgggcggcctcgaccgcgacggcttcgtcgccctcctgtccaagctcatcggcgagtccgcgcgcctgaagaacgacccgccggtccacaggccggaggaggacctcgtggcgcagcacgtcgtcgacgcgctccgcccggtgtccaccgagactgggggcggcccgctcgtcgtgcggaaggtcagctacgccgagggcaggagcaacgtcatcgtcgagtacccaggcaccgtccccggccggatcgtctccttcgtcggcatgcacatggacgtcgtcccggccaaccccagcgaatgggacttcgatcctttctcactaacctttgatagcgaagacaaggataagcttcggggacgtgggacaactgactgtctcggccatgttgcgctggtggctcagctaatgcggcggcttggtgaggtcaagccacccttgaagcattctgtcattggtgtgttcattgcaaatgaggagaactcatctgtcactggcattggtgtcgatggccttgtgaaggatggcttgcttgacaagctcaagactggacccttgttctggatagacacagctgataagcaaccatgcattggcaccggtggaatgattccatggcacctcaaagcaacagggaagctgttccacagtggtcttgcacataaggccataaattcgatggagatgaacatggaagcactaaaagaaatccaaaaaaggttttatactgacttccctccacatgaacaagagaaagtctataagtttgctactccatcgacaatgaagccaactaaatggagctatcctggtggagggcttaatcaaattcccagagaatgtacaatttcaggagatataaggttgactcctttctatagcacttcccatgtcgtggagaagttgaaggaatatgtagaggacataaatgagagactcgagacaactcttgatacccgtggtcccgtgtccaaatatgttcttcctgatgaaaatctgcgaggaaggcttgaaatcagttttgatggagatgtgatgaatggggtggcctgcaatctgaagtctcgaggctttaaagcattatgcaaagcaactgaggaaattgttggccatgttgaaccatattccatcaccgggagtctacctctgattagggaattacaggacgaaggatttgatgttcaaacagctggatacggcttactgaagacgtatcacgccaagaacgagtactgcttgttttcagacatggcccaaggctttcaggtatttgcgagcatcatttcgcagctggaagaagaggtctgagccgtcttgcgtggatatagaagagagtgccttcaattggaattactcgtgttgctcagtgaatctttgagaactctcaagtccgtgacacggacatctaataataagatgagattgttgacaaaaaaaaaaaaaaaaaaaa

SEQ ID NO: 5002 - protein, 444 aa, Panicum virgatum
  misc_feature: Ceres CLONE 1813852
  misc_feature (1)..(344): Pfam Name: Peptidase_M20 Pfam Description: Peptidase family M20/M25/M40
MASPALKDAVGGLDRDGFVALLSKLIGESARLKNDPPVHRPEEDLVAQHVVDALRPVSTETGGGPLVVRKVSYAEGRSNVIVEYPGTVPGRIVSFVGMHMDVVPANPSEWDFDPFSLTFDSEDKDKLRGRGTTDCLGHVALVAQLMRRLGEVKPPLKHSVIGVFIANEENSSVTGIGVDGLVKDGLLDKLKTGPLFWIDTADKQPCIGTGGMIPWHLKATGKLFHSGLAHKAINSMEMNMEALKEIQKRFYTDFPPHEQEKVYKFATPSTMKPTKWSYPGGGLNQIPRECTISGDIRLTPFYSTSHVVEKLKEYVEDINERLETTLDTRGPVSKYVLPDENLRGRLEISFDGDVMNGVACNLKSRGFKALCKATEEIVGHVEPYSITGSLPLIRELQDEGFDVQTAGYGLLKTYHAKNEYCLFSDMAQGFQVFASIISQLEEEV

SEQ ID NO: 5003 - DNA, 1282 bp, Panicum virgatum
  misc_feature: Ceres CLONE 1813869
  misc_feature: Encodes the peptide sequence at SEQ ID NO. 5004
agctgccacgcttttggaagacgcacgcaacagcggagcagccaagcagaaactgcagatcgagggagtagctactagctagcagtctagctatcatcgatggcgagccgaaagctgggcttgttcgtcgccgccgtcgtgtccgcggcggcgttcgtgccgccgtccgccgtcgcgcagctgaggacggactactacgccagcgtctgccccaacctggagagcatcgtccggggctccgtcaggcagtccatggcgcagtcccagatctcggcgcccgccgcgctccggctcttcttccacgactgcgccatcacgggctgcgatgcgtcgatcatgatcgtgaactcgaacggcgacgacgagtggcggcacagcgacaaccagtcgctgaagcgggaggggttccagacggtcctgagcgccaaggccgccgtcgacggcgacccgcagtgccgcaacaaggtgtcgtgtgccgacatcctggcgctcgccgccagggagtccgtcgtccagagtggcgggccgtactaccaggtggagctcggccggtacgacggccgcgtgtcgaccaggggcagcgtcgtgctcccgcacgtcaacttcaacctggaccagctcaacgccttcttctccggcctcggcttcaaccagaccgagatggtcgccctcctaggtgcccacaccctcggcgccgcggactgccccttcttccagtacaggatcgggagcgacccgagcatggaccagggcctggcgtcgcagctgcgcgccacctgcggcgccaaccccggcggcggcttcgcgttcctcgacccctcgccggggggcttcgacaacgccttctaccggaacctgcagggcggcaggggcctgctgggcaccgaccaggtgctgtacagcgaccagaggtcccgcggcgccgtcgacgcctacgcggccaaccagggcaccttcttcgccgacttcgtggccgccgtcaccaagctcgggaggatcggcgtcaagacggccgccaccggcgagatacgacgcgactgccggttccccaactagcagcgagttcgttaattagttgcttaacctcgccggccggccggtcggcatctcggcaccatggatgatgcatgtaccatatattacagtgctagtatacgtagtctagtatgtgacgagtgacggctgtaattacaataagctcatggctttgattcaggggcctgaagtataagctagatatatacgtatataccttccttgtgaaaaaaaaaaaaaaaaaaaa

SEQ ID NO: 5004 - protein, 318 aa, Panicum virgatum
  misc_feature: Ceres CLONE 1813869
  misc_feature (1)..(237): Pfam Name: peroxidase Pfam Description: Peroxidase
  misc_feature (19)..(314): SWISSPROT Homolog: EC 1.11.1.7 Peroxidase 16 precursor
  misc_feature (26)..(314): SWISSPROT Homolog: EC 1.11.1.7 Peroxidase 45 precursor
MASRKLGLFVAAVVSAAAFVPPSAVAQLRTDYYASVCPNLESIVRGSVRQSMAQSQISAPAALRLFFHDCAITGCDASIMIVNSNGDDEWRHSDNQSLKREGFQTVLSAKAAVDGDPQCRNKVSCADILALAARESVVQSGGPYYQVELGRYDGRVSTRGSVVLPHVNFNLDQLNAFFSGLGFNQTEMVALLGAHTLGAADCPFFQYRIGSDPSMDQGLASQLRATCGANPGGGFAFLDPSPGGFDNAFYRNLQGGRGLLGTDQVLYSDQRSRGAVDAYAANQGTFFADFVAAVTKLGRIGVKTAATGEIRRDCRFPN

SEQ ID NO: 5005 - DNA, 1544 bp, Panicum virgatum
  misc_feature: Ceres CLONE 1813882
  misc_feature: Encodes the peptide sequence at SEQ ID NO. 5006
gttttgcttgttgcattccatgtccatctacctcacgcgaaaaatgccgaaaccgaagggataacctgacagaccaggggagcagccgagcagatcaactagagccaagaagatgaacaaagacaaggctccgaggccgggggacggcggctcaggcgacggcttgccgccgcaggccacgcgccgtgccggggcgccgccctcgtcgtcgaccccgccgccggagttcgacatcagccgcatgccggacttccctccgcggaacgccggccaccggcgcgcgcactccgagatcctgagcctgcccgacgacctcgacctcagcgcccccggaggcggcgacgggccttcgctgtcggacgagaacgacgaggagctcttctccatgttccttgacgtggacaagctgaacgcgtcgtgcggggcatcgtcggaggccgaggccgagtcgtcgtccgcggcaggcggcgggggtgagggggctgagctgggccacgcgcctaggccaagacatcagcacagccagtccatggacgggtccatgtcgatcaaggcggagcagctggcggcggcgcagggaatggaggggatgtcgtctgcagaggcgaagaaagcagtgtctgcggcgaagctggctgagcttgctcttattgacccaaagagggcaaaaaggatttgggctaatagacaatctgctgcaagatcgaaggaaaggaagatgcgctatattgctgaactcgagcgcaaggttcaaactctgcaaacagaagccacaacatcgtcagctcagttggcattgctgcagagagataccactgggttaacaactgagaatagtgagttgaagatacggctgcagaccatggaacagcaagtccacttacaagatgccttgaacgacactctgaaatcggaggtccagcggctgaaggtggcaacaggacaggtggccaatggtggtggaagtatgatgatgaactttggcgccatgccacgcccgtttgggggcaaccagcagatgtttcagaacagccaagggatgcaatccatgctggccactcagcagctgcagcagcttcagctccactcccagcctcagcagcaggcactgcgtcctcagcaccagcagcagccactacacccgctgcaggtacaacagctgcagcaggcggcgagagacctcaagatgaaagggcatctgggctcccagggccagtggggagacgggaagtctgggagcagcggtagttaagcagctggttctgaaagcttggtgtaagtggtggttagaagtgaagatggctgtttcggggatgatgttgtgcaactgtagtgatcgttaactcagtcatctatctataggctcagttcagcttcagtttatcgttaacttggttatctgtaagcacagttcagctgcaactacagacagtcggatgatcacagatgttcatctgctggattttttttgtatttctccttagttaaggggttaaaaaaatggttcgaaattaaaggtttcggatggaatctcccgtttcatc

SEQ ID NO: 5006 - protein, 379 aa, Panicum virgatum
  misc_feature: Ceres CLONE 1813882
  misc_feature (1)..(55): Pfam Name: bZIP_2 Pfam Description: Basic region leucine zipper
  misc_feature (1)..(61): Pfam Name: bZIP_1 Pfam Description: bZIP transcription factor
  misc_feature: The sequence is a functional homolog of  SEQ ID NO 1046 in the  10/225,066 US patent application
  misc_feature: The sequence is a functional homolog of  SEQ ID NO 2388 in the  10/374,780 US patent application
  misc_feature: The sequence is a functional homolog of  SEQ ID NO 412 in the  10/412,699 US patent application
  misc_feature: Useful for making plants with modulated growth and phenotype characteristics
MNKDKAPRPGDGGSGDGLPPQATRRAGAPPSSSTPPPEFDISRMPDFPPRNAGHRRAHSEILSLPDDLDLSAPGGGDGPSLSDENDEELFSMFLDVDKLNASCGASSEAEAESSSAAGGGGEGAELGHAPRPRHQHSQSMDGSMSIKAEQLAAAQGMEGMSSAEAKKAVSAAKLAELALIDPKRAKRIWANRQSAARSKERKMRYIAELERKVQTLQTEATTSSAQLALLQRDTTGLTTENSELKIRLQTMEQQVHLQDALNDTLKSEVQRLKVATGQVANGGGSMMMNFGAMPRPFGGNQQMFQNSQGMQSMLATQQLQQLQLHSQPQQQALRPQHQQQPLHPLQVQQLQQAARDLKMKGHLGSQGQWGDGKSGSSGS

SEQ ID NO: 5007 - DNA, 2108 bp, Panicum virgatum
  misc_feature: Ceres CLONE 1813888
  misc_feature: Encodes the peptide sequence at SEQ ID NO. 5008
aggagccacctcgcacccttccccgccgtccgttctgccagcttcgccccggcaccttccacctcctctttctgctccgccgctccaccctcgggccatggcggcggcggcggcggcggctctccgtacccccgcgcggctgggactcgacggtgccgctgccggggagcagtggctgcggaagcggcagcggcagcgcggggccccggcgcctgttgccgtgccgtgccggaggaaggcggctgcggcggcggcggtccggtgccagcgagcagccggcgccgccattgtcgagaagaaggatgcatcggtggccgctgcgcaggagagaggcggcgacaggggcgcggggccggagctcaccgtcgtgatgaagttcggcgggtcgtcggtggcctcggccgagcggatgcgggaggtggccgacctcgtcctcagcttccccgaggagcggccggtcgttgtgctgtccgcgatggggaagaccaccaacaaactcctcatggctggggaaaaagcagtgagctgcggcgcggcgaacatctccgagctcaacgagctctcctttataaagaaattacaccttgggacggttgatcagcttgggctagataggtcaactgttgttggtttgttggatgaactggaacaacttcttaagggaattgctatgatgaaagagctgactcttaggacacgagattatcttgtttcctttggtgaatgcatgtctactagaatatttgctgcgcttttaaacaaaattggggtaaaagctcggcagtatgatgcgtttgaaattggctttataactaccgatgatttcacaaatgcggatattctggaagcaacttatccggctgttgcaaagaggctacatggagactggattaacgatcctgctattcctatcgtcactggctttcttggaaagggatggagatctggtgcaataaccaccctaggcaggggtggtagcgacctgacagctacaaccattggcaaagccttggggttaagagaaatccaggtttggaaagatgttgatggtgttttaacatgtgatccgaatattcacccgaaggcaaaacctgtgccatacttaacatttgatgaggcagctgaacttgcctattttggtgcgcaggttttgcatccacaatcaatgcgaccagctagagaaggtgatatacctgttagggttaagaattcttataaccgtcgagcccctggtaccctcatcactaaagaaagagatatgagtgagagtattttgactagcattgtattgaaatcaaatattacaatgcttgatatagtgagcacgcgcatgcttggccaatatggttttctagctaaggtcttttcaatatttgaagatttgggcatctctgttgattgtgtggctaccagtgaagttagcatatctttgaccctggatccatcaaaactatggagttgtgaattggttcagcagaaaaatgaacttgatgatgtcattgaagagctggaaaagatagcagttgttcatctcctccagaaccgttcaataatatctttaattggaaatgtgcagaggtcctctttgattcttgaaaaggcatttaatgttttacgaagaaacggtgtcaatgtccagatgatctcgcaaggggcatccaaggtgaacatttcattggtagtccatgacagtgaggcaaaacagtgtgtccaagctctccattctgctttctttgagaatggcttcttgtcggaagttgataaaatggatgttgtgcacgatgacttcacatcgcattccaatggaacagttcacagccattagctcagattttaatatagccccccgttttgctactgtggtgtcatttgtagttttcgaaataactatgatcaaataatttttggtcggcatccaatgtctcgtgacgccaggagggggttctggtttatggctatttctaacttgaaatatatagtggtgccagtagtccaatgtcgctgaactgtaaagggggtgagcacattattcgatccgtgttgcttgttctgactcaaatctatttcgggtgtgctggaacgccggaataaaaaaaaaaaaaaaaaaa

SEQ ID NO: 5008 - protein, 575 aa, Panicum virgatum
  misc_feature: Ceres CLONE 1813888
  misc_feature (1)..(284): Pfam Name: AA_kinase Pfam Description: Amino acid kinase family
  misc_feature (62)..(554): SWISSPROT Homolog: EC 2.7.2.4 Aspartokinase 1, chloroplast precursor
  misc_feature (83)..(547): SWISSPROT Homolog: EC 2.7.2.4 Aspartokinase 2, chloroplast precursor
MAAAAAAALRTPARLGLDGAAAGEQWLRKRQRQRGAPAPVAVPCRRKAAAAAAVRCQRAAGAAIVEKKDASVAAAQERGGDRGAGPELTVVMKFGGSSVASAERMREVADLVLSFPEERPVVVLSAMGKTTNKLLMAGEKAVSCGAANISELNELSFIKKLHLGTVDQLGLDRSTVVGLLDELEQLLKGIAMMKELTLRTRDYLVSFGECMSTRIFAALLNKIGVKARQYDAFEIGFITTDDFTNADILEATYPAVAKRLHGDWINDPAIPIVTGFLGKGWRSGAITTLGRGGSDLTATTIGKALGLREIQVWKDVDGVLTCDPNIHPKAKPVPYLTFDEAAELAYFGAQVLHPQSMRPAREGDIPVRVKNSYNRRAPGTLITKERDMSESILTSIVLKSNITMLDIVSTRMLGQYGFLAKVFSIFEDLGISVDCVATSEVSISLTLDPSKLWSCELVQQKNELDDVIEELEKIAVVHLLQNRSIISLIGNVQRSSLILEKAFNVLRRNGVNVQMISQGASKVNISLVVHDSEAKQCVQALHSAFFENGFLSEVDKMDVVHDDFTSHSNGTVHSH
